United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 46

SEQ ID NO: 719 - DNA, 198108 bp, Homo sapiens
tttgttttcaatacactcatatatttttactttgtaatacaatatagctgtcacatacaatggctctagtaggcttaaatcaaattgcaatgggcaaggaaagccaaagaagggtttacacaatattcaataagcaacagtatctgttcagtgtgcaataaaataaaaaagttctaacctagaaacacagaaaaagaatttattgtttttaagtttcagaaataaaagtaacagaatagtgtataatctgtaacaagctggtcctgtaatttctaaactacagtccaattaaaacatttaagtaatagaaacaatctacatgtttttctaccaggtaaatatacctgagagggttacctataaagaaataggctttaaaacttttaaccacaaagaaccttctgctgcgacattatgaagatgggctatgcatgtggccagactaagtcatttcccggagattctgctcactgcttagctgcaggtagtggtccatcaatgacagagtattttacatcaataccagctcattcaaccaaagaagcacagtaatattttaaaatcacctgtttatattcattagtatgtaaaaatcacaatacacagatttggaaacatataacgtgtccataaaaaagagtatattatgtaagcataagctttttaaaaaggccttagcaatgcaataatgagggaagcagactctacatgttgactacagtgaagatatgttaaaattataattattgtcattgccaagagcttagaaataaaaacaaatttaaaaaattaagacattctggtagcaaaattacagctactgtaacaacagctccaagcaaaaaatcaattcagagcttgaatgcaatttgtgctttgtttctataagaatgcagtgttactctcagacatttctaaatgattagattcataaataagcagttaatttcttttcatcacaatttatttctaattcatcctacggagattatagatagaactaaaaattacttagcttttttccagtactttatataaattgagatcttttttaaacagtgatttattgtgtttcttaaggtaaaacaacaaaaacaaattctaaaattgtaactttaaattaagtggttaaaatttcagatgacagagccgataactggtaacagcttcttgaagttcatattaagagtccaattagaaacactaacaactacctggcaatagtttgaaagaatcagaagggttcggtgaagtgaaaaaaaaatccgaacatgcaaaataccccccaaaacacatgaccttctttttcattttataatctaaacttgtaaaatatttataaatacatgatcattctacacaatacagatcttctagagcatttctaaaggatattacagtttttggtcttaaggaataaagactaagatggaaaaggagatgaaaacagtgaaatctgaggaagcaatacactctctacacacaagcaaactagttcatccagtcaagttagcggttacagttcagtacatgattttcaaggcaactaagaaatcaagacacagatatttccccttcctagagtttacaattctttcaaaagctccaatgtatccataaaggagtgctgatttttgtggggttttttcccagaaggaaacaaagaataaataggggaaaaaaagtttccatccctaaattcacatacacaacaagttaagttaaactataagctagttttagactacccagtgaaacagaattgttggtactatctgaggcaggtgctaccctccctagtcagttcaaaacatgatccagtaaaacaaatacacattgttatgcctcaaacaactataaagcatttcattattcttcaaatatcatgtttaattaactcctaaggtaatagacttctagaatgttgtatcttaatggtgtacctgaatcaatactagcaatagaatgcaaaattcaaaattgctataaaggtaaaatcatcataaaaagaaactcaatccttatgtaaaaaaagggagaactgagtgtgaaatactaacaccaaatgtctgaaggcagaatttttgtttgtggaagacagagcgaagagatagatgcacctaatcaagaccaaatagaagacagtgaagaatatgaaaaatgcttaaaaaagaagaaggaaaatggagaagagacaggcagcaaaagaattactagatagatcaaaaataagagaaaatgaggcatgtgcatatggcttttttgtctgtcctttgtgttcctaaataacttaaaacgtaagtggcatgtaggccatactagcaggcaagaatgagccttgtgatgtatacagatgaagaatctgaggctaatgaattgttttgttttttgtttttgcttttaattcatacctgaaagccttgaatccttgctaaatattccagttgttttgaaggttgtactggagaacaagggggagtaggagaacttccttttaaacctatggcttcagctgtagaagatgttccattcataaggagttccctggcaattgtagctgaactattcgatgtgggagatatactgaagaaagagcttgaaggttggttcatatctttgggtgacaaatagcctagagtagtgccagagattactttgtggcggctggcttccatctcttgataaacatcaggagacaaatgaagaattccttttggagctataaataaaatgaagaacactgttattacacttaaaataaccgaaatagaaacatagcattattaactcaatggctttacttggtgtagtaacaaagaaatgagaaacactgccaaacaagtatctttgtcatactgtagaggcagttgcagcttctattgaaaggtgaataatgtctatttcaattttcctaaaattagaggtttaaaaacatccaaaaaaagtggtttcaatgggacttatgtgtagtagtgaagctataaagggacaagggaaactgaatgtgtggaagtataatggggcagaaaatcaggaatgtgcagtgtcttcaccctgcaatttaatattttatatctcataaaagaggcatgaaaccccaacacatacagcaattgaggcacatcaggtaaaataaaggctgaatcagtccaaatttctttggaggtacaaacgcatgtattcaacagcctagtgatcctctcacctccacaaggatgtcccacagacaactctaactcacgaacacataaaaaagcaaatgggtatcatctcaaaactagcactgtctctaacttgctttgctcatactaccatgtggctgctcatgacccaacctagactcctggcaaccatctctgatttactcataagcaagtagttatcgtgttgctcaaacatctcaagaatatgaccattgtagggattatctagtgcattaattcaagccaggccatggacaggttctgaaatcaagaggagtgggggctatgtcattagttgatggagcttaaaccatattagagaagcactttcctttgactatcatttgtctcagagaagtttcaaaccacatttcaaactgcttattcttatcttttgatcaggtatcaataactctcaaatgatattatcttttaaaattattggtaagtcaccactcataaagaatgtgctctgagagacacaacttaatttcctgttcttgccccttcctctcctgatgctaaccttctgattcaagctttcaatgtttctctgctgctagtattctcagtgtccatttcccaaaatgtgttctataacatggtccccaaataaaatggttccataaataaaaactgaaaataatgcaaattacataatacaaatgccttttgtgaaattaaaaatacacattagcatagtgaagaatcagaaaactcaaagaacaaaaatctattcgacttggtttaactcaggattcctgagtttactttttgtccaagcctttaacatagcatgaataaaacagctaacactttgggaaatgctggaggctagcccaactctcctctgactcagtcatttccaatgacctgtctttgagattgatgaccttttcttctgcttgacattgtctgctattgaatccctctggtaactttttcagtttatggtattttttagctccatgctttctgcttgctactttttaaagttttctttttgttgaaattctcactttttttcatgcattgttcaccagacctcagtgggaatgtttgtaaggattactttgaattctctgtcaggtaaatcacatatctccatttcattagggtcagtttctggagctttatctcattcctttatttaggaaatgttttcctgtttcttcatttttccttgattctctgtgtttgtgtctgcacaaactggcctcatactggagaagatcctaaccaatcagcctggacagagattctggaggcctctcaaacttttatgctagtctaatccactttctttgttcttggcagtccccaggcatcagtcccttgcttgtctcagtcccatcagagctctgagacaagcaagactgaagccaattcttcaggcaactcccagataagttgggtcattggatacatggtgctcctctttgcctctccaggaaaaagctgaaagctgaagcttttcaacagttagctttgtgctgggctgagcaggggatggttacagtgaccaccaccaccagccacctctttcttcattggccccggggttgctaaaatatgccatgtcctgtcagcactctgagactggccagacagaagccagtcctctgggtagccccagaaaagctaaggcattggatgcgtggtatacatctttccccttctaggcagaaagaagctgggagctgggggtggagggtggttgtcctgattgtatggccctgcactgtgaggagggattatggcatgagggtatcttaaatttccctgccaattaagatctggctggtttcatgctcacccggcatacaggagcctcttaactggtttctggatttctcacaaagaaaaattgcctataaattattgttgaattgctgtgttccagggcttcctattctaccatcttgccaaggctagaacattctcttacttaaaggtctttcaccagtttatcagttacactatagaacccaaactccttaggataacctaggaagcccttaataatctggctcctacttatcgctctatcttcatctacgaaatatttcatgaagatcccatgctccagttacacagatatatccaatactccaggctgtttgatcccaacacatctttatttctattgttcggttacacacatgcacatactctcttagttaagctccaactgctattgtgctagttaagcttcaggcatcgcaccaaccaatactgtcctgacctcaagtcatgctcagtctatcaggagaggaacgaaaatggataatacaatgtgataggggtctcactagagacaggtgtatagagcagtgggaatgggaaaggagaagtgctaaaagctcagggaaggcttgctggagatgacgatgacagtaaatttcaaaggatgaggagaatacagtccaggaggaagaggactgagagcagatggccagcaggagcaagggcagggacctggagggtttgtgttctaggaaacctcaggccatgccttatcacaagagcatacagagtcagaattgcaaatgcaggtggaggcacgcaggggccaaggtccagggaactttatcctgatgccattaagtataaaagagttttgtaagtttttttaaaaacactttaaatagcttaaaataatacagacagtcctccgcatgcatgagtcccatatccctggattcaaccaactgtggatagaaaacatttgcaaagagaaacaacaacaacaaaaacaacaacaaaaaaccccacacacaataaaaaataatgcaacaataaaaaaaaatacaaaatttaaaactaatacaatataataactatttacatagcatttatataatatttgatgttgtgtaatctagagaagatttaagtatactggaatatgtgcataggttatatgcaaatatgatgccattgccattttctatcacggacttgagcatctgtggattttggtatctataaggtgtcctgaaaccaattcttcacggatatcaagggatgactgtatatcaatcctattttatgtattttctttattcctttatgttagctttcaaattctctacattaacatgtgttagtttttttataatcaggaaaaaatttcaataaatttttttacaagaaaacattatgtactgaaaaaagttaagataaatctcatcagccagaggacattactttcaacattttgctttaaagatatgtttttaatcctgttttatctatgcactttttagttgttgtttacttgaaaaaacaagttaaatacataggaataaaatatgatcctgtcactgtttataaaacaatatatttctacaactaatactaaaagtataaaatttcattatatgaactgtttcttaaaacaattccatattatcagacatctaatttatctccagttttttgcaattataaacacagtgatgaacattcttgtaactcaatccttattcacatgaaaatttatttcctcaagttagaagcggaattgctagttgaaaggatattttagagtttttgacacttaacaaattgccctccaaagaagctgtaccaatatcagacgcccacagagatatatgaaagtatcttgtttcctattttggtattggaaattactataaaaaatcttaaggctgggtgctgtggctcatgcctgtaatcccagcactttgggaggccgaagctggcaaatcacgaggtcaggagttcgagaccagcctggccaacatgttgaaaccccgtctctactaaaaatacaaaaaattagctggacgtagtggcaggcgcctgaaatcccagctacttgggaggctgaggcaggagaatcgcttgaacccgggaggtggaggttccagtgagccaagatcacgccactgcactacagcccaggcaactgtctcaaaaaaaaatctttgccagttatcaacagtaacagaaagcaggtcagtggttgtctggggagtggagctggtgggagtgacagattgcaaaagggcatgagaaatcttttggtgagatgaaaatgtcaagactgattaaactgtagacattatgtgcagtttattatacttcaattatacctcaataaagttgtaaaaaaaaattgccaatttgacaaatggagtgtcatattactgatttttgttttttactatctgcataaacattatatatattttagtttaaagaataacttaaatgttataattctaacttctatactcaatttaaaaaatcaagaaacttaacagcattacttcagtattgttattatacaggactaatgggtttgccaatagcaatattataaagcaacaaaaatgctctccacactcaagagaggcattacctcacagcataagaacgtggagttcaggctctcctattctacagtaaagcctaagtggacttttcttcacaaataaagattactttctacagagttcaactaacagactagtcatagaaatagcataaaaacatagatttatgtggtcaagaactgaatgacttttaacttgaacatcagtaacagtatttggatgggtgttaattcacttaggatcttcctgttgtaaatttaagtcgcttttcaatagtataaagatctaaaagtagaatcaaagagtaatttagggtatgcatatttaaggaccttattttgctaattaggtttctcccaaaaaactaccccagttcatacttctattagtaggatgtgactgttttcccacacttctcccacaacacgtttcagttactctaaataatcattgccactctacaataattcattgttaatttatttttgtttggttactgctcaggataaactttttctcatgtagctactttaggtctgtgccttctttgacctcaattttgctcatggacttcaaccactacacttccctcgctcaggcttgtaacatccattatattcattcaccctttatctgaagaggtcctgaacccattctgccatcatctatcttttgtccctggttttgcctttgatgctcccatcttggtacagtctataactacagtacacagttacaatgcagatacaacatgggcactgttctagtactttacttctcatttaattcccataacaaccatatgaaatgggcattattattttcctatattagagatgaaaaaaactgaagcatggagaagatatgaaactctcccaaggtcatatggataataagcagcaatgctagaatttgactccaggcagtctgcctctagagtttgaatacttaaccattaccttaaatagcctcctaaaagaacaggtaggaaactaaatgcaacatctcaccagctccaaacccctaaggcttaaatccagtaagtaaatgcccggggtttgcccagattggttccaaggatgacccatgtcatgatggttgtccctagatgttccagagatgagctcaccaaaatctcactgaagtatacagagtttatacatgattttaaaggtctaaagttgccagggactgtgatatcttaacaccaggctattgtacccacttgacatgtttttgctcagtagatctgtgcttctttcagatgggtatatgaatcctctggcacacaaatcttcctggagcatctttatggagctccagttcttactgaagagttgaagagggacttttgaattggagagctcttaaaaggttttataagcgaacttaggagaaccttgcctttcaatgatcactgatgtcatgattctttcagagatgctgaagaagataagtgtttgtgagtagcaagtggtatcagaggtattaaaacacagcaagccaggcagcaagaaagataatgccactgatccaaatggttactgccactccactggaactcccagtttctctggaagtccttggaatgggcatagctatttcacaacaaataatttcttttcatttttcacagaaaagctttgaaaaaaaaaactttgtttccattgccagcttgaatttacgcctcaacaatgttggactataaatttgtttataaatacccaaatatccaataatactcaggcccactttgctacagtgagtttttcacaataaaaaattataattaaaaattcttaagaactagaaacaggggcttctggttcaaaacaggaaatgtgagaaaattatgaacaacagcatgattatctgtctctagtgatttttaaaaatcatttatatgagaactggtaggctctaagtaaggtctgtagtctagttcattgtattatgacaatttcctagttttgaaaatgtactatagttatataagacatcaccactggaagaagctgagtgacgggtacatgcaacctctttgtaccattcttataacttcttgtgagtctatcattattacacttttaaaagtttttttgaaagcaccgttttatgctgctttgggcctctccctcaacatagagaccccagaacagggtggtgatggggacaccaaagtgggaaggactggtggcagcaccattcctagatatagctctgaggataagcagggctggcactggcaatgcctgctccttgacaactttgctcacggcctttgcctaatgcacaggccctggctccccaggctctgggtgcttgacttttagctacatgaaagcaagggagatcctgatgacagtgtgggcctcatagccgggaccttgttctctcccagggtagcctgaggccacgtattagttaagagtacatgtgacccaagggagcctactggaccaccatggtcatgtccctgaaggtcagggacaggtggaatgcatccttggcatgatctttagctactagactgatgtgagctacagaaatcccccttcctgctgccctgttgttgggatcaaatcgaacaggtagtatttgtaagtgactccacctcttcttttacacacagctcactgcaaatctggtcttccagataaggccctcagacccttagttctgcctaatttttaagccaaatatatactacttatgaaatcaaaaatcaacaatgcaaaatataaactcttgtggaaaactaaaaagagaaaatgttagctaacagcaaaacaatgaaaaaataaaaaaataggtaaataatttgttagaggtttcttcttaagatcagtttcagaatcaccttggaaacgaaaaagacacactaaaaaaagagtcattactgaacagatttttttttttttttttttttttgagacagagtctcgctctgtcccccaggctggagtgcagtggcgccatctcggctcactgcaagctctgcctcccgggttcacgccattctcctgactcagcctcccgagtagctgggactacaggctcccaccaccatgcctggctaattttttatatttttagtagagacggggtttcaccgtgtcagccaggatgttctcgatctcctgacctcgtgatccgcccacctcggcctcccaaagtgctgggattacaggcgtgagccaccacgcctggccaaaatgatgtattttaatgtgctcaaaaagcataacctgaacagtggtgaaaatcaaccttgctcttacccttagagttgaacggaagcactgattttattaatttgtgcattttattggtcctttttttcctgctacatttaacataatgatgtatgtgaagggttcttaatttggtgaatgtttatgaataaaattactgacaaagaacttttcaggaagatgtttgccttttggtgaacacagtaccaacgggaaaatgcacttagtccagtcttgcccccaaaaaggcagaatcccaggtcatgacatagcatccagcacacctccaagaggaagaaggaggaatacaaaatagtaaataatacatattcctcaaaacaccaataatgaacagaaataacagcaataaaggtttttcaaaaatgttttaaagatcaatttatgatgaactgggaaatgcctttggaaagcttgtaccttagtcaaataaaagtgcgagtgagttttcaaattcaggactggctgctattttttctttaaaacaggcaaatggaaagtatttaataacaaagaatataaacctgggtatggtgaataaattcatcattcatcttttttttttaaaccttacacaaatgcagtaacttatacttttgccagaaattttctttaacaagaagattctggagcccaaagtgagtcatgcaaatcaaagaacagtctggcacaggggttattaatagtgatccaagggcccctaaatagtttgaaataggttgacttcacaacaagggcagtgcacattgtatatgactcagagtcagtgtggtgcagggaagtgattggggagttcaggaattccccagaagcgcattcaccactcatcttaataataaggaagatttcacttagttggcttatttagaagaaatttttttcaaggctcagcttttcaataaagacacaactgtgactatttctaccaagtaagacaaaatagttgctgtgaaaatgatgtttgagagcaccttgtgaggataatgagtcatcttcaatttttagtttatttaagtggggttaaaatgttgctcgtaaaataaagatcgttcttcttggttatgattcttctcagaaaaactccattagttatgatttccctacgacagaaaaacaccaaaaaatggattatataagtctgacatatgacaaaagtgacctgatctctcagcaggaagaaacacatactgaaatgtctaccgcagcagcttccaaacactgcaccacaatactcctctgccaggattcctattgcttcctagtcaatacctgcaaacggctcacaatacaataatagtacaatacaataacaataataattctggctaaaactcatagagtccttactagatatcaggcttgttccaaatgctttgcatatattagtttagtaatcctcacaatgaccctcaagaagtagggactatgaatattcccattttacacttgaaggccctaagacacaggtgatatgactggcttaaagtcacagccagtaagtggcaggtgttggggcagtatccaggcatctggctacagtcagcaagtataactacctttcagtagtaaaacaaataaaccaagaactactgttcttatatctatacatttaagaagttctgggcatttagattcttgaaatattctaacaccatgatagagacaagaaactgtcaagatattgaacttcatttcttcatttcagacctattttctaggctcaatgaacctcagtctcccctctcatagtaaaagaaaagatggaggtcagtgcagtggctcacacctgtgatcccaacactttgggaggccaaggcaggaggatcacttgaggccacaagttcaaaaccagcctgggctatacagcaaggtgctgtctccataaaaaattaaaactttagctgggcatggtggcatgcacctgtagtcccagctactcaggaggctgaggtaggaggatcccttgagcagaggagttcaaggctgcagtgagctataatggcaactctgcactccagcctggacacactgtctctttaaaaaagatagagagagagagagactgagatttttctcactgtaaaaccacccattgggaaaaatgtaaaaataatgcacttggctattttcacaattttgtttgtgggaagaaaataaattcaaatattaggttcacacaaagaaaaacttaagcacagccttaggatgaaagaacttaacccacaaaacactttcttacaattctccttatatgatctaattatgatttaacaatttactacacattagtctattattcagtctattatatattattcagaaacttatggaagaatccacaatattattaataaaaacaactaactggaactgtataaatattaagtactgggctgggtgcagtggctcacacctataatcagcactttggaaggctaaggcaaaagggctgcttgagctcaggagtttaagaccagcctgggcaacacagcaaaacctcatctcaaaaactgtatttttaaaataatatatatatataaagtacttatccaatttttaaattttcttgtaaaaataacaaattcactttttagaaccaggaaagaagcagcctagcaagaaataaaatttagacaaaacacaccttagtccagccaaatacacacaaaaaaacctgttctcccacttttatctatgtatcaaaggcagagagggactttcacccttgcaaagctgtaacaactctccccaacttccctgatgtggtagtgtcagaaaaaactgagtaggcagcttggactttcatcctagccccgtggtgtcagtggagatcatgtagggacactaaacttctacccccacctagcagtaataggatgccccccacctccgtgctggagtggtgtcaggagagaataaaggagaatcagaactagtgggaacaaggtcacctcactatggtgtcagtggagaccatatggggaccagaatttccactcaatccagggctgggggtaggggaaagggtatggctataacagcacaacatgaggaactctcatggtgacagaactgttctgtatcatatttatattaataccttagttgtgatattgtactatagttctgcaaggtgttaccagagataaacaaggcaaagggtccataggatctctttgtattaattcttacaactgcatgtgcatctacaattttctcaaaataaaatttttattaattattttaaaatttattgtagagacaggatcttgctatgttgcccaggctggtcttaagctcctggcctcccacttcaacctcccaaagcattgggattacatgcatgagctaccatgcctggccatcaaaataaaaagtttaataaaaaagaagtcttgggtgacaccagcaagatggtagaacaggaagtcccagcccttattcctaactcatacattgatttaacaatgatatacagaccaaaatacctttttgagaattccagaatccagttaagaagttgcagtatcccagatgagcacaaagccaagaatggccacactgaaacatgtaagaacaatttcactttacccacaccacccccctaagtcagcatagcttagtgccacatagcttagtgccgggagagagcattccagatcacaacttctcccttggggtaaaggtgagtggaatgtgcatccaacattttacgttttcagagggcttcccaagggactaatttttgtcttgcttcacttggagtgccgacagagccagcatattttggatacctgggatatttagttttcccggcaccatttgttgaaaatgtggtacacatacagcatggaatactatgcagccataaaaaagaatgagatcatgtcctttgcagggacatggatggagctggaggccattttccttagcaaactaacacaggaacagatattaaatactgcatgttctcacttacaagtaggagctacattatgagaccacatgaacacatagaggggaataacacacactggagcctatcgaagggtgaagggtggagggtggagggtggaaggtggaaggaggtagaggatcaggaaaaataactaacaggtactaggcttcatatctggatgatgaaataatctgtatgacaagcccccatgacacagtttacctacataacaaacctgcatgtgtacccctgaacttaaaaaatgaaagttaaaaaaaaaagaaaatatactcagtgggtcctcaaataatgttgttttgttcaacatcattttgttataatattgatgagaaaaaaaatcaaatcccacctgggccactgtcttatgtggagttctcatgttctgcccatatctgcactggttttctccaggtcctccagtttcatcccacatttaaaagatatgcatattaggttcactggcaggtctaagttgtcccagtatgggtgtcgtgtgtgtgtgtgtgcgcacacgcgtgtgcacatgtgtcctggaatggaatgacatcctgtccagagttggttcttgcctttgctccctaagctgctaggataggctctgaccaacctcaatcctgaactggaataagtgggttagaaaatgaatgactgaatgtatacaaatgaatgtaaaattaaaatctgtaaaatgcacaataatcatataatatggtttggctctgagtctgcacccaaatctcatgtggaattggagtcccagtgttggaggaggggcctggtgggaggtgattgaatcatgggggcagacttcccccttgctgttctcctgatagagtgttcacaagatttgcctgtttgaaagtgtgtagcacctcccctgcttgctctctctctcctgctggccatgtgaagatgtgcttgcttcccctttgccatctgccatgactgtaagcttcctgaggccttcccagaagcaaaatcctgaacagcctgcagaactattatccaattaaacctcttttctttataaattactcagtctcaggtatctctttacagccctgcaaaaacagactaatacattacacaaatgcacaacaataaacaatgcagtataaaagtgttcagtgagcccaccatatttgttattgtttgttttttaattgtgtggtggtaggaagtactgcttacaattttcactttgcaaacatttatactttgatttaacccaccaccaccatgactgctatcactcacttattcaccccacattgagtaaacaattatcttgtttttattaaactttcttaattgtacatgtaagctcatatttatttcaatgtttaatattacaatttgggtctttattgagaagtctggtgatatttctctaaccacaaatatgttgtgagaacttaactcttgtttatatcaatcagcctatgataaaactgatttcgttatatgtcatttcacttaaagtagtagtttccaagaacctatcaatgatgttaagtaagaacttactggatttaatttttttagtggtaaagcaaaaaaaagaagtctaatgttctgtattaacacaaaatgtaataaagtaaaaacaacaatagtacattggtaaatgcaccagactggagcccagctatctgggtttgagttgaggcagcagatattctccttatcatgctttcttcatctgtaagatgaattagtcttaaggaacttttcatttctttcagccctaataatctatgaatcatcttaacacaaaccagaaagcttggaataaaagaacacacttgaataacatcacccaaaaagcctgttgagtgttttttaaatttgactattactaaagtttttttaaatcttaagaaaaatcaagtaatgtagatggctgtgtcactgatgtaataatagttaaaacaaacatttcacatagtttctcagccatttagtgtttttacatgatccacccaaatatcaatctggtatctgaaacaatagtttgaacattttccatgtaataaaacatcttaaatgttttataaaaaaagattctggtacatgatatataaaacattctttcaaaaaaatgcgtacttaattttaatggaatttcttaaaaacactattctctttttttcctttaattatcagcaaatgatatatctagaaataaaggtgctgtctagtggcaactgcagagaccctggagtcagaagacatgagttcaagtcttcactacctttaactaagagtgtctttagacccgttataaaatcaactgagcctcaattttcctgtatgtaaaacatgtgaggttggacattctccaaccttttcacacttaagcctccttatgttgtttttcttctatgtataccatgcttaaaggatctgtctttcagacagactgcatttattaagtaataataaatcatctttcaaagactgccaacctgagattcagaacatcttgaggtctgaattcaaataaaattctaatccaaagcaaagcaatctactaagagtaactgtattacttccattaggttgctgaaatactaattatgccaaccattattatattgaatccaacaataccacgctgagaatctcaggtctggatcacacctaaattcctagaattctaattgttatatgttataaactactcaaaagatcattaatacagtggggaaaaaagtgaaaatgcaattcttgcatttgctcaaatactgagcaccaacaatgccagacactgtgctatgtgatttactttttaagattaaaaaaaaggccgggcgcagtggttcacgcttgtaatcccagcaccttgggaggccgaggcgggcagatcacctcaggttgggagtttgagactagcctgaccaacatggagaaactccatctctactaaaaatacaaaattagccaggtgtggtggcatatgcctgtaatcccagctactcaggaggctgaggcagaagaatcacttgaatccgtgaggtggaggtggcagtgagccaagattacaccactgcactccagcctgggcaacaagaaaacgattaaaaaacgattaaaaaaattgatttttttttcaaataatatttgtctctctctcttttttttttttaagatgaagtctcactcattctgtggtccaggctgcagtggcacaatctgtgctcactgcaacctccacctcccaggttcaagcaattctcccaccttggcctcctgagtaattggaattataggcatgtgccacaccatgcctggcaaatttttgtatttttagcagagatggagtttcaccgtgttggccaggctggtctcaaactcctgacctcaagtgatctacccacctcagcccctgaagtgctgggattacaggcatcccaccttttcttactcgctgggggggaggggggagttgggcaggatggtggtgtttatcttaaatatggactcgtctttcaataagcaatttcatctttaaaaactactgaaatcatcaataataccaaaaagggtacattataataaacaaatactttctaaaaaaatgaaagaatgaatgatgcattaacattatacaaagaagttttagggaaactatctgcactgccttcctgaaccttaatagttttcaaccatacagttagttccctgttgcttattttagtgcttcataattgatgctttgactactctcacatctcttatttctgttgccaaggaaggagatttttgtcttttcaattacttgtactccatgtagtacgtgcaagaagattacagaccaagtacatctttattcacatttgtttaaaacacacattactttaaactgactcatgttaaaacacaagaaagactcaatgattaagctgggtgcagtggctcatgcctataatcctaacactttgggaagccaaggcaggatgacttcaggccaggagtttgagacaagcctgggcaactccacaagaccttgtctctagtcgggggagtgggggcaaagctgggtgtggtgccacgtgcctgtaaaattagctacttgaaaggctgaggcaagaggatcccttgagcccaggagttcaagtctgcaatgagctatgatcatgccactgcacaactgacagaattttgctaacagagtgagaccctatctcaaaaaaaaaaagacaacgattaaaactggcacatagatagttagatgaacagaggagaacagaaagtctggaataataccaaattcataatcttagtatatggtaacagtgaactctcaatgcagtggggaataaagttgggtccatactttcagtataagtaacagatggatcaagacttcaagatttcaaaaaatgaaactataagagttccagaagataacttaaaagaaatgttttgattggaggttccaagatggccagataggaacagctccatgctgcagctcccagtgtgagcgatgcagaagacgggtgatttctgcattccaactgaggtaccaggttcatctcactggggcttgtcggacagtgggtgcagcacacggagcagggtggggcatcatctcacctgggaagcgcaaggggtcggggaattccctttcctagacaagggaagctgtgacagatggtacctggaaaatcaggacaccgccaccctaatactgcgcttttccaacggtcttagcaaacggcacaccaagagattatatcctgcgcctggctcagagggtcccatgcctacagagcctcgctcactgctagcacagcagtctgagatcagactgcaaagtggcagtgaggctgggggagggccgtccgccattgctgaggcttgagtaggtaaacaaagcagccgggaagctcgaactgggtggagcccaccacagctcaaggaggcctgcccgcctctgtagactccacctccgggggcagggcatagctgaacaaaagtcagcagaaacttctgcagacttaaacgtccctgtctgacagctttgaagagagtagtggttctcccagcatggagtctgagatctgagaacagacagactgccacctcaagtgggtccctgacccccgagaagcctaactgggagacaccttccagtaggggctgactgacacctcatacagctgggtgcccctctgagacgacgcttccacaggaacgatcaggcagcaatatttgtcattctgcaatatttgctgttctgcagcctccactggtgatacccaggcaaacaggatctggagtggacctccagcaaactccaacagacctgcagctaagggtcctgactgttggaaggaaaactaacaaacagaaaggacatccacaccaaaaccccatctgtacgtcaccatcatcaaagaccaaaggtagataaaaccacaaagatggggagaaaccagagcaggaaagctgaaaattctaaaaatcagaatgcctcttctcctccaaaggaatacagctcctcgccagcaacggaaaaaagctggatggagaacgacttctacaagttgagagaagaaggcttcagatgattggtaacaacaaacttctccaagctaaaggaggatgttcaaacccattgcaaaggagctaaaaaccttgaaaaaagattcgacaaacggctaactagaataaacagtgtagagaagactttaaatgacctgatggagctgaaaaccatggcacaagaactacgtgacgcatgcacaagcttcagtactgatttgatcaagtggaagtaagggtatcagtgattaaagattaaactaatgaaataaagcgagaagtttagagaaaaaaagagtaaaaagaaatgaacaaagcctccaagaaatatgggactatgtgaaaagaccaaatctacgtctgattggtgtacctgaaagtgacggggggaatggaaccaagttggaaaacactctgcaggatattatccaggagaacttccccaatctagaaagcctccaagaaatagcagactatgtgaatagaccaaatctacgtctgactggtgtacctgaaagtgacgggaagaacggaaccaagttggaaaacactctgcagtatattatcccagagaacttccccaacctagcaaggcaggccaacattcaaattcaggaaatacagagaacgccacaaagatgctcctcaagaagagcaaccccaagacacgtaattgtcagattcaccaaagctgaaatgaaggaaaaaattttaagggcagccagagagaaaggtcatgttacccataaagggaagcccatcagactaacagcggatctctcggcagaaactctacaagccagaagagagtgggggccaatattcaccattcttaaagaaaagaattttcaacccagaatttcatatctagccaaactaagcttcataagtgaaggagaaataaaatcctttacagacaagcaaatgctgagagattttagtaaatgggctaaatgctccaattaaaagacagactggcagtttggataaagagtcaagacccatcagtgtgctgtattcaggagacccatctcacatgcagagacacacataggctcaaaataaagggatggaggaagatctaccaagcaaatgggaaacaaaaaaaagcaggggttgcaatcctagtctctgacaaaacagactttaaaccaacaaagatcaaaagagacaaagaaggccattacataatggtaaagggatcaattcaacaagaagagctaactatcctaaatatatatgcacccaatacaggagcacccagattcataaagcaagaccttagagacctacaaagagacttagactcccacacaataataatgggagactttaaacaccccactgtcaacattagacagatcaacgagacagaaagttaacacggaaatccaggaattgaattcagctctgcaccaagtggacctaatagacatctacagaactctccaccccaaatcaacagaatatacattcttctcagcaccacatcgcacttattccaaaattgatcacagagttggaagtaaagcactcctcagcaaatgtaaaagaacagaaattataacaaactgtctctcagaccacagtgcaatcaaactagaactcaggattaagaaactcactcaaaaccacacaactacatggaaactgaacaacctgctgctgaatgactactgggtacataacgaaatgaaggcagaaataaagatgttctttgaaaccaatgagaacaaagacacaacataccagaatctctgggacatatttaaagcagtgtatagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactaagggagatagagacacaaaaaacccttcaaaaaaaatcaatgaatccaggaagcggttttttgaaaagatcaacaaaattgatagaccgctagcaagactaataaagatgaaaagacagaagaatcaaatagacgcaataaaaaatgataaaggggatatcaccacccatcccacagaaatacaaactaccatcagagaatactataaacacctctacgcaaataaactagaaaatctagaagaaatggatagatttctggacacatacaccctcctaagactaaaccaggaagaacttgaatccctgaatagaccaataacaggctctgaaattgaggcaataattaacagctaccaatcaaaaaaattccaggaccagatggattcacagctgaattctaccagaggtacaaagagaagctgataccattccttctgaaactattccaatcaatggaaaaagagggaatcctccctaactcattttttgaggccaacatcatcctgataccaaagcctggcagagatacaacaaaaaaagagaattttagaccagtatccctactgaacattgatgcaaaaatcctcaataaaatactggcaaaccgaatccagcaacacatcaaaaagcttatccaccacgatcaagttggcttcatccctgggatgcaaggctggttcaacaaatgcaaatcaataaatgtaatccagcatataaagagaaccaaagacgaaaaccacgattatctcaatagatgcagaaaaggcctttgacaaaattcaacagcccttcatgctaaaaactctgaaaaaactaggtattgatgggatgtatctcaaaataataagagctatttatgacaaacccacagccaatatcatactgaatgggcaaaaactggaagcattccctttgaaaactggctcaagacagggatgccctctctcaccactcctattcaacatagtgttggaagtcctggccatggcaatcaggcaggagagagaaagaaagaaagggtatttcattaggaaaagaggaagtcaaattgtccctgtttgcagatgacatgattgtatatttagaaaacctcattgtctcagcccaaaatccccttaagctgataagcaacttcagcaatgtctcaggatacaaaatcaatgtgcaaaaatcacaagcattcctatacaccagtaacagacaaacagagagccaaatcatgagtgaactcccattcacaattgcttcaaagagaatacaatacctaggaatccaacttataagggatgtgaaggacctcttcaaggagaactacaaaccagtgctcaacaacataaaagaggacacaaacaaatggaaggacattccatgctcatggataggaagaatcaatatcgtgaaaatgggcatactgcccaaggtaatttatagattcaatgccattcccatcaagctaccaatgactttcttcacagaattggaaaaacctacgttaaagttcatatggaaccaaaaaagagcctgcattgccaagtcaatcctaagccaaaagaacaaagctggaggcatcatgctacctgacttcaaactatactaccgagctacagtaaccaaaacagcagcgtactggtaccaaaacagagatatagaccaatggaacagaacagagccctcagaaataataccacacatttataaccatctgatctttgacaaacctgccaaaaacagaaatggggagaggattccctattcaacaaatggtgctgggaaaactggctagccatatgtagaaagctgaaactggatcccttccttacaccttatacaaaaaaattaattcaagatggattaaacactgaaatgttagacctaaaaccacaaaaaccctaaaagaaaacctaggcaataccattcaggacataggcatgggcaaggagttcatgactaaaacaccaaaaacaatggcaacaaaagccaaaattgacaaatgggatctaattaaactaaagagcttctgcacagcaaaagaaactaccatcagagtgaacaggcaacctacagaataggagaaaatttttgcaatctacccatctgacaaagggctgatatccagaatctacaaagaacttaaacaaatttacaagaaaaaaatcaagcaaccccatcaaaaagtgggcaaagaatatgaacagacacttctcaaaagaagacatttatgcagccaaaagacacatgaaaaaatgctcatcatcactggccatcagagaaatgcaaatcaaaaccacaatgagataccatctcataccagttagaatggcgataattaaaaagtcaggaaacaacaggtgctggagaggatgtggagaaacaggaacacttttacactgtaggtgggactgtaaactagttcaaccattgtgcaagacagtgtggccactcgtcaagagtctagaactagaaataccatttgacccagccatcccattactgggtatatacccaaaggattataaatcatgctgctataaagacacatgcacatgtatgcttattgcagcactattcacaatagcaaagacttggaaccaacccaaaagtccatcaatgatagactggattaagaaaatgtggcacatatacaccatggaatactatgcagtcataaaaaaaggatgacttcatgtcctttgtagggacatggataaagctggaaaccatcattctgagcaaactatcgcaaggacagaaaaccaaacactgcatgttctcactcataggtgggaactgaacaatgagaatacttggacacagggtgaggaacatcacacactggggcctgtcatggggtagggggctgagggagggatagcattaggagatatacctaatgtaaatgacgagttaatgggtacagcacaccaacatggcacatgtatacatatgtaacaaacctgcacattgtgcacatgtaccctagaacttaaagtataataaaataaataaataaataaaataaaataaaaataaagaaatgtttttaatttcagagtcggaaaggtattatttattatacccaacttacacatgctataaaagaaaagactattttaaaatgtcattcaaatatattaaaaagaaaaaccaaactttaaaagaaaacagagaagaattttcatgtcataaaggcacacagatgcacacagtcctaccaagtaaaaaaaaaaaaaaagagagaaaaagactaaccaatctaatgtccaaagggacatcagatatggttatgtcattcacagaaaaagtatagaaatggctcatagatctaccaaatacatagtctcattcttaataagagaaatgcaaaataaaactatactgaataccatatttcaactatcaaattggcaaagattcaaaactttgatagcacactgtgttcctgaagctgtagggaaacaggaaatctcctacactgatggtagagacgtaaactgctgtctattgacagtactctggcaacatccatcaaaattaaaaggatacatactctgtaatggagtaattccatttgtaggaatttctccaacaaatatgctaccacatacgtaaaattacttatgtatgaggtttttacatggcagataataggaaaatactataaacaatctaaatatccatctgtgaaaaattgattaaataataataaatccctatacatatcaataggaaaggatcttcaggacatactgttaagctaaaataaaatgggtagaacagcatgttcaaaaggctaggggattgaataatatatatttgaatttgtgtgtgtatatatgtgtgtataaaatgtatatacatttatacatatgtatataaatcatatatataaattctgggacaatacacacacaaaaaaccacaagttacctgcttgaaggtcagggtggccactgcactaatgaggacaaaaaatacggagagctgttttgcatttttaatttttccccatttaaaaaccccagtaaaaatagaaaatgaaaaataaaattaatgaaatagtggaatttgaactaaacttcaactaaattcatcatcaaaaatgaaattgaaggtaaaaaacgataaaagatttctacttgttacagcatggaaaattagatactttgaagggccctcccactatgaaacaactggtatttcttgtaaatttgaacttacacatattatattccactcccagaaactcttatacatgtgcacccatagaaatgttcaaaaatgttcataataatattgtttataatcacaaaatcctgaaaatatcccaactgtggaccaacagatgaatggataaatcattatgggatattcacatagtggatgaaatactttatgtaacaaaacaaaataatcttaaattgcaatcttaagtggggggcgggagagggcagaattccagagggcaatataccatacgacgctatttttctaaagtttaaaaaaaaaagcaaaattaaataagtactgataaggactcatttatttgatgaaattatgaggaataaagggtggggcgactacatataaaattcagagatagtggctacttctgctgggggaggcatagccaatgggggatatgaaagaggagaacaaaggtgaaggtaaatatattggtaatgtctagttcttaaattgggcggtgggttcatgggtgttcattatcttgcttcataagttatataagtgttaaatacgttatgcatcaaatattgcctatttttctttaaaaataatagcagttaatgtttcttcacaaattgtaatacactttaagattttataaaactccatctttctagacaaactgaatgagtaattaggagcattacctttattttctccttatgcttactgtaaagtttctttgctaacagagaaaagcaattaagtagttcttaatacttcaactttgaatttctgcaagatatttatctgtgttatcattacagtctgctcctaattttgaaaagactaattttaaacaccttttgatccccatagacctcttagaatacacagtacatattctaaatttcagcatacatttcagaaattgaaatttcattcagactctagaaaactgtttcttcttctttaccttcagaaaagtttcctcaagacttcagtatacagataattctgcttccctagctgtttaaatataatatttatggccgggtacactggctcacgcctgtaatcccagcactttgggaggccaaggtgggcagatcacaaggtcaggagatcgagaccatcctggctaacacaatgaaaccccgtctctactaaaaatacaaaaaattagccgggcgtggtggcaggcgcctatagtcccagctactgggaaggctgaggcaggagagggcatgaacccgggaggcgaagcttgcagtgagccaagattgcgccactgcactccagcctgggcgacagagcaagactccatctcaaaaaaaaaaaaaattatatatatatatatacacacacatatatataatatttatgtttaaatgcagtcagattgtgtatttcaggccaaagtttgtaaatgtaagtgttttaaatattcatttttttctgattataaaaccagtatatgttcattatggaaaactaatctatttttccgtatgttttagccaagccctacaaagaaatgggcctaagctctgtatacttatggctaattcccttcagaatgacaataagtcagagtcccatcagcagcatgtgacagtctgtttccccaacagttggaagtatcatttttaaatccctgacaatttgcgtggatcagaaatttcataacatttatttttaatccccattttcctgattgctaaacattttttcatgatttcttatctgctctttttaaatgtcttcttaagacctttggccattggggtgtttgcctttttttaaaaaattgacttttatgtgtcctttgcatatattcaatttgttgctatgctgcaatttatactgtcatttgcctttttattttcttatgcggctccttgaacttgtttttagcatttacgtatataaatccatcttttttactttatggtttcatccgttgctcttatgcttagaaaaactatcatactgcaatgaataaatgcatcctaaaaatgctcatattatttccatttttaaaaaaaatgtatctgatatctttttacatgtaaaaatgagccaagcgagtttttaaaatcacaatttaaattcattaaatctttccggagaatattgcagaaaaacatgttatctgtgctaatctgattaaaaacttactctctaatttcagattctttttcctttaaatcaatggatcttcagagacagactcaactggtatgactaaaacagaggcaagcttaacattacctctaatcttccttcctagcttcagtaggcaagaaaggagaattcttgtcaatgtaattttttaaagactatagcttctcaccactcaggtaggtctaatatacagtcatcaatgtaaaagaaggatgatatcattctgaaatatttggatctttcctcctgtgttcagaggagaagcagcaattctacctgcaggctcaaatggacagcaatgagaatatgtatgttcccattgctcccaattgcttcagatagccctctatttacgggacctttgtttgaaaacaaccagatattcagggactgggctgcccagtacaagtaacccaccaatccttctaaataagatcactaaaagctggctacattcttacatttctaacacagtatttatgtctaaagaaataattaagttggatcactcagctttatatttacatccaattggctccaactgttttaactgtctcactacaaagtggtttctactatgggaaccccaaagggaatttgttcagggagctctctcaaaacactattaaagaaagtatatattaatctgtcaccttaaaagtccaacacttatatacctcccttctatctcccacccctacccacccccccaaaaaaaccaaaaaaacactagaggttctaaatatagtacatagcatttgggaaaccagcaggcaatctacccaatgtcatatcactgggacagtgtagcctcctggtttcaggatgttcagtgtttaataatacatgcatatgaaacaaaagtgacaaaaatattggtaagtcaactaagatcctaaagaggtcaataagaatgctatctcattccacaagtatttgtctttggtcatctctaatgaacctacaagtgccagcatatttcacaggggctaaataaaactttttaaaaggttaacggaaaaatatttatgtgaaaaatgcctccgaataatcttttagtgggtggatttggcacataccagtgaatacctttgagcttagtccaatcttgaattaagctacagttcaccttcaagaaactatgaacctgcttttaagtaaaagcctgtattaataagaaacatggaatgtgaatacaaaaagagatgttatcagctgaactgtatctaaatattttacaaagttttccaagagccgtgagctgtcagtagatctttaaaattcatgatctttttttaaaaaagttattcattcatctgtaaaaatctagttttttatgtgtacaccaagcataaaattgccctatgctaaacttaacataaacctcacattacagagttatgtgtttttattcttcaacataactattacagtgattcaaaggataaaaacacacttagaatagtctaccttctgctgcatttcagtacaatgaagaaagcctgagcagcacccaaaaactaggtccatattttaaatctgcaggcaatcaagcaaggaaaataaattgaggaaccaggctatgtaatcacaatcacttgcaaaaccatttaaactattttctagttgtaattgttagcagtttcctatgactgtaatcttttaaaaaatatcttccacttaaaaaattaaatgcacatgtacattaatgttttttgtctacttatagttaggtgctatgccagattaaaattcccctctttcccctttccaattctacattcccttttcatttttgtacattatggttccaagctaatttcgtattatttatccaaataatgggtggctaaaaatttgatctttaaaactacaattttgaagcaatgtagagtttaacaaaacataacaaacaaaaaaccatagtgagttagccatttcatgatgacagtgtttttcacaaagtaatatgttaccttttcagatgttattcaaggatgggtaatcattttataaatgttacataattaaagattctcaacattataaattagtatgcataactcttaacagagaaaattgaataataagatgtaaattgagttgttcaaggtcagacagtatgtcagtgaggcagccagcactggcaatctcaaattcctgtcttcccccacatgtgccatcccacaagatccctgctctaacctttgcctgcaaaatgctaactctggtattcttcacaggacagaaaccatttagaatagaatttcaaacttaagaaactgattaagaagttaacctaaatattaccataatatatgaatttaaattaattttcagctaattggtccatcatctgaatgatcaattcctaagcacagtccaacttcttcctaatgttgtatttaagtgccaatgagctggctcaaggggactcaggtttcacttgtgagaactaacccttggggaatgaaacagctacttttcagagctgggctgcccttatcctctatcgtaatccaaggaagggacaatccagtgttcattcaaagaactcttagagcagctttctcacctccttacagctgggaagagataacagaacattcttatttcaaagccttaatctgaaccattgtagaccatgaattcctaaagcattaaccgtctggttaagatttaagctggcttcaaatagttttctcacttctaactttatgtctcaagcaaacccgttatgcattcttacacatttctgatcacttaaactcactggcctctttgtgatattccttcccatgtctgcacaggacagaagtatcccccacttgtcatcccatgagatgtatcccttagcaagttaaaaaaaaacaaacacataaagctaggggccaaaacatcattgtttaatgatggagcctgcaggttatctataaagtgatttcacgttaaaattgtcaagttaataactatttgatctttatattaaaatacataaagtttatattctttgaaaaaaaagtttagtgcctgaatgtaactattcaataataagctatatattcttggtcaccatatgtatgcacaaaccatctgacagacaaaagtataagaatggaatttctggcacgcctacatagaatagtatcatttttataaaagacaagagggaggaggcatggaaggaaatcaacattcattacgtgcttactaggaaacaggtactgtgctaagtactttacataaaactgcaatcaatttcatgtttattacattccctcaccaaatcattataaaccaatatattcaaacatcaaaggaactgaacacaaactctaggaatcctgaactgattccattttttccttgggctatgtgctaaggccatcatattcatcacccctatttatacaggccaagggctcagaagcacattaatttaaattattcccagaaagcagccccaaaatgccattacctcactgaaataattcttttcaagaggctagttttgataatccaagaattcaattcttatgagcatactttgataagaatttgttactaatttcattatacatcaagagacgagccactaatatcaaagactaaaaccatggattacgataatttacagatttaagctttttcagtgcccagaggttgtaaagaagatagatagggttggaaatgggatagactgggtgtttttactagccaaatgttttgattcactgatttacagtaaaatgttaacttcagtgaaatagatacttttcaggaagtgagggagagtattaaggaaaaatgtctaaacgtccaatgtaaaatatcttgatcatatacatttgaaaaaaattagtaaactgaaattgttttttaagtgtttgacaatactgtaagtggaacaaagcagcaattttattcttacacttctgacatttcacttagtgactttaataaaatattaaaattctaatgactcagcaaaacgcaaaaaatgcttaggcaatgttaagtgaaaacaataaaattttatgtatatcataattatataaaaatttgtgtgcataaaaaataattggaactttgaaagttgatttgacagtataatcagcttatagataattacttctttatttttattataaaaattatttttatattatttaaattattttttatatttttatattttttataatgttgtttcaataaaaatggcaactttaaaaaagcatgtgatcactacatgtattaaatggcagtctgtctgcaatggcttaactgtgttaagtgtatctgtgtcttagttttccagctattctgtcagttccaggaaagcaaacaccaggactcctttgtaccctccaaaatacttaacacagcctctcagacccagacagacccaaccaatcccagtgacagctagtcactgagccactgatgaacaccaagtgcagacaacataaaaatgagaacttactattatttgttggttcaggaaacccaggctttggaccactccatcctttgttttcccctgtctgaaagattaaatcaatcgttcaaatccagagaaacaagcttattcaaaaagaaaaaaaaaaaggtgaccaattaagcaaaggcaaagtcctctcacatggttattctgcatattatctctatctttgaccctgggatgatggctacaaaagaaactaacatgaagggtatcatttattccttttctgcacctaaatctacttatgtccttctacttttgtctgatcatgtaaatttataattcaaggcataaagccaatattcaatatatgtattattagaatgtaagctctagctaggtggtgaaaaaaataaatctttttttttttttttgagacagagtctcattctgtcgcccaggctggaatgtaatggcttggtctcagctcatcgcaacctccacctcctagattcaaggattctcctgcctcagcctcccgagtagctgggattagaagtgcctgccaccacgcccggctaatttttgtatttttagtagagatggggtttcgccatgttagccaggctggtctcaaactactgacctcaaatgatccacccactttggcctcccaaagtgctgggattataagtgtgagccactaagcctggccaaaaagtaaatcttattaaaatagtaaataataatcatcaccacaaatgcttaagtgaccaaaagagcttttgtatgattcccgaggtcaaattaacaacctaacaatcaaacatttctgtagacaaaaatgttactatgtccatctagaaaagtcctatggtaagggtcaccaaatactgctataatgacatatacaaaaaatacaaatataaaaaaaataaaaaaataaaaaaatgacatatacaaaaaaattgaaaactaagtcctaactttaagtcctaactttaagcaaactaagtcctaactttaagcaaaacatgtaatattctgacttttgccaaatgattagtgtttggtataaaatacattctgaaatgtagatgctttgaagtagtaagtattcaaatcaaattaataagtgactttagttatattatctttctgtacagctggtaacttatctcttatgatgatcagcattttatatttatgttaacggtcaaaggtcaaatagataattaagcctagatataaacacaaaatacaattgctgcaaatagtttacccatgttcatttttaaaaaaaagttgttcttattgaattcattcctttttaatcatacatcttagggtgacaaggaaatatatagtggcagacagcagaagcaaaactgaaaataaagaatcctgaagagtaagttgacagtatgttagaaacaaccagcagcttcatatgaactagggagcatctctttctctctctaattagctcttttatctctttaaaacacaaattcctgtcttcatcaacatttaccatcctgagagattgctgctataacctttgactgcaaaatgctaacacaggcatccttcacaagagagaaattactatgtaataaaatagactgatagtagtaatagctaatagctaacactgaagatttaaaagtggggttgctaatgcgctaagtgttttgcataaatatggattatctcattttcatcctcacaaaaatttggtaagataagtgatattaacattcaattttacagacaagcaaacagggttagagttcctgtaattactctaaggtcacacagataatatgcacaggtgccaggacatcaaactacatcttctaactagaggagagtaatcatgctacctttgtactgccattatcaggagagaaaaaagaagctaaagaaaggaatgagcaaaaaagttacagattaagtaaaactgtgccatctaagaatgaaaagaaaaacagtgagatgaagaacagagtttggaactattaagaagaatgctctaaaggtacggccaggatggaaaggactactgcaaaaacaaatgagagaaaacagaagtagaccagttccaagggatgaaagaaatttaaaagattttgaaaagcagctaaaataattattcacatgaaaacctggtgaacagaaagaaacaaagtatgttcaatttttcttttacattcctaccatacttttaattttattcatacctccaaaacatagcctgtacttatcaaagtgctgacaactgtttaggttcttagagaaataattacgtttccagaatcctggagcagttctacaattagccacaggattctagtctttctaaacaagtttttcatttttaataagtggaattaataaaatctgttttatttgactaaactaatttcttctattcttaccttatgttacctcaatactatacaattggctggatgtggtggctcaagcctgtaatcccagcactttgggaggccgaggcgagcggctcacctgaggtcgggagttcaagaccagcctgaccaacatggagaaaccccgtctctactaaaactacaaaattagccaggcatggtggcccatgccggtaatcccagatactcaggaggctgaggcaggagaatcgcttgaacccgggaggcggaggttgcagtgagctgagatcgtgccattgcacaccagcctggacaacgagagtgaaactccgtctcaaaacatgtatatattatacaatttatccagtaggtaacatatgattttcatctgagagctatgcctaacttcaaaatttctttcttttaaagatcattgtttgaagagtaaggggaagaggtcaggagagatgaggtcaaagtaattactacgagaacttctctcttgaaaaggagaaacccagcaagcacaaagtacagttcatctcccaatccttactttctgtatttcttctactgtacccctcagacacaaacgagaaatataaaaggagatgatatggtttggctctgtgtccccaccaaaatctcacctttaattgtaataatccccacgtctcaagggtggaaccaggtagagataactgaatcaagtgggtggttccctcatgttgctctcttgatggtgaatgagtctgacaagatctgatggctttataaggggtttccccttttactcggtattcatttctctttcctgctgccctataaagaggtgccttttggcacaattttaagtttcctgaggcctccccagccagccctgcagaactgtgagtcaattaaacctcttcctttataaattacccaatctctagcagttctttatagcaaacaaatataggaggcaacagcaggaggtaagtcaaagtctggaaagtggaaagcagatgaagaagttgtagctagcttagcagatgtgagtaactgaaacctaacctgcagaggaagaagccaacaaagagctcacagtaaggtgatgtgtcacccagaaccctagaaagcctccagaattaggagtacacctggtacatttaaagatgaatcctggaaggggctgaaacagaaagatttgtctggaagtcttttcaaggtattatgaaatctccctatcaactctttgaccccatgcagtcaggtgcctaccccttcctaataggggtttcctgttgggagaggctaaaacagagaggctctggataccaggcatagttgagggtgaaatccatgtgtcaccctgcaaataaggagatgggagttccaaggtttcatactgaaaaataagattccaagactcttttctcatttgcccctcagaagacacatccagggttccaaaccacaggaacagaaagataatgaggagaacagaagaaaaaaaatgcaaaaaaaaaaaaaaaaaaaaatcctcaggcacataagagaaagactacacccattaaacaagaataggaaggcttaaaaggaatattctgagaatgaggaagaactctgggaaatcaaaaataaaatagctgatgtgaaaatgtcagagagggactagaaaacaaacttgaggaaatcttcctagaaaacagaacaacaacaaaaacagaaagagggggagaaaagaaaaaccacaagaccatccataagattggcatctcagaaataaataacagcaaaaataaaagtaaagaaattattaaagaaataagaaatttctcagtttaaagtatatgaatttctagattaaaactcaaatgtccaacacaatttatcaaatacacatataaaatacacatatctcagaacccctgagaaaatagaaaagcatcgagagggaagagaagggtaaaagtttcatatacaggctgaagaatcaggtgttgaaattttaacagcaatgctgggaggtacaagacaagggtgcgatgccttcccaactccgtgaaaatttacttccaatttagaattacagcttagaaaaaaactatcaagtgtgtggcaaatataaaaaaatttcagaccacaagatctcaaaaaaaaagtttacttcccatgtatccttcacagggaaggccctaaagtatgtactccattaaaacaagaaagtaaaccaagaacaagggaaactgtccagaaaatagtcaactcaacaaaggacagaggccagagaaattttcaggataatggtgaagagaagaaccttaacagcagctctgcagcaggcatatcgatcaatctgcaatacaagaggaggataaagagctctaagggttgggtagggtgtacgttgggaaaggaacgaaaaaaactgcatgatgtgcttgactggtaaagactttggggacagaaagatgtagaaaagtgtatgtgtggagtatgtaccagagttaaaccctcattttccatagcagaaagtacatttaatttttttacttttatattacttctcataatatttaaacatgagaaaccaagagatagcacaaactacccatagtggtaagtaataaaataaatagttacaataggtggtaaagtggttgcctctggcaaaggggaagcagaaatggccagtggcagggaaggagaacaggatattttggtattttaaattataaaccttgagtttttatactattaatcttgtataaattctgcctttttatatatgtattattttgagtatgagtactactttgatgaatataatgatcaaatacaaaaaagagtagtcatgtcttgacttcaacaaactccaagatattaagaaaaactctaagatatctgaatgaagaaaatcaagatgcaagaatggcatataaaaaagaggtgaagagagtattccacttttccttagaatctggaaacataacaatgacaaacagccaatctgaaaaagacaattgcaacttttcttgaaccctttagagacctgagattacaaggtaaacaagcaaaatgaattctagtgagtgataaatccttctgggagagataggactcacaaaaatgttaacagctttggcagggcagggatagcagagatgactgccatgaatgtaagtaagaagaaagtagatgaaatgttaaattcttaaagcctgagtatgagctagcatgatagtttagaaaaactgggagctccagacagcagctcttttccattgtcctgccctggattctcagaaggacaactggggctacagctgcagaccagagagagcccaacttggtgcaggaatgcagctggttaatggctgcactgagggataagcacagaaccttgccacttctctaggccattctccaatacaaaacaaaaaatttaagccaccgggggaagggtagaaacaaatcctatatgccgttggggcaaaggcaggaaattctctggtcctaagagctcagtaaagcttcattgcttctgaagaggattgaaagcaaaagctatatgctcctggggaaaaaaaaagatagaaaacctacttgagagtaagacactacaccagtataaagcagaggtctgcaaatgctgggaaatgtacaggaaactctctcatgcccaaactgcccaaaaatccaagataaaatttggttaccacagagaagacagcaaaaacagaaagatccacctctgacatccaggctcacagaatctgccagaaaatgaagctggacaaaaaaatcaagaactatgacacccaccacaatcccaggattaaataataaatagcagcagtctactacagagcctgaagagagataaccccatgccatgacacagcaaagaagagacctctaaacctgagggctgagcagagaaactgtgaaaaaatcctctcaaaacctcacattacacaaagcatgggtaacagcatatcactattgaaggaatttgtagttaacagtgactatggcaataacaaaacccaaaatgaattcagttaataactagactgatgcaaccctcgatccaaaaagtctgagagagagacatatgctgatttctcaacaaatactatttgacttagcctctactatttttctgttgcaaggtccaacactcattcaaaaattatgagatacccaaaactgcaagaagaaataaaccactgccaaaacacagggaagtcaacaaaacagggcccagggatgaccctgatgctagacctttcagaaaggtattttacaacacctatgattcataggttgaaagaccaactggaaaaagcagataacatacatgagcatatggggaatttcagcacaccaatagaaaccacagaacaaaaacataaggaaatcctaaacgaaaaatattagagatcaaaacattgatgtcattattaataatgcattaattcagactgcacacagctgaagaaatattgttgaacttgtagacaaatcaacagaaattactcaaactgtttaataaagaaaatcctataagacaataccaatggtctaatgaatgtataaatggaaactccaaggaaaagagggagaaaacaaggaataaaatatattttaaaagataatagctaagaacttgtcaaaataactgattccatgacatcaaatcacagatccaaaatgctcagagaaccctataaggacaaggaggatgacaaagatgaggatgaggatgaggaaggaagagaagcaggaggaggaagaggaagaggaggaggataaagaagacaaggaaaaggagaagggaagaagaaagaggagggaggaggagaaggaagagggaagaggagagaagaagaacaatagggaaggaggaagagaagaaagaataaagaggagatagaagaaagaggagaaggaagtagggggagaaggaagtaggaggagaagaaaaaacgagagaagaaatgagaagaaggaaggaagaggataagaaggagaagaagaaaaggtggaggaaaaggagaaggaagaaaaatagaaagaagggaggaagaagggtgggaaaagagtacaggggcagaggagaaaggaagaaacaaaaaaaatcaattagatacatcacaaccaaattgttggaaaataaagaaaagaaatatattaaaggctgagagaggaaaaaaaatacatcaacaagaacaagtaagaattacaacagactttacattgaaaattatgcctatcaggagacaagggagcaagatctttaaagtactaaaagaaacaggaaacccagaatcctatatccagaaaaaaataactttcaaaaatgaaggtgattcattggaggcttaaaaaagaaaaaataacgtgaaattttctgctagagcagtcactgaagagcagcagccatagttctgcattaccccatgcccatgggcctcaaccagggcccaaggtgaacaagaatatgagcaagctgaggcagggctgccaccctggacaccttaccaagcacacaaagcttgtgtaagacatcatctgggaggtgtgtggcttccccctgaaagtggcatgccatgaagctgctcaaagtctccaaggacaagcgggccctcaagttcattaagaaaaggatgaaaacacacatatgcaccaacaggaagcaagaggagctgaggcaatatcctgactgccatgaggaaagcagctgccaagaaggtctgagcccccaccccactttgtgtataataaaacctgcaaagaaaaaaaatgaaagtgaaataaagacttttttggcaaacaaaagctgagagaatgcactgcctacagatctgctaaaataagtaatattaaaggaagtccttcaagcaaggaaggggtataataccagaaagaaatttgaatttacacaaataaatgaaggatattgaaaataatcaaaatgagagtaaatataaaaggcattttctgctgattttaatcacttaaaaagataactgactatataaagcaaaattagtaacagtgaattgtacggtttgaaaaatatagaaaactaaaatgtatagccacaataggaggtcagagaaacttagagaagtaacctatgtgaccacaatagaggtcaaaaaagaaaaaaagtaaacagagtaagtgcggggaaaaaaaaaggcaactaataaaatggtgtgtttaaatacaacaatctcaataacttcagtaagtgcaaatggtctaatcaccctaactaaagggcaaagtttgtcaaattaaattttaaagaacaagacccaattatatgctttctaaaagaaaccaatttaaagataggttaaaagtaagcacagggaaaaaaatatcccatgcaaacaccagtcaaaataaaactggagtagctatattaatatcaaacaaaacagatttcagaacaaggaataaagggaaatatccaatagaagtggtcaagtcaacaaagacacaacactaactgtatacatatataacaacaaagtttcaaaatgcataaaacaaaaactaataaaactgtaagaagtagaagtaggaaaatccaaacttatagttggaaactttaacactggacaaaacaagtaatcataacagatacagggcctgaaagaagaaatcaagagggaaatcagaacatattttgagttgaatgaaagtaaaaacccatacagcgtgtatcccagaggtaaaaaaaaaaaaaaaaaaaaaaaaaaaaaaaacaagagagagacaagaaaaacccaacttgtcaaaatgtgtagggcagagctaaatcagtacttaaagaaaaattcacagcattaaatgcttatattagaaaaaagaaagttctcagatgtatagcctaagcttctacctcacaaaattagaaaagaacaaaaaattaaaaacaaaaacaagtgaaggataaaataaagagcagaaatcaaaaaaactgaaaatagaaaaacagagaaaaatcaatgcaactaaaacctaattgtttgaaaagacttaaaattttataaaccccctagctaaactgaacagaagaaaaagagaaaagaaataaatgatcaatatcagaaatgaaagtgagtatcattacagattctgctactactaaaagagtaaagaaatgttatttagattttgccactattaaaagaaaaagggaatgttataaacaattttatactagtaaattcaacaacttagatgaaatcaactaattctttgaaagactaaaactgccaaagttcattcaagcagaagtaggtaacctaagtaaccctatctatttttaaaatctgagtttgtagttaaaaaaccctttccacagagaaaattctaagcccaaaagccttcactggtaacttctaccaaataattaagaaataccaaccaggtgaggtgcctcacgcctgtaatcccagcaccttgggaagccaaggcaggcggatcatttgaggtcaggagagcaagaccagcccagccaacaaggtgaaaccgcttctttactaaaaatacaaaaaatcagccaggcatggtggtgcacactgtaataccagctactcgggaggctgaggagggagaatcgcttgaacctgagaggcggaggttgcagtaagccaagatcgcaccactgcactccagcctgggtgacagagctagactccgtctcaaaaaaacaacaaaaaaatcctgtttttgctggttttaaatattgcttttgccacactcatcaaaagtcttattgataaatcaatatattcagtcctcttatttgatctctctgcagcatctgactaccacctagcagtcattctctattcctttttgcaggtagtctttcctcctcttttttcctgtaccttgcatgcatcttatctactattcaaatcttacccattacatttgtgaaatatctctggagtctttccattcctcctctctaccttcactgtctcagttcagaccctcaatatctctcacctaaacaactctggttgcctcctgactggcctttctgcctttggtttcactctgctcaaatccatgctccccattacttagagttatcttttgaagaatgcaaaccagatcaattcacattcatgttcaaatcttaaataagcatttcttcaaaccttctacttcgcataataacagtgacctcagcttttcctgactttccaggttcatcctctagttttgttatatggttaaaattcctcactccctgcacttaaagaacgatcagctccttgagtgcagagaccaagtctcagtcatcttattaaaatcagtcattttaagtgtctggcatttagtgagtgtgatgattaactttacatgtcaacttctctgggccacagtgccaaatggtcaaacattattctgagtgtttctgcaagagtgtttttgggtgagatttacatttaaagtggtgaactctgagtaaagcagatcaccctccacaatgtgggtagtcctcatctaatcagctgaagggcctgaacagaacaaaacgctgacctccctgggcaagtgggaattttccagtagactgtttttggactgaaatttcaactctttcctgagtctccatcctgtcaggctgtcccatcagattttacactagccaagcctccacaatcacatgggccaattccttaatatatatacacagacagacacacacatacacacacacacacacacacacacacgttgatggttctttttctttggagaaccctgacttatacagtggttatgcaaaaaatgtttttcaaattaatgaaattaattaatgctggttttttgttgtgtttgctttcacttaatttacaaatacatgtctgtgaggagatttattttgacatatttttatagatcactcaccagttttaagtcaatataaatgtgttaagttaaaacaacatatatacaatataaggactatagaaactggaacacatgttaggtttcacgttacaaatacttttaaaagaagaaaaagtgttgactagccaggttataaaaacagaattgaaatctctagcaataatacacagacaaagattttttaaaatcattcaaaagaattgcctagaaaacaaaaaagtacatctaagtgtctttatatatttttgtttctaattctaaacttttaaaatgtgttcctgtagaaactaaaaaaatctctgaaacagaattcttgtgtgagaagatggcctggtctaaagcatattacttttgataaaagtaattagtaagcctgttttgtgaatgttcacataaataaaatgtttggtagaaataatgtctacatatccacagataacaaaatgatacttaatacaaaatggaaataagccaatttctgccaagttatctgccaagttctgaattcagggttctctgcttcccttgtaacagatgtaggtgttaatgatgtcattaactgttgcagaaaaaataggggaccatgaacacaggtcttggcagaaaataaacaacctatgagttcacctttaaatttaaagtaaatagaaaaattagtttatagagtgtctgtccaatacagttcctgccctaaagggataagtcagaatttttatttccagtgttttcagctgtattccaaaaataaaggctaacaacctgtgttcttaaaaggcacaaattaagactgtgtctatatggcaaaaacaaccagtcaacaagttaaaaatgttaaattggtattacataaaatatgtacaaccatacaacaaactttttgtattttctaatcataagattataaatactcattaatatctcatcttactccatatgttattttgtgcttggatcatctatctttgtattgcctcagaaaagttaaaattgacatttactttaatatcagttaagatcaaaatttattaatcactttgatattatgacagataggatacatacatgtaaacttaactcttaccttctcaagttgatcctgaagattagtggatgctttataaccaagttgtaacagcattgcttctgcagcattttttttggctatctttttattaggtcctgttcctgtagcaacttcattgcctaccttcacctgataagattaaagaaataaattaaagaaatacatttatgataaatttaaacaggaagtccttacatcataaagcaattctactctctagcatttgaaaacataaagttcagtccaaagtaaaaatggcaactaagataacatttatgtaatgttgtatatgtacatgaaaaaatggtccttaaagtatcaatggaggattatctcaggatggtagaattttatagaatttttacttccatatatatttatatgctatttgattttttaaacactaaatttatattatttatataagcagaaaaataaaatttacattttaacagcgttcatgttggttatgactacattttagcattcttatatttcaattaataaactgaaaaggctaaaattcatattggtgccatttaaaataatgttcaaattgcaatattatgtaaacattcaagtttacaaagatttatattaaatagttcctgaagagaattaatatacaagtgttcctacaacattatgattaaaaacaaggcttctggccaggcgcagtggctcacagctgtaatcccactttgggaggccaaggcaggaggatcacaaggtcaggagtttgagaccagcctggccaatatggtgaaaccccgtctctactaaaaatacaaaaattagccaggtgtgatggaacacacctgtagtcctagctactcaggaggctgaggcaagagaatcgcttgaacccagtaagtagaggttgcagtgagccacgattgcgccactgcactccagcctggggccacagagcaatactccatctttaaaaaaaaaaaaaaaggcttccaagtcagattgggatatgaaactcaactctattatttcctagctgtacgaactggtacaaattatttaatatctctaagcctcaggtttttcatcagtaaagccggggtaataccaactactgcacaatgttgctttgaaaattaaacaagataatgtatgtaaaccacagcatttaatccatcacaattgctccaaaaaaaagatttttatcattagaactattctacagttatcttctgtgagcaatttatacatgtacttaaatacacatcaaccatacaactataaaaagtaaagtagatagcaaaaaaggatagaattacaaggagaaatagaaaatacacaactatagttgaatttctttttacacagtggtctcagtaagtgattgaagaagtagttaaatagttaatcacaactttggaaattaaacagtgtaattctggtcaggtgtggtggcttatacctgtaattccaacactaggaggattgtttgaggccaggagtttgagacccgcctgggcaatatagtgagaccccatttttacaaaaaaaattttaattagctaggcatgatggtgcatggctgtagtcccagctacttgggaggctgaggtgggaagactgcttgagcccaggagttcagggctgcagtgaaccgtgatcacatcaccacactgcaccctgggcaacagagtaagaccacatctctaaaaaaattaaaattaaaaattaaaaattttataaacaatgtaattccaaattacctaagggcaaaagaagaaattccagtgaaaactagaaaatattttaaataatccatggacatatatcaaaacttgaaggacacagcaaaaggagggtctagaagaaaatgcatagccgttaacagcttacaggagggcaaaaaagtaatgagctaaacatccacctcaagaagtcccaaacatatcagcaaaacaaacccagagaaaatagaagaataaaaagcaaaaaggaaatacaaaacaaagtacaataaagttagaaaagccaaaagttggttctctaataagactaataaaacaataaaccaaaagtaagactgatcaagaaaaaaaatacgagttcttctctgagatgggtatttttaaaaaagaaaagaagaagagaagacacaaataagaaatgaaataattaaaaagggagattaccatcacttctgtagcattacaaaataataaggattactgaggccgggtggagtagctcactacctgtaatctcagcactttgggaggccaaggcaggtggatcacttgaggtcaggagttggaggccaggttggccaacatggtgaaaccctgtcttactaaaaatacaaaaataaaaaaaaaaaaaaaattagccaggcatgatggcaagtgcctgtaatcccagctacttgaaaggctgatgcaggagaattgcctggacccaggagaaagaggctgcagtgagccgagatcatgctactgcactccagcctgggcgatagagtgagtctctgtctcaaaaaaaaaaaaaaaaaaaaaaaaaggaatactgagagcaatttcatgctaaaatttaaaaacatatttagatacaatggaaaaattcctagacaatacagattaccaaattgccacagaataagcctaaagaatatgactaaaactactaatgaaatcaaaccataattaaaaacttcgcaaaaaggactcttcagatcttctccataaagttctactcaatatttaaggaagaattatgctattcttttcatccaaattcatccataaaacacgaaatgagaaatcagtccccaattattttatgagctctcattttgattccaaatcccaacaagaacagtataagaaaatttacagaacagtttcactcatgaacatagatgcaaaagttttaaacagtataatgaataaagcaatatagaaaaagaaaaagattcatgacaaagttaggtttattgcaggaatgcaagtttggtttaacatttgaaattcaaactagaaatcgacatttattcataatgaaaattattagcaaactaggaaaagaagaaaactttttttttttttttttttgggatggagtctcactctgtcacccaggctggagtgcagtggcacaatctcggctcactgcaacctccaccttccgggttcacgccattctcctgcctcagcctcctgagtagctggaactataggtgcccgccaccatgcccggctaattttttgtatttacagtacagatggggtttcaccgtgttagccaggatggtttcgatctcctgacctcgtgatccgcccacctcggcctcccaaagtgctgggattacaggtgtgagccaccacgcccagtagaagaaaaccttttaaatatgataaagggcattttacaaaacacctacagcaaacctcaggaaacactgtacttaatgttgaacgaaactaattagaaacaagacaaggatgttccctattattactactgtttaacagtttacacaaatcctagacagagaaataaggcaaggaaaagtaaaaaaagaagcagaagggaaaagaactcattatttatagatgtgatttcatatataaggaatctaagaaactccacagatgaattataagaattgattagattgtaataagctcagtatgaaaaagaggactgcatttctacattccatccacattcaagtagaagatgaaaaatattaaaaagataacatttacattaaatgaaaatcaaatacctatgatgtgcaaatcttctacatagaaaacaaagtcttattgagaaactttaagaaaaacctcataaacagagcaaaatgccatgttcatggattgaagacaatactaatgtaatagtatcagttctcttcaaattgacctaaactcaattaattgaactcaatgaaaactcaatcaaaattccatatatctttttacaatacttgaacaagatgattccaaaatttacatggaaatgtgaagtgctaagaacagccaaaatccttttgaggaagagcaaggtgtgggacacttatttgtctggatatctagacttattatgaagttaatataaagaaaaaatttaaatttgactacactaaaaattactcttgttcttctaaaagcattatttagaaaggaaagtcacaacacaagaggaggtatttaaaatgccatataactgcaaagggcttgcatccagaatatacaggaggttcccatatatcagtttttttaaaaaacgagcagaaaaatgagcaagaaaagtgggcaatccatatctgaaaagttgaattgttttaccagttatcattttacttaaaaaaaagttagaaagtttcaataatagtttcatgccactttaatacatttcacaatgacaacaaaattcagttttcagctatacagcatgatactctaaccatacttttcttttttgtctattgtgtaaaatcataatattggctgtttcatctgtcccagaacatacagattcccatttggtatccacacttgagtactgttcatcatttattcttacatccttatttacagtttttatttgtgttattatttccaacagtactttttttttttttgagacggagtctcgctctgtcacccaggttctggagtgcagtggcgcaaactcggctcactgcaagctccgcctcccgggttcatgccattctcctgcctcagcctcccgagtagctaggactacaggtgcccaccaccatgtccggctaatttttttgtatttttagtagagacggggtttcactgtgttagccaggatagtctcgatctcctgacctcgtgatccacctgcctcggcctcccaaagtgctgggattacaggcgtgagccaccacgcccagcctccaacagtacttttaagcttcagtgaaccacccaattttaaggaactgggagaatatacaacaaaatggtaagaaaatacaaacttaaacataaacaatgtacaaatgatataaaaaaggtgctgtactctcttttaacagagtttcagtaaagacaaactaaatgacagttcatacagcacatgaaacgctgaaaacatattcattacagaatttctgtaacaactatcacaaattgcatagtttaaacctgtgaaatattttttaaatatttcattgcctttttttctgaaactggaaaccactatgtcgtgacaaatcagaagcagtctttggacctcactctgagaaggacaaatctagtacagtcagaccaggtactcagagccagatgaatacacaccacctgccgtaacagtgtctgcctcaacatggcaggccctatggataatctactcaaatccctggctagagtacctctgctccctgttattttttccaatgctttgtttgttcccccagcttcatcagtccctatgttgctgctggaatccttgctggtgaaaagattaggccagttatgtcagaagcttcctctactgctctgaggcctggtcttggacttgtcagctgtaatgctgttcccattcctgtattcaccttgtctctccgtctgctagatttccatctggcctattctgataccttcaagacttacttcttctaaaacaagtgcttcccagattcatttacccattcacccagcccttgcctcatgcaaattttaataatcgcatggttgaatagtttgtaagcagttatcctaatttgttaatataaaaagaccacattgccaaaggactttcattccctgctaataaacacaatggtcactcaaaacatcactttattataaaagttaagtaagtttataaatttcacaagtcatcttccttgagaagtcacaaattttataactattgtaaatatggtctctacatttaaatgttaatttctatctgtaaagaagctcaattattttaccatgcagtaaatttaagactgccaaatgtttgtctttaaatttaacagctcattcacatgaatcaaatcctcaaaaacctaagaaactaaaaagttctgaaataggatttaccaaaaacttaatttttatttattttttaacaacctggtgatctcaatcacaggctgaaaagttagtaatacagtgtgctgatatgcaatttggtttagttatcattattttctgtttgaaagattaaaatactcctcaccaaaaaaatgaaaagctttaagaaatctgctctggaataaaatacccaaataatgtcatcggagattttctttcgtttatctagtaatcaacataagtaactgcatccattttttaatatatagactttttctttggtaacagataaaaatgagcatctcatctctagatattttgctgccacattcaattataacaaatgataacattgcctaagtagtttatacaaaggccgttactttgataaaattgctgcaatactgtaatgaatccactggggcttccagaaggggaaaaaacaatatgaattcagtgcgaaaacatttaaaagcacagccaaatgtccccatttgactagaatgtttatgaatacccataaaatggaagctggcctaagatatgctaaattcctctttcaaaaggggtactcaatatactctgtagaaaaggatttgtttaataaagccaaagccagtttatattcccaatacatgtctaaaattcaggcgatttttttcttcaagctttggcattcaaagtatatgttccagaattcttcaaagttaagaatgttaaggaaaaaaatagtgaacatattttaccagtgaaaataatgaaacaatcatgtgctggatcctaataacatcttgacaataatgtgattactaaccagagaattcccctctttttggatatctgggttcccaggagtgacttatctatgactacattataagttaacatctccaaaaaaaaaccatacaggcagaaaggcaggcagcaaatatctatcaaatgtttattaaggtcctactatttacaaaccactgtattgggtactgaaagataaagaaacatggagattataaattgggagggaaggcacaacttagctatacacttaaacttaatcaatatgagacactgtatttgagtgccaaaatgtctaccacatggtcagcacttaatatttgttgattttatctaagttacataaaatgtgagatccttggatttgactaaaaagtttctgtgactaaccaattatttaaaaaacagtttgagactaagcacagtggctcacgcctgtaatcctaacactttgagaggctgaagcaggaggatcacttgaagccaggagtttaagactagcctgggctacatagtaagatcctgttgctataaacaacaacaataaaacaacatttaattagctggccatggtagtgtatgcgtgtaatcctaggctactcaggaggctgaaaagggaggatctcttgagcccaggaaatcaaggctgcagtgagccatgatcatgccaccgtactccagcctggctgacagaacaagaccctgttgccccaccaaaaaaaaaaaaaaacaaaaaattaaaaaacagcttggggaaaataataatttaaatatagactgggtattagatgattctaatgaatcatgtctaatgtaagaaaagctttcatatttcttagaaacatacactgaatatgtaaggctgaaatgacatgtagttagaaattatctttgaaatacttcagtaaaagaagagagaaaggaagaaagagagggagaagagaaaaattaatagctgaatcaagtgtggcaaaaatcttaataactgttgtgtttgagtgatgggcatattaatggtccattattattctctccccacctttggatatgtttgaaattgtaataaaaaagtaaaagaaaaatttcttaagactggagtttgagctggcaaatgaagatgaataggtaggggttgaaaaggagagcattttaggcattctacttcattcctagcccatctgccaatacactagcagccattccttgattttcttggctccacaatgcagcagtcagatctcagcaatcctgagtgcctcagcccccaccatggttagctagcctgcttactctctttttctaactttcctgacagcccacaagctcaggattttggccctgatccatctactacatccatccttctaaattttgtttctaattccatgtgtctccaattcccagtagttaacagactccggctacaaaatgtaacacaaaaagttaaaagataggcattaaatgataaactccatggtaaataacctgtgtgaactcagagtcccttggaaaactcatgttgtctattgtaacatgtccttgacacttgaatgtttccaccaagttggtaggtgagcctggacagaatgaatgctttaactggaaacagttttactttctgctcttaagtcctagtttgcctttcgcccaaatgcctattccatcctggggatttctaaatcttttcaatagttttaaaaggttagaaatacctgcatcacaaattctcgacgtcgaggcattcctctttctgaaagcaaaacataatccggctccttttcctttttggcctgttgaatttgcgccaggcggctaatagggttcatcccttggccatattctggtccggcctaaaaattaatttaagaaaaagttttaaaatatgcttgtgaaacctgttattgaatccttaaagaaacagtgcttcttccctccacccccacaccccaaaactgtgactagaaaagataaatgagtcatttatgaatatttataaaggaaaatcataaaatagacctgtaaccaaggcttctatgggacttggggcttagatgtattaatggcaaggtgtcaactatgctttttaaattgggcacactcttcagtataccagaggtgcttcacaacttctgttcatcaagaaacatcaaaaagaacagaagaagaccaaccatgaactgggaggagatctctgcaacacattatcattttattttattttatttatttttttgagacagagtttcattctgtcgcccaggctggagtgtggtagtgcaatttcagctcaccacaaactccacctgccgggttcaagcgattctcgtgcctcagcctcccaaatagctggaactacaggcgcgcccacaccatgcccagctaatttttatatttttagtagagatggggtttcatcatgttggccaacctgatcttgaactcctgacctcaggtgatcccactggccttggcctcccaaagtgctgggattacaggtgtgagccgcagcacccggccacaacacacataattttaaaaagacgtatccggtatccaaaatatattttttaagacccctaaaaagtactaagaaaaagagaatataaaagggaaatgggcaaaagagataaatacttcacataaggaaaaactcaatatatgaaatgataactaacctctaggacacagaaaatacatattaaaaacctcagtgagttactatttcacatccaccaaattagcaaaaattaagaagtctaacagccccaagtggtgagaatggggagtaacagaaactcttataaaacactgggagtactataaatcggaaaacaacctggcaatgtctagtaaagcctgagatggtacatcctaccccaattagcctattcctaggcacatataaaccctagaaaaccgtaacccatgcacagtagctcatatgtacaggaatatccacagatgcattatttgaaataggaaaaaaaaactagaatattcatcaataaaagaacagataaattacagcatgttcatataatggaatggtatatagcagtgaaaatgaattaattattgctacatgcatcaagatgaatgattttcagaaagaatagtaagtaaaaaaggcaagctacagaataatatatatatagtatattttatgtaaagcctgctaaaactacaaaatactgctgaaattaagatctaaatagtcaatacatcatgttcatcgatcagaagactcaacaataagatgtcaattctcctcaaaatcccagtaggcttttttcctttttttttttttttttttttggcagagtctcactctgttgcccaggctggagtgcagtggcatgatctcagctaacagcaacctctgtatcctgggttcaagcgattctcttgcctaagcttcctgagtagctgggactacaggcgcacgccaccatgcctggttaatctctgtatttttcatagagacagggtttcaccatgttggccaggctggtctcaaactcgtgacctcaagtgatccttccacctcggcctcccaaagtgctcagattacgggcatgagccaccgcacctggcccccagttggctttttaaaatttaatgtgtaagctgatactaaaattcatatggaaatgcaaaggacaaagaaccaaaattttgggggaaaaaaaaagactcagactacctaatttcaagattataaaactatggcattcaagacagtgtgtgtagtattggtataaagacagacaaagggaccaatgaaacagaataagtgcccagacacagatatatatacacacatacacatacacacacacacacacacacacacacacacacacatacacacacacacacacacacacacacacacacacacacacggtcacatgattttcaacaaaggcacaaaaggaattcagtggggtagtcttttcagccaatagtgttgggacaattggctattcatatgtaaaaagaaaaagaaaaagaaaaaaaaatcttcaagccaaacctcataacatttataaaaataattaactcaaaatgcctcacagacgtaaatgtaatttctaaaactataagatttccagaagaaaaatttttgtaacttggttaggtaacaatttcttagatataacaccaaaatcacgttccatgtaaaaaaactaataataataaaatgaaacaatataaataataataaaataaacataataaatcttcaaaattaataacttctgctctttgaaaaagacaagtcacagacttgaagaaaatatttgcaaagtacatatgtaataaagcacctgtatccagagtatataaagacctctaaaaattcaataataaatttattattatttgaaataagcaattaaaatttgttaagctggcaaaaaatttaaataaacacttcatcaggcctcatgtgacagtaaacacataaaaaattcttgatatcatctgccacagaggaaatgtaaattaaaaccaaaatgagatatcaatacccatctacatgaacatctgaaattttaaaaactatgctaggtgttagcaaggatgtgaaacaattggagttatcacacactgctgatgagaatgtaaaagtgcacagctgctacaactttgaaaaactaaagttgactatatacctactaaatgaccaagccattccactttgaaggatttacccaagagaaatgaaagcatatgctcttaagatacacacacaaatattcatagctgctttatgagtaacaatcaaaaattagaaacagcccaaatatccactgacaggtgaatggataaacaagtggtggtatatcaattcaatgaaatattacctgcaaaaaaacagaactaccaattcatgcatgcaacaataaggatgaatctcaaaataattatgctgggttaaagaagccagccaaaaaaaagagtggtttctcggcaaattaaggtagaagattacaaaggggcataaggaaaattctgggaggaatggatgggttcattatcttgatggtggttatagttttacacatgcaaacaaatacgaaaacatatcaaacagtgcactttaaacatgtacaagtcactctatgtcaattatacctcaataaagttgtttaaaggaactaaacaaataactttagaaaaacaaacatagtaaaactataaggtaggaaatggtcatacaaaactagtgatagaggttgcctagggaaggttgcatgaggacgtgatggaagaagagcatacagagagcttcaaagcttattgagaaatgttttatactcaagttgggcagtaggtctttctcacacttacttagtatgctttttaacttatacacaagtttatatatagctttttgtatgtattataacataaaagcaaaaattcaggccgggcgtgatggctcatgcctgtaatctcagcactttgggaggccgaggcgggcagatcacctgaggtcgggagttcgagaccagcctaaccaacacagagaaaccccatctctactaaaaaaaaacatacaaaaaattagccgggcatggtggcacatgtctgtaatcccagctactagggaggctgaggcaggagaatcactttaacctgggaggaggaggttgcggtgagccaagatcacaccattgcactccagcctgggcaacaagagcgaaactccgtctcaaaaaaaaaaaaaaaagcaaaaattcttggaaaccaaattatctttctgcatatgaactttcttcatgtatttttcctagaaataaaagtctgcgtatatcatacggtcaaaactttatttccacctatgaaaatttattcttgtctctactatctgtagagacatggagacatggataatcactctgttacagattacacgttacactaaacttatgtaagagccactatgcagtcttagctcttccggatgattgctgccatttcatcttgacaatctgtagtttggtgctccaggtacagcatccaggcagatccctcatggtctttcaaactatgtttaggattttggactttatccaaagagtaagaaaattactaagaggttttaagcagaggcatgatatgattagacaggtgtctctaaaagatcatactttttaaacgatcatttggtgtcaagagtacttgtagccagttaaaaccttaactgtagtagttcaggttaatagatgtctgtgagttggacaaaagagtggcagaagggatggaaaaaaaggaaccaacttaaaaaacattaggtgacaaggccaagcacagtggctcactcctgtaatcccagcactttgagaggccaaggcagggcggatcacaaggtcaggagttcgagaccagcctgaccaacatggtgaaagcccgtctctactaaaaaaacaaaaattagccacgcgtggtggcgcacgcctgtaatcccagctactcaggaggctgaggaaggcaggagaattgcttgaacccaggaggcggaggttacagtgagccaagatcatgccactgcactccagcttgggtgacagagcaagactccgtcccataaaaaaaaaaaaagaaaaagaaaaaaaagaaatattagctaacagagtaataggacttaatgactgataggacgtaaggggtaagagagaagttaaacgtcgggcgcagtggctcacgcctgtaatcccagcactttgggaggctgaggtgggtggatcacaaggtcaggagttcaagaccagcctggccgacatggtgaaaccccatctctactaaaaatacaaaaattagtcgggcatggtggtgggcacctgtaatcccagctgaggcatgagaatcgcttgaacccaggaggcagaggttgcagtgagccgagacagtgccattgcactccagcctgggcaacaagagcaaaactccatcttcaaaaaaaaagagaagttaaaaatgacccccagcagtttcagcagctggatgtttgtgccagtcactgagataaagaatgctgcaggagaaagaggtttagaagggaaaatgatgaatttgggcccaaaacttgaggcacctgtgaaatactaagtggggatgtctaataggtagtgcagagcatacggtattcaggaatcatctatttaaagatgaaattgaacccccagaagtagaagaacagcttagggaaagaggaggaaaaagactgagaacttcactgttgcaatggttagatgaagggaaaggaaagagcaaaggaaacttttagcttttgataaaatactggtttcaacttccacttatatcctgaaaaaaaaaattaaataaagggccgggcgcggtggctcatgtctgtaattccagcactttgggaggccgaggcaggtggaacatgaggtcaggagatcaagaccagcctggccaacatggttaaacactgtctctactaaaaatacaaaaaaattagctgagcatggtggtgtgcacctgtaatcccagctactcgggaggctgaggcaggagaatcgattgaacccaggaggtggaggttgcagtgagccgagatcatgccattgcactccagcctggcaacagagcgagaccctgtctcaattaaaaaaaaattaaattaattataaggggaatgaagagggactgatgagaaaagacaaatccacataataatttataagtctaagattgaaatcccaatgaaaaggtaaagagaagctctgagtctagcactagaagtagtatgcccagttcatgaagatgttaaataagtaggaatgtgtttccagtggcatactgtctttatttctgtttaatttgactcaaagaatgtctctgagttccaaggaaattattgttgatatagattgcaatgaaaagaatcagatacataaatccaatttagataatgatggagttcagtgtacattaagaattgcttggggctgggcacagtggctcatgcctttaatcgcagcactttgggaggccaaggtaggcagatcacttgagcccaggagtttgagacctgcctgcacaacgttgcaaaaccctgtctctacaaaaaatacaaaaaattagctgtgcatggtggtgttgtgcctgtagtcccaactacttgggaggtgggaggatcactcgagaccagaaaaatcaaagctgcagtgagctgagatcctaccattgcactccagcctgggcaacaagtgagaccctgtttaaaaaaaaaaaaaacaactctgggtggcaaaggcaggcagatcactttaggtcaggagttcaagaccagcctggccaacacagtgaaaccccatctctaccaaaaaataccaaaattagctaggtatggtggcacatgcctagtcccagctactctggaggttgacatgggagaatcgtttgaacccaggaggcagaagttgcagccagccaagatcatggtgccactgcactccagcttgggagacagagttagaccccgtctcaaaaaaaaaaaaaaaaaaaaggcagcgggggaggggatgacttggtttcttgctctgattgaaatgaactaccagcacccttgacaattaagttattccttggacagcaaatcttaaatcatcattctatataccaataaggacagtcttgtaataattgtgtccagaacatttgatctctaagattagaaagccttctttgtagtctcgtcttatagaggagaattacatttaaaaacagaatgtaaacacaaagacattatcagggcagttttacatgttaacaggataaccctatacagtgactctgaaaatccaaaagttcacaattaaccaatatcaaatgggcactggagtcagatgtgacaactggatctgaaagctgattctgctacaggatcttggataggtttcttaaatataaagggcctcatctgtaagatggaaatgaatgctgcatcacagagtgattaagtgatcaaatgagacaatgtgattattttattactttaaataaaaccaaggcaaataatcatagatattttacctgcttccattgagtgtaacaaactatagaccctcaatgtataagccatacaaggaagtgaggaatatgctaaaaatcaggatactattccaagctgatccatttactgacatattataaggtatgaacatacttaaaattatctagattccaactcattatacacatgttgttctctcaaaataatcttacatttcagagggtatctacaagctttattttaacataagacagacatggcaaaagtaactccaagtgtgatgtatatgaggaaaaatgcaggaggctaacctagtctgggagtaggagaggaccagaggagttcctaaaaaagtcaagtttatgctgagatctgaatgatgcataggagggaagttctgggataatattacttatatactggaagcagtagcaaataactgagaattcaaaatgtttctcctgtctcccacctctggggaataacatttaaataataatcttgcttttaatagctatagttaaaacaagagttagatttatatcctactatagaaatgtacagatcttttccagcctaacagtttattatgatgattattattatgattattattattattatcattttgagatggaatctcattctgtcaccaaggctggagtgcagtggcagtgatcttggctcacctcaacctctgcctcctaggttcaagcgattctcatgcctcagcctcctgagctgtagctgggattagagacgcatgccaccacaaccgactaatttttgtatttttagtagagaccaagtttcgccatgttggccatgctggtctcgaactcctagcctcaaatgatccacccgcctcagcctcccaaaagtgctgggattacaggcatgagccaccgtgcccagcctggtttgcctggtttattattcttaatttatcaagataaaacttagtttaatagagcagacagaagttatgtgaccagttttgtgccaccattccaacataaaatgctgttcctccatcacagaaaagccatagattttatatattaatagatttaagaaaacagttcatggatatattcacataaacataaaatgtgaataggtagtattagatacaaaataccaatagttaatatgtgttatttattatagtatttgcattatcattaataacaatgaatacttaataattactaatgcattttgtgcattgtttcagttaatacttataacaatcccatacagcaaggtcagttactattcccactttataaatgaagaaatatttttaaagttaggtaacttgctcaggccacagggattcatactcagaactgactccaaagttcattctcttaatagctatattctactcctgactgtgtaggaggagcatatgaatgaaagtgccagtcctctttggaaccactatgactcatgataagtggatctatttgtatttatttttagtctaccttacatataacatataattccagttcagggaatgcattacctactacatcttctaagtgaagtcatgtcagtattcattaaaaacaaatatttaagtagttatttttgtatatatgtatatatgtattttaaataaaggtacaaaggtataaaacctgtaaaaatacctaaattgtgccattgtgcaatcaaaagaaatccattgagattaaatatatttcttatctgtaatccttcatttgtatagcctgatcagaagaaggctgctaaatcagtgaggctgagccagcaactaaaatgctggcaatttaaggctttctctggaaacacagaactctagctccagacatgtcatacgtgtcaagcattcacaggcactgtcctgtactaaatgctgattcatctcattcctctgatatttaccttgcttctcttattaatgtaaataaattctgacccaataaaagagtcacaatatcttgaaaagctgtgtgctctatattcttctttggcaaggtatacacatctgaacgaatggcaacaaaataacaccatctacttcatatggttgctatgtggattaaatgtgattaaagcatgcaaagtgttgggacaaagtctggcacatagactgctttatgatttccagctgctgtagctatcattgttagtattagtcacatgatttttttgtgtgtatcctgttaccatttcatgatatcctaagaagttactatgcaacagccatgtgtgcagaaagaacactggattagagatcagagcggttcaggaggtttgacatgattgctgaataaaaatgggcaaactctttgaacacgttttgtaaaatcttatttgtaaaatgagggctaacatcatctaccttatacggtcatgagggggattatagtaaaggtgacatgaatggtaaagcactttttaaacaacaaagaaatacataaatacctaaggtattatgattatttgatgtacaaatgcaggtgcacaggtatttaaaaagcaaaatagaattgtcattaatttatagtcacatgtcctgccctcatttcaggactgtatatagtccataagttcagggatctgccttatagaaaaatgcttatctatagctactataatatttatttagtaaaactgactgatgttcacaaatataaacttacctttactattgttttagggcgttttttaaaaaatagttttggcttttccaccacaggaagaggtggaagttttttaagctcctgtaagacggtggtcgcagcgcgcttcttggagagttttttgctatttccttctccttctgcagagaactctcctactgacactcgagtaacaaagcttttcatatgtggtggtccactttctttaataacctattaaatacaagtaaaatattaaataatggataggcacttgagatgtattcttaaagtatgacttaatattcatatcaaaaccaaaattagtattatgccaaaattatagtatttctttaagaaagctattatgaaggtattatactgggactatttatgacacttgatgcttaatgcaattgaaacaaaagaaatctaaataaacacatttgattcatagtcaaaatgatttattactttaaaacagatcattctaattacagtttctccatgtcttatggaacacaaatttaagaacatcaaagataccattagattagataccatattagattggtcatctagaatgataatttgtatataattacatacctaacttcctcctatgtacgagtaagttgctggagaaacgagtagttctataaaccacaaggcactgtgcctgtggaagcctctcaaaaacagtcaatggataaaaataagctgtttttgatagggatgtcaaaagctgttttacagaaagggatatttattcttgtgacacgattttaaaaaggtaagtaggtatgccaaaaaaattcctagctttctagagtaatgagttatggacctgtcaactatgaatgtaatgttcctaaaccttgtttaatctgcaatactaaatatttaacctttaattgttcacattagatcatcattataaacatcagatatcctacatcataatatattgatgttcccaagaacacctaagaataataaaactgtctgttcttactcattgtagcctttaaaaaaaatcccaataattttttagtataagcaattactttttacaggttttccaaattttccgtatcatttcttgctggaccaataggatctcaagtacattctctccctgacttcctcattttgctgcttttaacaagctgtggaccgagaactgagataatgcaacttgtaagaatgtgtccaagagaaagcaaacagtttctcagtccaactcagatgatcctgccaatgagtaagatgtgggagctttctagtaggtgaatgtcatacaatgtgagggaagaatctccacaactctttcagcttatttcctggttcttgtctactttccagacatgagttgtaaaattagtgacctcttaataaaagaagtattataataattatttttttaagttttcttttttgaaatttcatacaattttatgaatatatttgcaatatatttatctagctgttaagtcaagagttgcttcattacatcttacttcttggtgattttgttagttgaggttaaagtgaaacatattttggcctccacacaattgaaaaaaaaattggatattaacatgtatgtcactaaatcttaacttgaataaatttaatttaatcctatttaaaatgccaaatcttataggataccacaaattatctatacccagaaaataacttttataataaaaattgaaataccatgtatacaaaaggcttaatacagaaaagaaaaaaatcagaaggaatctgtgttatcatcatgatttctattttcaccagggcctagatcatttcataatactgggtttgaacatatagaagcacactaactcttgcaggatactaatacaccagttaatttgatttgtttgtttaaaataaccacagcaagggaaaaaatgggaagatctctaccgagtacatacctcaaaactgacaggcatatttcgcttcagagcaatttcaaacactaagctgatctcagacttatttgcatctttgtcatcatccacatcctttcctgattcaccattctaaatcacaaaaaataggataacactgaatcttgacattataacaaactttacttttattctacagtcaagatggcctatttaaattacaagaagaaacaacaaactatatagactgtatctgctgcattctcctgtaaccacagcggtcaagggctttgctgccaggctttttgttactcgatttttagcttgttttccttgaaggaaaagcatttaatgcagactttggaaatcttttactcaaccatacactaatttgagtttagcctacatccctaaacctggcactcttgttttagagttctctacccacccaacccccaacacccaggaattcccccactggtgttctaatgtgatctatgaggatgaagttacagaaagagtacaggatgcaaaccaggagcatcctaattggagatctatgtctggcacaggcattggtttactttattcacttatttaacacatacttctggaaggcctcatatatgctgaacttactataactattagaaagagacagtattccttgctgtcaagaactgggagagaatgatctagtgggaaaacagatcaagaaatagataggagctctcatgaaagagtacaagcagaaaaacacctaagtctgccattaagataaatatcaaaggagaaagaaacaattggtttggggaaaggaaaactgtagaggttgaactgtagggtaagtaagaagctcactatgctgccgggcatggtggctcacgcctgtaatcccagcattttaggaggccgaggcaggcaaatcacgaggtcaagagatcgagaacatcctggttaacacagtgaaaccccatctctgctaaaaatacaaaaaattagctgggcgtggtagcatgagcctatggtcccagctactcaagaggctgaggcaggagaatcgcttgaacccgggaggcagaggttgcagtgagctgagatcctgccactgcattccagcctgggcaacagagcgaggctccatctcaaaaaaaaaaggaagctcactatgctatgtataggacatgcctgagctagagatactattttgaagtcaatcaagaaagtagctgaagccatgagaatgagtgagattacttaagaacagcctcaatgtcatttgtaaaacaaaagaggactgaaaaatccataaaatctcttccactttaaatccttgattctagattcacacaatgtaatctatattcaataaacatagtatgaaatataagccaaatcaatgttatttctcatcctcatatacatccccaaatccccagttgcctgggaagtgaactcaagggaagaaccaaagctctgaaaggtagtcaccctgcaggaacacatgaagcaagactgtcaggtcttcactctagtattcttccctatcagaacagattatttattttaattataaaatgctctgatttgtttcactgggaaagtagaaagaacagactgtcacatgcagcagcaccacacctgaggagatctttctggaataggttcattctgcagtgcttggagggctttcattgcagcattgtgtctagcagcttgtcgagtctttccttccccaaaaaattcattatttcctacagtgagctgaacataaaagatcttaggcactgggcaatgatacctaaaataagaaaataaaaacattaaagttagcttaataaaaccactctataatcattcataagatttgtttaaaatgataccaattatataatgtgctatactcttaataaaactttaacctcaaaaacatacttttttgataaaatgtgagtcaatacatctatagataatagcttatactgatctccatgaaaaacatatatagaatacaacattaaacataaaacaatacagtaaaaattatttaattatatcacaggatacttcctggtgagaagttttcggtcagattttgacagaagtaagagaacagtctgatgaagctacaacagaggctgggtcaggcaagactgttcaggcgacaacatgtagattaccgtgctttttgcagaagataattacgattagaaatatagattagaaatggaccgactacaatgcaaagtaataaggagagcagattcagcataagaataaggagtttaggccagttcttaagcaggaagtgttatattcatacattttacggtgcctgaggtaatgaggctaatgaggtgtgactaaaaagctgcaataatgcagatatgaagagataacagagaatgtaagaagaaacaaaaaaaccaaaagaaattaagcagaaaaaattaagatatgtaataaaatccattaattcaacaattatttatggagcgtcttctatttgacaggggactatgacaatgaacaacaacacttagagtggggaagataaacaataagaaaaatatgtagaatacctagtatgttagatgtagatgtaagaaaaagtaaagaggaaagggttcagaagtgtcagggaggtaggttttagatagggtggccaagagaagtttcattgagaaaatatcaattgtgtaaagacatgaaataagttagggaacaagccatgcagatctctgggacagtgcatctgaagcagagagtataccagcagcaagggcagcgaggcgggagtgtgccacacatgttcaagtaactcggaggaagcctgtctggcaaaagtttagggagacaggaaaagctagatgagaagaggtggcaagattccatagggccttccctacaaattgctgtaggcatttttaacccaagtgaaatgaccagccactggaaggttctgcacagagaagtgacaaaatctgacttatctcttggaataaccatctgactactattttgaggacacactgtaggggaacaatgctggaagcaaggatatctaataggctactgggataatcaaggggaaaggtgacagtggcctgaactagggtgtagcaatggaagtaacgagaagtcattgtttctagatgaattttgaaagtagagatgatgggtttacccaaagactggctatggaatatgagaggggagtcagggatgacatcacggtttcggaactaaacaactggaaaatggagtacccatctattgagacagtgaagattgcaaaagaaatgggtttgctgggggtggatttcaacagctctgttttggggatattcaattattagacctattagatatccaagtgtagatgtcaactggacaactgaatttattagtctggacttcaggaaagaggtccaagatagaaataatatttgggaatcatcagtatataggtggtatttaaaggcataatataatgagaactctgtgggagggtgtgatgggagaaaagccaagcaagcacgatgtccttcctgaaagtcaaacaggaaaaaagtctatcaaggagaagggagggattaactggatctaatgctactaacaggtcaagtaaaatgatgactgagaaatatgaccactgaattgagcaacttagcaaaataaacagaatcgattttgatggaatggtggatttacaactgcaatgctgaaaaaaatgagttaaaaatcactccagtcctaaaaaatgtttgtttccaagcaaaaagaagtccaattgaggtcctactatattttagataattactgcacatccaagtagtgacgctctatgtccaacctgagataaactggatagagcgcatcatgtaagcattcaccaggcagatgggactaatcaatgaaggtttactgaaggtgaagaactagaaatgttgattggtactgaagatgcagatttgtgaggcaataattgaaaccatgcaagtggataagcacctggaaagggtaagtgtaaaggaatcaaaaaagagcctaaggctcggaactgattaatgcctgtgatcaaagtgcaagggaaacaatagacagcagtgaaagagatgaaaaagggtcaaagttagaagaaaaattacaacacaatgtcagggacaggagtaattaacagtgtcaaatgaaggagaggaattcagagtatgaaaaaaaagaaaaagttgctgttttaaatgcttaacctaaaatcaattttcttgaactacagttttctattaatttaagataacgcattttaaatgtttttattataaacaaagattaaaaagcattaaaaaactataatcttttttgctttttggttacaacaattaaatattgtgtactgaagtgcacaatttcctatcatctattttattttaatccctttaatgcagaaatttattttaattccttaatgcagaaatctgacagactaatatgaataacgccggtcatcttcacttcatatttctcaaaattcaattttcccacctccacataactttgtttatttttaactggtggtactataaaactttaaaacagacaacttgaaatcagaaatttactcctgaagtgagatctcatatggcaaactttcaccatagagcaaatgtttacaattaattataaacttctgaaaatagaaggtccacaactgaaatgctaacagacctttaactacagtagagggagtgggcgccactataatcactaaggcctgctgacaattacaaaactcattttggtttgccacagagacaaacaaaatttctgttcattgtaactttactggaatatgatgtcataacacataaccatactgaaacaatctgctgattttctggccaaaatattaattgcacaccaaagagcccttggggcctctccctttttggtcatcaaatatggctcaatgtatgtgtatgtgcatgcatgtggatatatatgtatatataaattatattgtgtaagtatcagaggaaaaattaagtatgttgcatttttaacataaaaggtaaaaattctagcactaacaacaggaaataccaagactggatgcctgacttatttcattctgtttcacttcatcctcttacttaacaatgattcttaataatataccccacatggtttgaataccttatatatcacatctcctcataccatcatgacaatcaagattagccagagcactctcattaattgcatccagattgaattacaggggagatgatgcagaatggtttttgtgtgataggtctggtctcaaaatacttacttcctttggtaaagaaatacccaaagtttattaattataaagatcgatatgttctatttagtggatttccttctactttcacttatttcaagtattaagctcacttttagtaaggtatttgatatggtttggctgtgtccccactcaaaatctcatcttgaattgtaatccaaattgtaatctccatgtgtcgtgggagggacctggttggaggttaagtgaatcatgggggcggtttcccccatggtattctcatgatagggagtgagttctcacaagatctgacggttttataagcgtctggcatttcccctgctggcattcatttcctctcctgctgtcctgtgaagaggtgccttctgccatcctgaggcctccccagccatgcagaactgtcagtcaattaaacctcttttctttataaatcacccagttcagtctcgggtatttcttcacagcaacatgagatcagactaacacagtaggtataataagtgatgtacatatttttacaaattagtatatttacctaagcagacatagctattcttgaatgatttttctcaagtagaattctgtggtcaatgtttagatccccataatgattactgttaaaagatgaaccacgaaaactcccccatccaagttatttaagtttcagggtcaaatggttgcatttcttttaaatcccaaaaaagtcttgggatttgaaagatcctactttcatcagaattatcttccatgcttgttaaaaatgaagattcctgtgatccaagcctgatctgctgcatcagagtttctgaggatggaaccataattttaagctgccctgctgactctctgcacgataaaggtccaggattatcaccacatcccacaatgtggcccatgtgacttggcaattgcttcagagtccattcaaggagaccacacacaatgcttactgcacaatggttaggtctttctctcttttttttttttttttttttcctgagacgaagtctcgctctgctgcccaggctagagtgcagtggctagatctcggctccccgcaagctccgcctcccgggttctcgccattctcctgcctcagcctcccgagtagctgggactacaggcgcccgccaccatgcccagctaattttttttttttttttttttttgagacggagtctcgctgtcgcccaggctggaatgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcactgtgttagccaggatcgtctcaatctccgaccttgtgatccgcccgcctcggcctctcaaagtgctgagattacgggcgtgagccaccacgcctggccaggtctttcatatctctttttcatttaatcctcactacagcctggtgaggcaggagatgtccccaaggtcaccttaagaggtaacaaatgtccccaaaagagttgctgggaaccaaatttaagtctgcctaactgcagagtccaggaaattccgtatggagcttcctaaaaatctgctttatcttcttccatttttgttaatttttgtttattaaattgtctatcttcatggaaggccagagaacctaatgcaagggatctaaagtaaggcccactgatagacttcagagatgttttattgagtgaatggctgctgaaacaaacagacaaccatgatgaaacactgtgtttctgcagcatgtcagatcaaatagacacaagtgcatgacgtaaaatcaaagtgaaacatcaaaatgaacagcgttgtgtgccacattacttaacagactaaatctgacaaatgctgcttgcaaggcctttttatccccatgtctccttgccttctaactgctggaagtcttgcaaaaaataaataaaattgtaaataaaataaaatagaatcttcctttcctttagatcccaaacaagtcttgagattcagcctatcttcaagataccacaagtcaatacaacagtaagaaagaatgtatactggttcctttgatttaatacttgatattccttacagtttttttgagtaaaggaaagattttacattcacttatatctgactgttagttgtagcaactttttataccacatatccttgccaacctccctaaagttacttcatttaatgccctctttatggactcattttgtattatctttctaaacaactaaaatcccgtatgtcctccctaccattctgtgactgttttattctccaacatctccactttcctgagtatcatttttacaaggtgagaaagacatatcccaaataacattaggatttttacaaattgaaaaataattacctcattctatttgatagcattattcataaatctcaacacagcttaaacattcatatctcccctacagacttacatcttaaaatatatgaaaatgctatcttccgatctaataaggagaggctttggatttctgtgtttatttctaacattgactggaaacagaaatgtcacttaacctttctatctcagtttacttatctacaaaatatttgtagaatttatgtttaaaggaccctaaaggccaaaactaagaattcaaatgacatgtcgattattttgactctttgtacactttttggcactgctaagcattctttttcttgctgtagaaaaacagcaggtttttatcatagagctataaaatagtccttggcacattttcaaacttgtatgtatataaaatatctagatagaagacagttctttctctattcatatctacaaattttgaaaaatatatcttttatgagatctaactgttaattcttgaggaatttcaaatattaggactgattagaaaagattcacaggtcagatgaaaatatgctttaaaagaggtgtatggatattctatttgtagaattactgtaagtatgttttaaatgcctagaggaaatatagaaagatatgcactaaaagctaggatagggtgttttgaaatgatagcattataaatgatgttctttcctctcataatttcaagttttaaaaaataatacggtacactagaataaaaatggaaaaaaaaatacttaattgaaggaagtctagtccctatccaaacaaaggtaaatctgtgtttgaaattaaatttgataaactagtggaatgatttatggaatacagaacacaaatcaagagaataagtaacttgtactgtatcactgacagtagtgccataatcaggactatgcaaagcacagcacgttatcaaagagccccattattgtaaacacacaatcaccaccctcaatctcatacttggaaccaacataaacttgttcttgccccttctctaaatggatatatagataaatcattatcacatcaccattatcataattagagctaaaacatacaaagcacttactatgtgccaggcactattccaagcatttagatactaatctcactgaatcctcacaaccccacttcattttacagatgaggaaactgaagaatagagatattcactaaccttcccagggccacccgacttgagctcacatttgagcccaggcagtctcactccagaacccatgctcataactgctataccatgctgcctctgaatgaactggatagatgaacactataaactgcagaagtactaactataaactctgaagaagtcatgctggactgggaatatcaaagcaacttaagtctctctagatgtatgagatctggcagattctgaagatctctgtacgccaaaagtcaggtgcaggatatcagctgccaaaggcaatgatggggacactgtaagtctagaagaccaagttgactgcaaagtcctatttcctctctgctcattttttgtctcctcttaacccacccatctggagcccaggtttaaatgttctcattagggaaatgcaaatccaaaccacaataagacactacttcacacacccactaggatggctatagtttaaaaaaaaaaagtcataaagacatggcaaattggaaccctcatacattctggtgggaatgtaaaatggtgcagttgctatggaaaatagtttaccagttcctcaaaaaattaaaagcagaattaccacttgacccagcagtttcacttctaaatatatacccaagagaaatgaaaactggggttcaaacaaaaactcgtaggtaaatgtttacagcagcattattcctaatagtcagaaagtggaaataacccaaatgtcccgatgaataaataaaatgtggtatgtccccacaatggagtgttttacagtcgtacaaaggaatgaagtataattacatgctacaacataaacgaacttacattatgctaagtgaaagaagctagatacaaaagagtatatactctatgattccatttagacaaaatatccagaataggcaaacccatagagacagaaagtagattagtggttgccaggagctgggaggatggagtttgaggagtaactgttaacaggtatggggtttcttttaggagtgatagatatgttttgaaattagaccacggtgatggctgtacaacactgtgaatgtactaaatgcacaatgaattgtatactttaaaatagttaatcttgtgttacgtaaattttatttcaatacaaatcatttttttaaaaaatgttgatactccctagggttctattttgtttctcactgacaagacagtttttgtaggtgatctcacctactctcattcacattcttggcagactcccacaaactagcctaccaaattttgtaaagggaagtgtaaaagacctcccttttgcactctaggatgttactgacctggtcttcttcctactcttgtctaattgctaggggggtatgtgaattacattaataattcaacatatacttattaaaggcctacttcatgctgggatggagttttagtttctagagatggaggactgccctcaggaaactatcaatcaagtaagtacacatacacacacacacacacacacacacacacagacacatacacatcaacaaatgagatgagctaggaagaaaaataaagcatggtatagaaaaagattaacaggggctcctttaggaggtgacatttgaacacagatttgaataaagtgagaattctaggcatggaaatgccagaaagaaaaagtgctctaagcaaataagacagcaagtgcaaaggccctgcagaaataacatgttggttggtccatttttgagaaagggcaagtgttccttgtacctgacaagccctgagtcaaggaatgattagtaggaaactaggtctgagaagtcaccaggcagcaaatcagaacttaattccacatgatggaagccactggaaagttttaagcaggaaagtggcacaatctgacatgatttaaaaggatcttgttgctatttacccgaggagaggcaagaagagaataggtgacaagccattccatagtgcaggaaaagtcatctctaaaaataggagactgaactgctcaagaaaatataggattgcaggcagtgctacaatttcacttaaggattgtggtcattatatcaaggtggactagtcagcatagatgtttttctgtagcttcctaggagcaactgcagcagagtcagaggagctggaattaaccagttacagttttgccaagcatcgctgctcattccaactgggaggcagtagaacacacaggaattaggtagccataggactagtgaaaaatgggtgatcaactctagtgaaaagcagccacgctgaatctggcaggtgaggaaagggtgcacccagcctggaggttctgctcaaagtcttcaggtgctaaaggacaccaccctatttcttgccctcctggtggtcagacagtgtgtggcagaagcagtaagatgtgcctcccctgtggtggctgacaagcaaagcagtgctggaagtgttcctactttgcaactgtgaagaagggtccctggcaaggcgatctgggggcctcttcttccagtgtgctgccactgtgttcccctgggtgctgcagcaggcctgtctgagaggtaaatggctagcactgtggaaaccagcagaattgtggagtgatgctgcaggaatacggcggggggggggggggaggggggggcaggagggcgggttccctggagtagtatttctcaagtgggtcccacatagaaaacactggagtcttcctaatggggtctagaaacacttgctaaaaagcagattcagggctgaccaaagggattcaggatggagtccaggaatgcgcacattacctaacagcctaggtggtttgcacacatgctacagattgagaagggcctcgtcacaggggccttcttccctgtttgtgaatacaaaggcttctgattcctgaatatcaactttgtactcatctgccttacagagtgctcttcctgtctttaatgggattttagttaattctctcaccatttgtttcataagaaaaaattaggattttcctattatttccagaatttgtttttcctatttatttccacaatttattttgctaattttgttgatccaaacttccaaaagaatactaaatagcagctgataaagaatattcttatttcttacttgaatgggaacacggctagtaaatactcattaaaccttgttaaaaaaaaaaaaaaaacactgacagtgtggacagaggaaaatatttttaggtttagaataagatctactggatttaagttccagctactagatctataaagactttgggcaagaagccttatgttctctaagagccatcagtaataagaacaattttgtctgtatcaactttcagctttattcaagtgacaaaccagttgaaaattattatacttttcatgaaatatagcatatctgtgtactgagggacaattttcaaatagatatatatgttcacacatatactctgcagttcaaaaacatacaattttttttaaaatgtaagttttttttttttgaaacagggtctcgttctgtcacccaggctggagtgcagagcatgattatggttaactgcggcctcaacctgctgggctcaagcaatcctcccatctcagtctctcaagtagctgggaccacaagcatgtgccatcatgcctggctaattttttttttttgtagagacaggcactccctatgttgcctaggctggtcttgaattcctgggctaaagcaatcctcccaactcgggcgcccaaagtgctgagattataggcatgagtcactgtgcccagccacttttaacttttcaatatatattcactaaatactgcatgctagtaatctaatagcagaatcttacgtactaaaaacttatggaaaatatggcttattgtttctttgagttgtaagaatattcctattatttaattccagcagcagatatcatctttggttaagggttctctgagaatgcactttgaaaacaactagtgtagaaaatctctcaagtccttcccaccaacaaaaggattcacgaaacgagctctagaaaatacttataaaacttctatctctccattaagtccacaagcatatgtttttgaaaagtttgttagaagtataaaaagcatgaaagtataaaagatacaaacatactggattttttaaaagagggtttacactctttttcgataaattaattttataatgtctataataaaagattcaaatggatgattacgtttgcactaaaatcttccaagaagtttaaaaactgtttgctttattacaacgtccagcccaggcatctactccagtgcttttgctgatcagaattaactatcaactttggatgtttgcccacttcacatactcccaaaagtaacatggagacattacatcagcggtattgcagaaagattaatgtgctttgtttggagatgcaaactaattatacttactgcatacttctagtattctgtctctttcactcaaatctaaatgaatttagtcatacatttgcatacagtttaatgataacaataatgtatagttaatagatactcactggaacagaaaaaatttacttggcattttcccagctaattgtttttacagcttgacttcactttatacattaggtgcattcataaaaaggtttacataaagcaaatattttcatactaaatcccattttcccactgttgcccaatattaaatcttgagttatatttctacaggaaaatgctggctccaacacatcataaaaattataattaaaaatctaaacatacatgccaaggaataggtatgtttaatacattattttacaaaacactttatcctctcacctgcgataagaattaatctaaaagataatcattttgtttcatagtctcacaatcattagaaggacacgtatgttttaaaaaaattgcagggttttaaagtagcttcgtagaaactaaaagtagaaatataatttattagctggaactgccacatggagatctcctgtcagattttaggcaatgcaaatagtctcagattattgacagtaatcatttaagggtcttagaaatttcttcggctatgagtaacacactttggggggttcattacaatccaaaccagatgatttactggaattatacagatgctctggagccaataccactgtctgactcgaagcccacttttcttttttgaggcagggtctccctctgtcacccaggctgaagtgtagtcgtgcgattatgcctcactgcagcctcaactttcaaggctcaagcaatcctcccaagtaacaggaaccacaggcgtgcactaccacacttggctaatttttttttatttttatgttttatagagatgcttttcaaagaaataggaaaatgaactttgctcaactacctggatcctttcatactgtttaatattaaaagtgtaaaaaaagcaacatttgctaaaatagtacagtacttggaactttaagaaaactcttccacttttaaagtaccttggattaacgttaaacaatttataattttcagtcattttaaattaatttgtaaaatttttcctgcacaaatcctctggggaatgcactatgtggatttcaattacctatgctctccttttcctgcattgctgcagatacgcaaggtatgcttttacatcggttagtcagtgtgaactgtctcttattccaggatgcacactaagctgagaactatccaatcctctttatctttgccatgtaccctgaggtaaaacacagcaacaaataagggagatgatattggtagagacaatattgatatccagtctgactaccacacataggaagaggctgaagtaatacttagagctttgaaaggctaacagttttggcctcgggttatgatggtttactcctgttcacaatacagatacgtgtattttagtcacactaaatacaaagtgtggccaaagacattcttttctgtggacaaaatagtttttgaagatattctgaaataactcagtcatcatgacatcctactattcccaaagagtggatgttgacatgagttagtgtagcatagcagaaaaagcacgagctttgatgacatattactcctgggctggagggccagctcagccctttactagctgtgtcaccctatgcaagatacatgctgtgtcagaacatagtagccccaggaaatcatagttgttggcctctttccctcttgacaactaatccatcagccttctttgatattctacaatgtttctatgaagctgcagcatctctaaagcttttggttattccctgtaaagaatacccttagctgtggttatgctggcagaatctctagactttcatttcacacgctcagtggcacccctagtttcccattagcgcttgtaccatacccgggagaacatcacttcatgcctgtctaggagatctgacatttggttcattggtcactcaagaatgccaatctaggccaggcacagtggctcacacctataatcccagcactttaggaggccaaggcaggaggatcacttgaggccaggagtttgagaccagccttgccaaaatagcaagactgtctctacaaaaaacataaaaaattatctgggcatggtggtacacccttgtagttccagctactcagaagcggaggcaggagcattgcttgagcccaggaattcaagggtacagtgagctcagcatcaaatgtacccttgcggtttgagtaccactgcactccagcctaggcaatagagtgagacctcatctcttaaaaaaaaaaaaaagaggaataaaaaatgaacaccaatgcagttcaaaacaccaagcagtgtgcagaagataagctgataaattcagatactataaaaaccagtagaaatcaactaaataagcctctggaagaatttaatgtaaaataataaataacattactacaatttttaaaaattgtaaaggccatttatttacatgtttggggttctgttctacacagactgttctgtatagactgttctgtgacctgtcagtcaattacagtacaggagtctagtaactcatttatctttaaagaagtgcatcttgaccagagaacatgagaatgtcaacaaatcataaggaaataaataaagcaagttggtcaaggtccttgtaactgaagccaagaaaaagcctgggaaattaatgaataataagctcccaggaaactcaaactgagaaaagcagtaagccatgatgagaataatacctgagatgattaaatatatagtccaaatattactgcctacgatcctaaatcttacccacccgcaaaagagaacagccaaaaagctgaagttgctcatttttatctcaatgagagagaggagggataaggacgaggcaagaaggggggaggagagggagggagggagggaggaagacagagggaggaaaggagagagagacagcacacgaacacgagcaagagaacaagggcaaaaaatacttgctgacagtaggtatgatattaagaatattgtattatattgcattagaaatatagacgattgaaagctgacataaagaactgatttggatttagaaaagatcagaatataagatagttttatttccattttaaaatgagtatgtaaacaactattaagttcagtacattaaaaaaaaaaaaagtcttgctgcctttattgatttggagaaagcctgccacatactcttacaaagacaggatgtcaagcaaaccaataagtcattcaaacccagtgtatataaggttccttaagtatttgaggaatcaacatggagaattctgaaaatctgagacccacatgggagtaaagaaagaatgcatcttaagcaaattttacttattgttctctttgttatcctgaaaaagtcactcaagagaacaaaaaagggtttgcaaataagaccatataatcctatttgcagaggatgacacttcttatgagacttagaaacctgcaatacaatctgagcttataagactgagaactccaaagcaggagagtgatcaagactgacaagagtatgaccatggtgatctctcaggaagctaaaatcaccccagttatgcataagaaattctggccagaaactgaacacttcagagctggtgaactcatgataaaatcaaacagatgaagagctaaacttataatcttagttgtcacttgactcttgtttaatcaaaatgtaattctaatataatcaaaataagtatatcctgttacttctcaaatttagaaaggccagactcccctgcaaatgcttgagaaccctgtattagacctcatagttcctcaacaaagggaaaagtttagagtaaatgatacgcatgctattccaggaatagtgttctaggaaggctacaaaagggacaatttctgcttatacacagggaaaaagggagttgtattcactgcagccctagtgtatggtatccagcatgatacctagcacttaaaaggagtccactacatatctgttaaatgaaggagaggttatagctaacaattactgagtggtttactatatgccggcactgagcatgcagtaactcatctaatcctcacaatagcctgataaggcaaatacatattgttatcatttccattttacagttgaggaaactgaaaaacagagaagataagttgcttggcctaggcggaaccaggtttcaaatgaagatagagtggctccacagcaccccctaacctcaatactacattactatattcctctcaacttaaaagtgaatgattgcaagggagagacaggaccagcaagggccaggttctcagctatgtgggagtaaagcaatcaggactagcagaaggacaagttcaaagtgaaaggatgcatgtgagatctgaatggggaagtgctgggagtgaatgtactttgtgactatagactccaagtacctcttaacattgggcatgatctgaccttgaggcggctacaagatgaggatgggctagatcagtggtttcatctttgcctatataccggaagtacatgaggagctttaaaaaatactgaggacaagtcagtaagaaaaagaccactgaggccaggcacggtggctcatgcttgtaatcccaacactttgggaggccgaggcggctggatcacctgaggccaggagttcaagaccagtctggacaacatggtgaaaccccatttctactaaaaatacaaaaattagccaggcgtggtggtgggtgcctgtaatcccagctactcaggaggctgaggcagaactgcttgatcccaagagacagaagttgcagtgagccgagatcatgccacggaactccagcctgagtgacaaagcgagactccatctcaaaaaaaagaaaaagactactgaatcagcacaaaaactagcacaggttatacacttacagaccacagaaaaggaaatataaatgattttatgcatatgagaagatgtttgacctcattcataatcaaagaaatgcaaattaaaatgccaaagaggtatcattcttcacctaattatattggtaaaaaactccaaaacattcaaaacagcctcgtctctagtctagattattgtaataacctcccaactgctctcttaatcagcaaaacggtttttatttatttatttatttattttttgctcaaaacctgcgttggccggggtgggcggatcacgaggtcaagagattgagaccatcctggtcaacatggtgaaaccccatctccactaaaaatacaaaaattagctgggtgtggtggcacacacctgtaatcccagctccttgggaggctgaggcaggagaatcatttgaacctgggaggcagaagacatagtaagctgagattgcgccactgcactccagcctggcaacagagtgagacaccgtctcaaaaaaacaaaaaataaaaaaacctacattggttttgcatttcattcatagtagccagaatctttacaatggcctacaaggccttacataaatcaggctcccagtcacatctctggcttcttctaccactcacctcttcacttactcttctctagccacactagtctcctttctgctcctcaaactcaccatataagcctccacgttagggcctttacaatggctgatctcctgcttctccctcagacatcctcaaggctcactctctcaccttcttaaagtcttcgctcaaatctcacctctcagcaagacctaattcaaattgtgattcccatccttttactcaaacagggctctattcttcctatataagcacttttcactttctaatctactatacaatgtacttgtatttattttttattttctatctcccccaactagaatgtacacttcatgaggacagaaatgtctgttgatgtactccaagtacccataagaatgtctcaccacgtgtatgtataaagatacattctgcaacactgataacatcagaagattcaaaacaactaaatgtccatgaatacaggactaagaagttaaataaattacagagaaatcacacagtgggatactaaaccgttcttaaataaataaagcagtaaccctatttccagtatggccaagtaaactctcactgaactgattctcctgcaggaaacaataaattctgaacaaactgtaaaaaaacaatcatctaaaggtaccaaaaagtcaatgaaacaggtggacactggaggcaagttaacatctggaaaaaaagaacagcataggatgcatttctctcccttttttttcttttaatagcttgaatttgaaggcaagcccatctattccatgtgaaatagctaaaatgccactggaaaatagtcatactggtttgaagacccagcgataagggctcatattccaaagcccctggaatatggaggaggaaatattagaaataaaaatctgaggccgagggcggtggctcatgcctgtaatcccagcacttttggaggccaaggtgggtggatcatgaggtcaggagtttgagaccagcctggccaatatggtgaaaccccatctctattaaaaatttaaaaattagccaggcatggtggcaggcaactgtaatcccagctactcgggaggctgaggcagaagaattgcttgaacccaggaggcagaggttgcagtgagccgagaccgcgccactgcactccagcttgggcaacagagtaaggctccgtctaaataaataaataaataatctggagagagagggagcttcatattctatgtataaaactgttcgaatctctatctgacccctgaaccacacacacacacacacacacacacacacacacacacacacacccctggaaccaattcaaagaaatttagctacgagattagaatttgaggtgcctgccacccaatgcagaaaagttttgttgagaccccagccaactaactgcctgcctaaaaaatttttttggccaggcatagtggctcacgcctataatcctaacacctttgggaggccaaggcgggaagattgcttgaacccaggagttagagaccaggctgggcaacatagcaaaaccccatatctataaagataagacaacaaaaccccatatctacaaaaaattagctgggcatggcagcatgtgcctatagtcctagctactcaggaggcggaggtggggggatcacctgagcctgggaggtggaggttgcagtgagccaagattgcaccactgcactccagcctgggtgacagagtgagggcctgtctaaaacatacacacacacacatacacacacttcacaggaacataatagaatctaggttctacaacatataattttacaatgtccagaatacaatccaaaattattcaacatatgaaacaggaaaaaatgatccattctcaagagaaaaaaaactgtaagcagaaaactaccctgaaatgaccgagatgttagaattagcagcaaagggccgggtgtggtggctcatgcctgtaatcccagcactttggtaggctggggtgggtgggtcacttgaggctatgagttcgagaccagcctcaccaacatggcaaaatcctgtctctactaaaaatataagaattagccgagtgtggtggcacacagctgtaatcccagctactcaggaggctgaggcatgagaatcgcttgaacctgggaggcagaggttacagtgagccaagatcacaccaccgcactccagcctgggtgacagaggagactctgtattcaaaaaaaaaaaaaaaggaactaacagcaaagttatactatgttcaaagagatcaaagaaaatatgcttttaatgaataaatgtatggagaatttcagcagagaacagtaattataaaaagtagccaaacaaattctagaatatgatattcaaatttaaaattcactggatagacataatagccaaaaggagatgaccaaggaattaagattaatcaacagaaattatactacctaactattagaaaaaaagaagttaaaaaaatgaactgaagcttagggacctgttagacaaaattaaaaataattaaaattaaaaaaaaggtctaacagaaggagaggaggaaaaggggggaacagaaaaatattaaaagacctaagacccaaaaatttcctttggtaaaaggcatatttacatattcaagaagctcagtgaactagattaatataaagaaaaccacacaagatatgttatagtttaactgctaaaagctaaaaagacatattatttatggggagcaacaattcaaatgatggatgacttctcaagagaaaaaatctgaggccaggagacaagtggaacaacatctttaaagtctttataaagtgctgaaagtaaaaaaaaaaaaaaaaaaaaaaaaaaaagaaaagaaaaaaaagaaaaactgtcaactccgaattctatattcaatgaaaatatcttcaaaactgaaggcaaaataaagatgttttcagtaaacaaaaattcagagaaatcattgccagaagacctgcactacaggaaatactaaagggtgttcaaactgaagagaagtaaagccagacagaaatctggatcttcagagaaaacaaaaacaaaaacaaacacaaacacaaaaacaaaacaaaaaaagggaaatgatagatatgtgggcaaataaattcaagacctttttctcttaatttctttaagatatagactaaagcaaaaaatcataacattgtggaagttatgatctatataaatgtaatacaaatgacatctatatatggggtgggagttaaatagacctatatggttgcagggtttctaaaattttcataatcagtttagaaaaaataatgcagcttcttacatactgacatggaatgctgtttaaggtatttttcaaaggaaaaaaaaacagattcggaatactattacagaatgatactttcttaaagtaaatacatatacatatacatatccagagaatatcctgaaaggataatacatgaaactggcaggggcaggggcaaaattgggtaactggaatgcaggggtggcatagtatttacattaatatttgaattttttatattttatactgtataaaataaatacaaaaaattaaatacccacaaaaataaaaaagtaaaggctctgagaacttctacaataagaaaacgtttaaattttccttgatccagcattttacaaacctatatgactataggaaactgactcctctccctttttcaaataatagctatttctatcccaacagtgactgtgtattgcttacaccatattaaaaaacacttatttttttaaatcaattttttactagttgtaccaactaaatctagtaagaatataacccaggtcatttgaaatattcttttttttttttttttttaaaaagagtccatcagagtaacttcaaatataattgcaatttcactggcagtctaataaaattccacccactaaagttctagacttaatattttccaagacattcttaaattcagtcactgtcccatgcttacctgtttttaaaaactcattaggtacctctgttattactgtccaaactgaatgatatcaactatttctgaaaacataaaaaattgcttgttgaacatacaaatgattccataagaagatgccacaatatattttagttgctaaagattaatatgaaatgatcacatgacctgagtcatattcttactagatttagttggtacaagtagtaaaaaattgatttaaaaaaatgtgttttttaatatggtgtaagcaataccagtcagtgttgcaacagaaatagttgattaatatgaaatgatatcaactatttctgaaaacataaaaaactgcttgttgaacatacaaatgattccataagaagatgccacaatatattttagttgctaaagattaatatgaaatataaccattattttgatacaaaaaagaaaaacaaacccacaaattcttgttaaagttcaacagatattatttaaattgtagtatcttgtttttaacaatttaacagtttaatagtgaaaattttttctatgatacattaatttcactggttcgagtttctaaatccacttgaaaattttctttaatagtatattttattcaatttatctttgtacctacactaacaaaggaaaaagaatacaatttgtgaatacccagaaattccttaatcatggagaatgtatacaattgtttctatgctctttgaagggaggacatgatcctagtttcatttgtgctaacaaggagaatttattaccaaaacatctgggagatgaatgagatgctaaaacgaaagacatggaagcctagcaacatattctagtctagctaacccttcctaagaaaaaaagatagtactaatagtaaggtgctaatgagccgtacttggtaccctcatgctcgacaaccttctcagatcactcaggttgaaaataaacttctgtattacaactgaaactaaaaattacactgaaaaggacgtgtttagcaccgtagaggctcctacatatttaaagctacttctttaaaattccatgttttagatgtttgaacaagacatcaataattccattatccttgttctggtttgatattatttttatctctcccaaaccataaaatttgcaaaagaaaaaattcaactgcaaaattattcaatatttggaaacgaaaatttaacaaaccctcttaagaaccaataaaagctatcaaatagaatacaaatagatacataaaattttatacactggtaacagcattcaaatcaaagaggtgaagtattctaagaatatttactccagttgtgttaggaacaaactaaattatgacttcctcgggccaactaaatccagtaagaataacattctgttgctaatatgatcatatgaaataattatttttaaaaagaacttagcctatcaaagtcaacttcaaatataaaaagtgttccccatcaatcaactgtatagaaacaatataaaattattcaagatttattttacaaagatacttctcaaacccaagtgcttcctataataatacacatcatatactgtttactgatcaataggaaaaaagaaaaaaatgaaacaaaattagaataaaatatacaacttctaccagaaaaaaaaagagactagaaccagcagggacaaataagtggaactgattagaagacactgacttaaagaattggttatatataaaacatagcttcctatattggatatacctaaacttataatcccatacactctattattcattaatacagactagaggtccacaaacgttctgaaaagagccaaatagtaaatattttaggctttgcaggccataaggtttctaacacaccttctcaatactgctgttgtattgagaaagcagtcatagacaatacatcaacaaatgagggtggtggtgctccaataaaattttgtttttatggacactgaaatctgaatttcatataatttctacacatcacaaaccaatcttctactaattttttcaatgatttttaaatatacaaccttagatcatgggacatacataaaaagaaagctgtgggctctagactgccaacccctgcctcatctagaaatacatgaaaagtagttactagaaatactttccaaacattctttctaataactgaatatcaataatgttgcatttttactatgccattatttttaccatatgtaagttctaaaacagtataatctgccaaaataatgacggaatcaaagctaagaaagctaaaatgaagtattcttaatatttcaaagccacaaaaaagaagcaataaaaaaaacagaaaagtgttgtttcattacacattcctaggtcataaatttcacgtagacttaaactaactctatataatacttgcccactgagtgatacaaagttattagttatattatgccaaatttagaatttcattaattccaaatgtaatatagtattaaaatgtggccaaaagaatcctggagcctgggtgacatggtgaaacctcgtctctacaaaagacacaaaaattagccaggcatagtggcccttggaccacctggtctatattaacgagctactagggaggctgaggtgggaggatggcttgaccccagaaagtggtggttgcagtgagccaagatggtgccactgcactccagcttgggcaacagaatgagacccctgtcctcctacccttgcaaaaaaaaaaagaatcctggtagtttcatagttaacactgtttcatatggtaatactgaaatgtcttagaaaactcaaaggacaaagttgtgaaaactgtattttaattatagcttaccctttaactagttgttaagatcttcagcaaatcatgtcagccagcatttcctaaagtttgccctgtatccacagatcattcattaatgtaacaggatctatggccaattgagtctgagaaatgctacacattatatacatctctagaagatttataatgtacttaagcagatcataaattctgagaagttccgcagtaaagaaaactgttggtttaatctggtattgtccaaacttaaccactttttgtgtgtcatacttattaacatccaaaaaaacctaaaatttcttaaaacatactttagaaaattttctaatctctagtcgaaatcagataaacatccctttgggttctaaattttagaattctgtgagactaattctaagtggtaattttgtgaaagctgttcaactattaagttcaggtttacaaacctggaacctctggatcaaatgtactcttttatactcccacaacactatgaacttcctctactagagcacttatctttaagtagacatcatttctctaactttctagacttactccttaagtgggagatggaaccatcctagtttcttcaacacttaggagaatgcttggatcactcactaaatgtgtttcggttttggttttgtttctattttattgcaataatctcccacttgatctacccataaccactcttgcctttctcctactgcttctctatgcaaacatggtcaggtctcccccactcaaaaactttcatctttgccaggtgcggtggctcacgcctgtaatcccagcactttatgaggccaaggtgggtggatcatgaggtcaggagatcaagaccatcctggccaacatggtgaaaccccatctctactaaaaatacaaaaattagctgggcgtggtggcatgtgcctgtaatcccagctactcacgaggctgaggtaggagaatctcttgaacccgggaggcggaggtcacagtgagccaagatcgcgccactgcactccagcgtggcgacagagcaagactccgtccaaaaataaaaaaaaaaaactttcatcttccactcttctgaaaatgaagaccaaatttcgtaaaatagccctggaggatctagtctctgcctaccctctcctgctttacctcttttatcactgcttttctttattttatctgctttagccatacaaagctaataaagatgaaactagacggcatagagaaaaaagcaaggcaggggcctggggaatgtcagggtaggacagggtggagtgggttggggtgaaatgaaaggcaagactgaaaaggttacattagaccttggcaaatgagagagaacagaaaataaatacctctaaaatgggagtatacctgacttgtttggaaactgcagccagtgtggctggagtgaagttggaacagcagggagcagcaggtgggttagagaagtaataaaggtctgaaaaagcagggctttgtagggtgatgtatatgcaatcaactcccatagttacctctctcatctagatctctcctgagtccagtctcctacatgaaacacatatttgacaactcctcttggatgtcttacagacatgtctatccccgaagtcttaactgcactccaaatctgtttcttctccattctttcccatctcagtaaatggcagtaacctctatccactggcaaaagcaagaatcctaaaaggttctcccactaaatttagaatagacatgaaattccaattaaacatcctccacactaggcagctatagcctttaattaatatagcaaatatggtaaagaccctaatcccatacatacagtactccgttaagtattaccacccagtcacatattacacacatacaagaaggaaatcacttgcatctgagtcccaatcaaggagttcacattcctatgggggcagagactaggtgaagtgggacagtgaatctgcatatcctctgaaatgcccaatgtccatctaagacaaaatggtacctgtacccagagggttagcccaaatagtataatagcttcgagctaagaggtagccatcatggaggaagaggtccttatggcctctgacaatatcaatttaaaaacaggaggtccagtgagcccatcaagcaagatcaacataccatatacctgtacttttatactctaaaaagagatgggaacacagactaggaactactgccgtgtttgaaaatgcccccatgtttgttttctgtgctactgtctgttacttcatagtgactagaaacaaactctacaacaaaaatgacaatacattatggtgtattactacagcagaatactatgtaaatttattaaatagttgtacacttagttacatggaaactcataacacattctgaagtgaaagcatagtatataatttgcataaatagatacactcatataaaatgctacagctgcacctctggtaagccaaaggtttgtatggacttgtcctagaaagcaggaaagtgaggaactaagaaggcaaaatgaaaaattagaaatagattttgaaaagtaagttttacaaacttacctgacaaatttaagagaagtgaaattatacatagtgtattcactgaccacaatggaatcagactaaacatcaataacaaagataacaggaaaaatctccaaacacttggaaactacacttctaaaataatccaggggtcaatgaattaacaagggaaatttttaaactgaacgaaaataaaatacaatatatcaaaatttgtgagatgcagaagtgagaaaaattcataacactaaatacatagatcagaattagccaggtgtgcacctgtagtcctagccactcaggaggctgaagcagaaggatcacttgagcccaggagtttggggctgcagtgaactatgattatgccactgcactccagcctaggcaacagagtaagatcctgtctcttaaaaaaaaaaaaatgttatgaagaatggtctgagaaaaaaaagaaagaaaagacgaaacgtttcaaataaataatctaagcccacacctcaagaacaaagaacaagaaggggaaagtaaatctaaagaaagcagaaggtagtaaatctaagaagagaaatcaataaaactggaaacagaaaaaaactatacataaaagcaattaaacaaaatcttggttctttgaaaaggataataaaactgacaaacttccagcaacactgacaaagaaaaaagaagacacaaatcatcaatatcagaaaagaatcagggattatcactagagatcctgtagacatcaaaagaataagggaatactaagatcaattctacacacagaaatttgacaattagacaaaatgagccaaatcctcaaaaagcacaagctatcacaacttacccaatatgaagatgacttgaaaagccctataagtattcaataaattgaactcatacatttaaaactcctaaaaaagaaaatctccagttgtgggtgttttcaggaagaattctgccaaacttttaaagatgtaatgtctactctataaaatctcttccagaaaacagaagaggagagaatgtctcccaactctttttatgagtacaatagtatcctgatataaaaatcagaaaaagaatgccaaaggggttatggtggggggaactacagacaaatatcgtccatgactatagagacaaaaaaccttaatagaatattagcaagtagaatttagcaacatacataaagaatcttagaccatgaccaagtatcgtttattgcaagcatacaaggctggttcaatgtttaaaattcaatcaatgtaatctatcacattaacaggtcaaaaatgagaaatcatatgatcagttaattgatgcagcaaaacatttaacaaaattcaacacccattcacgataaaaaaaattctcaaaaaactaggaagaagaacatgtccagttggatttaaaatatttactaaaaatctacacctaaaatcagacttaatggtgaaagactgaatgttttgtacatgaagaatgaggcaaggaggtccactcccactactcttacacaacacagtgcttgaagatctagccagtgcaataaggtaagaaatgaaacacgtattagtccgttctcacattgctataaagaaatacctgagaccaggtaaattataagaagagttttaattggcttatggttctgcaggctgtacagggagcattgaggcttctgcttctgggaggcctcaggaaatgtacaatcatggtggaaggcaaaggggaagcaggcacatcttacatggccaaagcaggaggaagagagaaaggagggaggtgctacaattttaaacaaccagatctcatgataagtcactcattatcacgagaacagcaccaaggggatggtgctaaaccattcatgagaaaccatccccatgatccaatcacctcccaccccacccaacctccaacattggtacaattgaatatgagatttgtgtggggacacagatccaaaccttatcaaaatgaaaggcaagcagatcagaaacaaagaaataaaaatgtccctatttaaagatgaaataattgtctgtgtagaaagaaacatatttttaattacctagaactaataagtgaattagcaagtttataggacacaagatcaaaatacaaaaattgaaatgtaggtctacataccagcaataaatgcatggaaggtgaaagtaaaaatacaagaaaagatttactctaaaatttacatggaaaggcaaagaaagcagagtattcaattttgaaaaagaataaagcataagaaaccactctatattattttaacacttattatgtaacttcagtaataacactgtgaggagttggcagagacacagagttcaacagaacgtaatagagaacccagaaacagacccacactagtgtggccaactgtctttacacaaaggtgaaaaagcaattcaatggaggaaggagagctatccaacaaatggtgctgaacaactggataaccacaggcaaaaaaccgaaacaaaaacctttgacctaaacatgacacctgataaaaagaagctaattcaaaatgtacatttaaatgtaaaccataaaacctttaaaagaaaacctaggagaacacctttggggatctagatttggtgaggagatttagacttgatacccaaagcacactcacaaaaaaaactgataaactggacttcatcaaaataaaaaacttctgctctatgaaaaactatgttaagaggatggaaagacaaactatgaacagggagaaaagatttgcaaaccacatatctaacaaaggatttatatctaaaatatatacaaaactctcaaaactcaacagtaaaaaaaaaacaattttatagaaaatgtgcataagacagagatatttcaccaaagacacacagccagacacacacacacacacacacacacacacacacacacgaaaagatgttcaacatccctaaccattatggaaatgtcaaattaaagccataatgatatataactacacatcagaatgaccaaaataaaaatagtgacaaccacaaatgctgtggaggatgagaagaaactgaatctctcatacattcctgattgtgatgccagacagttcagcaactctggaaaatagtgtagcagtttcctagaacactaaacatatatttactacacaactgaggtatcacactcctgtgtatttatcccaaagaaataaacatttatgtccatacaaaacccatacatagatattcacagcagctttatatgtatagctaaaaactgaagaaaaacaaaacatccctcaataggtgaagggttcaacaaactgtggtacacagaacactactcaaaaacatagaatactattcaaaaagtcacatactatgattccatttatgtaatattcttgaaatgacaaaagcatagagatggagaacacattcatggttgccaagggctagagatagtagggtagcagaggtgaagagaagagtagttaagggacaacataaggaagagctttgtggtgacagaataattctgcatcttttttttttttttttggagacagtctcactctgttgcccaggctggagtgcagtggtgtgatcatggctcgtagtagcctcaaattcctggtatcaagcaaccctcccacctcagcctcccaagtagccaggacaacacacatgtaccaccatgtctggctaatttatttttatttttgtagagataggatctcactatgttgcccaggctggtctcacactcctggtctcaagctatctgtcccacctgggcctttcaaaagagctaagattataggcatgagtcaccatgcctggccgagttctgcatcttgtttgctgcagtgcttgcatgaatctacatgtgacaaaatgaaacagaactacaacacatacatttaccaatgtcagtatactggtttgaaatattgtcctacaagtctgtaaaatgtaaccaatgggggagactgagtgcagagtacatgggcttctgtgtgccatttttacaactttcagtgaatctctaattatttctaaataaaaagatttttcaaaaggaagacagaataactaaatcaatagtaattagcagtatctacattctcaagtttccaaatacgtatcttgaaaatttacatcccacatatactatcattcctagtattttcttgaatgattttatttcatggtgatttttattctagaaaaaatacgttctgaagtgaggcttcgagtgttttacttcacagtatccaaaatacccaataacaaaattattttgtaaaatgggtttgagtcttgcagaaatagatttataatccaattctataacttacttcataaatgatactgagcaaattaaacttgagtctctgtttcttcgtaactaaaacagggataaaatatatataccttggagaaccaccacgtctgtgtataaagaaactggcagtgttctacacacagtagactacataacttttactgttatcatcttatctccctgaaggtaacacacattcctatgggcaggaacaatttcatgtatttcccttgaatcaccttactgctgtcagcatggtgataagtatacaaaaaatacccaacatgcaattttctttgaacttttaacttctgccattaaaattaccctttttctttactgtaaatggttatcctctgattttctgaaaagggttaggtttggagtctttcagttgtgtcttgtttttcaaatgcgagttttcttgtttttgttttttagagacacagtctctctctgttacacaggctggagtacagtggtaccatcatagctcactgcagcctcaaacttgttggctcaggcgatcctcctgcctcagcctccctagtagctgggactacaggcctgcaccacatgcccaacttattttttaattttttgtagagactaagtcttgctatgttgcccaggctggtctcaaactcctggcctcaagcaatcctcccaccttgccctcccaaagtgctgggccaccaggccagcctccaataagagctttttgatgaagctaatatgtagtttctaaaggcatcaagccaagaaagagtagttcaatggtgtaatagttcagagatgcaaaacaaagaccgagatttccaaacattctgcacatcccatattcttgtttctaactcagccagttaaaaatatttttttgatatccaataagtggcatttttccaacgtctcatcacttcatacagatcattattcttgcttaccatttaagtaaagacttctatttgtatttaaattgactaacactgctccccattacccctttctcaacacagaggtccaggttgccgaccctgatctttgcaattttctagaaattatctctaaactcacctattcctcattatatttgttccatcacaatagaaattataaaaaagataataccagcccccactctgtaatttggtatcttctctgaagaatttattctactaattcttctcctagttctaaactcctaaaaggaactgtcaagtaactatcaaataggattaacaaactcaactttaatactgctcactaagcttctttctcttacttataaaagtcatattaaaatgtactatgatggacagggcagtttgtatgatattatcatcaatatatcacaacaaaagttccaaacacaacgctttagatgtctttgagaaggttttagatatctttgagagcacactactcaaagatgctcttctatatttaattttttataagttagtatatatgtcttctatataattttatatatatatatatatatatatatatatatatatatatggtgcaaagatagcacagagttcccacacacccttcatctagctttccctaacattagcaactgacaaaaacacagtaacactggtcaaaactggaaactgaacattgatacaacagtattaagtaaatcgcagattttattcaaagattctgtactttttgagtaactggtgacactggacttccagatatgatggggataactgaatatccagatgtcttgggagaatttctattatcattcctaatttaacatggtcccagctgctctatgatgagctttgattctctatgagagcatagagtcatgctaacatagaatcttatgttggatgaaaccttggaaatcatttaaattttttttaagtataaattatgacccattaacaggtcatgaaataaatttaataaaccacaactataattttttaataaaacaaaatagaaaatattagagtataatacagatgttatcgtatcataaattttttgttttagtgatatatgtaaaaatgtatatgtgtgtggatgtaggtatgtatttatatactgggtcacattatttttaaaaattccttagcaaaggtcagagtcaaaaatgttttaaaagtcactcatctatatcaaaccaaagaaagttctctttaatattcctgacaaatgataacccccatctctaactaaacactattaaaggtagaatatttgctacttatacatcagacggtaatacgtattaggacatttttaatgtggaaccaacatttctctgttgacttttgatctacaactcacaaaaagggtgggttttttccttctaaagaaaaatactgtgcaatcctatttctttttttccatcaaattagtgaacagaagttcttacacctagaaatcaaaagttccaaaagaaagtttccttttcagttcccaagaagagactctgaaaataaagggcaataatagaagaacagaaaaatatatatgtaaggactctaaatgggagaatagaagtaatgccaagcaaaaacgtcaagtcgataaaggaacatctttgaggaaatgatataaatattggatcctgcccctggccagccctgcccggccatgcgtccctcctcctccccaccttgtggcgggcagcagccctctagctttggctccgtggactggctctcccaaagcagctgctcagggccgacccacacccccaggcctgccgaggtctccctggggagcctccctggcccggaccaggcatcgggccccgaggagccccctcaggccgtcagcatcaaggaggctaggtcctcaaatctgcctccgccagagagggctatggctgggttgaggaaagggccaaacgcctggcgggccccactgtgtccacacagccttcaccacggagcaggtccgtggcttggagggcatcttccagcaccaccagtacctgggccctctggagtggaagaggctggccagggaaatgcagctgtcggaggtccagataaaaacctggtttcaaaatcgccgcatgaaacacgaacggcaaatgcaggactcccagctgaacagcctcttctcggagtcactgcacgcacccctggctttccactcaccgtcttctggccttgccaatggcctgcacctgctgtgcccttgggcacccctgcctgggccccagactctgatgctgtcccctggctccttctggggtctctgcaagtggaacaagaggccctggcctctgagtgggcctgctgctgtgggcagcctctggcgtaccaccccccaaagcccaggaagtggcatgcatacgctgggaccagccctgtccacggggccctggggcctggtgtgctctgccggagacgggatgcattttgaggaaatgcctctgactccaggcctcccatacaggtctgtgcagattgcacctggcacctacccagagaactcagctgttctgtttacattgtggaggcacctctcaccctgacccacgcaaaggttctggagatttctggagaatatatttattaaagccacctcttcaccaaaagttaccaaaagggttggtttaggaagtaaatgaagggtcagtgtagagtcaaacgcagaagtgggcttgttatagggagggctttcagcatatgataaaagggtaatttgttttttaaaaagtgttggaaaaactggttttccagttggaaaaagtaaaggttgtaggctttgtgtgtaaaaaagaaaaccatgaaggattggaagggggaaaaaaaagaaattatataaataaaattatcaaactcaggcagataatttcatagaagtatgcattacttactagcaaatcttctcattttggaaaatgtttcactttttaatttttttagacacacaaataagaagaaaaacttccacattcaaaagaaagactaaaccatgcacaaatgaaccctttctgtttcctttaacatacaagaaagtgatttcatgaaatttattaaaactgttatttctggccaggcgcggtggctcacgcctgtaatcccagcactttgggaggccaaggcacacagatcacgagatcaggagttccaagaccagcctggccaacatagtgaaaccccatctctactaaaaatacaaaaaaaaaaattagccaggcgtgctggcgggcatgctggcaggcgcctgcaatcccagctactcgggaggctgcggcaggagaatcacttgaacctgggaggtggaagttgcagtgagcagagatcgcgccattgcactccagcctaggtgacagagcaagactctgtcccaaaaaaaaaaaaaaactgttatttctgtccaattccaagcaaccaaagtacttcatgtcattaaatatgtatgtgtaacacacatacacatacatatatacatatagatattcaccaaaccattattcaactatctggccacttcattctactcaaaatgcagatccttagcaaaatttatgacagaaaaaaataaattctgaagtaaaaaaattcaccaactagataaaactcgatgttttccacagttaaggggacatcttagggcgtaattaaagccctgctactcttactttgccccaaattcaaacaataatatcggttttcaagataatagcaattgaaaagcatcaaagaaaggagcaagcaatatgcaaaggtgcactgacaaaaacaagaaataagatgacaatctgactgacaacaatgatttggaaagtaactaaaagcacacttgggtactctagaaacagatgtctaggattatctggtataaggacaaaccatgtacatatctcatgaggcttgtaatacttattgtttataaggttgataatgagtcaacagcaaggattcttcatgctaagaattgtggcattttctatttaaggatataaaaaatatatgccataacttttagaaatatttctatccaaaattactgaactaagtaaagttttaggttccaaaaaaaagtgaaccctcagcaatgtggggaagctagctgtccagaacaattatccttaaggagtgtggttaactgtaattcttcccttcttctttacttctttcaaaagttctatgactattcaaaccatctcataatctttgatgttaatagagggtaatgtgttttgggttgtggggaccagtatttaaatgactggacatagaattacttggggaagttttaaaaaacagtgcggttcaagctctgcaaccagaaattctgatttaattagtccacataaagtctgggcatcagaatttttaaagctgcccaggaaagcctgatgttcagtcagtgttaggaaccacttaggtaaacagttttcttcatgacacctttaggagtcttcaagagagatacagtatgcagcatttccaaaatttgtcttcaaatcccttttaccatggaacatcttataacactgacttaggtaactcttcatctgaaaatcaaggtaaatattaagtttagaatcaagttgtatagcttttcaaactttgtaaaagttctaatgtggttaggaagagggaaggggagggaaaaaataaaaggatgacttacttttatcttgctaccacattttttatattacaaaaattccaaatgaaatattttaattttaacttaaaatttcatagtttattttaatcatgcttatattaagcctgtgactcaaaagcatttacatgttgtgaaagctaatttcaaagataaaaccgtgctgccctctaatggttcaagataaatatttttacctatacatagtagtaaggtgataaatacaattttattattttataaatgggaggattacattatataccagaaaagaaaaataagatttcaatttttggtataactgagcccaaaaacttaactatgactgctatgttcaagctcaagacccttttaactgtccaggcacactggctgacccctgtaatcccaacactttgggaggccaaggcgggaggattgtttgagcccaggagtttgagaccagcctgagcaacatagtgagaccccatctctacaaaaaataaaaaattagccagacatcatggtgtcccaactactagagagactgaggtggaaggatcacttgagaccagaaggtcatggctgcactgagccgtgatcatgccactgtactccagcctagatgacagaacaagattgtctcaaaaaaaaaaaaaaaaaaaaaaaagaactcttttaattatcaaacctttttttttttttttttttttgagacggagtttcgctctgtcgcccaggctggagtgcagtggcacgatctcgactcactgcaagctccgcctcccgggttcacgccattctcctgcctcagcctcctgtgtagctgggactacaggcgcgcgccaccatgcccggctaatttttgtatttttagtagagacggggtttcaccgtgttagccaggatggtctcgatctcctgacctcgtgatctgcccgtctcggcctcccaaagtgatgggattacaggcgtgagccaccgcgcccggcccaaaccatttcttaaaccaccacatttgcctatgcatgtgtaaatcaggataaaaatgtacacctcttctgcattctgcaatagccatctctaacttagcttctttttcaaataaatctatggcagtagtgttcaaacttgaatgcttgtaccctacaaaaacattttagaaagttacacatattcttgcatatttcttcttacagctaaagttttaattcacatttttaaaatttcattaagtacttgcaaaggatgtagtttctaatttactgtaaatatttacattttaaaataaaattatgtcactcttttaagtgtatccaaaaactgaactatcatagcaagctgacatccacctttatctactcaaaaaatacataaattctgttaaatacaacagaaattttacaccagctgtatcttgtttaacttgcattttactgcactctctccatttcatcctaatttcatattttataactaaaagtcttttattcctcattctaccataattctatgcaacaaaaatagatatattaattaaaattataggagtttgtacttccatgtaagttagaaaatattttgtgcaatgagccattattgaaattattagcagataatgaaacaaatattataattttaatacatcttttttttttttttttttttttttttggagacagagtcttgctctgtcgcccaggctggagtgcagtggcgcgatctcggctcactgcaagctccacctcctgggttcacgccattctcctgcctcagcctcccgagtagctgggactacaggtgcctgccaccacacccggctaattttttgtatttttagtagagacagggtttcaccgtgttagccaggatagtctcaatctcctgacctcgtgattcgcccgcctcggcctcccaaagtgctgggattacaggcatgagccactgcgctgggctaatttttttgtatttttagtagagatggggtttcaccgtgttagccaggatggtctcaatctcctgaccttgtgatccgcccgcctcagtctcccgaagtgctgggattacaggcatgagtcaccgtgccaggccacataatttttaaacaaaaagtaaaatattaatggacatgaaactcactgacatttacagagctttttttctttatattgatgtatctaagaaagaatatttcttactgctaaaatgagataagttctcaattctactcttatttcacttatttcaggtataatcactaagaaatgtaattcacattaaaaactaaatcactctgagttttgttataacaaggtcactcaattttttctatgccaaaacacacactgtgatctaccatcagaaattatttttaatgacgtggcaattgatgttaagtcctctcacaatttgctgaaagcaagtaaccagaaactacctgacttacaaaggatgcattacacatttgctacaattattcagattctccatttctgggaaatattccaaaacagtattactatgacttatcaaatgattatgaattatacctgctattgtttcccttagcagtttaattttatatagtccaaaagggtagaaaacatcaaaatattgttaattccaatatccttttgctgaaataacatttgttttataaaatgttttgatcttatcatacacttcaaatatattttacccaaatggtagagctgcaaacagctcatttaatttatggtaaacacccgctgtcaaccaaatgccaaatcaaaatctgcctttatttctcaactcaaatacatttcaggcttaaacaaaaaagattttaaatttgtctcataaaacaaggcccaaatatacactacatacaagagacaccaaaaacagagaaaagctaaaaagttgtactagcttaatgaaaacggaaagcagtgattgttatgctgatatcagacaaagcagagttcaagcaaaaaggtattaatggcgaacactaggtattaatgctaaaacctgcaattcttcagtgatatataacagttatgaatacctatgcaccaaataatgcagcagccacctgaagccaaaaactacaggagatgcaaggagatataaacagaagcacacaaatactaagagattttaacacatcactctcagtacaacacagatcaagtggacaaaaaaacatataaaagaccaaagcaacaaactcttacagaagatgttatgctgtatatgtgtgtacatatgatcctccatttgatctcaaagaaagcataaggaagtgccacaaggtggagatattacagtctcaaatcaaaatataacaaactagaaattaataacaaaattttaaaaagcaaagggcccttctacttgaaaaataaaccttttattaagtaatttgtacatgaaagggaaaatacaaactagaaaatcaatactgaaagaataataaaaatactacatagcagaaactatagtacaaatgtaaaacaatggtcgaaggagaattcataaccttcaacagttatagcaataaacgtattcaaatgaatgaattaaattcaacataaatttttagaaggtatatattattactaatttcatattagattttatttgctcatttttttcttctatatttatattggtattagactgcaacttccttttctgtactgtctttaccaggtttaggtgtcaatgacaactttatttgctaaaaagaattcagaggccgggtacagtggttcatgcctgtaatcccagcactttgggaggccgaggtaggcagatcacctgaggtcaggagttcaaaaccagccaggccaaaatagtgaaaccttgtctctactaaaaatacaaaaattagctgggtgtggtggcgcacacctgtaatcccagctactagggaagctgaggcacaaggatcgcttgaacccaggaggcggaggttgcagtgaaccaagattgcaccactgcactccagcttggcgacagagcaacactccattaaaaaaaaaaaatatttaaaaggcacaatagtcacactcagtaacacggggttttaagaactatcttgggggactgggcacggtggctcacgcctgtaatcccagcactctgagaggctgaggtgggcgaatcacctgaggtcaggagttcaagaccagcctgaccaacatggtgaaaccccatctctactaaaaaaaaattaaaaaattagccgggcgtggtggcccacgcctgtagtcccagctacttgggagggtgaggcatgagaatctcttgaacccaggtaggggaagttacagtgagcgaagatcgtgctattgcattccagcctgggcaacagagcaacactccatctcaattaaaaaaaaaaattatcttgggaagttcaccaccatttatcacaatgtttctatgagaaaatacattccaagtttccagtaatcaacataaaaacaaagtttggaacaaggcctatttgatgatcacccaaaatcttacccagaatttattagacacaatattacatttccaagaaattatgttattgcagaaacttctataaacatgtaacataaaccctcattaatagtcaaagcaaatttgttttaaaaaccatacttatgccgggcatggtggctcatgcctgtaatcccagcactttgggagcccgaggcgggtgaatcacgaggtcaggagttcaagaccagcctggccaacatggtgaaaccccgtcttcactacaaatacaaaaattagctgggcatggtggcacgtgcctgtagtcccagctactctggaggctgaggcagaagaatcgcttgaacctgggaggcggaggttgcagtgagccaagatcaagccactgtactccagcctgggcgacagagagaaactccgtctcaaaaaacaacaacaacaacaacaaaaacaacaaaaaaaaaaaaccaaccatacttaaattgctttctaaatccaacggacactaaaacttcacaaaaccttcactgaaaatcagtatttgaagaaaatgcataaaaagtgattgagcattaaggagaaacagctggtggataacgttttttgattcataaaggaaccctccaaaacaaagcagaaaaaaaagcttcaaaagtttttcggaatttttagagcaatgactggcaacctatataaacctttcagaattctgaatactgaaagcccacgtatttatatgtcacatgacatattaaaaagagcttcatggcctagcttggtggctcatgcctgtaatcccagcactttgggaggctgaggcgggcagatcacctgaggtcgggagttcgagaccagcctgaccaacatggagaaaacctgtctctactaaaaacacaaaattagcctggcatggtggcacatgcctgttgtcccagctactcaggaggctgaggcaggagaattgcttgaacccgggaggcggaggttgcagtgagctgagatcgcgccattgcactccagcctgggcaacaagagcgaaactctgtctcaaaaaaagaagagcttcataatttaaactgtcattgtacccagatttttttttaaacacaagtaaataaacattgctaagcaagattttgctcaactgaacaaaaaaataaagatattggtgaaagagcattgcttcaaacacaaaataaaccaagtatttttcagagcttgagcaacagattaataaaactagcctcaaataaaagaatagagaatgctatttatttctccctttctagacaaaagttgttaaaatttttaaataactttaggactagaaagatagaccccttgttgtaaaaacattacgaattcagtattaatcagatttaagtcatggctatattttcctaaataatcgcaacaaacttgaggggagaaaaacttacggtaattatctttttgttgccactttgtttatattcacttttgtagagaataatgcttaaacttttagcataaagaactcaaaaaggatttcaatagcattaaaaaaaagtgaccaaatgaaaatcagactaaggtcaacccaaaattatagacattttttaatttaagaattggctctgtttacttatgcttttgtttttgtctaaaggggatatgaaaaatgttaaacttgtgtgacatatcctgtaatcccagcactttgggaggctgaggtgggcggatcacaaggtcaggagttcaagaccagcctgaccaacatggtgaaaccctgtctctactaaaaacacaaaaattagctgggcatggtggtgcatgcctgtaatcccagctactcaggaggctgaggcaggagaatcacttgaacccgaaggcgaaggctgcagtgagctgagatcgcatcattgcactccagcctgggtgacagagcgagacaccggctcaggaccaagattaagtggtgatccctgggcctgcctggctgcctctaaaaacagaacaaaggagcatggagtcctgaagttctatcatggtaaatgtattaccaagttattagtacttgaatactaactctgtggcaagaaaacagaccagatattccttgggaatgaacgctgagaaagctgaaagaccagcttgaatggctatcaagctagacaaggcagaagaggtatgtgtataaaatgctgcatataattacacaaaggccacagattttccaaagctcatgtttaaatcctaacttaataactcctgatatgcgcagttttctaagggagaaatgattctctgggtaacattattccagggtcaagtaaattttaacacgggccaaaaatatccatatgcaatagagaatcagccattcctcctataaagcatacacccagaaataataacagaatcacagcctgatttaatttttttaattaagcagatgtaaattcttttaaatctcccacagtaacaatgtccagtacaaatacactgatatttagattcttttaaaggaactcaaaacactacagtaaagtaaggtaaagggtcatgcatggtcactgaattactttattaaaacctgaaaacaacactgtaaggaagcgttatttattctcctaacttacaggtgaattaaccgagaattagaagtcgaataacctgctcaaatccacataactatgattccaactccagagtttgtacttgtaactaaacaagctaaaatgcaataaaggctaacaattataataacaatcagtgcacaaaggcagaagctaagcaactgaaccagcctatcattctgtcctcaaacaccctataaggtaaatattattttaacctctagaaaaacatttacaatgtttttggccaaatgcttgagaagcaaaaatctggcgctttcttataaatatttttagcctcaaagaaaatggaggattacaaaatgttattttttaaatcaatgttattgaggtaaaatttacatttaatgaaatgtgcctattttaggctcagagtttgatgaattttgacatacactcatattaacaatcaccaaaatgaaaatacagaacatttctatcacccccaaaactttccttgtataggaaattcccagccccaaatctagacaatcaaagaacctctttctgtcactacggattagtttcgcctattctagaattccacaaaaatagaatcttacagtacctacactatgtatctgtcctgtcttcttttgctcagcatattgtttctgagattcatgcatatcattggatgaatcacaagttttgctgttgaatagtatgccaagtcatggttacattacagtgtaaccatttacctagtggtagatatttgggttgtttccaatttggggctattataaagaaaaatgctacaaactttcatgtataagtctttgaatggccatatattttcatttatcttaggtaaataccacatggaattgctgggtggtaagataagtactacatgcttaacttcataagaacatcataaactctgacaaggtgcctgtaccattttatatccccagcagcaatatatgagacttccagttgccccaccatgacactaggtgttgtcagtctttttaaactttagctatggttttaatttgcatttccctgatgactaatcactttgagcatcttttcatgtgtttattagccattcttatctctattgtctattcaaaaatattgtccatttttgccttattaatgagttgtaggtattcctttatatattctgaagtcctctttcaaatatatgtattacgaatgtttccttctaatatatgtcttgctttttcattttgtaaaaagtgtctttctagtaccagaagtttaaattttgatgacttataatttctcaattttttcatgatccatgtttaaattttgatgacatgtaatttctcaattgttgcatgatccgtgctttttgtgttctaagaaatctttgtctatttccaaagtagcaaagtattttcttctggaaattttactttaacttttacatatatgtctatgacccatttctgatttatttttgtctgtggtgtgaagtcaaggttcaggggtttttgttgttgttgttgttgttgttgttgttgtttttgagacagagtttcactcctgttgccaggctggagtgcaatggcacaatctcagctcaccacaacctctgcctcccgggttcaagcaattctcctgcctcagcctcctgagtagctggggttacaggcatgcgccaccatgccaggctaattttgtatttttagtagagacaggttttctccatgttggtcaggctggtctcgaactcctgacctcaggtaatccacctgcctcagcctcccaaagtgctgggattacaggcatgagccaccgcgcccagcccaggttcttttttttttctgtcagaaaggccaattattttactattatttgttggaaagagtatcctttccccattagcaccttcactggaattaattttgaaagaattaaattgttcatatatggattgatctatttcttgcctccatattccagagatcagcaaacttctgtaaagggcccaatataaaatattttgggctttgcaggccatatgatctattacatctattcgactctgctgttgtaacacaaaagcagactataaataagcaagtatatacaacacataagcaagtgactgtggctgtgttccaatgacactttactgacacacactagaatttcaatttcatctaaatgtcatgtgttgtaaaatatcattttatttttgatgtttttccaaccacttgcaaatgtaaaaaacattacttagcttgcaagccatacaaaaacaggcaagccagacgtgacccatgggctatagtttgccaactgctgttttattctgttccactgatccatatatctgtccctatgttaattttctgctgtcttgattattgtagctttatagcaaatcttgaagtcaggtagtgtgggccagccaattttgttcttttcaaaattgctttggctactgcaaaaacaatttgcagtagccaaattgtttttttgcatctccaaatgtcagcactactttattaattttaccaaaaaaaaaaaaactctactatgatttttgttacaactgcattgcatcttcacatcaactttgagagaactgaaatcttaaataatagagtcttctttaatttgagcagtattttatagccttcattatacaggttgtgtacctattttattaaatttatctctgaatatgttttcacgctatttaattccccaactgctcattactatttactagaaataccactgatttttgtatactaaccttgcaacttgtggccttactaaattcacttattcagtagcttttcagtacttttgatttattattttctacatacagaatcatggtgtctatgaagatagttttatatctcctattccaatattcccccatttgtttcttcttattgttgcacttgatagaactcaagtataatgtggggttctttgttgtttttttgaggtggggtctcactgcgttgcctaggctggaatgcagtggcgatcacagctcactgaagccttgacttcccaggcccaggcaatcctcccacctcagtctcccaagtagctgggactagaggcacacgccaacagagatggggtttggtcatgtttcccaggctggcctcaaactcctaagctcaagcaatctgcccacctcgacctcccaaagtgctgggattacaggcatgagccaccgtaccagtccttaagtataatgttgaacagaagtgataacagtgtgtattactgccttgttcctgatcttacaagtattcagtctttcactataaagcataatgttatctggaggttgtttgaagaagccctttatcagattaagaaagttctcttccattcctagtttgctgagtctatatcattagtgagcgctgacttctgtcaaatgttttttctgcacctaatgagatactgatatggttgttctcctttattctattaattgggttaattactttgattactgaatactaaattcatcttgctttcctagaataaacttcatttaatcataatgttatttaaattcggctgaatttaatttgctgatattttgttaagaatttttatctggctgggcatggtggctcatgcctgtaatcccagcactttgggaggacgaggtgggcagatcacttgaggtctgcagatcaagaccagcctgggcaacatgttgaaaccctgtctctaccaaaaatgcaaaaaattagccaggtgtggtggcatgcgcctgtagtcccaggtactcgggaaattgaggcatgagaatcgctcgaacctgggaagcaaaagttgcagtgagccaagatcaggccactatactccagcctgggcaacagagcaagactgtctcaaaaaataataataataatttttatatctgtgaccatgggggatactgatcttaagttcactcttcctcatccttgctttggtaacttgttcaaattttcttctctggtttatgagagttttaaaaagacatttctaatgcgtctttgttatgggtttaggttaatttctcccaaataaaaaaaaatcctaatttaacattaatgttaataatttaacattatttttaacaaaatatttaaaaagttaccttgctgcctatctttcagttctacatctattctataaagtgatatctacatgaagtagaatcagtttaagagttctgacacacattccatgtgtaaagcatatgagaaaagagaaaagaatatattccccaaaccaagggatgtagtatacaaaaggcaaagttctatatctattgaaacaaattgggcttttcaccactttatgcttacttcatttatccaagagaatttaatgttgtatacttggatgactttttcctattgggttgaacatatgaaactgacatatttgtaggtcaaagaaacgtcaaatattggcagtttcatacggtttaacctctaatttaatggccttggaatagtaaccaaagtgagctcacccagtctgtatgttgtttgatcagtatacaagcaccatctggtggcagaaaccaaaactgtaggtttgtaactgttcatatcactgctggtacaaatacagtcatccctaggttatctgtggggaattgtttccaggaccttcacccttaccccctacagataccaaaatccatggctgctcaagcccctgatataaaatgctcaagtccctgatataaaatattaatattttaatatttgcatataacctatgcacatcctcccatatacattaagtcatctctagattacttataatatctaatacaatgtaaatgctatgaaaatagtagttacactgcgttgtttaggaaataatgacaagaaaaaaatgtctgtacatgttcaatacagatgcaaccaccctttttttcctgaatattttcaatccacaattggctggatccatgaatgctgagcccatggatacagaacccagggatacgaggggccaactgaatattcaacatcaactgttgtactttccaatatgctttttaagagggtgttacaaatgagtgaaaaatcttatatgcaaagtttgaacaacctcagaataaatagcacaccaacatcacaatacttagcaacaaatcatcagcctatataacataaactgaaatgtaataaacaagctgttttcataaatcagaatcttggctattattaattttactgataattaacataatgcaatcaagtcaatttggatgtttcaaaaaacttctttcgccctatcaaatttccactgatagccatcactatctgtaaaatgatttccgtgtctcacagatttatttcacaggggtacaatgaaaaaccaagaagccttaagtaagtgtctaattctggccatagaaacaagtaacattcaggcaaaatagtccaaattgttttcttcttgtttaacttgctatgactcaacatatattaaaagaaaataacttgaccaacctagctataagagattgggccaagaactggatacattagctaaaggtaaccttgacataaaatatactaaacacatctaatgagaatgtaggccataaacttgttccaaactgagtgttaacaaataaacaaaccctttggggaagaaaggatacaccttcaatgaacaaagagctgataggtcactcaaacttgggttgaatcctaaactgccattttcttaagatatattacacaaacctattctgaaagctctagatgttatactacctcttgccacgtctacttccaacaagtctttaaagtcaaagataatctttgctacccttcattgtggccataaagagtgataaaatgactcctaaatacttcgtaggcaatttaaatgcaacatagtgcaaattaaactcttcatctttccaaaaacctgctccaactactcttgtggtgaacagtattactagccatccaaatatctgaagttatccttaataccccaaatgcaatcaagtctaccttctaaatatctatagacactgtcccctcctctccatctgcactattccaggcctgcatcacattatgcctgaattacaacaacattgtcgtaattctttatcccttcaagttttaggaatattgccaaagcaatattcctaaaacatatatccaattattttatccctcagcttaaaatccttcaatgactcccaatcaccttcagaataaaatccaaacctcgtggcatggacaattcaggacattcaaatcggggccctgcctagacttcactcttctcattccagacttaccgaactgtttctaagtccatgaatgaactaaacttctcaggattcctagcctttgttgccaaaatctgtattacttttccttgccctcctcacctggctaaatcctagttaaccttgaagattcagttcatccctcctggaaggcttctttggtgccccaatctggatggggtgcttagttccttcctaatgtttccatagcaccatcggggcacatctatcattctgttctttcgttttcctcttctactaaacttaagtctattagactgcctgtctttcctcaaagtctctactcaaacacaacatgtggcaatgagtaggcatgcaataaatgtctgctgaatgaagatgacctcacgaaagtccttcatttgctattactatctctgttttgcaaatgaggaaattaatggaggtccagagccttgtgcaagatcacttaactaaaagcatcagaactaggaactgaaccaaatgttctgactgtaatggaaataattttctctaaaaatctttgcttttgaggaaccgctccataaaataattgtaccctgcggagtagtttggatggggctaacctgtttctccaggttggacatataacccaggcttggctaaagtaaagtatgtccctacccccaaccaagtttgaatgattaattccaggatggacagtttactccaagtgtttgtggggacttttctaatgactatcaaaaaaaaaacttcaccttcttcactacaagtctacagactatacagtgtatgaagtatagcaaatgggaattggcttatttgaaaacaaagtagagaaaaaaagaaacaagagctagaaagagagaaatagaaaatgaggaagaacaacactaaagccctacatccaactatgcctgtacatctccccaagagatatcccagttacatagctcaaaaattcccatttgcacataacctagtttgagttttggccccatggaaatctacaccagcagatcaaggggccatttggtctgctggtctgccattttggccatttgctaagcaataatatttttttatctgtgaatatacaaaattgaaaaactgtctaaattcagccattctatttctctaatgtacataatttttataagaaagatgggagaacaaaagcacgaagtgttctccaagctttaccttgtactttgtcaaatgaatttttatatgctttctgcttcataatatatctgttagtgaaaagtgcctcaaatgataaagaaaaatacataaccggatgtaattattgtcaaacatcttgggcataataaaaggagacaggtacttcagaatccaagttgtatctacagagtttgctcatggataaatgtttttttctccactcatcattaaaaaagaagaaaaattcagttcttcttaggcctttgaataagttcaagtggagaaacatcatcagtagagggtggtaaaacagcataggtaatacctaattttgcttaatattactttaagtagaaaataaaaggaccttttcaaaaatccctctaaatgatacctgtttcttggacttcacctttcattccctgccttaagaagctaatgattaatctgggttctgacaaggaaaagacatctccttggatctttggctccagagtccctgtaatccattcaagtgttgccatctataaattaaaataaatatgagaaatcatggttgtaacagcctactgagtaatggttaggtctgcgcttctgtgagcagaaagagcttttcagttgaaacatggcttggtagcttactagtactttccgatattctttttacctttttgtgatctgcagaatatcataaaataaagacactccaaaaaaggaaaagtccatattatctattcatggaatggcctaaggcacatcctttatttatgactttggagaaatcataaataaaattattgtacccctcacaacaaccataagaattagatcttggaactagaaactgccaacaaagaaaaaatgccgacattcttaacagaaaatttagaaaagaaaaaaagaaaatcaaaatcacatgatccctgtctaatttcacatactaactcctctctcccttggttcactctgatcaagccacattggcctcttgaggccaatgccaggcacacttctactgcggggagtacttgctatttcttgagcctggaattctctctctctctctctctctctctctctctctcaacattcacactgctttttctctctcttcctttgaggtctttatcaaaagcaaccttctcagtgactaaccacttcttattgactgactacctcccctacaagaacatgagctccataaggacagggattagtgtctgacttttcattgctttagcaccagactttttaaaagtaataaatttagaagtaataaaagtagtttatttccatttaaaagtaataaattcactagtcagaactgtagcaaaatttcaataaaggaccacagataccaaaataaaacaaatataaagatgtaatactctcataaatctatttactagagtacattagcaataaaattagtatataataggctaggtgttccttactcaggtgactaaagatatctactgtgttgaagtgggcaactagctttatttatttacattggggaacgtcagattaaacataaaggcaatgcgtatattatacagagaaagagaaaataaaacaactacaagagaaatgtgttgtcccttgtgcctcctatgcggtgtggacaccaagctgagggctgggaagcctgccattgtatgcatcacaattagaagcagagatgttacaggagagaatgaaatataccaaggaagccaagaaaagctgagggtttaggcccattagcaaggggaagatagtagatacactctggaagcattacctaagggagaaaaagacggactagatgccaccaactgcaagtttccacacctcgtggacaaggcacacgaccacaaagaaaagaggaactaaaggacaacacaagatgcctctacagaggtgaggtatatagatgcctctcccttcctagcatagagaaagctcccccaggcatacctgagaggaaaagggaagggcagaagtctaatacagtgtgcaaattcttcttagagaacctaaacaataatatttaaaggaactatttacaattgaatagaactaagttttaaatggatacaattaaagataatttttcccctagcaagcaagaaaccaaaaagtatcagattatttatggactaaataaatatcttccctacacatctaagttatggtatcagtaaatacataaaaccataacaaaagcaccagcaaatatctgatcaaatataggaaagaatttctcaggcataaaagaagtgagagaaataaagaaaaatcaatagataagaccacataaaattttaaaactacaggatattaaaaacaaatacacaattaaaagccaaattttttaaagcaggaaaattacaacaaacaaaatagactgaaggttaacatcctcaacacataaacatttgaaaactggtgaagcaatggaataaaaatcagcaaattaaaatagacaaatcaaaaaggataacaaatatctaaaaaaaaaactgttcagcctcactagtaatcaataaaattgaattttaaaaactactacttgatggccacgtgaggtggctcatgtctgcaatcctaacactttgagaggctgagagaggcggataacttgaggtcaggagtttgagatcagccttgctaacatggtaaaaccctgtttctactaaaaatacaaaaattagccggaaatcgcttgaacccaggaggcggagggtgcagtgagctgagaccacaccatggcactccaacctgggtgacagagtgagacttcatctaaaaaacaaacaaacaaacaaaaaaaaacaaaaaaaacactactttttaactaccaaagaagacaaaaacctttttaactcagtgttctcagaatagaataagcattctcatatactgtaagaaattagtacaaactttagtgcaattgggcaatgctttattctttttaaagaatattccccttatagtaatataaggaaggaaataatcagtgatgtgaacaaagatttacatagtgattatttactgcagcaatcttaacaaaaaagagggcataaacaacctagataaaaaaatagacatacatttatataccttatgaagccatatgaagcattatgtagccatcaaaatcattttgtgccaggcacaggggctaacgcctgtaatcccagcactttgggaggccgaggcggacagatcacttaaggtcagaagttcaagacccccagcctggccaacatagtgaaaccccatctctactaaaatacaaaaattagccaggcatggtggcaggtgcctgtaatcccagctactcaggaggctgacacacaagaatcacttgaacccgggaggctgtgggtgcagtgagacaagatcacaccactgtactccagcctgggtgacagagtgagactgcgtctcaaaaaaaaagaaagaaaagaaaaaaaaattcttaaatatatgacaaatggccactatattaagtgaaaagagagtgcttgttttgcatatacaagatacacaaattatgatatatccatacaaagtacactaaccagcaataaaaaagggcaaaacccagatataagcaacatggatgaatccccaaacaagaaaatcattatacaaagtaaaagaagccagatgcacataaatactgtatgagtctagatataaaaagttcaacaacaggcaaaaactagtctatgataataaaatagtgattatttctgggagaaggatgtgtcaaagacaaagaggtctgaggaaactctcagaggtgattgggaacattctgtatctcgatctgagtggtgatcacgtgaggctatacgtatgtaaaaagtcatcaaataaagtataaatacatatatacatacataaaataaagtcatcaagaggtatacttaagatttgtacattttactgtatgtctatcataccttcataaagtactacaaaaactgcatataaaggacaacttcaacttggttaaatatatttaaatgcaaagaaaaaaagaatgtaaagtacatgaaaatataaaaggtggcaaattctgggattacattatttacattttttcttttttccctataaattacaaacattcatgttcactaatgtatttagacaaatcaagaaaaaaactgagctctgcttggtaaatgaatgagaaagtcaacactataaactgtgaaatgactttaagacttggtcttccctgcaacaaatacagggccctcatgacacaataaaaactagttccttcagatcttttacgtttgtggggtaggggaaaaaaaaaaaaaactagttcctgaaaactgggtttctttaagttattaatttaaatattccttgtgaacctgctttatctaaattccatgcacaatgcccaaggtcaattagatttacaatgaaaatactcttttgagtgtgagaaacttttataacatggataaaataataattaagaacaaaaccaaaaaagacatacaaacctctgattgtacatgccccgaaagttgtaattagctctataatttgggaatggctttggatctaatggcctgtagatggcaggctctccccttttcatagcaagcccattcagttccacagttggagttatactgcctgtttaaaaaaaaaacattaaaggcacacaagtgaaatatcttcacaattaaacatgcaagctatatttatacaacgcttaaataccatggaagaaggtaagaatggatggaccacctgtatgattttctaaggaactgcgaaaacaaagtaaaaaaccaagaaaatagttcctaataaaatcttgggattttgcaatgttttctgtacattaatgacaaaaaatctgagtgtgcaatcattactatcaaaacatagtaaacagatgattcttagattgctaaccgtgaatattattttttaaagtactgcatttcatcattacttaccccagaaagcttgcatgtatttaatcattaaaaacatcatctgtgaatatttttatttatactttggtaattaaataactaagcattggcaagaaagtcatcagtggttcttggacttatctaatgaaaaaagttttttgaattttttctataaccaacaaaacagagtaaatataagcaatgtttcctgaaactaaaatgtcatcgaatatattcctagcaaatattaaagatacgtacaagtagcattatcgataaaaacaaaagactgaaaacaacctaaacaaccatcaatgcagcatcagttatataaatgtccatagcataaaacactgaacagctataaaaggaggaagactactacacaccttgcttcttttattttacttaatatacctcggaggttataccttagcagtgtagggtataatgttaaacgaaaaaaagcaaggtaccaaatagtgtgtgctttatattatcttttgtctaagaaaggtgaaaatgaaaatataaatatatatttgcttactttttttaaagaataaacccaaaactaaaaaaaaaaaaaaaaaacttacttaggaatggaagctgtatgtctctgaatgtacactgtttcatagattttattttgaaaacatgaattttttgcataattacagaaatcaaaatttcatccaaaaggggtgggggagcaatctctaaaatcgaaagaaaactggaactaaatctatctacagtgacttaaccacaaagagaattatttcaaaagacttaaaaaactgtaaaatagccatgagatcctaaagagaaaaaaaaatcttaaattgttttcagtaatcacattgttagtaacaagtaatatgcttttacttaagtcaaacaaaattaaataaaaatggagacaaagtaatctctataaagaaaacaaagcaattaaaacctaattgattggtggccctaatcatacgaagaacagttatttcaaataactttaaaatatagtcaaataaccacatattctaaagatttttttaaaccctgcaaataaatcataaactatttttagtaatcatgctgttagtaatattggcgtccctgtctcactgcaattgctattataaaattattttatatatatataaaatatacataaaatagactaaagaattaatgtcagaaacaaaggtttttagcataaagagacacaaatataaaatcaaacacactacctaaaaccctgtagttttaaatcctaactgaaatcctaactgaaaatatagtcttaaatcctaactgaaaatatcacaatgaattcatgatgtattttctcttaaggaaaaaaaaaagtactaggtatttcctagcttaagtatccacttaagaggcctaaaagccataacccaacaactgcaaaatgcacattgtattcatcaacacatggaacatattccaagacagaccacataagccacaaaacaagtcacagtacatttaagaaaatcaaaattatatcaactactctctcagaccacagtggcataaaattggacatcaactgcaaaaggaacactcaaaaagcatgcaaatacatggaaattaaataacctgctcctgaatgattgttgggtcaacgatgaaatcaaaatggaaatttaagaatttgaactgaatgataatagtgacacaacttatcaaaacctctgggatacagaaaaagtggtgctaagagcaaagtttacagcactgaatgcctgcatgaaaaagtctgaaagagcacaaataagacatacatgtatacacacacacacacacacacacacacacacacaggctcaaaatgtctcctcagaaaatacttattacttactattcaacaacaaaacatacggattaattaactttacagcaaagaagcctggcatactcctcaccgcatgacaaaagtcgtcactgatgggacaagtcaatctcaggcgtctcctcatagaaagcactaaggtaagtccaagtcatttttctggtattcatgctaaaatgcataaatcatgaggaaacaccagacaaactcaattgaggggcattctaaaaactctgtggtcccatactcttcataaatattatggtcataaaaggtaagaaagactgaggaactgtttgttacagattgaagtggaatgaagagaaatgttaagtacatgtaacacatggtcttgattagctcctggagctgtaaaggtttgggatgattagtgaaatctgaaatggagtctgtggattaaatggtaatatggatcaaagttaacttcccgatagaacggtgtccgtgtccttaagaaatatacattgaaatattaaggggtaatgggacatcatgtctacaacttattcccagatggttcagaaatgctatcaatggggaataaaggtgaaggatacatgggaagtctatgtactatttccacaaattgtatataaatctgaaattacttccatagtttaaaaaaaaataaaagggagaaagcaaaacagttctataatatattcccaattactaacagatcaaccatgctgcaaatgaacttaactcctcattaggatataacttctttttaagacccatctacacactgtggagtcaagactggatctttcctccacagacctattacttctcaatactgagttacagtcaccaggtttataacaaaggtgccactacactgcagaggggaatggactatcttttcaataaatggtgctggattaaatgaatgtccatatattttttaaatgaagaaaaatattgaactctacctcacatcatacattaaactcgattcctgacagactgtagatctaaactgtaaagatctaataatactgcttctaaaactaacatgaggttatcttcacaaacttgtaagagacacaggtgtattaaatggcacaccaaaaaagcgctaactataaaggaaaagactaataaattagcttccactaaacaagaattttgtttttgttttgttttgttttttgtttttgagacggagtctcgctctcacccaggctagagtgcagtggtgcaatctcagctcattgcaacctccgcctcccaggttcaagcgattctcctgcttcagcctcctgagtagctgggattacaggtgcacaccatcacgcccagctaatttttgtatttttagtaaagttggggtttcaccatgttggccaggctggtctcaaactcctgacctcaagtgatccacccaccttggcctcccaaagtgctgggattacaggtgtgagctaccgtacctggtctcattgaaaagaatttctattcatcaaaatgtacccttaggagtatagaaagatatttgcaatatacatatctgataaattatatgaatccagaatatgtaagaaccctgtaagccagtaaaaagtagaaaaaattttaaaacagacaatgcagatttttaagtgggaaaaacattccaaccagcactttacaacagagcctagcctaatgccaacaggcatatggaaagatgctcacctgcatttgttattagagaaatgcaaattaaaaacacaatgaattactattatacctctcagcataatagctaaaattttgaaagctggagatatcaaatgttgatgaggatgtggacagctctcataccgctggtgggaaggtaaactgacattctttgacattatgtattaataccaaatacattcataactatgacccaacagttccaatcctagatatattcccaagagaaatgtatgcattttaagaatactgttcacagcagtattatttctaatagctcaaaactggaaacaattcaaatacgtataatagtacaatgaataatatgtaaattatgtatacttatgcaatagaatactacatagcaatgaaatactataccattaaatgcaacatagatgactctcacacacaatattgagaaaaatgagctatcacaagagtctactgtctgattccaacaagaaggcacaactaatctggtagaaatcagaatattggtttcctttagagttgtttaaccaactgaagtgggcatgagggaagcttccatagcactagtaaaacatgtggtgaagtgttcacagcataaaaattcatcaagctctataactgtaatgtgcccttgtctgtatacagtattagactttattttaaaagtttacaccaaataatcgattcattctctcagcttactataacactcaaccatggaaattcttatctccactggggcctttcagacactctcctgtttccttcctctgactcttgctggtttacttcctgctataatcctctaaatatggacttgacccagagctcagcacacaattaactgctcttgctttacattatatgcctttgctttacattatatgccttagacagcttgttctgttccattccaaatgccactctcaacactcctgcagagcgggaggcatacagtactcaatgcacgtgagtctctttctttcttcacccataaactatgacaatggttttttagtgtctcccaccttccctttacatgtcaaactgagcttcctaaaatactcctttaaatgcatcatgcactgctcatgaatattaattcctcccagctacgtataaaacttaatctcgtaaagctggcattcaagtcgtcccaattcactcactaactacatctccagtcttacctcctactagtcatttacctgctctaattaaaaaccatctataaaattttttttttaccaaatccattgtccagattcctacttcaaagcctttcctcatagtattccctctggctaaaatattctttcctctcatctataactgcctacttttcggtcaaggcctgtatcttacttcaactacttcagtccatgtttatcattacctgtaatactgatggctgttattgtctacttggcacttaatctttaccatcaaattacgtgttcatatataagactgtaagacactcactgaaagggacaatgttttatttctcttagatatgtaaaaagcaagtgttaaatatatcatggtggtggtatgctactaatgatcaaccagtattctgaagaggcttttaaaaattaaagaaatggacaatcttttaggaacttcaaaatgaagagaataagttttttttctattgtaataatattttggcttatttaagcttaataaatactgcaatcagttgaacagaagcagagacttgcaatcagaaagccatggattctgcagagtagtccttgaaagagcagagaatgtcaacctagcacagaccacatgagaatgaaacaagtgtctatgtgatttgattatgaatataaccaagtagagaatgattaaatacattttagagttattgttgacaggcacaaaatctttcttaacctccataacaaaaatatctaaggcgaaattaatattgactagaaggtaaccacttgaattaatcagttaacaaatgaatgagtaaatggatatatggctggtactaaagttatagtaattccattaacctaatgttatcaattaatacactatgtccaaaatacaggtttgcctttcccaatagataacgggacatatagattcactgaggtcacccggagaaaatgatggatatcaggcaggactaacttgaggctcccactcaggacaaaacagcatgtggagactcacagtgtaaactctgctccaagaaccaccacaagaacataccaggaaaactgaaagaattcacagaccctttgaaagaagcagcttgccgctgcaaactccatgagacagccaaaacaccgtgagtgcccaaagtgtgagagggggaaagtctgcctccaaacacacatcctcactggggaacctgaaaatccagatcacagaagaatttaaccttacctaggactgaaacaaatttagagagctgagcgaaatataaaagtagaagaagcaggccaggaatggtgggtcatgcctgtaatcccaacactttgggaggccaaggtgagtggatcgcttgagcccagtttgagacaagcctggctaatatggtgaaaccctgtttctactaaaaatacaaaaaaaaaaaaaattagctgggcaaggtggtgcacacctgtaatcccagctacttgggaggctgaggcaggagaattgcttgagcccaggaggcggaggctgcagtaagccaagatcaacgccactgcactccaacctgggtgacagactgagactccacctaaaaaaaaaaacaaaacaaaaacaaaaacaaaaactagaagcagcagcgataagagacccctgtagacactcccagtccctagggaagccattttttttttttttttttttttttttactttcatctcacagtggtccttggggaaggcagtcagtggaactagggaagtaccacagtgagaaagacttctagctgaacgctgtcataattttgactgaatgcaaattttcctgggcagaatctgggtggggggtgggggaggaggtgggaatagggggccggcgggaatagggggccaatggaaagtacagatatgagaacagaagccactgcaggcatggaagggcaaggcctgaaagccctgcttgctttcttagcaggaagacttctagcctagggcaaatgctttttctgcagacactccccaataccagcctggagtccagtagctccactgggtagctagacccagaagaaaaataaccatcgctgcagttcagctctcaggaagccccattcatagggaaacggggagagaaccacatcaagggatcatcccgtgggataaaagaatctgaacagcagattcaagatcttgcctctgacacagtatatccaaatgagaagaaaccagaaaaacaattctggtaatatgacaaaacaaggttctataacaccctcaaaagatcacactagttcaccagcgatggatccaaaccaggaagaaatatctgaattaccagaaaaagaattcagtaggtcggttattaagcagctcaaggaggcactagagaaaggtgaaaggcaacttaaagaaatttttaaaataatacaagacatggatgaaaaaatttccagagaaatagaatcataaataaaaaagagtcacaacttctgaaaatgaaagacacacttagaggcatgcaaaatatactgcaaagtttcaacaatagaatcaaacaagcagaagaaagaacttcagagctcaaagacaaggcctaatcaaattaacccaatctgacacagacaaaggaaaaagaattttaaaaaatgaacaaagcctccaagaagtttgggattatgttaaatgaccaaacctaagaataagtggtgttcctgaggaagaagaaaaatctaaaagtttggaaaacttagagggaataatcaaggaaaacttcctggccttgctggagatctagacatccaaatacaagaaggtcaaggaacacccagggaattcattgcaaaaagatcatcacctaggcacacagtcaatcaggttatctaaagtcaagtcaaaggaaataatcttaagatctgtgaggcaaaagcaccaggtaacctataaagaaaaacctatccgataaatagcagatttctcagcataaaatctacaagccagatggaattgaggtcctatctttagcctccttaaataaaataattatcagtcaagaattttatgtccagtgaaactaagcttcattaatgacggaaagataaaagtctttttcaggcaaacaaatgctgagagaatttgccactatcaagtcagcactaaagaagtaataaaatgaattattaaatcttgaaacaaagcctcagaatacaccaaaacagaacctccttaaagcataaatctcacagggcctataaaacaataacacaatgagaaaaaacagacaaaaggtattggggcaacaactagcacaatggatagaatagtacctcacatcttaatactaatgttgaatgtaaatggcctaaatgctccacttaaaagatacagaatggcagaatggataagaattcaccaaccaagtatctgctgttttcaagggactcacctaacacataaggactcacataaactgaaggtaaaggggtagaaagagatatttcatgcaaacagacaccaaaagccagcaggagtagctattcttacatcagataaaacagactttaaagcaacaacagttaaaaatgacaaagagggacattacataatgataaacggactagtccaacaggaaaatatcacaatcctaaatataaatgcacctaacactggagttcccaatttataaaacaattactactagaccttaataaatgagacagagggcaaaataataatagtgagggacttcaatattccactgacagcactagacaggtcgttaagacagaaagtcaacaaaaaaacaatggacttaaactataccctacaacaaatggatttaacagatatatacagaacattctacccaacaactgcaaaatgcacattgtattcatcaacacatggaacatattccaagacagaccacataagccacaaaacaagtcacagtatatttaagaaaatcaaaattatatcaactactctctcagaccacagtggcataaaattggacatcaactgcaaaaggaacactcaaaaagcatgcaaatacatggaaattaaataacctgctcctgaatgattgttgggtcaacaatgaaatcaaaatggaaatttaagaatttgaactgaatgataatagtgacacaacttatcaaaacctctgggatacagaaaaagtggtgctaagagcaaagtttacagcactgaatgcctgcatgaaaaagtctgaaagagcacaaataagacaatctagggtcacacctcaagaactagagaaacaagaacaaaccaaacccagcagaagaaaagaaataacaaagatgagagcagaactaaatgaaattgaaacaaaagaaatacaaaagataaataaaacaaaaagttggttctttgaaaagataaacaaaattgatagaacattagcaagattaaccaaaaaaagaagacagaagatccaaataagctcaattagaaacaaacaggagatataacaactgataccagagaaatacaaaatatcattcaaggctactatgaacacctttacacacacaaactagaaaacctagaggagctggataaattcctggaaatatacaacccttctaggttaaaccaggaagaaacagaaactctgaactgaccacagcaagactgaaatggtaattttaaaactgacaacaacaataaaaaaagcccaggaccagacggattcacagctgaattctaacagactttcaaaaaaagaactggtattaatcctattggcactattccaaaagacagagaaagagggaatcctccctaaatcattcaatgaagccattatcaccctaataccaaaaacagggaagtacataacaaaaaaagaaagccacagaccaatatccctgatgaacatagatgcaaaaaatcctcaacaaaatataagctaactgaatccaacagcgtatcgaaaaggtaattcaccatgaacaagtgggtttcataccagggatgcagggatagtttaacgtccacaagtcaataaatgtgatacaccacagaaacagaattaaaaacaaaaatcacatgacatctcaacaaagaaaaagcattttacaaaatccagcatccctatatgattaaaaccctcagcaaaatcggcatagaagggacataccttaaggtaataaaagcatctataacaaacccatagccaacgttatactgaacagggaacaagttgaaagcattccccctgagaactggaacaagacaaagatgcccactttcaccacttctattcaacacagtactggaagtcctagccggagcaatcgacaagagaaagaaataaagggcatccaaatcgataaagaggaagtcaaactgttgctgtttgctgatgatatgatcgtatacctagaaaaccctaaagactcaaccaaaaagctcctagatctgataaatgaattcagtaaagtttcaagatacaaaataaacgtacacaagtcagtagctctgctatacaccaacagcgaccaagctgagaatcaaatcaagaactcaaaccctttcacaatagctgcaaaaaaatgaaatacttaggaatgtacctaatgaagaaggtggaaagaactctacgacaaaaactacaaaacactgctgaaagaaatcatagaggatacaaacaaatggaagcacatcccaaactcttggatgggcagaatcaatattgtggaaatagcatactgccaaaagctatctacaaattctatgcaattcgcatcaaaataccatcatcatttttcacactactagaaaaaacaatgctaaaattcatatggaaccaaaaaagagcccacataactaaagcaagactaagcataatgagcaaatctggaggcatcacattacctgacttcatactacattataaggctatagtctccaaaacagcacgatactgctataaaaataggcacatagaccaatggcacagaatagagaacccagaaataaagcccaatacttagagcaaactgattttcatcacagcacacaaaaaatataaagtggggaaaggacatcctattcaacaaatggtgctgggataattggcaagtcacatggagaagaatgaaactggatcctcatctctcacttgatataaaaattaactcaagatggatcaaagacttaaatcaaggcctgaaaccataaaaattctagaagataacattggaaaaactcttctagacattggcttaggcaaaggcttcatgaccaagaacccaaaagcaaatgcaacaaaaacaaagataaacagatgggacttaattaaactaaaaagcttctgcacagttaaataaataatcagcaaagtaaacacacaacccatagagtaggagaaaatcttcacaaactatgtatctgacaaaggactaatatccagaatctacaaggaactcaaatcagcaagaaaaaaataatgccatcaaaaagtcagctaaggacacgaatagataattctcaaaagaaaatatacaaatggccaacaaacatgaaaaaatgttcaacatcatgaattatcagagtaatgcaaatcaaaaccacaatgcaataccaactgatatggtttggctgtgtccccacccaaatctcatcttgaattgtaatccccataatctccatgtgtcaagggagagacaaagtggaggtaatttgaatcatgggggcggtttcccccttgctgttcccatgatagtgactgagttctcacaagatctgatagttttgtaagggtttggcaagttcctccttcagtctttttctctcttgccaccttatgaagaagatgcctgcctcccattcacctttaaccatgactgtaagtttcctgaggcctctcaagccatatagaactgtgagtcaattaaacttcctcctttccttcataaattacccagaatcaggaagttctttatagcagtgtgagaacagactaacacaccaccttactcctgcaagaatggccataatttaaaaataaaaaaataaaggatgttggcgtggatgtggtgaaaagaaacactttttttttcttttttttttttttgagatggagcctcgctctgtcaccaggctggagtgcagtggtgcgatctcagctcactgcaacctccgcctcccgggttcacaccattctcctgcctcagcctcccaagtagctgggactacaggggcccgccactgcccggctaattatttttgtatttttagtagagacagggtttcaccgtgttagccaggatggtctcgatctcctaacctcgtgatctgcccacctcagtctcccaaagtgctgggattacaggcatgagccactgcgcccagccaaaaagaaacacttttacaccactggtgggaatgtcaactagtaaaaccactatggaaaacagtatggagattccttaaagaactaaaagtagaactaccatttgatccagcaatcccactactgggtatctacccagaggaaaataagtcattatatgaaagagacacttgtatacacatgtttatagcagcacaattcacaattgcgaaaacataaaaccagcccaaatgcccaccaatcaacgaacggataaagaaaatgtggtgtacatatataccatagaatactactcagccataaaaaggaatgaaataatggcatttacagctaactggatggagttggagaccattattctaagtaaagtcacacaggaatggaaaaccaaatgtagtatgttctcataaatgggaggtaagctacaaggacacaaaggcattgagaatgatacaatgggccgggcccggtggctcacgcctgtaatcccaacactttgggaggccaaagcagatggatcacgaagtcaggagatggagaccatcctggctaacatggtgaaaccctgtctctactaaaaatacaaaaaaattaggccaggcacagtggctcacacctgtaatcccagcactttgggaggccggggtgggcagatcatgaggtcaggagatcgagaccatcctggctaacacagtgaaaccccgtctctactaaaaatacaaaaaattagtcaggcgtggtggcacatgcctgtagtcccagctacttgggaggctgagggagaagaattgcttgaacccgggaggcagaggttacagtgagccgagattgcaccactgcactccagcctggtgacagagcgagactccccctcaaaaaaaaaaaaaaacaatggattttggggatctgggagaaggttgggaggggaatgaggggtaaagactacacattgggtacagcatacactgcatgggtgatgggtgcaacaaaatctcagaaatcatcacggaagaatttatcaatgtaaccgaataccacctgttccccaaaaactattgaaataaaaaaaaaaagataatgacatataatgttgttcgtattgtatgcaattagaacaactctttaaaattattcttaggagcttaaaattagaacagtaatttacttagcagtattttacatgcaggtggtttgcggaatttgtgatggggtttctttcttttttttttttcttttgagacagagtcttgctctgtcgcccaggctggagtgtagtggcgtgatctcggctcactgaaacctccgcctgccaggttcaagcaattctcctgcctcaacctcctaagtagtggggactacaggcacgcgccaccatgcccagccaatttttgtatttttagtagagacggggtttcaccatgctggccaggctatatataaatatatagttttatatattatataaatttatataaattatatttatataattatgtataattatataatatatacaatatattataaattttttaatttaaatataaacttaaatataaattaatttaaatataaattaatttatatttctattaatttacatttataaaaatttatatttatatttataaatataatttatatttatatttataaatataatttatatttataatttatataatataaatataatttataatttatatttataaaaataatatatttatatttaaattaatttaaatataaatatatatttataatatataaatatataatatataaaataaaatatatataattatataatatataaaatatagttttttatatatataactatatatttaaactatatatttaaaaagagaaattaatcattttttgtaattttttttttgcaggggtagaaacaaggtcttgctatattgcccaggctgctctcaaattcttgggttcaagcaatcctcttacccaggcctcccaaagtgctaggattacaggtgggagccactgcaccaagccactatcatttttgtttgtttgttttttgagacagagtctcgctctgtcgcccaggctggagtgcagtggcacgatcttggctcactgcaacctctgcctcccgggttcacgccattctcctgcctcggcctcctgagtagctgggactacaggcacccgccaccatgtccagctaatttttttgtatttttttagtagagacagggtttcactgtgttagccaggatggtctcaatctcctgacctcgtgatccacctgcctcggcctcccaaagtgctgggatgacaggcgtgagccaccgcgcccggcctactatctttactttaaaaaaaaaaaactcagtcaaattttctgtgctttgtattcaaatatgtttttgccaacattaaaaaagtaaacaatgcacttttatagtatccactaaagcaaattttaaaaacaattacaattactttcttcatcctctcaccttcattttttttttttttttgagatggagtttcgctcttgttgcccaggctggagtgcaatggcgcgatcttggctcactgcaacctccatctcccagattcaagcaattctcccgcctcagcctcctgggtagctgggattataggcacctggctaattttttatatttttagtagagacagggtttcaccatgttggccaggatggtctcgaactaattacctaacatgatccacccgcctcggcctcccaaagtgctgggattacaggcgtgagccaacgcaccaagcctccttcagttatttttatgctaccgtgtgtgtgtgtgtgtgtgtgtgtgtgtgtgtgtgtgtgtgtaggtatgggcatatgtgtactattaatacttgctcactctgttactagcctactataaatgaaacatacaacaagcagaacacacatagcagacaacataacagaaggagtcactgccatacctgggttattgttaacattacttttgggtggcttctgaactggtttgggaagcgtagattcagtcaaagctttattggcaacagcctgctgagccttctttatactgctgccttcggattcccatgtctgctcaccaagactcagctgcactgagaacatcttagaaaaacataaatagacaaagaaaacattaagacttttccaagaaataaaattggctgtctgagagaaaaataaacatcatagaatcagaattttagagctagaggtgaccttacctacagatcatctgcaacaaaatcttactctacctagtgaagaaattttaagagagtaccaaattctgttctatcctatccaaaagcttagtagcagatctaggtgtacattctgggtagaataaatcaagaagcaatctttcctctaaatggaatcacaatgttaatgtcattcaaatggtcctcacaaaagcagaataagtagaaataataagagaaactgtaagagaagccaaaagaccatgtgtctataatactttcataaaatctaattccttgaatgttacatttagcacaatctaggcaatgagtcaggcaattctattaaatattatactaccaaaaaactctgaatctccacaacaaacattgagccaatcactaaattctgtccattttaacatcataaatatttctcaaatcttcttcctctctctgccaactggatccagcctttcatcatctttagcttggacataatattcttccagctgatcactgctaaaactatctttctaaaacacaaatccaacttcatcaccccaatcaacatcaggttaaaacccttcaactgttcctgttttagcatggcacaaaggctctacctgtgcatcctcatctcacacacatccttccactaacatgctctgaattccattctcactgtatttccatatgagcccccaaacctattcttcacctttaaaattcagaatcaagttacatgatatgcgcataattggtttcactccagactgcatattactttctaggaatactaagtattaacttaaaattacttattacaaaaaaatatatattattgtagaaaggagatcagatagaaaataccttcactaagttagcatcaccaataatcatacaaattgacgtcatgtgccccctgatacaatccagtgagaagtatatatcaacaaccatgtacaattcttggccaaaaatgtttaatctgaatctaatcacagggaaacaaccagagagatctagattatgggacattctataaaacaaatggcctaggctccaaaaatgtcaatgtcataaaaggaaaaaaaaaacaaagaatgcagggaggacactaaagagacatgaaggccgtgcacagtggctcacgcctgtaatcccagcactttgggaggctgagatgggcggatcacaaggtcaggagattgagaccatcctggctaacacagtgaatccccatccctactaaaaatacaaaaaatttagccagacgtggtggcgggtgcctgtagtcccagctactcgggaggctgaggcaggagaatggcatgaacccaggaagcggagcttgcagtgagccgagattgcgccactgcactccagcctgggtgacagagcgagactctgtctcaaaaaaaaaaaaaaaaaaggaaaagaaaagagacatgaaaagacatgataaataccatgcatgatccttcattatatctaaaatgggaaggggaaaaaagctgtaaaggacattcagaggacaactggggaaatgtgactatgaactatacattaagtaataggtttagccaggattaaatttcttgtgtgattaacagtattgtgattatgaagaacgtctttagtcttacaagatagatatgtaagtatttaagagtgaagtgtcatggtagctgaaatttactttcaaattgttcaaggaaaaattatatgtcaatatagagggagcaagaaataaagtaatgtggcaaataaattaacgatcggtgaatctaaaccatacatgagtgtctattacaccactctttccattttttctgtagatttttaattaatcaaaatagagaattgggatttgtcatttgaaattcacaacataaacatacctgtttaaagtgattaaattttcttttattctaattcagtttaaaatatatacctaaaatgtatctttaatactctctctggtttcagaatgatttttcaatgactagctctttttcttcaaattttggtatttaacaaagaactttgccacaaagtaagaaagttcaaaggtttcacatgatatatataatatacataatcttgcatatagctcatatgcttgaaaacagaaatacccacataaatgaccttgagattcctgattgcatcaggaaagcatattaaatttactctgcatgtctccagacctgacctctcctaaacaacaatcacataaatctaactgtctacttggtatttccacaaactcaagaggtaaaaggtcaaacaaaacactgcctcctccactctaccccctccaaatcagttcataccccaaaatgtttaatccattatctcccaatagttcaggttcaaacctcattagtttcgtttatccttgccttcctaaggcttatttaacatctcataactcttcgttgtaatttatattgtcacctccttggtctaaggtttctataaactcagactcagtatacttcatttagctcctatctctaatctttcctgcctcctaatcatccagatgtcaccattttcccaatctcatgagccagacacctttgagaggtcttcccttctctcctgcttgcaattaacaactactgactcaacttaaatgtttttcagacctggcctcctctctttatactaagatatatacatgcaccaatgtctttatactaagatatatacatgcaccaatgatatgtggacaatatcagtatctctcccctaaactaccacaacaccacctgtggtatataagaaatatgtatttggtctccggccctggttcctaacacagagctcccaaaaccttgtaatttccggaaggacaggagaactaggagcatttttgttctaatatttggtctttgatcccaatttctaacacagagctcttaaattccttggaatttcctgggtgataggaaatttttattctaatgagccaactcttggcaggcccctggatagagagctagtctgagggccagtcaccagaaaaactaagccatggttagaaacttcatttttagccccatcccattcctatccaccacggaggaaagaggggctggagactgagttaataatcgatcatgcctatgtgacagagcctccataaatatccctaaaagatagggtacaaaaagcttgcaggctggtgaacacactgaggtgctgcagggtggcacacccagacagggcttggaagctccatttcccttctcacacacttcatcctacgtacttcttttttttttttttccccggagatggagtcttgctctgtcgccaaggttggagtgcatggcacaatctcgtctcattgcaacctccgcctcccaagttcaagtgattctcctacctcagccccccaagtagctggcatcacaggcacaagccaccatgccgggctaatttttgtatttttagtagagacggggtttcactatgttggccaggctggtctcgaactcttgacctcgtgatccacccacctcagcctcccaaagtgctgggattacaggcgtgagccaccacgccggccctcctatgtactctttatctggctgttcacctatatactttagaatatcctttataataaactagtaaatataagtatgtgttcccctgagtcttgtgagctgttttaacaaattatggaacctgagaagagggtgctgagagcccccggtttatagccagttggtcacaagtttagaagacccagatttgtgactgtcatgtgaggtgagagcagtgttgtgggactgagcccttaacctgcagggtctgcactaaccgtgggcagttagtgtcagaatttagttaaatagtaggacatccagtcaatgtatggggacaattgcagaattcgctggcgtggaaaaaaaccccacatatttagtgtcagaaatgaagtgttacagccaggtgtggtggcttatgcctggaatcccagcactttgggaggccaaggtgggaggatcacttgagctcagaagttcgagaccagcctgggcaacacagggagacctcagcactaccacaaatgtaaaaaattatccaggcatggtggtgcgcacctatagtcccagctactgaggaagctgaagcagggggatcccttgagcccaggagatgaacgctgcagtgagctatgactgcacaactgcactccagcctaggcaacacagcaagaccctatctcggaaacaaattttttaatttaaaaaaaagtgggctgggtgcggtggctcacgcctgtaatcccagcactttgggaggccgaggcgggcggatcacgaggtcaggagatcgagaccatcttggctaacacggtgaaaccccatctctactaaaaatacaaaaaaaattagccgggcgtggtagcaggtgcctgtagtcccagctactcgggaggctgaggcaggagaatggcgtgaacccgggaggtggagcttgcagtgagccaagacagcgccactgcagtccagcctgggcgaaagagtgagactccgtctcaaaaaaaaaaaaaaaaaagtgttggaagtatagaaaaaaatttctttttactatcttaaagcagttcccttaatatgaccttcccattcaaactaccattcttaccaccatcgacatgaacattctgtaaaaccatcaacatgaacattctgtaaaatataagtatttccaaggcaatcctatgcttttctacaatctctcttaagattcctactacagtaaaaagtgtagtagttttaagacggaatgctggagacacactgtttatgaatttaagccttggcttcgccatttactatgtacaacactgggaagttaattattctttctaactctcagcttcttacctctttagtgaaatgaggctaataagaacacatggttagttgtgaaaattagaacaaaatggtgtaaacacccccacttgaaagtcagagattgtcaaactagataaaaatgcaaaatcaaactacatgctacctacaaaaactgtacttcaaatataaaagcacatatagttttaaagtaatgagaaaaacatatactgacataaatcaaggagaaattagaatggctatattaatatcagactaagtggattccagagtaaagactattaccagtggtaacgaaggtcatttcatatgaataaagaaagcaattaagaagacattgatatcctaaacatttaggcacctaataacacagcttaaataaatgaagcaaaaactgacaaaacttaaactataaaattgacaattaaagtcagattcaatactccttatcaaaaactgatataacaagcaaaaaaaatcaccaagaatatagtacagttgaacaacactatcagccaacacaatcttatcaacactgttagaatactccaaccaagaaaagcagaatatacacttgctctcaattgttcacaggacatttaccaagacagaccatattctgggccataaaataagtctcaataaatacaaagaattcagaccacacacaaagtatgttcattgggtaaagttacagaagagggtagagtaaaattacagaggagggtagagcaagatggtggaacaaaagcctatatatcattcatcacccccagtggaacaccaaattttaacaactatggacacaaaaaagcaccgttacaagaaacaaaaatcaggtgaacaatcacagtgtctggctttaacttcatattgccaaaagaggcattgaggagggtaggagagtcttgaatcaccaacatcaaccctctcccacactcccagcagcagccatgtggcgtggagagaaaatctgtacactttgagggaggagagcacggctattggaaaacagtacattaaactcagtgctgccctgtcacagcagacaatgaaaatgtgctggactcagccagcacctgcacagggagggaggatttggaccagcactagctggaggggaattgcccatcatagcagttggaacttgaatttcttggcaagacttgccaccacaggctgaagtgctccggggtcctagataaatctgaaaggcagtctaggacacgagactgtgcttcctaggcaactcctagtgtgaggctgggcttagagccagtgaactaggatggcacgcaacctagggagacaccagctggaatggctaagggagtgcttatgccatccctcccctaaccccaggaagtgcaacttgtagcaacgaaagtatctacttccttctgcttaaggagaggagagtgaagaaaaaagagaactttgtcttgcattttggatatcagctaagccaccataggataaggcaccaggcagagccgtgaggcccccattccaggccctagctccaagataacatttgtagacacaccctgggccagaaaggaacccactgccttgaaggtaaggactcaatcctggcaggattcattacctgctgaccaaagaaccaatgggtcctgaataatcaccactgatacccaaggagtatgcagtgggccctgggctctgacatgtactggcttcaggggtgacccagcacattcccagctgtggtggctattgtgaaagactcctgtttaagaaaagcagacagaaaagtaaagggaacattgtcttgtgccctaggtaccagctcagccacagcaggaagagcaaaaagcaggctcttggggtccctgagtccacacctacgctggacagcatttccggatctacttcagggagcccactgccctgaagaatgagcccatggaccagtggtggtgttggtggccacacaaggagaggttcctctgcctgtggaaaggggagggaagagtgggagggattttgtattatggattgagtgccagcttagccacaatagaagaaaacatcaggtaaattgctaaggtttttgactccaatccctggctctcagacagcacctctggacacacctggaacccagggaaaaacccgccaccctgaagggaagggccttgggcaaggccagtgctgtgctggcttcaggtctgacccagagcaatcccagggatgatgaccacagaggtgcctgcatcaccacacccccaattccaagtggcttagcactccatttgtttgggagaaagtaaagaaaaagaacaacaatctctgcctggtaatcctgagaattcttccggatcttatccaaggctgccaaggctgtacctctaacaagtctccaaaagccacagcattgttgggcttggggcccaagtcccttcaaattcctgggaaagccttcccaaggacaggcataaacaaactcagactctgaagactacaataaatacctaactgtttaaagcccagacaccaacaagtatctacaaccatcgacaccattcaggaaaacatgacctaaccaaatgaactaatataaagcacaagggatcaatcctggaaaaacagagatacatgacctttcaggcagagaattcaaaatagctgttttgaggaaactcaaagaaattcaagacaacacagaaagggaatttggaattcttatcagataaatttaaccaagagatcaaaattaaaaagaatcaagctgatattccagagtttaaaaatgcaactgacatgatgaggactacatcaaagtctcttaacaacagaaatgattaagaagaattagtgagcttgaagacaggctatttgaaattacacagttagaaaagacaaaagaaaaaaattaaaaagcaatgaggcacaccaaaaacatctagaaaatagcctcaaaggggcaaatgtaagacttactggccttaaagaaaaggtagaaaaagagataacagtagaaagtttattcaaagggataataacagagaatttcccaaacgagaaagataacattcaaatacaagaaggttatagaacaccaagcagatttaacccaatgatgactacctcaaagcatttaagaatctaattccctaaggtcaaatataaagaaaggatcctaaaaacagccagaaaaaaagaaataaataacatacaatagagctccaatacaactggcagcagacttttgttgttttgttttgttttgttttgttttgaaacagagtctcactctgtcacccaggctggaatgcagtgatgcgatcttgcctcactgcaacctccacctcccaggttcaggcaattatcctgcctcagcctcctgagtagctgagattacaggcgtgcaccaccatacccagctaattggcagcagacttttcagtggaaactttaaaggtgaggagagtgtggcaagacatattttaagtgctgaaggaaaaaaactttcacctagaatagtatatctggtgaaaatatcctttaattatgaaggagagataaagtctttcccagacaaacaaaagccgaaggatttcatcaacaccagacttgttctacaagaaatcctgaagggagttcttcaatctgaaagaaaaggatattaatgaaagaagaaatcatctgaaggtacaaaatgcactggtaacggtaagcatacagaaaaatacagaagagtataacactgtacctgtggtgtataaactactcttaactgaagtagaaagactaaataatgaaccaatcaaaaataatagctacaacaacttttcaagaaatagtgtaataagacataaagagaaacaacaaaaagttaaaaagctggcagcggggacaaagttaaagtgtagagttttaattaactttctttttgcaagtttgtttctgcaattgtgttaagctgtcatcagtttaaaataatgcgttataagtattagtatttgcaccggcgcagtggctcacacttgtaatcccagtactttgggaggccaaggcaggtagactgcttgaggtcagaagtttgagaccagccttgccatcacggtgaaaccccatctctactaaaaatacaaaaattagccaggtgtggtggtgcacacatgtaatcccagctacttgggaggctgaggcatgagaatcgcttgaacctgggaggcagagattgcagtgagccaagatcacgccactgtactccagcctgagagacagagcaatactctgtctcaaaaaaaagaaaattaatttaaaaaagatagtatttgcaagcctcatagtaacctcaaatcaaaaaacatacaacagatacacaaaaaaataaaatgcaagaaattaaagcataccaccacagaaaatcactttcactaaaaggaagacaggaagaaaggaaagaaggaagaaaagactgaaaaccaccagaaaacaaataacaaaatggcaggagaaagttcctatttagcaataataacactgaatgtaaatgaactaaattccccagtcaaaagacatagagtggctgaatggagaaacaaacaagatccaatgatctaaacacaccccacctatgaagacacacacagacagaaaagagagggatggagaaacatattccatggcaacggaaaccaaaaaagagcagacacagctatactcatatcagaaaaagtagtatagatttcaagacaaaaactgtaaggagagacaaaaaaggtcattatataatgataaaggggtcaattcagcaagaggatataataattgtaaatatatatgcaaccaacactggagcactcagatacataaagcaaatattattagacctaaagagaaagacagaccccaatacaataacagctggagacttcaacaccccgctttcagcattgcacagatctcccagaaagaaaatcaacaaagaaacatcagagttattctgcactatagacaaaatggatctagtagatatttacacatttcatccaatggctgcagaatacacatttttctcctcgacacatggatcattctcaaggataaaccatgttaggtcacaaaacgagtcttaaaacattaaaaaaaaaaaaagagagagagagagaaaaagaaaaaagaaagaaaacctaaaataatatcaagcatcttcactgaccacaatggaataaaactacaaatcaataacaagaggaattttggaaactacacaaacacatgagaattaaacaatatgctcctgaatgaccatttcaatgaagaaattaagaagggaattgaaaaattccttgaaacgaatggtaaaccaaagcctatgggatacagcaaaagcagtactcagagggaggcttatagctacacacacctacatcaaaaaagtggaaaaatttcaaacaaacaatctaacaatgcaccttaaagaactagaaaaataagagcaaactaaactcaaaattagtagaagaaaagaaataataaagatcagagcagaaataaatgaatttgaaatgaaaaaattatacgagatcactagaacaaaaagttggtgtttgagaagataaacaaaattgacaaacgatttagccagactaagaaaaaaagaaagaaggcccaagtaaataaaaccagagatgaaaaaggagacattacaatggatacaacagaaattcaaaggatcgttagtgactaccgtgagcaactatatgccaaaaaattgaaaaatcttgaagaaacagacaaattcctagacacatacaccctacaaagattgaacccggaagaaatccaaaacctgagcagaccaataacaagtgaggagatcaaagcagtaatgaaaagcttcccagtaaagaaaaggccaggacccaacagctttactgctgaattctaccaaatatttaaagtggaactaataccaatcctactcaaactattctgaaaaatagaggaggacggaatgcttccaaactcattctgtgaggccagtattaccctgataccaaaaaccaaacacacatcaaaaaaaaaaaaaaaaaaacctacagaccaatacctctgatgaatattgatgcaaaaaccctcaacaaaatactagcaaacctaatccaacaatacatttaaaagatcattcatcatgaccaagtgggatttatcacagtgatgcaaggatggctcaacacacacaaaccaatcaatgtgatacatcacatcaacaaaatgaaggacaaaaaccatacatttcaattggtgccaaaaaagcatctgataaagttcaacatcactttgtgataaaaaccctcaaataactgggcataaaaggaacatgcctgaacataataaaagccatatatgacagatccacaactagtatcataatgaatggggaaaaactgaaagcctttcctcttaggtctgtaacacaacaaagatgcccactttcaccactgttattcaacataatactgaaagtactagctagagcaatcaggcaagagaaagaaagaaagggcatccaaattggaaaagaagaagtcaaattatcattgtttgcagatgatatgatcttatatttaaaaaaacctaaagactccaacaaaaaactattagaacagataaacaaatttagtaaagttgcaggatacaaaataaatatactaaatcagtagcatttctatatgccaacagtaaacaatctgaaaaagaaatcaaaaaagtaatcccatttataatagccttaaataaaatttaatacctaggaattaactcaaccaaggaagtgaacgatctctacaatgaaaactataaaacactgatgaaagaaactgaagaggacatgaaaaaataaattggaagaatcaaagcaacctacagactcaacgcattccctatcaaaatatcaatgacattcttcagagaaataggaaaaacaattctaaaatttatatggaatcacaaaagaaccagaatagccaaagctatcctgagcaaaaagaacataactggagggaccacattatctgacttcaaattatactacagagctatagaaaccaaaacaacagggtactacataaaaataaacacacagaccaatggaacagaagagagaatccagaaacaaatccacacacctacgatgaactcatttttgacaatagtgtcaagaacatacactggggaaaagacagtctcttcaataaatggtactgggaaagctagatatccatatgcagaaaaatgaaactagacccctatctcttgccatacacaaaaaaaatcaaatcaaaatggattaaaggcttaaatctaagacctcaaactatgaaactattacaagacgacattaaggaaaattttcaggatgctggagtgggcaaacatttcttgagtaataccccacaggcagaggcaaccaaagcaacaatggacaaatgggatcacatcaagttaaaaaccttctgcacagcaaaggaaacagtcaacaaagtgaagaaacaacccacagaatgggagagaaatatgtgcaaactatccatctgacaaggtattaataatcaaaatatataagaagctcaaataactctataggaaaaaaatctaataatccaatttaaacaacaaacaggtatatgaaaaggtgctcaacatcactgatcatcagagaaatgcaaatcaaaactacactgagatatcatcttgctcaagttaaaatggcttttatccaaaagtcaggcaataataaatgctggcaaggttgtggagaaaagggtaccctcatacgttgttagcaagaatgtaaattagtacaaccactatggagaacagtttggaggttcctcaaaaaactaaaaatagaactaccatgcaatccagcaatcccgctgctgggtatattcccaaaagaaaagaaatcagtatgttgaaaagatatctacactcccatgttttttaggagtgcttacaatagctaagatttcgaatcaacctaagtgtccatcaatagatgaatggataaagagtggtatttatacacaatggagtactattcagccataaaaaagaatgagatcctgtcatttgcaataacatggatagaactggacgtcactatgttaagtgaaataagccaggtacagagagacaaacatcacatgttgtcacttatttgtgaggtctaaaaatcaaaacaattgaattcacagagatagagaatagaaggatggttactagagattgggaaaggtagcaggaaggttgaggggatgggaagatggttaatgggtaccaaaaaaaaattagttagaaagaatggataagacctagtatttgacagcacatagggggactacagtcaataataatttaattttacactttaaaataactaaaagagtataagtagattgttcgtaacacaaaggataaatgcttgaggctttggatacccaatttccattatgtgattattatgcattgcgtgtctaatctatgtgaaaaaaagattagtagctgcctggggtctcaggtacaaagagagatgattacaacaaggaatgagaaaattttgtgggacaatggaaatgtttgttctttttcttcacatagatattttggtacatgcaacataccaaatacgttgtatgcattgggtataccaaaatatctcatgtacttcataaatatatatacctcataaatatatatacctactatgtacccacaaaaattaaaaataattttttaattaaaaaagagacaaagaatattattattgataaaagggttaattcatcaagaagataaaacaattataaacatatgcaccaaacaacagaataaagaacttctcaaaactgaacaataaaacaaacccaataaaaaataatgggcaaagatctgaacagacacttcactaaaggtatacactgatgacaaacacacaaaaagatagccagcattatcagtcactacggaagtgcaaactgaaaccacaatgagattccaccacatacctattagaatggctaaaattagaaaggctgactatataacctgtaggcaagggggcagaaaaactagaactctcatacaccgctgaggggaatgtaaaatggtacaactatattttgcaaaaaaatttggcaatgtcttaaaaagttaaacatgcacctgctatacattcctgacactcttattaccaaagaaatagagaaaataaaatagagaaagagaaaaggtaatatatgtctgatatggtttggatccgtgtccccacccaaatttcatgttggattgtaatccccaatgttggaggtggggtctggggactggatcatgggggtggatttctcatgaatggtttagcgccatcccttggtactgtcctcacaatagtgagttatcatgagatctggtcatataaaagtgtgtgggacccccccaatccccacattgctcctgcttttaccatatgacatgccttttacttccaccatgattggaagcatcctgaggcccccccaaaagcagatgctgctatgcttcctgtagagcctgcagaaccatgagctaactaaacctcttttcttataaattagccagtctcaactatttatagcaatacaagaatggactaatacaatgtctatatgaagacttgtatatagatgttcaaattagctttattataatagcaaaaagctaaaaacaaccaaaatatccatcaacagatgaatgtccaaaaaacaaagtgtgctatatacacataatggactactcctcaataataaaaaggaagaaatactgacacacacaaaacatgagcaaactcaaaataactatgctaagtgaaaatagtctggtaggagtacataccactatatgattacatttatatagttttagaaactgcaaactcatctatagtcacagaaagcagattagtagctgtgtggggtcccaggtacaaagagagatgattacgacaaggaacgaaaaaatgttgtaggacactggaaatgtttgttctttttttcccacacagatataaagcagaaacaatacttttggcatgggttaaattatgaaagaagtcagtttgcattgcttcaaaaaatgttctcccatctttttagtattttctctctcatgactctttactacatttcccttccactatcctcactctcttatcctatacttccactgcaaatgtacatagaaagaaaatgatgatttcatcatgcctgaaaattatgtattcaagaggcacatcctacagctcaaaatctctgctctagcccaatactcatcaactgatgaaatcccctcatataacaatcactacatacaatcagccaaattcaagatgtagaacattttataggacaaattactctatttctccaacaaatcaatgtcataggaaaagaggggatggggataaaaggagtgttagtattaataaataaaagagaccaaagagacatagccaccaaatgtaatacatgatccttgtttggaccctatttgaacaaaccaaatgtaaaaagacatctctaagtctaattaaaaaaaagatggatacagaccatgtattacataatatttgggcttcttaatctagtcataatgacggtgtagtgcgctatttttttaaaggtccttatcagttacagatgcataccaaagcacttatgaatgaacagacatagttcttttaaaaactttagttcaaaaaagtgggtaggggatggtaaataaatttatcttggcaaaatattcaacgttggtatctatttcaaatttttcataataaattaaaagtaagatttttgtttgttttttgagatggagtctccctctgtcgccaggctggagtgcagtggcgcgatctcagctcacggcaacctccgcctcccaggttcaagcaattctcctgcctcagcctcccgagcagctgggactaaaggctcgtgccaccacgcctggctaatttttgtagttttagtagagacagggtttcgccattttgaccaggatgatctcaatctcctgatctcataatctgcccaccttggcctcccaaagtgctgggattacaggcaaaagtaagatcttaagatgttgtgggtttcataatgaatgttatgagacaaaactcctaacagcatgatatgcaccttatttattttcagtgcaggaacagtgcctgccacatagtaaatactcaacagaccttttactaaggggttgttttagtcctatatatgactaataagcaatgatataattatttgggtacctccatcatcaacacaatgcttaagaacttataaatcgtcactccattataccactttatgaggtattatattactccatttacagataagaaaactgagactttaaattagttgttcaaggtcacataagctcggcaatgaagggcaaagatcaagctgggcaactctagcgaagatttttttttaaagactacttggcttaagggccagtggatgacattgcctccctcagtgatacccattccaaagtaaaccatctcaaagtatcagcactagtacaatttacttgaaacttagccaggcttaccaacaaattatcagaataggaaaataatggaaaagaagaaaataccattttatgttattcatggctctcttcctcatattctaattaaaacagccttctttcgagatttgagcaaaccaaaacaataatctgtagaaaaaataactgtatacaggtacctaggaaataaactaatattacaataactcccattattataaggtatactaacttgtttcagagttcaattaaaaactgagcagaaaaataaaagaagacaaggcaaagactaaaataattattattttaatagtcacatattacaagttgttcagaatttgtgatactcatgggggaaggaggaaatcatgtaaacgtaagataggtcactacctgtcagcatgatataagagaagacaattccataccatactgaagacattaacctctgtcctgtgtttccaaactctggctgtacttttgagtcatttcagagctttaaaaaattcctgatgtgtgtgcttcacccaagaccgattaaattaacgggatgagactcaggcataagtattttttaaagctcctgaaatgattccaattaacagccaaagttgagaaccacttctcacctatgtcagcatatgtgtagtatgtgtgtgaattgccatataattaatgtaccaagaaaaaaaattttttttttgagaccgagtctcactctgtagcccaaactggagtgcagtggtgcaatcttggctcactgcaacctctacctcccaggttcaagcaattctcctgcctcagcctcccgagtaggtgggattatagtcacgcaccaccacaccccggctaatttttgtatttttagtagagaagggtttcaccatgttggccaggctgttctcaaactcctgacctcaagtgatcctcccgcctcggcctcctgaagttctgggattacaggcatgagtcaccatgcccagccccaagaaaattaatgagttgaaactaggtttaaatttttcttaccagagattatcattaatttcattaaaatacattttatgtctcacctaaaggccactgatagacatacatgaatgaaaatgattttgcttttcacaaaaaggatccagacttagccaattaggattaatattaactatattattatgtgaacttatcaatatcatgtttcactcaacaacatgccaattattctagtactctttttaaaaataagcaagctacaggctaaggggggtggtgtatcaccaaagcacctacagcaactggcacaggttggcaaaagggatctccaaatctccttaaaaccaagggaatcctgggactattgagaaataagaagagacccactgtcatctactttcatcacaaccaacctgtttagcctttaaaaccccagcagtgagacaaggagatagataaaaggtcagttcataaacccttccaaaaattacaatggattcctaaagaatcttaatgaaaaccaaatcctcctaagagtcctccagaaacttcccaggtaggctgaccttcctttaccatatatagaggatagggatgatgtcactaactgttaaaggcagtctagctcttcactcttgggagaagaaggcagaagaagcaaaactggagaaatggccttgaagaggtgaaacaggttgggatccaggacacaatggaggagctgggcaagtcagctgagggtacctacataaaaggcacacaacatttaagcaggttaaagagctatgtgaggattggggaaagaaaggaatagtaaaatggtggcagaatcaatggatctgcagtatgaaaggactgtggaagtcaaattactagacggaatgaactagaaagttaagaggcaagtgtcacagaaagatgaaagactgaaattaacattatgcagttattggtaatgataaggtcaagaatgtgattataggcatgagtggctgaaggacagtagagaacaagatcaccggagatgttaaagaaactaaaaggtcaacatgctggaacaatcatctatttaagtgttgaaatcaccaaaaattaaaatggggaatgctaaagagagtgaaagtgagccataagaaatgtgatggaatcacccagatgtaaatgacaatcatgagggaatgtgggaagtgtgtctgctaatatgaaactcaaaactgggggactgtctcaaggaagaatacctggaattggcaatgaggagcaaagagtatatactacagggaccaagaaatgtaaacgagtaaaatacacacccaaaaacaagctcagtctagcacaaaactaatgaccaacatatattactgtactataacacagtaacggctaccacagagaactataggtcccactggaggcccagtagaggaatcagaggtttcacaaacgtgtggaagatgtaacatggagctgagtgctcaacaatgagtaagggcaaaagcaccttcaaggcagaaagacactacaacttaggcaaaggcagagagatgtgaaaagaacataaagcgttctgagaaatgcaaacagttcaacatgattaagggcagaatgagtcagaaagagagtcaggacatatagctggaaaggtagaccaaggctacaactattttttctgttaaagcaagaacaaaagatatgaacaaattaaattgttgcccctaaatccttcataaaaaccattaatagaaaacaaaattgacaaattgtagtttcctcttattttccttagtttgtaggagatgccaggatgcaaataacctaatagccagttgctttaagaagattaatcaacccttagagaacaaatgctgccacattatatacaaattttatgatcattatgataatctccaatagccaagatataaatgtgccatagaaaattatgcacaactaagatattgtaagcaactgaatagagctcaaacataaatgcattagttgtagatttgtaacatgtatatatgcaaacataaatgtatacagctatatataaataaaaattgctttccatttaaaaaaacaatataagtgaatgcagagataataagaacagtggtatatacaacttttataaatgattaatgttagaattaaatatcacattggaaaagatgtctcactaggtaactgttggtatatttactctgtctccatttctactttagcagctgtgatttaatggaaagcacaccatatttgggagccaaagaaaatatattcaagtactggcactggcacttatgaactattaagcaagtcacttaactttcctgtgcctgagtttaaattacaaaatggaaatcaaaaatccatatatcatgtggttttattaagatttatatgaagtactatatctaaaagagctttgtaaaccacagtgagctacaaaatagtttagttacatactttgaaatattattaatgtagaactaaaagccttcaagccatctgctgaacccccactccccaaaataaagcacgattaaaatctgagatgataaatctgttagtctgataagtatgtctcaccacctctcttcataaccttacctttgaatgagcaggccctctttcattcagaagtttatactggggttggactctattgaaacgggctaactcatttaccagacacattgcagttttctcttttgggtttgccattttatcttggagagaagctgtaaataaaaaggctataaagtttttgtgaagaatgactttacaaaatggaagaaaaactagttttgactttgaaggtagattgtatatttaaattattttcatgaattttgtattttaaaaattcaaattacctaatgtcttccattacatgcaacagaaatatgtatcacattttaaacaataaattaaggtaaaatttttcctaagtacctaagttgttctatgtatataacagcatgcttaaagattttaaagtaaaattataataattttttatcttaaaaactttcctttcccctcaaaaaatttactagaaacacatacgtttcctggttcttattactatgaaactaaattttgtctaccttcttgatcgtttcatctcaatttttttccttctcattatgaggcagtgtgttagaaaaagctctagtcttgggaatcaggtcctaagtttaagtactagctcttccaactacaatttttcggtaactctaaacaaattaactcccctttctgtttttttaaataaattttcaaagttgtaaaaagaataatttaacaagtgcccatgtacctaacacccagtgcttattaaccatgttccatgtttaactcttattaaaaaaaaaataagtggtattccattcctgttaagttccttattatcttttacagagtattgatgtatgtggttctagactcacataaatggtattatagcattataataaacattctcacagtttactttcttcactcttcattgtgttctcaagacttttacttatataaatctagcacattaattttaactaccatagaatttcttttacaatattgcaccagtttttttatccactcctctactgagacactgggttgtttccaattcttcactcttaaagagagcatgctgtcaaatagctctcaaaatgactgtaccaaattaccttcccctaccgtttctcctcaagctcaaaaacatggaatataatcaaatattttaatttctgataatttgatatttgacaaacagtatcccattattgttctttgcatatttttctccactactattttatgtttgtttgggttttttcttgttcagagacagtctcactatgttgcccaggctggactctaaccctgggttcaagctattttccctactcagcctcccaagtagctgaattacaggcttctatccttttttttttttttttgtattatagttaccaacttttccttttatggtctgtgctttttacgtcttgtttaggaagtcctctctaactgtcaagatctcaatgattttacttaaactcactaagccttctattctttctataaaatgagagaaataaatctatcccgcttaagtcccaaagttgttgtgagattaagagttgtaaatgtatgatatggttttctaaactatatcgcaaatacaaggtactattatagcttcagaatatttttctaataccacattattttaacctatatttttcctttctctcatttatagacacatttaattacttttttctttcacttcccataaaaaatgccaaaatatattttaaaatctaagcataaaacatgcaagtggattacttcctgctcatttaaactatagtcacaataaatacagttcaattgtagccacaagaatacttaaaatgaatgaaaatggctggctttaggaacttcatctacaaacttcctaggccaaagtttaatattaaaaataatattcttttacatttctaatactcttaacaggcccaataatttgtacaatggcttgattgtgataattatgattaagaaactattttataagaaaactacgtaagcacctggtaagacctaagtaaaaagaaggaatctaagcaaccaattgtagggccaagacagctgacagtagattctacaattaagccattgtaagtggcttgcaaaaaaaaaaaaaaaaaaaaaaaaaactagtaattattacttttgggaaaagtacaaaaaagacaaaagtcaagacagttttgagaaaacctgcattttacctattccattgcatgtcacacaaattttataaaacatcctgttcaatttggaaagtcagtcgttataagaaaatacaaggtaacctgagacgataatcagttttggcctttgcataccattgcatgaattcaagtgcaacagacagcacagccaatttaatatcaaaaagcaaaagcagaataattggttaaaatgagaaaatattaaagtctgataaaaatcagccaattttgcataacacaaatagcatttataccaccactgtgtaattttcataattcagtaatgctgcatattcatctgttacaatgcaaaacatattagaagcatacaaacatagtgtgaaaattttatactatgaaaattgctaatagcataggttctacacatattaaacagcgatttaaatggttcatttataatgaacccgtttggtatgaaaacctaatctaaatcctctaaaggaaaatgttaacaaataacatggtataaaacttatattccattaattctgacttcctgcttcataaaagttaacatgaatccaataacacattttaatgggtgactgaagttttagtgtgagaagggtccaagatcccactttgataaagcttcaaaattaaaatcaaaatgtttaaagttgataacttaggaaataattagtcatagttgttttattttaaaaagggattaaaacaaatagttgttcctttatttaatgagaaatcttaataggattcttacttgacagagagctcagtaatacagcaataacttttaaattacaccaaaatttagatagagcatctataaaaacaaactggtctataaaatctgagacacataaaaaagttatataaatcttttttagagaagtcaatagtgcaaaaaagtgagaaatgcacataatgttacacaggtatgcattttcaaagacctatagatgttatcactgaagatagtttgaaatagtcttcaagtccatttggtggctggaatagtagagacctacttagaagtaaataaaattaataaaaatggattcacaatctcagactctgccactttgaaagaacaactgccacatgatggttaagagcctgttttggatatctctgtcacttactaatatctgtgtgaccttgagaaagtacttaaatctcactttcccacaaagtaaaatagagataatagttgttcttatctcactagataattgcatggattgaatgagataataccaaacactgttaacaatgattaaaaattcattattattctgatttaaacatttgttaaaacaattacactatcatcaaatattaaaacagtgacataaaaagtcatgaaaaaagtttataaaactaagtaaaaatattcttagccaaaatattctgttacgataaattgattttactcatacaaatatacttcttggctgggcatagtggctcacatctgtaatcccagtacattgggaggcagaggcgggaggatcgcttaaggccaggggtttgagaacagcctggacaacatagcgagacctcatctctacaaaaaaataaaaatattagccatatgtcatggcacatgcctgtactccttgacactcagaaggctgagatagaaggattgcttgagcccaggagttccagactgcaatccagcctgggtgacagagtgagatcctctctcaaaacaaaacaaaacaaaaaacaagtatatttctgtagtagtctgtgaaaagcatgtatttgttattattttttccactgacttataaacccataagttcgtttccactgaaaaattctcaaatatgatataaattatattaaaggtttacatgtgctaggaaatattctaccttcactgatacgaaacttggttagatataacttacaactttgataagaaacactggtaaaatacatatttataataacagtatttgcatatccaacaaaaacataaatatactctatttttagattcactctatttttatgtcttcacaaaatgtcctggactctggaatttgaatcttcattttgcctgttcatttgtatgtgtaggaaccagtgaagaaacacagcaactgtgttcaagtcactgaacaagctacaaaataatgtagctcacaggcaaaatgatctgtccccaaaggagttcacagtctgatagaagaaacagacacagacaatagacaaacacaataaatcacaatataagtactataataaggctgttacaaaaactccttagacaaagggtgtatggaaaggcaagttttaagaggtggtgattagataaggaaagcaaaaattcacttaggtaacaagggaacgtgagagacagtccaagcttttcaaggagtatagacacaggagaaagcacataaaacaacataactttctggcaaatgcaagcagaaaactggcagaatacagaacgcatgagaaaaaacagcagaataaaactatgtgaccagaattcactagaacaccaaaagtttcctaaaccagaacttaaagtagcattttttaaagtagctatattccagccagaactgttgctactaaggtcacagactacctcgcttcgcaaggcaaatcattccaaagaatcctttccatccttggtcccagaaatgacttaaacacggtttctttccttttttttttgagacagagtttcactcttgttgcccaggctgtagtgcaagggcgcgatctcggctcactgcaacctccacctcctggattcaggtgattctcctgcctcagcctcccgagtagctggaattacaggcatgcaccaccacgcccagctaattttgtttttttagtagagacggggtttctccatattggtcacgctggtctcgaactcccgacctcaggtgatccgcccacctcagcctcccgaagtggtgggattacaggcgtgagccaccacgcccggccttaaacacagtttctatgtctctttactggttcccctttctctattctctgctattggagggaactcatcctaattcccaagtaaaataagaaagaaaaaagtcaaaagagcaaaggaccctttcatgggctcttgccttctaggagcaatctgacagatatgtccccagctattaactaaaacaaaccctctattttcaaattagaccctaacataaggctgtccaagcaaaattatcgacaaactacccaggcatcaaactgctccatttttaacagtctgtccattaggaaaaaatttaagttcctctctcacataaacacaaagataaatttcagaaatattaaaatgcaaaatacaaaaatttcacaaaaactaacggaaattagctaaatatctgtcatactcctgtaacacagaaggccttcctagatatgaaaaggaacctagaagccataaaggcaaaaactgatagttaacaacataaaaataataaaacttctctaaagcaaaacataccacatatgacactaaagtctaagccattttgagttactttttgtatacagaagaaatacttgcaatatgtgaagaaaggccaggcgtggtggctcacgtctggaatcccagcactttgggaggtcaaggcgggcagatcacctgaggtcaggagttccagaccagcctggccaacatggtgaaaccccgtctctacaaaaatatacaaattagccaggcatgatggcgggtgcctgtaatcccagctactcaggaggctgaggcgagagaatcacttgaacccgggaggtggtggttgcaagtggaaccaagatcgcaccactgcactccaccctaagcaacagagcgagactccgtctcaaaaaaaaaaaaaaaagtgaagacaaactgttaacattcataaaataaaaagatactataaatcaatttttttaaagccaataggaaaaaagggcaaagttacacacaattcacataatttcttgagtaaatatacctgttcaaaagaatgttaaagagcctggccaacatggtgaaagcctggccaacatggtgaaaccctgtctctattaaaaatacaaaaatcagccaggcatggtggcacatgcctgtagtccgagctattcgggaggctgaggcaccagaatcgcttgaacctgggaggtggaagttgcagtgaaccgagatggcaccactacactctagcctgggcaacagagtgagactgtcaaaaaaaaaaaaaaagaaagaaagaaagaaaaattcaaattccagtgatatataattttcccctattagactgataaagattttttttaataatcatttaagtattaacaagtatgtggggaaaatgggtgagaattctgttggtgcaaatacaaattagtacaaaatttctgatgggcaacattgattaaagtttcaattgtacctatctttaaaacagcaattattaatctgaggattcatactacaggaagacatttgcaatgataatctggaaaacaagactataatagcaaaaactataaatgagataaatattattatttaccaaaaattggttaaactacatgaatcatgcagctttgaaaagagaaagaggtacagagcttatgaatcaacatgggaaaactttgcaaactggtgaatgacaaaagttacagcagcttactgtgtgatcgtatatttatcttcttttttttttgagacggagtctcactctgtcacccaggctacagtgcagtggcgcaatctcggctcactgcaagctccgcctcccaagctcaagcgattcttctgcctcagcctcctgagtagctgggattacaggcatgcgccaccatgcccagctaatttttttttcttttttttttttttgagacaagagtctcgctctgtcacccaggctggagtgcagtggtgtgatcttggctcactgcaagctccgcctcccgggttcacgccattctcctgcctcagcctcccaagtagctgggactacaggcgcccgccaccacgcccagctaattttttgtatttttagtagagacggggtttctccatgttggacaggccagtctcgaactcctgaccccaggtgatccacccgcctcggcctcccaaagtgctgggattacaggcgtgagccactgcgcccggccagagtaagttctttctagtcttgacagtgccaccatggtcctgaaaaacagaaaaataatgctcaaggatctgatttaaagcaggccatgttgtgcctccatctccaacttttccagtgaagctatctagagatttaaacaggacaaaaacacagtgtgtccttaccagtatttagtttggtcagtcttcttaacttcagtcattctaaatatgtgtataatgatacctcgtgattttaatttgcatctccctaatgaatactgttaattaacttttttcatttgcttatatgtcatctgtatctcctgtggtgaagtgtctgaatattttacttttgatttttttttcttattgctgaatttgaagagttctttacacatcctacatacaagttactgattagacatatgcttggtaaagattttcttctaggccaggcgcggtggctcacgcctgtaatcccagtactttgggaggccaaggcaggtggatcgttttaggtcaggagttcaaaaccagtctgggcaacatggtaccccgcctctattaaaaatacaaaaagtagctgggcacggtagtgtgcgcctgtgatcccacctactcaggaggctgaggcacaagaatcacttgagcccaagaggtgaggggctgcagtgagccaagaaggtaccactgcactccagcctggggaacagagcaagactctgtctccaaaaaaaataaataaagtagtaggaaaaagatgaattgctaacaaagttggagcaaatggacagtcatcttagaaaataataaagaggaatcactacgaaaaaaataaaaatttttttcccaaactgtggcttttctctttattctcttaccagtgtcttttaaagagcagattttaatagtctaatttatcaatttttatagtttgtacttttaatgtatatctaaaaaattattacctaactgaggtctaaaaatttttttctcctgttttcttccacgaacattatagttttaggttttacatttaagtccagaagccattttgagttagttttcctatacagcgcaaggtatgaatccattttttgtatatcaatatccaattgtttccaactgtggaaaaggctacatttctcccactacattgcctttatgtctttgtcaaaattattagttatctacatataaggagtttatttctggactaccaattctgtttccactgatctatttgtcttttgttgttgttgttgttgttgttgttgttgttgttgttgttttgagacggagtctcgctctgtcgcccaggctggagtgcagtggcgcgatctcagctcactgcaacctccacctcctgggttcaagcgattctgccgcctatttacctatttttacgccaaactattttacagcttttaattcttgaaatcaggtagtgttggctcccacactgttctttttcacagttgtttaaagttctttaaatttccacatgaattttagaatcaccctgtgcagttctataaaaaagcctgcaaagattgaaatataagtctcttaaatctataatttggtgaaaatcaacattttaacaaagttgagtattccaacccatgaaaaggatacacagtcacttctcattattgagataataatatgtcaatgactgttatgtgaatcagcaattatagagccattgctcccaggggaactaacgtattaggttcttgcaagcttctgctgacatttttgtgaactgatcatatgtcatgttttatgtgtttctgtttagagacttcttgtttagtatgtattactaatatatgttactgattcattaacattgaactcatgtccaatagtactgtttaactcctgcctgaataaagcttatctaatgcacatatattctccgtaaggcatatcagagcctcctggtacttagaaacactatatggcacttaaacattacactttaaacattttaaacatcaaaataaccatctttgtaaacatcaaaataaccaacaaaaagcacaaacatgcaaaaaatgcagcactaaataaaccaagaaagggctacttgcttacagtatgaaacccaaaataagaaagcagagcattgtcttgtttgatcccagctgggtatatacatgtgcactgggtgattcaaaatgttttgcccctgcaagtgtctgagaatgaccacaaaagcactgcaagtattggttttggggttacaaataaaaattagtgagtaagccaattcctaggtaaagaatccatgaataatgagaatcaactgtatcttattcaggtatcctttaatttcttgcagcagtattttgtagttctcattttctttaacatattttgttagacttatctctaagtagttcatatttttgatgcttttgaaaatgctactcttttattttcatttatgattgttctctgctaatgtatagaaacacaattggtttttgcatactgctcttctatcctgcaactctgctatagtaatttattagttctagtaggattccatcagattttctacatagacaatcaggtcatctgtgaataaggacagttttattcatttctttccaatctgaacaccatgcatttccttctcttgcatgatggcatgggctagaacctccacggcaacgtcaaacggaactggttaaagtggacatcccgtcttctttttttaaaataagtgtccagttttggccaggtgtggtggctcacgcctgtaatcccagcactttgggaggccgaggcaggtggatcacaaggtcaggagatcgagaccatcttggccaacctggtgaaaccccgtctctactaaaaaatacaaaaaaattagccagacatagtggcgggtgtctgtagtcccagctactacagaggctgaggcaggagaatggcacgaactcacaagggggagctttcagtgagccgagatcgtgccacttcagcctgggcaacagagcgagactgtctcaaaaaaaaaggtgtccagtttttcaccaataagtacaaggtcagctaataaggtttttcatagaagcacattagcaggctgggaaagttcacttccacttctagtttgctgagagtctttatgatactgaatattagattttatcaaatgatttttctgcatctattgagatgatcatgtgatttttgctttttagttcattaatatgttaaattacactactgattttttggaacactaaaccaaccccacattcctgggataaaccccacatggttatgacatattatccttttaataaactgttgaattagatttgctgaaactttgtttagatttttgcaattatatttatgagacatactggtctgtaatttccttaaaatgtatttgtctgattctggtatcccagtaatgctggcatcatgagccttgtaaaaaattccttccacttcaatatttttaaaagcatataaaattgatattattttttccttaacttgtataattcaccagtgaaactatccggacctagagttttctttttaagtagacttttactacaatttttatttctttagcatataaaaagctactcagggctaggcatgatagctcatgtctgtaaccctaccacttcaggccaaagcaagaggatcacttgagcccaggagttggagaccagtcagtacaacatggtgaaaccttatctctacaaacattaaaaataaaaaaattagccaggcatggtagcatgtgcctgaagtcccagctaggaggctgaagtgggaagatcacttgaggtcaaggccacagtgagctatcatcggaccactgctctccagcctgggcgacagagtgagaccctgtctcaaaaaaaaagctattcaggttatccattttcttcttcttcctttgggattaatttgttcttctttttctagtcttttaagatggaagctgaagtcaaatatttgagctatttgagttcattcttctttcaaaatatatacatttggagctataaatttctccctaaatactgttttagcaatatctcctaatgttgtattgctgttgtcatttagtttaaaatactttcttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacagggtttcaccttgttaaccaggatggtctcgatctcctgacctcatgatccacccgcctcggcctcccaaagtgctgggattacaggcgtgagccaccgcgcccggcctagtttaaaatactttctaatttacctttccttctttttaaaccatagattacttatattttttaatttccaaatatttagagatttcccaagaatctttctgttaatgattcctaattccactgtaatcagatacaattttttaatgacttgaatccttttgaattcatttaagacttgtttcatggccaggcaccatggctcacgcatgcaatcctaggagtttgggaggcagaggcaggaggatcacctgaacccaggagttctagaccaacctgggcaacacagtaagatcccaacactacaaaaaaaaaaaaaaaaaaagaatattagctgggtgtggcggcacacatttatagtcctagatactcggggagcagaaatgggaggattgtttgagcccaggaggtcaaggctgcagtcagccatggtggtaccacttcactacagcgtgaacaaagcaaaaccccacctccaaaaaaaaaaaaaaaaaaaaaaaaaaaagtcctttatggcccaaaatacagtttatcgttgcaaatgttttggataaacttgtgaacaaatacgtattctactctttttaggtagagtgttctataaatgcaattaggtcaagttgcttaacagttactcaagtctactatatctttgatgattttctgtccacttctatcaattattgacaggggttactaaaatctccaattatgactggatttctcaatttctccttgcatttctatcaggttttgtttcatgtgttttgaagctctgttattaggtgcataaacatgtaacatcattatgtcctcttaactgacctctttaccattataaatgaaatgaccttctttatccctggaaatattccttgctctcaaatatactttaatattaatatagccactccaagttgcttttgactaggttaccatattatatcttttcccattctttcacttttaacctgtttgtttacaaactatttcttgtaggcaagcatatagttggatcttgcttttatatccaatctgacaaattcagcctttaaactggagtgtttagacaatttacatttagtgtgactattcatatggttaggtttgattctatcatcttgctatttattttatatttttcccatttggtgtttgttccttttttcttctttttggacttctgttgaattattttgtgtgactccattttatctcctttttattggcttattagttgtaactctctattttgctattttaggggctagagtttacagtatacatttttaacttaccacagtctatcttccagtgatattatcacctcacacagagcaaaagaatcttataacagtatacctccatttctccctccctgccttttagctattgttatcatgcattttacttttagataagttataaaccccacaacagcttgttaatatttttgctttaagcagtcacttatcttttaaggagatttaactgataagaaaaaaaatctcatgtatttacccaagtagttaccatttctagtgttctttctttcatgtaactccatatttgcatctggtatcattttcctgctgtctgaagaattgcttttaaattttcttccagaggggaaatgttagcaataaattctttctgcttctgtgttgtaaacatctttatctcatctttattttagaaacatatttttgtcagatacagaattatagattgacatttttcatctttcagtactttaaagatgcttccccagtttgcttgcttatatcgtttctgataaatctattaagataatcatctttatctttcttcctctacacacaaaatgaccatatctctttctctgactgcttttcagattttctctttatcatttgctttcaacaatttgattataatgtacagtaagtcctcacttaacatcatcaataggtccttggaagctgcaacttcaagtgaaacaaagtagaacagaacccaatttaccatggtccaatcgacataaacaagtgttaagttcctacagtgtatttctagttacaaaaacatcaccgaacttctaataccaaaacacttctaatattaaacaatgaaatgaatgtgagctacacatacacttaagaaagattaataaaaacaagtaagataattattcacccaatttttctagttcagggtcacaggtggtcagagcgtatcctagccgctcagggcacaaggcagaaaccagccttagacagaatgctattccacactagagtgcgtgcgtgcccacacacccacacacacacacacacatacacacacacacacaacagactaactcatactggaacaatctagagaagccaattaacctaatgctcacatctccctaatgtgggaggaaactgaagtcccaaagaaaacccatgcagacatgggaagaacatgaaaacatcacaccaatactggccccagccaggaatcaattctttttctctcatcaacattatgacaaaatgatgttgaaagaaacattatttgaggacctgctataccttggtgtagttttatgtttcttatacttaaaactcattcaacttctttatctgtagatttatggcttaagtctaaaacatttttggccattatttcttaaaatatattcttctgtatattatgtcccttgagaactacaattattcatctatttggctgcttgagtgtgtcccacagctcactgacttttttttcttctttctctatgcttcattctggatggtttctattgctctgccttcaagttcattcataattttttctgcaatgtctaatttaccattaatctcataccgtatatttttcatctcagttgtagttttcatcactgtaagtctgatatgggtctttttgtctcttctgtatctctaactttttgaatacatggaatacagttataatgttttaatgccctctgctaattctatcatctgtgtcagttctgtgtcaattttgacggaagattctcataattatgggtcatatttcatgcttctttgcatacatggtaatctttaactgaatgacataccttgttaattttaccttgctatatgactcctataaatctttttggactttgtccaggcatacagttgagtaatttggaaatagtttgttcctttcaagtcttgtttttataatttactagttcgctccagagcagcaacatcttctcaactcagagtctgccagactccacatctcagtttctactctctatgtcacatcctggaaaatctctcagtgcagtaggcctggggcaattgtaggactcaccttgtttgtttcttctctctcaagaatcacttgattcttgagattaagacctgaatgtcttaatcattgttgtttctacatattttgtttttttggagaagaggggtaggattgtttcaagaggacagtaaacacgatccttgttacaccacatggaccagaggcaaaagtccccatccgtccttcttatttaatctatctgtatctatttgagtttcttgtaaacatcataaatataccgtccctgacttacgatggttcaccttatgattcaactttaccatagtgacaaagtgatatgcactcagtagaaaccatactgaagtacctatataagcattctatttttcactttcagtatcacattcaataaattataatgagatatttaacactttattataaaatagggtgtatttagatgattttgcccaactgtagtctaacttaagtgttctgagcacatttaaggtaggctaggctaagctatgatgttcagtaggttgtgtgtgtgtgtgtgtgtgtgtatatatatatatatattttttttttttttctgagtcaaggtcccactctgtcacccagactagaatgcaatgaagactataactcactgcagccttgacctcctgggctcaagcaaccctcacacttcagcctcccaagtagctaggactacaggtgcacaccaccacatccagctaatttttgtattttttgtagagatgggttttcaccatgttgtccaggctggtcttgaactcctaggttcaaattatctgccagccttggcctcccaaagtgctgggatacaggcatgagccaccatgcccagttaattatgtgtatgaaatacatttttgactttcaatattttcatcttacaatgggtttatcaggacctaacaccatcataagtcaaggagcatctgtacttgagtcttgctcttctatacaatctgacaatctttgccatttaaattgagcatttaagtcatttacatttagtatagttgtcaatattactagatttatatctactgttttgttatgtttttgtccttttatttgttcctttcttcaactttatcttcttttagactgattatttttagtacccattttatatcctacataggcttactatttttattttgtcgtataggaattgttctaaaacatacacagcctaccttcaaatatcattccacttcatgtttgatatcagcacctaaaaattctatacttccctttcccttatccctttctttatgctactgacatcaattaatttctatgtataagccctcaaggcactgttagtatttttgttttagtcaattatctttttaaaagttaaaaatgggccaggcatggtggctcacacctgtaatcccaacactttgggaggccaaggtgggcggatcactggaggtcaggagttcaagaccagcctggccaacatggcaaaaccccatctctactaaaaataaaaaaattaactgagcatagtggctcatgcctgtaatcccagccctttgggaggccgaggcaggtgaatcacttgagtccaggagttgggagaccaacctgagcaacatggcaaaacaccttctcaacaaaatatataaaaattagccggatatagtggtgcatgcctgtaatcccagctacttgagaggctgaggtgggaggactgcttcagcctgggaggtcgaggctgcagtgagccatcatcgtgccactgcactccagcctgggaaacctgtctcaagacctgtctcaacaacaacaacaacaaaatttttatttcaataccaccaattttcagctatttgattatgatgtgcgtggttaggttttttttttttttaatatttcttctactttaggttgacttcttaccatcatctacaggtttatagtttctactaaacagagaacagaggtttaaagtcattatttcttaatgtcattcgcagcaacctggatggaactggagacttattctaactgaaataactctggaatggaaaaccaaacgtcatatattctcactcataagtgggagctaaatttgtgaggatgtaaaggtgtaagaatgatacaatggactttggggacttggggaaagggtgaaagtggtatgaggtataaaagactacacattgagtacagtgtacactgcttgggtgatgggtgcaccaaagtctcagaaatcaccactaaagaacttattcatgtaaccaaacaccacctgtttcccaaaaactgttgaaataaaaaataaataaaagtcattatttcttataatattttctgttgcccctcccttctcctaggattctaattacacgtcttaggccactcgatatttcccacagctcactgatgctgtttttttctttagtccttccaccctgtgcttcattttggatagtcactattgttatctattcaagcccactgatgtgtgtcttatctgctattaatcccatccaatatatattttatttcagatactgcattcttcatctctatttttatattttctatgtatttccacatcatctttctgttttcccctcgtgtcttgaacatttagagcatattagtaagaactgtttctatatctttgtctgctaaaccatctttatcatttctgggtctctttcttttcagaaaatgtttaaatcctggctatgggtcatattttcattcttctttgtaagcattttaatattttattgaggtagaattgacataatatctaattaatccattcaaagtgaacgttcggctgggcacggtggctcactcctgtaatcccagcactttgggaggccgaggcaggtggatcacttgaggtcaggagttcaagaccagcctggccaacatggtgaaaccccgtctctactaaaaatacaaaatttagctgggcgtggcggcaggtgcctgtaatcccagctactgaggaggctgaggcaggagaatcccttgaacccgggaggcagaggttgcagtgagctgagatcacaccactgcactccagactgagcgacagagggagactacatctcaaaaaaataaataaataaaaaataaactgaatattccagtggtatttagtccactcacagtgttgtacaactaccacctatacctagttccaaaacactgttatgaccccaaaagggaattcaacacccattaggcagttgcttctcattcacccttaatcccaggccctggcaagcaacaatctacattctgtctcatagattacctattgtggatatttcacataaatggaatcatacaatatgtgaccatttgtgtgtgtcttctttcacttaatatgttttctaggttcatctgcatcgtagcatgtatctgtacttcatttctttactgctagacaatttatggaatacagactactgcaatttgtttactcattcatccactgatggacatttgggttgtttccaccatttagctattgcaaatagtaatgctatgaacatgtgtggtcatatatttgtttgagtacctgctttcaattcttcagggtatatacctaggagtggaattgctgggtcatatgacaagtctatgtgttcctttgaggaattgtcaaactcttttttccacagaggctgaaccatttaacattcccaccagcaacatacgagggttccagtttctccacatcgtcctcaaaaccagttactgcccgtcttttgattctggccatcctagtaggtgagaagtggtatcttactgtggttttcatttgcatctccctgatcactaatgatgttgagtattaatgatgtgtttatcttctcagagtaactgtctattccaagtcctttgcccattttttagttgagcttttttttgctgttgagttgtaagttttcgttcttgtattttggccattggtccattatgagttaatttttatacatggcatgaagtaggggtccaactttattgttttgcatgtgcatctccaggggtccccaaaccatttgaagagattattctttccccactgaatcatcctggcatgtttgttaaaaatcaattgcctacatatatattaattctggactctcaattctattagtctatacatctatccttatgccagtaccacactattttgatcattgtagctttgcagtaagtttcttaattgggaaatatgagtcctctggctttattcttcctttttcaagatggttttggctatttggatctgttgcaattccatatgaatatgaggatcagctttccaacttttgcaaaaaaaaaaaaaaaaggccaatggaattttgatagagattgcattgaatctggagattgctttggacagtattgccatcctaacggcaatgtaaagtcttccaattcatgaacacaaaatgtctttccacttatttaggtcttctttatttcaacatgttttatagtttacagtgcacaagtctttcataagcaagtcaactcctttaggcttttggatgctattataaatgcaatcttttaaaatttctttttgtattgttcattccgagtacacagaaacacaaatgctttttgtgtgttaccttgtacctacaactttgctcaagttatttattagctttagtggaggtttttctggattctttgggattttctatatataggaccatgtcatctgcaaacagagacagttttatttcttccttccaaatctgtatgtctttgtttctttttcttgtcacactgctctggctataacttccactacaacttgaataactggtgagaatgggtatccgtgccttgttcctgatcataagggcaaggatttcagtcttttactattgagttggatgttagctgtgggttttttcataaacgctgaatgttgaggaaatgtttaaaaaaaaagttccctactattcctgattttgagcctttctatcaagaacagctgttgaattttgtcaactgcctactgtatcaattgaaacaatcacgtgggggttttccccgcttcattctattaatgtgttgtactacaccacccttgcaatcctgggaataagtcccacttggccatggtgcatattcctttaaatatgctgctagattcagtttgctagtattttgttgaagatttttgcatctttattaataaggaatattggtctgtaattttcgcattacgtctttgtttggctttggtatcagggtaataatactggcctcaaagagtgagttaggaagtattcttactctctcctctccaattttttggaagagtttgagagcgattctcatactctttaaatatttaaatatttggtattcttctttaaatatttggtagaatccaccagagaagcaatatggtactggacttctgattgggagtttttgttttgttttgagatagggtctcactctatcacccaggttggagtgcaatggcataatcatggatcactgcagtctcaacctcccaggctcaagtaatcttagtttgggaggttttttaactaattcaatctgttcacttgtaagtctgttatattttctgtttcttctgagtcagttttagtaatgcgtatttctaaaactgtgtccatttcatgtaggttatctaatctgtgcataaaattgctcacagtattctctttaatcctttttgtttaaggtcagtagtaatgtccccacactcacgtctagttttagttatacctatctgtgttttttctttgtcagtctagcaaaaggtttgtcaatttcattgatcttttcaaagaatcaaacttttggtttcactaattctctatattattttcctattctctatttcatttatctccactctaatctttatttacttccttttttctggtagctttgcattttctagtttctttaaaatgtaaagtaagattatttatttgaggcctttcttattctttaatgtagatgtttattgctaataatttccctctcaggactgttttcactgcatcatttaagtcacatatattgtttccattttaatttatttctaagtattctctaattcccacatatttgtaaatttccatatatttgtaaattttccagtattccttctgttaatgattactaacttcattccactgtgactggagaagatacatagcatgatttcaatctttttaaatttactgaaacttgttttgtggcctaatacagcctggagaatgtttcatgtatactttaaaagaatatatattttggcagggtgcagtggctcacgcctataatccctgcactttgggaggccgaggagggtggatcacctgaggtcaggagtctgagaccagtctggccaacatggcaaaaccccgtctctactaaaaatacaaaaattagctgggtgtggtggtggacacctgtaatcctagctactcaggaggctgaggcaggagaatcacttgaaccccggaggcagaggttgcggtgagccaagatggagacattgcactctgggctgggtaacagagcaagactacgtctttcaaaaaaaaaaaaaaaaaaaagacaaaaaaaaaagaatacatattttgctgttgctgaatgttctgtatatgtctgttaggtctagttgattaatactgttgttgaggtcctctagtcccttactgatattctgtctagatgttctatccattgctaacgtcaaagcaagcattttttgactgaatgacaaaaactaaattttacattgttgggttctgaattttgttgtattcctctaaatagtgttctggtgcagttaagttacttggaatcatttggagccttctgaggactcttcccagtgccccatgtattctacaacatactttactctgcatagtaggaacacgactatttgaagccttattgtgaactctggaaattgtttttcttagtgctttccaagtgttttcttctctggcctcaggtagggcctgtcaagcatctacgaaatcagaactcagcaaaagactccaggagaaccctctggagatctccaaaatgcatgctcacttgttcatgctctcttgctttttagtttatgcctccccaacgccaatcccaacccccttagctcttttttctctggtactctgccctgtaattctaatcgccttgatcttcccaaatttttatctttgtctttttatctcagtaggactgctgggctctgttttggttcctccacaccttgcactgcagccaataaactgcctctaggctctgcagtaagctgttacaattgaagggctttaccttcacttgttcctattctctcagggatcacagtctggtgctgcctgtcatcaatgtctaaaagctattgtttatatattttataaattctcaagttatttaaagaggaagagtagatttttgctacataacaaattacctccaattttgtggctttaaaaatcaagcattggccaggcacggtgactcacgcctgtaattccagcactttgggaggccaaggcaggaggatcacctgaggtcaggaatttgagaccagcctgcccaacatgatgaaaccccatctctactaaaaatacaaaaaattagccaggtgcggtggtgcacgtctgtagtcccagctactcaggaggctgaggcaggagaatcacctgaacctgggagacagaggttgcagtgagctgagatcgtaccactgcactctagcctgggtgacagaccaagacttcaactcaaaaaaagctaaaaaaaatttaaaaacaaacaaaacaagcatttctttttttcacacagtttctgagggttggcaatcagggaacagcttagatgggtagttctggctcaggatctctcatgaggttgcagtcaagatgtcagcaggacagatgtttaggactggaagcttgactaaagctgagacatctgcttccaagaaggctcgttcacatgctgttggctagagaggcctcagttccttgttggctgttggcaggaggcctcagtttcccacagcatgggcctccccatcgggccattcacaacatggcagctaactattctcagagtgagtaatccaaggttgggggtagtgaggggaaggaggtggagccacatttgtattataaataacctatcctaagaaatgatccatcacttctgttacattctattggttccacagataaacctcaatacagtgtgtatggggattacaccatggtgtaaatatcgggatgccgggatcattgggggccatcttggaagctggctacatataaaataaatccagttcccattataccagcataggggaaagtagaagtctttcttacacatttttaacctccttatgtttactatttttcttatcccctaactgtaggctatattctatggctacaagagacatgagcagattacagagctccacacccagtcttggaaagaaaagtaactactactaagtagcagcaacttttaagagaaaagaatagagttcctggtgcttgtggcaagaagcaggaggaccttgaagccaatctgggcttgagaaagtggttcattcccccaaatacttcactcaatgatctacctaaatgtctgccgtctgccctcctttcccaccaatttccagtcaggcagcaatagccaacagcaatattaatagtaaaattaatagcagtagtaccagcaccaatgctaagcattttgcctttgttatctcaattactcctcacaacaaacctctgagatagctgtcattattccttacactctagactttgtttcttggtagtcatactctggtcttacactatccagtgtaataaaaactttttttttttttttaataacacctggctccctcttgccctacacggttctgctactccttcgacacggaaaaattctgtcttgtcctgcctgtcatctcttccacttcagttaggccttaaagcttcctcttagctaccatgttcccaatatctactatcaaacctcactaaaaagaatcaccagattattttgatccctgtaaattcccagttgctaggctctcccaatactacaaccgcctaatatagacttttccaattccttaggacacactgacctgtcaagcctacctcaccagctaatctccaaaacttggccctacttcagctactcatttaaaaatattattcacagcatgtatcttcgtaatttatatttgctgtagcttactgctaaaatgagttccttttcccgggggacctataattaatgatcagggagaaagggccaaaatataccatactggtaaatattatggtaccccagaaaccagtatactcccgttggttatctgttgaataatgactgaaaagtataaagtaatgattataaatactaactcagaaaattatcagagggcataatccaaagaatgttatttacaaataaaaagaaatagatgacagtagacacatataagcaatccacaaaaggcaaaacacgaaagaacaaaaaatatttaaatattatagaaacacaaaataaaataccaccttttgtcagacagataagcaaagactgaaattttgtcaaggaagtaaggaaacaggtagatacacttctggcagatataattttgtctttttgggagctatacaccaaatatctttaaaatccacatacatctttgactagtatttccatttctaataattaattctaagaaaataattggacaaagagatatacatttaaaaaatttactatggcactaactacaatataaaaatctgtccaacaataagggcttggttaaattttagtacatccaaactaagaattattattaaatcacttcaaaacattacatattgtataatcccagtttttaaaaagtaacatatattcacataaaaacatacctgcatagaaaaaaaatctagaagtatacaccccaaaatgttaccagtgattatctctgtaatagaagtggaattttttgtgattttttttgtttgtttttcagggtttgtttttttttttttttgcttatcacacctaattttctacagtaagcataagttgcacatggataataacacacattcttaaaaggcaaaaacaacaactatgatcacaatttaaaggcagaaaagtgctattatcttaacagaacatggaacatccatgttctatgataataataaagttaggcaaagttaatatcaaataacctgatattcaatagcctagtttttaattagttttagtaacacatatggaagaatctgttatgaataaaaaaccatgtaggccgggcacggtggctcacgcctgtaatcccagcactttgaaaggccaaggcaggcagaccacgaggtcagaagttcgagaccagcctgaccaacatggtgaaactccatctctactaagaatacaaaaattagccgggcgtggtggcatgcgcttgtgatcccagctactcaggaggctgaaacagaagaattgcttgaattcggaaggcggaggatgcagtgagccaagatcatgccactgcactccagcatgggcaacagagtgagactccatctcaaaaaataaaaaataaaaaagcatctaattcaggtattttaagaaaacaaaagccttcccaaataaaaatgtagtactaatcctagagacaacgttgaaaatcacgtagtaaaaatctcaactctttcaagctgagaatcaacttaaatcccctttgcatgcctagggtctcattctgttacccaggctggagtgcagtggtatgatcacagttcactgcagcctcaacctcccaggctcaagagatcctccaccccagcctcccaagtagctgagactacaggcatgtgtcaccatatctaactttttttattttttgtagagacagggtcctactatgttgcccaagctggtctcaaaatcctgggctcaagcaatcctcctgcttcagcctcccaaagtgctgggattacaggcatgggccaccacactgggcccctttacacatttaccttgagaaccctcactgttatgagaaagtggttgcccagaaagtaagattcaaaaatcactcatgaatttaagaattcaactctatgtttagctgaagagagtcttcatctcagacttgaacagtttgggggatgacagttatagtcagtaacaagaagggggggtctcttaaattgttctaggaatacacttctgttaagattgagcatcctaaatccaaaaatctgaaatccaaaatctccaagatttcaaacttcttttgtaccaacataatgctcaaaggaaatgctcattggagcattttggattttcgatttttggattagggatgctcaacctgtaggcaaaattccaaaatctaaaaaaatctgaaatccaaaacacttccagtgccaagcattttggataaggaatactcaacctgtacaatttaagtatgtatatctccaggcactgtgtacgatttctagccaacatccagggaattgcttgtggccatgtagagaattgcctaggaactgtttgcaatgcctgattcaacatgacctgcaacatagccagtcagtaaatcctcattaggactaatccataaactataattttcaatgaagttggctagcataaaatggtcatttccaaatgtctgtggcagaagatgaaaaattattttaattgtaaccaaataattaatggcaggtatccatagaaagttatttagtggcaacttcacagctataacagtttgcaaataaggtctcataatgcttccactgggatttgagagcagctgtgaggaaacaggaagcactaagcacaggacagcactacgatttctttaaattattagtaatgtttttgattaaagtaatttttgttgcactagggaagtttctagtacaggagaaaactaaataataactttacatgagggagagttagttgcatttgtgtaacacaagcagcatataacaccaaaactgacaacataattacgtggttattgttgaaaaataaatatctccttgctttagtgacaactctagcaccattcatatattcatacacccaacaaataaatgtatgaaaactatttacattgtttattctaggacctggaaatataagagtaaacaagaaaagtcactgtcttcatgaaacaaactgtctaacaagggagacagatgttacaacaaataattacatatttgactataactacaaatgtcatgttattaaactaaagagcaaggtgctataacagcatatagcaggactgcagtcaagcaagccaaacccaggggtggggaagagaggtccagcagaggaaatctgtgcaaatccctgtagccagaacaaccttacccaatctaggaactgaaacggtccagtaaaactgaagcactgagattatttctagggcacacattaagtctaagatgtataaagacatccaagagatcaaggtggtaaatgctacatgagtttggagctcagaaaaaaaaggtctagaccaggtataaacttagaagtcattagcttagagatggcatgggatgcacaggaactggaaatttctttggcaaggtgagcaggactatatgtcggaaggcagggggtcaagattactttctttttttggaacgcatctcgctctgtagcccaggctggagtgcagtggtgtgatctcagctcactgcaacctccgtctgctgggttcaagcaactcttctgcctcagcctcccaagtagctgggactacaggtgtgcaccaccatgactggctgatttttttgtatttttagtaaagatggggtttcaccatgttggccatgctggtcttgatctcctgatctcaggtgatctacctgccttcgtctcccaaagtgctgggattacaggcgtgagcgaccacgcctggccaagattacttttgttttttttttgagacagtctcactctttttgcccagggtggagtgcaatggcacgatcttggctcaccgcaacctccgcctcccgggttcaagtgattctcctgcctcagcctcccgagtagctgggattacaggcacgcaccaccatgcctggctaattttgtattttttagtagagacggggtttccccatgttggccaggctggtctcggactcccgacctcaggtgatctgcccgccttggcctcccaaagtgctgggattacaggtgtgagccaccgtgcccagtcgattactttcttaatcacaggggaaaagaaaaaaagtttaattacttctctgttgatttgcaatcaaaagaaataaaagtattttgtttctttccttttttttttttttgtttttaagagacagggtcttactacgttacccagtctggctcaaactcctgggctcaagagatcctcccacctcacctcagaaagtgctgggactacaggtttgagccacccagcctggccaaaagtattttctaacactatagttatgatacaatgttctatttgatcgggaaaggtaaaattaaatgtataaagttcttggagaaacgtcaagaactaagaaaagcacttctttcagtgagtctaaagtattaaatgctgtagtttatcagggcacttccttctagtgtttttcagtgccctggaaagtgaactttaaaaaaaaaaaaaaaacagatacaactacttcacaagatttgtcactaaaaatgctttgagtctgcagaactgccacctactgaagctgtatcatgatcataagcattctgaacacattaacaagtcctaaagggatgtgacatcaagaagaacagacaaaccttctgccttgcacaaccagaagttatcaactttcagaagatcattctaatccttaaacaacctgccctacacagcctccaatgatgactatacagtaggtaactgctttaaaaagtgatgagtcaggttacagttatagaaaagaaaagctgagttaaaatgttccacaatttacagccaaagcaccatgtaagcatgaaaaatgccttaacacaaactcacctgatttatttgaagcatgttaagacaatattgaccaaactgctgtatccctcacggctccaaaaactggaaaacgaaaatgaagaaataaagttcaacttagctgataacctcaatgactggtattttaaacacatgcccttgatcaaaatcaaatataaaatgtaatttatccagatctccatagaactttctatgatgataaaaatgttctgtacttgcactgtccaatctggaagtcattagccacatgtggctactgagcacttgaaatgtggctagagcaatcaagaaaataatatttaattttctttcatgttcacttgaataactacgtcactagtagccaccatactggacagtacagatctgaacaaagctccttctgcttctagacttctaagacaatcccaacaaaagtgaagctgttaaaaataaatctgagagtttcaggttaatatttaatgtatacttccctttttgcagtcctgttttaaacagctttgttcccatcttctatacgataaattaatcctaaagaagatgcaacaccacaagtattctcttagatggtatggaaaagagcatatagtacaattatcttgctgaatagtttctttttctctgtcattttgtctgttatcatcagtataaaaatagtatgtatattaaaatttcaggctgggcgtggtaatcccagcattttgggaggccaaggtgggtggatcatttgagttcaggagttcgggaccagcctggccaacatggtgaaaaccctgcctctaccaaaaatacaaaaattagccaggcatggtggcgcgtgcctgtaatctcagctactcaggaggctgaggcaggagaattgcttgaacccaggaggcagaggttgcagtgagccgagattgcgccattgcactccagcctaggcgacagagcgagactccatctcaaaaaaaaaaaaaaaaaaaattttaatttgaaaacagatgccaatgaagggcaggaaagtccaaattacaaataaataaatcatgggatcttgtaatgaaaaaaagtttatataaaatataaattatatacagacctctcccctaaaaattatctaaagcaacaacacaattgtgatacacagcaaaaggcctatatctaatcacctgtatagaaactgttatgctgctaaattttaatattgaactttcccctggaagcaaacgttttgtaagtacacacatacatacacaaacacacacccatatttggctaccattttttcaagatgacaaactagagtccattcaaaatgactttgaaaactttaatatttttcttacaatagtgtcctcagcatctgcatcaatttttatttattttctaattactgtcacatttcctatgagaacgggatgctgtataaagagcacacggcctggatattggtgaatttgagttttagtcaaagttcttcagattaccttctgagccttggttcaaattactttgtgtatctttgagttcttctttttctgtcttcttttttttcttcaatctttaaaaagtaagctaaagtccttgtggtaggcagcctctaacaaatagaatatagcagaaataatgagataccacttccaagattaggttataaaaattcttaggtgtcaccttctctcactcatttgctcagagggaggcagatgccaaactgtggtgccctttggagaggcccatatggcaaagaactgagaaaagcctctggccaacagccagcaacaattgatttcttcagtccaagagccccaggaaactgaaccctgcaagagccacatgaatgagttcagaaacagatcttccaccagtagagcttccagatgtgactgcaaccccaactgacagcttgactaccacctcttttatgagccacaggcacccagctaagctgcacccagatttctaacccacagaaactgtaagataatgtttgttgtcttaagtccttaaattctggtgcaatgtgctatgcaacaataaataagactatcctgtccaactctataattcaatattcccatggtgctttaggtattaattaatatttggataggcaaaaaaataaaataaaatccctgttcaacatgagcaaatgagtaacattagaacttcaaagtggcaaattataaaacttaaacatttatattttcaattcaaaaaatgagattattcacaagtgtagcattagtcacatggtgttaaaatacacccgctttcaataggaatggagtatctcattaaaaaaatacactagctataacttaaaatacaaacacaaccaatcatctttttttttaactgaaaacagttcatttaaaaagtaaagtgtgaataaccactaaagcatctcagtgacttagtgtcccttgctttctagaatttatcattactggtcgggtgtagtggctcacgcttgtaactcagcactccgggaggccgaggtggggggatcacctgaggtcaggagttcaagaccagcctggccaacatggtgaaaccctgtctctactaaaaatacaaaaattagctgggcatagtaacacatgcctgtaatcccagctactcgggaggctgaggcagaagaaataaatgcttgaacccaggaggccaaggttgcagtgagccaagatcatgccactgcactccagtccaggtgacagagcaagacttcatctcagaaaaaaaaaaaaaaaaaggccaggcgcagtggctcacgcctgtaatcccagcactttgggaggcagaggcgggcggatcatgaggtcaggagatcgagaccatcctggctaacacagtgaaaccccgcctctactaaaaatacaaaatattagccgggcgtggtggcgggcgcctgtagtcccagctactcgggaggctgaggcaggagaatggcgtgaacccgggaggcggagcttgcagtgagccaagatcgcgccactgcactccagcctgggcgacagagcaagactccgtctcaaaaaaaaaaaaattaacattattaagcattcaccaactttgaaaaactccactttgtctttattagtatacgttgctaaagttacaaatgcttatctacagatctctatgtatttcttcaatattagaggctgataacactggtggctgattccaagaagcaagcagagtaagatattggggtacctttttgaaagttctaacctttttttttttctttttttttgagacggagtcttgccctgtcacccagagtggagtgcaacagctcaatctcagctcactgcaacctccacctaccaggctcaagtgattctcctgcctcagactccccagtagctggggatacaggtacacaccaccatgcctggctaatttttgtattttttgtagagacggggtttcaccatgttggccaggctggtctcgaactcctggcctcgggtgatccatctgcctcggcctcccaaagtgccaagattacaggcgtgagccaccacgcccggcccgaaacttctagtcttctgacacggaaaagatattccatgaagtaacaaaaaataaaactttatgaacataaaattaaccatacgatttaaatattctgtaagccttttctttacaatataaagagctgtagaaattaaaacacatgaaactaatgtctataacagcactctgtaattggctaacattctgaaaattatacttttttaagcaaaccagttattttagatttacatcaatttaaaaattgtagtttgtaattataccatggacaattcagaatgttcacagtggcacgtctttaagactctgtttctactttaaagacacgcccagtctactgtcacatattttaaacaatttgctaaaatatcaagacatatcaataaaatgcagagcagttttatactacctttggtttcataaaatccacctcctcagctgggtgtggtggctcacgcctgtaatcccagcacttttggagtctgaggcggacggatcacctgaggtcaggagttcgagactagcctggcgaacacggcaaaatcgtctctactaaaaatacaaaaattagccaggcatggaggcacgcacctgtagtccaggtactcaggaggctgaggcaggtgaatcgcttgaacccaggaggcggaggctgcagtgagtggagattgcgccactgcactctagcctgggtgacagagtaagactccatctcaaaaaataaaaataattaaaaaaaaaatccacctcctctatcacaaaagtttccagctacagttgattccaattacaactaagcgcttttagagaaatgtatccatgcgtcccaaaaatgccctatctggtcaggcatatgaagacaggcaattctagattccaaactactaaatgaaaacaagcaggattatagggagacggctggggaagacgtgatgctcatgaagaatggcccaacctgtaactgcaatgtactgctgatataagtcgtactttaattatgaattacattttgcccatctgagaaattaaaagctgcacagaaatctatataatccccaataattaaactgctttataaaacggcactgttactaaatatgtataaattttttatatcagcacccatcctacagttgataggcaattctcacttaaatgtcttatttgacaacatgaaaagcaaaaaaaatttactatctctactcttagactacaaactgctacaaaactatcaattcaatgcttattactctaaaaaagatatacggtcctttaaagagctttttaaaatgtttttcattttgatttttcaaagtgggtacccaaaaacactgcttttatgtaaggaaaacagaagtcttacgccacaaactattctagtggaaaactctaaataacacaggccagaaaaaaaaaaaaggaaactaacatttttcagacaccaattgtatacgctaggtgccacattttgccatttttacatcaactcatttaatcctcatcatcttgggatgtaggcattatctccatttttctagaggttgggttatttgcctacagtcacattgctaggtttagaacggttcattctggcccaaagtcgtcttttcttcactatacaccaaattaaaaaagacttgccttctttttaatttttttttttttttttttttttgagacggagttccactcttgctgcccaggctggagtgcaatgggcaccatgtcggctcaccgcaagatccgcctcctggtttcaaatgattctcctgcctcagcctcctgagtagctgcgattacaggcatgcgccaccacggccggctaattttacatttttagtagagacggggtttctccatgttcgtcaggctggtctcgaacccccaaccctcaggtgattcacccacctcggcctcccaaagtgctgggattacaagcatgagccaccatgcccggacatttttttttttttttgagactgagtctcactctgtcacccaggctggagtgcaatggcgccatctcagctcactgcaacctctgcctcccgggttcaagcgattctcctgcctcagcctcccgagtagctgggattacaggcgcgcaccaccacacccagctaatttttgtatttttagtagagacggggtttcaccatgttggccaggctggtctcgaactcctgacctcctgatccacctgcctcggcctcccaaagtgctgggattacaggcatgagccaccccacctggccaattttttttattttctatgatcagcttggtgaaaaataaaagatttgccttcttataatttttcctggaacaaagtcaagggcttgacctctaggacaacataatggcaaagctcctatatagaacttggggaggattatttaaaatcaaacgatgcacacataaataaaaatgataattattactgattctagacatctagtattttgtgtacctataagaggcacaaatatatctatatgtgaataatcatactgtgcgtgtctcaaactatgcagtctaagagaattcaattttgcagtatctagagttttccctctttattatgatctgtacctataaatgatcagattcccagcactgaacgtgcacaaaacaagataataataggaataaagagaagggtaggcacaaaggaaaaaaaaaaaaaaacctaccatatcttctagaacctaaacaggaaaaccgctctgcctcgatttctggattgtttgtatatttaaaagcttgatgactatcttagattttttttatattcatactatttgttgaaaagcaaaccaagccactcttcctagcacttcattccagacaagccaagtaagctaaaatgtaaaatttgcatggttttccaagctcaagtatttaggagttaaggatcacaatgtatgtaacttacccttaaatggtccaggggaaaaatattttgtgtgtgatagagagcaaataataaatacataaaatgttaacaggtgaatctgaataaaggttacaaagattttctttgtattattcttattcttgccatttgtctgtaagcttgaaattatttccaaataaagttaaaatttaaaaattacacagcattttatttgaaattaacaatacatacttggattacacagcaacattcttacaaatacaaaacactggtttttatggggaaaaatgcagtaatttgtgagcaagtatgtaccatatcctaccaacttatcatcacttaggaataaatttcagactagcctaccatataataaaatatggcaatagtgacttgacttgaaaccatagcaggaaaacacaaacacaccagatagtttggcataactgcttcgcaaatttaatacaggcctgctgcaaaatgcagcaatctacaattaaagtgttatgtgatatctcttgtttgcagtaagatacaaactgaacaatgaaaatctggccatactacaaaacagagatggagagtaagtcttggttttggtagttttattaaataagatttttccaccgcagctgagttcacaacagtgtacttgaatcatctaaagaaagcaaggacggggaagaaatatcctggagaaatgttgaaatcttttctcctccaaggttactatcaccctgcctgtccatcacaattttgatttcaagtattcacgatgctggtctgaaacacaggatgcatcagaagccaagtaatgctcagcaaaagttcaccaaaattgtgaaagcaaacattaaataaaaaacgttttcaattaacagtaaaatatctttaaaggatcatctctagcctttctttctgcaggatccacccactttaaaatcctttggtaaattcccaggtctaccctaattgaatggtccctctctatctgctcaagcagttcttaaccctttggagtggggatgggggtaaggggacatcacagcaaatatggacccttaccaaagaaaattattcacaaatgcaaaattctacacacatttccaaagacttccagaatcccacggccattacccccaccgcctccctaagaatcccagagtggcgtgcttctcaatggcctctgcggagcacccccagcccccaagccacagcccccggctcgaccccgaagagactagagttcctgctctcacacagcggattccgtaactgagctttgtctcctcgcccaactcccttcaccccggcaaggtcactaccgccaactacccctttaagccgagccatcacggtaggagttcgtaacagccacagcagaacttgcctgtcataggatatattttgtcccctcggccccacctaccctccccatttcggcaagttacgtctttaccactagcccattctacagaaatagctgccgccgccaccctccggcgcgccccggccccgccgctccgcctccagcgcccccaggcccatttcccgcagaccctccccgggccgccctcccctgccctactctaggcgctccctctccctcgcagccacaccgtggctgcactcgccgtcctctcttccggccgctaccaccccggccccctagaaccccagcctcccgcgcccgcagccgcgttcctgtctccccgacctccgcacccccacttggcccggcctcctcgccttcctcccggctcctcccctcaggacacctgtgtcgtcccaccccctccaccacacacgcaccccccaccccaattccttcgcctccctgtcctccctcccccgccggtctcccctccccgctgctgccccgagagcccgatgtgggagggaaggcgcgggggaggggaggccgcgaagggggctgcttttctccgggttccccgtgctgcggaactgcagggctccccagcgccctctgccttcttcgccggcggcgcggaagtcggggtctcccggacgcccccgatgagggtatttaccttcttgccggggacactttgcagacggctccaacattggcaaacactacagagaactgaccccgctcggccgccgccggcttccacccctcgggctccccgccccccgcctccgcccgcctccgcccgcctccccggcgctcccgccgcgccctcccgcgctcgcgccgcgcgcccccgcctgcgcagccgctcccgcgccccagcacgcccggccggcgcgcgcgcccggcaccggctctacctccactccgcctcccgccggcccgcgaccaagcgcggccattgttcgcgacgcagctcccgccccctggcggctgccgggccccagcagctgcaggctctgcggggctagcggcggcgagctgggcccctgggcgagggccattcccggggggcttgggcacgcgggcgagcgactgcgcaaggagcgcgcccggtccgcagtctcctcgtccccggcgcgactccccgccccctcgtctgccaagggtgggcctggggcagccccttccacacctgcaactcggcaacttccttccccgcccgactgaccgtctgctctttctggtccgcaccctgtgctctgattccccgctcgtacctttcccaggctctccggctgcccctctgtgctgtgcaggggacgcgcgaccatcccgcgtctgctccggccgccgctgtgcaacgcacggtttagcggatcttgcacctttctagacgggggagggggcggggaggaggttgcttcaccgtctcgcccagcaaacaccagggatccgtgatcacctgctcgccaagacccgcggcgtggccagacctcctcttctaccgaaaatattagtcacatgaaaaagaatccttggagccaaaaatgagaaccattgaaaacaatgccctgaatcctagatttatgaggcaagagt

SEQ ID NO: 720 - DNA, 197327 bp, Homo sapiens
tttgttttcaatacactcatatatttttactttgtaatacaatatagctgtcacatacaatggctctagtaggcttaaatcaaattgcaatgggcaaggaaagccaaagaagggtttacacaatattcaataagcaacagtatctgttcagtgtgcaataaaataaaaaagttctaacctagaaacacagaaaaagaatttattgtttttaagtttcagaaataaaagtaacagaatagtgtataatctgtaacaagctggtcctgtaatttctaaactacagtccaattaaaacatttaagtaatagaaacaatctacatgtttttctaccaggtaaatatacctgagagggttacctataaagaaataggctttaaaacttttaaccacaaagaaccttctgctgcgacattatgaagatgggctatgcatgtggccagactaagtcatttcccggagattctgctcactgcttagctgcaggtagtggtccatcaatgacagagtattttacatcaataccagctcattcaaccaaagaagcacagtaatattttaaaatcacctgtttatattcattagtatgtaaaaatcacaatacacagatttggaaacatataacgtgtccataaaaaagagtatattatgtaagcataagctttttaaaaaggccttagcaatgcaataatgagggaagcagactctacatgttgactacagtgaagatatgttaaaattataattattgtcattgccaagagcttagaaataaaaacaaatttaaaaaattaagacattctggtagcaaaattacagctactgtaacaacagctccaagcaaaaaatcaattcagagcttgaatgcaatttgtgctttgtttctataagaatgcagtgttactctcagacatttctaaatgattagattcataaataagcagttaatttcttttcatcacaatttatttctaattcatcctacggagattatagatagaactaaaaattacttagcttttttccagtactttatataaattgagatcttttttaaacagtgatttattgtgtttcttaaggtaaaacaacaaaaacaaattctaaaattgtaactttaaattaagtggttaaaatttcagatgacagagccgataactggtaacagcttcttgaagttcatattaagagtccaattagaaacactaacaactacctggcaatagtttgaaagaatcagaagggttcggtgaagtgaaaaaaaaatccgaacatgcaaaataccccccaaaacacatgaccttctttttcattttataatctaaacttgtaaaatatttataaatacatgatcattctacacaatacagatcttctagagcatttctaaaggatattacagtttttggtcttaaggaataaagactaagatggaaaaggagatgaaaacagtgaaatctgaggaagcaatacactctctacacacaagcaaactagttcatccagtcaagttagcggttacagttcagtacatgattttcaaggcaactaagaaatcaagacacagatatttccccttcctagagtttacaattctttcaaaagctccaatgtatccataaaggagtgctgatttttgtggggttttttcccagaaggaaacaaagaataaataggggaaaaaaagtttccatccctaaattcacatacacaacaagttaagttaaactataagctagttttagactacccagtgaaacagaattgttggtactatctgaggcaggtgctaccctccctagtcagttcaaaacatgatccagtaaaacaaatacacattgttatgcctcaaacaactataaagcatttcattattcttcaaatatcatgtttaattaactcctaaggtaatagacttctagaatgttgtatcttaatggtgtacctgaatcaatactagcaatagaatgcaaaattcaaaattgctataaaggtaaaatcatcataaaaagaaactcaatccttatgtaaaaaaagggagaactgagtgtgaaatactaacaccaaatgtctgaaggcagaatttttgtttgtggaagacagagcgaagagatagatgcacctaatcaagaccaaatagaagacagtgaagaatatgaaaaatgcttaaaaaagaagaaggaaaatggagaagagacaggcagcaaaagaattactagatagatcaaaaataagagaaaatgaggcatgtgcatatggcttttttgtctgtcctttgtgttcctaaataacttaaaacgtaagtggcatgtaggccatactagcaggcaagaatgagccttgtgatgtatacagatgaagaatctgaggctaatgaattgttttgttttttgtttttgcttttaattcatacctgaaagccttgaatccttgctaaatattccagttgttttgaaggttgtactggagaacaagggggagtaggagaacttccttttaaacctatggcttcagctgtagaagatgttccattcataaggagttccctggcaattgtagctgaactattcgatgtgggagatatactgaagaaagagcttgaaggttggttcatatctttgggtgacaaatagcctagagtagtgccagagattactttgtggcggctggcttccatctcttgataaacatcaggagacaaatgaagaattccttttggagctataaataaaatgaagaacactgttattacacttaaaataaccgaaatagaaacatagcattattaactcaatggctttacttggtgtagtaacaaagaaatgagaaacactgccaaacaagtatctttgtcatactgtagaggcagttgcagcttctattgaaaggtgaataatgtctatttcaattttcctaaaattagaggtttaaaaacatccaaaaaaagtggtttcaatgggacttatgtgtagtagtgaagctataaagggacaagggaaactgaatgtgtggaagtataatggggcagaaaatcaggaatgtgcagtgtcttcaccctgcaatttaatattttatatctcataaaagaggcatgaaaccccaacacatacagcaattgaggcacatcaggtaaaataaaggctgaatcagtccaaatttctttggaggtacaaacgcatgtattcaacagcctagtgatcctctcacctccacaaggatgtcccacagacaactctaactcacgaacacataaaaaagcaaatgggtatcatctcaaaactagcactgtctctaacttgctttgctcatactaccatgtggctgctcatgacccaacctagactcctggcaaccatctctgatttactcataagcaagtagttatcgtgttgctcaaacatctcaagaatatgaccattgtagggattatctagtgcattaattcaagccaggccatggacaggttctgaaatcaagaggagtgggggctatgtcattagttgatggagcttaaaccatattagagaagcactttcctttgactatcatttgtctcagagaagtttcaaaccacatttcaaactgcttattcttatcttttgatcaggtatcaataactctcaaatgatattatcttttaaaattattggtaagtcaccactcataaagaatgtgctctgagagacacaacttaatttcctgttcttgccccttcctctcctgatgctaaccttctgattcaagctttcaatgtttctctgctgctagtattctcagtgtccatttcccaaaatgtgttctataacatggtccccaaataaaatggttccataaataaaaactgaaaataatgcaaattacataatacaaatgccttttgtgaaattaaaaatacacattagcatagtgaagaatcagaaaactcaaagaacaaaaatctattcgacttggtttaactcaggattcctgagtttactttttgtccaagcctttaacatagcatgaataaaacagctaacactttgggaaatgctggaggctagcccaactctcctctgactcagtcatttccaatgacctgtctttgagattgatgaccttttcttctgcttgacattgtctgctattgaatccctctggtaactttttcagtttatggtattttttagctccatgctttctgcttgctactttttaaagttttctttttgttgaaattctcactttttttcatgcattgttcaccagacctcagtgggaatgtttgtaaggattactttgaattctctgtcaggtaaatcacatatctccatttcattagggtcagtttctggagctttatctcattcctttatttaggaaatgttttcctgtttcttcatttttccttgattctctgtgtttgtgtctgcacaaactggcctcatactggagaagatcctaaccaatcagcctggacagagattctggaggcctctcaaacttttatgctagtctaatccactttctttgttcttggcagtccccaggcatcagtcccttgcttgtctcagtcccatcagagctctgagacaagcaagactgaagccaattcttcaggcaactcccagataagttgggtcattggatacatggtgctcctctttgcctctccaggaaaaagctgaaagctgaagcttttcaacagttagctttgtgctgggctgagcaggggatggttacagtgaccaccaccaccagccacctctttcttcattggccccggggttgctaaaatatgccatgtcctgtcagcactctgagactggccagacagaagccagtcctctgggtagccccagaaaagctaaggcattggatgcgtggtatacatctttccccttctaggcagaaagaagctgggagctgggggtggagggtggttgtcctgattgtatggccctgcactgtgaggagggattatggcatgagggtatcttaaatttccctgccaattaagatctggctggtttcatgctcacccggcatacaggagcctcttaactggtttctggatttctcacaaagaaaaattgcctataaattattgttgaattgctgtgttccagggcttcctattctaccatcttgccaaggctagaacattctcttacttaaaggtctttcaccagtttatcagttacactatagaacccaaactccttaggataacctaggaagcccttaataatctggctcctacttatcgctctatcttcatctacgaaatatttcatgaagatcccatgctccagttacacagatatatccaatactccaggctgtttgatcccaacacatctttatttctattgttcggttacacacatgcacatactctcttagttaagctccaactgctattgtgctagttaagcttcaggcatcgcaccaaccaatactgtcctgacctcaagtcatgctcagtctatcaggagaggaacgaaaatggataatacaatgtgataggggtctcactagagacaggtgtatagagcagtgggaatgggaaaggagaagtgctaaaagctcagggaaggcttgctggagatgacgatgacagtaaatttcaaaggatgaggagaatacagtccaggaggaagaggactgagagcagatggccagcaggagcaagggcagggacctggagggtttgtgttctaggaaacctcaggccatgccttatcacaagagcatacagagtcagaattgcaaatgcaggtggaggcacgcaggggccaaggtccagggaactttatcctgatgccattaagtataaaagagttttgtaagtttttttaaaaacactttaaatagcttaaaataatacagacagtcctccgcatgcatgagtcccatatccctggattcaaccaactgtggatagaaaacatttgcaaagagaaacaacaacaacaaaaacaacaacaaaaaaccccacacacaataaaaaataatgcaacaataaaaaaaaatacaaaatttaaaactaatacaatataataactatttacatagcatttatataatatttgatgttgtgtaatctagagaagatttaagtatactggaatatgtgcataggttatatgcaaatatgatgccattgccattttctatcacggacttgagcatctgtggattttggtatctataaggtgtcctgaaaccaattcttcacggatatcaagggatgactgtatatcaatcctattttatgtattttctttattcctttatgttagctttcaaattctctacattaacatgtgttagtttttttataatcaggaaaaaatttcaataaatttttttacaagaaaacattatgtactgaaaaaagttaagataaatctcatcagccagaggacattactttcaacattttgctttaaagatatgtttttaatcctgttttatctatgcactttttagttgttgtttacttgaaaaaacaagttaaatacataggaataaaatatgatcctgtcactgtttataaaacaatatatttctacaactaatactaaaagtataaaatttcattatatgaactgtttcttaaaacaattccatattatcagacatctaatttatctccagttttttgcaattataaacacagtgatgaacattcttgtaactcaatccttattcacatgaaaatttatttcctcaagttagaagcggaattgctagttgaaaggatattttagagtttttgacacttaacaaattgccctccaaagaagctgtaccaatatcagacgcccacagagatatatgaaagtatcttgtttcctattttggtattggaaattactataaaaaatcttaaggctgggtgctgtggctcatgcctgtaatcccagcactttgggaggccgaagctggcaaatcacgaggtcaggagttcgagaccagcctggccaacatgttgaaaccccgtctctactaaaaatacaaaaaattagctggacgtagtggcaggcgcctgaaatcccagctacttgggaggctgaggcaggagaatcgcttgaacccgggaggtggaggttccagtgagccaagatcacgccactgcactacagcccaggcaactgtctcaaaaaaaaatctttgccagttatcaacagtaacagaaagcaggtcagtggttgtctggggagtggagctggtgggagtgacagattgcaaaagggcatgagaaatcttttggtgagatgaaaatgtcaagactgattaaactgtagacattatgtgcagtttattatacttcaattatacctcaataaagttgtaaaaaaaaattgccaatttgacaaatggagtgtcatattactgatttttgttttttactatctgcataaacattatatatattttagtttaaagaataacttaaatgttataattctaacttctatactcaatttaaaaaatcaagaaacttaacagcattacttcagtattgttattatacaggactaatgggtttgccaatagcaatattataaagcaacaaaaatgctctccacactcaagagaggcattacctcacagcataagaacgtggagttcaggctctcctattctacagtaaagcctaagtggacttttcttcacaaataaagattactttctacagagttcaactaacagactagtcatagaaatagcataaaaacatagatttatgtggtcaagaactgaatgacttttaacttgaacatcagtaacagtatttggatgggtgttaattcacttaggatcttcctgttgtaaatttaagtcgcttttcaatagtataaagatctaaaagtagaatcaaagagtaatttagggtatgcatatttaaggaccttattttgctaattaggtttctcccaaaaaactaccccagttcatacttctattagtaggatgtgactgttttcccacacttctcccacaacacgtttcagttactctaaataatcattgccactctacaataattcattgttaatttatttttgtttggttactgctcaggataaactttttctcatgtagctactttaggtctgtgccttctttgacctcaattttgctcatggacttcaaccactacacttccctcgctcaggcttgtaacatccattatattcattcaccctttatctgaagaggtcctgaacccattctgccatcatctatcttttgtccctggttttgcctttgatgctcccatcttggtacagtctataactacagtacacagttacaatgcagatacaacatgggcactgttctagtactttacttctcatttaattcccataacaaccatatgaaatgggcattattattttcctatattagagatgaaaaaaactgaagcatggagaagatatgaaactctcccaaggtcatatggataataagcagcaatgctagaatttgactccaggcagtctgcctctagagtttgaatacttaaccattaccttaaatagcctcctaaaagaacaggtaggaaactaaatgcaacatctcaccagctccaaacccctaaggcttaaatccagtaagtaaatgcccggggtttgcccagattggttccaaggatgacccatgtcatgatggttgtccctagatgttccagagatgagctcaccaaaatctcactgaagtatacagagtttatacatgattttaaaggtctaaagttgccagggactgtgatatcttaacaccaggctattgtacccacttgacatgtttttgctcagtagatctgtgcttctttcagatgggtatatgaatcctctggcacacaaatcttcctggagcatctttatggagctccagttcttactgaagagttgaagagggacttttgaattggagagctcttaaaaggttttataagcgaacttaggagaaccttgcctttcaatgatcactgatgtcatgattctttcagagatgctgaagaagataagtgtttgtgagtagcaagtggtatcagaggtattaaaacacagcaagccaggcagcaagaaagataatgccactgatccaaatggttactgccactccactggaactcccagtttctctggaagtccttggaatgggcatagctatttcacaacaaataatttcttttcatttttcacagaaaagctttgaaaaaaaaaactttgtttccattgccagcttgaatttacgcctcaacaatgttggactataaatttgtttataaatacccaaatatccaataatactcaggcccactttgctacagtgagtttttcacaataaaaaattataattaaaaattcttaagaactagaaacaggggcttctggttcaaaacaggaaatgtgagaaaattatgaacaacagcatgattatctgtctctagtgatttttaaaaatcatttatatgagaactggtaggctctaagtaaggtctgtagtctagttcattgtattatgacaatttcctagttttgaaaatgtactatagttatataagacatcaccactggaagaagctgagtgacgggtacatgcaacctctttgtaccattcttataacttcttgtgagtctatcattattacacttttaaaagtttttttgaaagcaccgttttatgctgctttgggcctctccctcaacatagagaccccagaacagggtggtgatggggacaccaaagtgggaaggactggtggcagcaccattcctagatatagctctgaggataagcagggctggcactggcaatgcctgctccttgacaactttgctcacggcctttgcctaatgcacaggccctggctccccaggctctgggtgcttgacttttagctacatgaaagcaagggagatcctgatgacagtgtgggcctcatagccgggaccttgttctctcccagggtagcctgaggccacgtattagttaagagtacatgtgacccaagggagcctactggaccaccatggtcatgtccctgaaggtcagggacaggtggaatgcatccttggcatgatctttagctactagactgatgtgagctacagaaatcccccttcctgctgccctgttgttgggatcaaatcgaacaggtagtatttgtaagtgactccacctcttcttttacacacagctcactgcaaatctggtcttccagataaggccctcagacccttagttctgcctaatttttaagccaaatatatactacttatgaaatcaaaaatcaacaatgcaaaatataaactcttgtggaaaactaaaaagagaaaatgttagctaacagcaaaacaatgaaaaaataaaaaaataggtaaataatttgttagaggtttcttcttaagatcagtttcagaatcaccttggaaacgaaaaagacacactaaaaaaagagtcattactgaacagatttttttttttttttttttttttgagacagagtctcgctctgtcccccaggctggagtgcagtggcgccatctcggctcactgcaagctctgcctcccgggttcacgccattctcctgactcagcctcccgagtagctgggactacaggctcccaccaccatgcctggctaattttttatatttttagtagagacggggtttcaccgtgtcagccaggatgttctcgatctcctgacctcgtgatccgcccacctcggcctcccaaagtgctgggattacaggcgtgagccaccacgcctggccaaaatgatgtattttaatgtgctcaaaaagcataacctgaacagtggtgaaaatcaaccttgctcttacccttagagttgaacggaagcactgattttattaatttgtgcattttattggtcctttttttcctgctacatttaacataatgatgtatgtgaagggttcttaatttggtgaatgtttatgaataaaattactgacaaagaacttttcaggaagatgtttgccttttggtgaacacagtaccaacgggaaaatgcacttagtccagtcttgcccccaaaaaggcagaatcccaggtcatgacatagcatccagcacacctccaagaggaagaaggaggaatacaaaatagtaaataatacatattcctcaaaacaccaataatgaacagaaataacagcaataaaggtttttcaaaaatgttttaaagatcaatttatgatgaactgggaaatgcctttggaaagcttgtaccttagtcaaataaaagtgcgagtgagttttcaaattcaggactggctgctattttttctttaaaacaggcaaatggaaagtatttaataacaaagaatataaacctgggtatggtgaataaattcatcattcatcttttttttttaaaccttacacaaatgcagtaacttatacttttgccagaaattttctttaacaagaagattctggagcccaaagtgagtcatgcaaatcaaagaacagtctggcacaggggttattaatagtgatccaagggcccctaaatagtttgaaataggttgacttcacaacaagggcagtgcacattgtatatgactcagagtcagtgtggtgcagggaagtgattggggagttcaggaattccccagaagcgcattcaccactcatcttaataataaggaagatttcacttagttggcttatttagaagaaatttttttcaaggctcagcttttcaataaagacacaactgtgactatttctaccaagtaagacaaaatagttgctgtgaaaatgatgtttgagagcaccttgtgaggataatgagtcatcttcaatttttagtttatttaagtggggttaaaatgttgctcgtaaaataaagatcgttcttcttggttatgattcttctcagaaaaactccattagttatgatttccctacgacagaaaaacaccaaaaaatggattatataagtctgacatatgacaaaagtgacctgatctctcagcaggaagaaacacatactgaaatgtctaccgcagcagcttccaaacactgcaccacaatactcctctgccaggattcctattgcttcctagtcaatacctgcaaacggctcacaatacaataatagtacaatacaataacaataataattctggctaaaactcatagagtccttactagatatcaggcttgttccaaatgctttgcatatattagtttagtaatcctcacaatgaccctcaagaagtagggactatgaatattcccattttacacttgaaggccctaagacacaggtgatatgactggcttaaagtcacagccagtaagtggcaggtgttggggcagtatccaggcatctggctacagtcagcaagtataactacctttcagtagtaaaacaaataaaccaagaactactgttcttatatctatacatttaagaagttctgggcatttagattcttgaaatattctaacaccatgatagagacaagaaactgtcaagatattgaacttcatttcttcatttcagacctattttctaggctcaatgaacctcagtctcccctctcatagtaaaagaaaagatggaggtcagtgcagtggctcacacctgtgatcccaacactttgggaggccaaggcaggaggatcacttgaggccacaagttcaaaaccagcctgggctatacagcaaggtgctgtctccataaaaaattaaaactttagctgggcatggtggcatgcacctgtagtcccagctactcaggaggctgaggtaggaggatcccttgagcagaggagttcaaggctgcagtgagctataatggcaactctgcactccagcctggacacactgtctctttaaaaaagatagagagagagagagactgagatttttctcactgtaaaaccacccattgggaaaaatgtaaaaataatgcacttggctattttcacaattttgtttgtgggaagaaaataaattcaaatattaggttcacacaaagaaaaacttaagcacagccttaggatgaaagaacttaacccacaaaacactttcttacaattctccttatatgatctaattatgatttaacaatttactacacattagtctattattcagtctattatatattattcagaaacttatggaagaatccacaatattattaataaaaacaactaactggaactgtataaatattaagtactgggctgggtgcagtggctcacacctataatcagcactttggaaggctaaggcaaaagggctgcttgagctcaggagtttaagaccagcctgggcaacacagcaaaacctcatctcaaaaactgtatttttaaaataatatatatatataaagtacttatccaatttttaaattttcttgtaaaaataacaaattcactttttagaaccaggaaagaagcagcctagcaagaaataaaatttagacaaaacacaccttagtccagccaaatacacacaaaaaaacctgttctcccacttttatctatgtatcaaaggcagagagggactttcacccttgcaaagctgtaacaactctccccaacttccctgatgtggtagtgtcagaaaaaactgagtaggcagcttggactttcatcctagccccgtggtgtcagtggagatcatgtagggacactaaacttctacccccacctagcagtaataggatgccccccacctccgtgctggagtggtgtcaggagagaataaaggagaatcagaactagtgggaacaaggtcacctcactatggtgtcagtggagaccatatggggaccagaatttccactcaatccagggctgggggtaggggaaagggtatggctataacagcacaacatgaggaactctcatggtgacagaactgttctgtatcatatttatattaataccttagttgtgatattgtactatagttctgcaaggtgttaccagagataaacaaggcaaagggtccataggatctctttgtattaattcttacaactgcatgtgcatctacaattttctcaaaataaaatttttattaattattttaaaatttattgtagagacaggatcttgctatgttgcccaggctggtcttaagctcctggcctcccacttcaacctcccaaagcattgggattacatgcatgagctaccatgcctggccatcaaaataaaaagtttaataaaaaagaagtcttgggtgacaccagcaagatggtagaacaggaagtcccagcccttattcctaactcatacattgatttaacaatgatatacagaccaaaatacctttttgagaattccagaatccagttaagaagttgcagtatcccagatgagcacaaagccaagaatggccacactgaaacatgtaagaacaatttcactttacccacaccacccccctaagtcagcatagcttagtgccacatagcttagtgccgggagagagcattccagatcacaacttctcccttggggtaaaggtgagtggaatgtgcatccaacattttacgttttcagagggcttcccaagggactaatttttgtcttgcttcacttggagtgccgacagagccagcatattttggatacctgggatatttagttttcccggcaccatttgttgaaaatgtggtacacatacagcatggaatactatgcagccataaaaaagaatgagatcatgtcctttgcagggacatggatggagctggaggccattttccttagcaaactaacacaggaacagatattaaatactgcatgttctcacttacaagtaggagctacattatgagaccacatgaacacatagaggggaataacacacactggagcctatcgaagggtgaagggtggagggtggagggtggaaggtggaaggaggtagaggatcaggaaaaataactaacaggtactaggcttcatatctggatgatgaaataatctgtatgacaagcccccatgacacagtttacctacataacaaacctgcatgtgtacccctgaacttaaaaaatgaaagttaaaaaaaaaagaaaatatactcagtgggtcctcaaataatgttgttttgttcaacatcattttgttataatattgatgagaaaaaaaatcaaatcccacctgggccactgtcttatgtggagttctcatgttctgcccatatctgcactggttttctccaggtcctccagtttcatcccacatttaaaagatatgcatattaggttcactggcaggtctaagttgtcccagtatgggtgtcgtgtgtgtgtgtgtgcgcacacgcgtgtgcacatgtgtcctggaatggaatgacatcctgtccagagttggttcttgcctttgctccctaagctgctaggataggctctgaccaacctcaatcctgaactggaataagtgggttagaaaatgaatgactgaatgtatacaaatgaatgtaaaattaaaatctgtaaaatgcacaataatcatataatatggtttggctctgagtctgcacccaaatctcatgtggaattggagtcccagtgttggaggaggggcctggtgggaggtgattgaatcatgggggcagacttcccccttgctgttctcctgatagagtgttcacaagatttgcctgtttgaaagtgtgtagcacctcccctgcttgctctctctctcctgctggccatgtgaagatgtgcttgcttcccctttgccatctgccatgactgtaagcttcctgaggccttcccagaagcaaaatcctgaacagcctgcagaactattatccaattaaacctcttttctttataaattactcagtctcaggtatctctttacagccctgcaaaaacagactaatacattacacaaatgcacaacaataaacaatgcagtataaaagtgttcagtgagcccaccatatttgttattgtttgttttttaattgtgtggtggtaggaagtactgcttacaattttcactttgcaaacatttatactttgatttaacccaccaccaccatgactgctatcactcacttattcaccccacattgagtaaacaattatcttgtttttattaaactttcttaattgtacatgtaagctcatatttatttcaatgtttaatattacaatttgggtctttattgagaagtctggtgatatttctctaaccacaaatatgttgtgagaacttaactcttgtttatatcaatcagcctatgataaaactgatttcgttatatgtcatttcacttaaagtagtagtttccaagaacctatcaatgatgttaagtaagaacttactggatttaatttttttagtggtaaagcaaaaaaaagaagtctaatgttctgtattaacacaaaatgtaataaagtaaaaacaacaatagtacattggtaaatgcaccagactggagcccagctatctgggtttgagttgaggcagcagatattctccttatcatgctttcttcatctgtaagatgaattagtcttaaggaacttttcatttctttcagccctaataatctatgaatcatcttaacacaaaccagaaagcttggaataaaagaacacacttgaataacatcacccaaaaagcctgttgagtgttttttaaatttgactattactaaagtttttttaaatcttaagaaaaatcaagtaatgtagatggctgtgtcactgatgtaataatagttaaaacaaacatttcacatagtttctcagccatttagtgtttttacatgatccacccaaatatcaatctggtatctgaaacaatagtttgaacattttccatgtaataaaacatcttaaatgttttataaaaaaagattctggtacatgatatataaaacattctttcaaaaaaatgcgtacttaattttaatggaatttcttaaaaacactattctctttttttcctttaattatcagcaaatgatatatctagaaataaaggtgctgtctagtggcaactgcagagaccctggagtcagaagacatgagttcaagtcttcactacctttaactaagagtgtctttagacccgttataaaatcaactgagcctcaattttcctgtatgtaaaacatgtgaggttggacattctccaaccttttcacacttaagcctccttatgttgtttttcttctatgtataccatgcttaaaggatctgtctttcagacagactgcatttattaagtaataataaatcatctttcaaagactgccaacctgagattcagaacatcttgaggtctgaattcaaataaaattctaatccaaagcaaagcaatctactaagagtaactgtattacttccattaggttgctgaaatactaattatgccaaccattattatattgaatccaacaataccacgctgagaatctcaggtctggatcacacctaaattcctagaattctaattgttatatgttataaactactcaaaagatcattaatacagtggggaaaaaagtgaaaatgcaattcttgcatttgctcaaatactgagcaccaacaatgccagacactgtgctatgtgatttactttttaagattaaaaaaaaggccgggcgcagtggttcacgcttgtaatcccagcaccttgggaggccgaggcgggcagatcacctcaggttgggagtttgagactagcctgaccaacatggagaaactccatctctactaaaaatacaaaattagccaggtgtggtggcatatgcctgtaatcccagctactcaggaggctgaggcagaagaatcacttgaatccgtgaggtggaggtggcagtgagccaagattacaccactgcactccagcctgggcaacaagaaaacgattaaaaaacgattaaaaaaattgatttttttttcaaataatatttgtctctctctcttttttttttttaagatgaagtctcactcattctgtggtccaggctgcagtggcacaatctgtgctcactgcaacctccacctcccaggttcaagcaattctcccaccttggcctcctgagtaattggaattataggcatgtgccacaccatgcctggcaaatttttgtatttttagcagagatggagtttcaccgtgttggccaggctggtctcaaactcctgacctcaagtgatctacccacctcagcccctgaagtgctgggattacaggcatcccaccttttcttactcgctgggggggaggggggagttgggcaggatggtggtgtttatcttaaatatggactcgtctttcaataagcaatttcatctttaaaaactactgaaatcatcaataataccaaaaagggtacattataataaacaaatactttctaaaaaaatgaaagaatgaatgatgcattaacattatacaaagaagttttagggaaactatctgcactgccttcctgaaccttaatagttttcaaccatacagttagttccctgttgcttattttagtgcttcataattgatgctttgactactctcacatctcttatttctgttgccaaggaaggagatttttgtcttttcaattacttgtactccatgtagtacgtgcaagaagattacagaccaagtacatctttattcacatttgtttaaaacacacattactttaaactgactcatgttaaaacacaagaaagactcaatgattaagctgggtgcagtggctcatgcctataatcctaacactttgggaagccaaggcaggatgacttcaggccaggagtttgagacaagcctgggcaactccacaagaccttgtctctagtcgggggagtgggggcaaagctgggtgtggtgccacgtgcctgtaaaattagctacttgaaaggctgaggcaagaggatcccttgagcccaggagttcaagtctgcaatgagctatgatcatgccactgcacaactgacagaattttgctaacagagtgagaccctatctcaaaaaaaaaaagacaacgattaaaactggcacatagatagttagatgaacagaggagaacagaaagtctggaataataccaaattcataatcttagtatatggtaacagtgaactctcaatgcagtggggaataaagttgggtccatactttcagtataagtaacagatggatcaagacttcaagatttcaaaaaatgaaactataagagttccagaagataacttaaaagaaatgttttgattggaggttccaagatggccagataggaacagctccatgctgcagctcccagtgtgagcgatgcagaagacgggtgatttctgcattccaactgaggtaccaggttcatctcactggggcttgtcggacagtgggtgcagcacacggagcagggtggggcatcatctcacctgggaagcgcaaggggtcggggaattccctttcctagacaagggaagctgtgacagatggtacctggaaaatcaggacaccgccaccctaatactgcgcttttccaacggtcttagcaaacggcacaccaagagattatatcctgcgcctggctcagagggtcccatgcctacagagcctcgctcactgctagcacagcagtctgagatcagactgcaaagtggcagtgaggctgggggagggccgtccgccattgctgaggcttgagtaggtaaacaaagcagccgggaagctcgaactgggtggagcccaccacagctcaaggaggcctgcccgcctctgtagactccacctccgggggcagggcatagctgaacaaaagtcagcagaaacttctgcagacttaaacgtccctgtctgacagctttgaagagagtagtggttctcccagcatggagtctgagatctgagaacagacagactgccacctcaagtgggtccctgacccccgagaagcctaactgggagacaccttccagtaggggctgactgacacctcatacagctgggtgcccctctgagacgacgcttccacaggaacgatcaggcagcaatatttgtcattctgcaatatttgctgttctgcagcctccactggtgatacccaggcaaacaggatctggagtggacctccagcaaactccaacagacctgcagctaagggtcctgactgttggaaggaaaactaacaaacagaaaggacatccacaccaaaaccccatctgtacgtcaccatcatcaaagaccaaaggtagataaaaccacaaagatggggagaaaccagagcaggaaagctgaaaattctaaaaatcagaatgcctcttctcctccaaaggaatacagctcctcgccagcaacggaaaaaagctggatggagaacgacttctacaagttgagagaagaaggcttcagatgattggtaacaacaaacttctccaagctaaaggaggatgttcaaacccattgcaaaggagctaaaaaccttgaaaaaagattcgacaaacggctaactagaataaacagtgtagagaagactttaaatgacctgatggagctgaaaaccatggcacaagaactacgtgacgcatgcacaagcttcagtactgatttgatcaagtggaagtaagggtatcagtgattaaagattaaactaatgaaataaagcgagaagtttagagaaaaaaagagtaaaaagaaatgaacaaagcctccaagaaatatgggactatgtgaaaagaccaaatctacgtctgattggtgtacctgaaagtgacggggggaatggaaccaagttggaaaacactctgcaggatattatccaggagaacttccccaatctagaaagcctccaagaaatagcagactatgtgaatagaccaaatctacgtctgactggtgtacctgaaagtgacgggaagaacggaaccaagttggaaaacactctgcagtatattatcccagagaacttccccaacctagcaaggcaggccaacattcaaattcaggaaatacagagaacgccacaaagatgctcctcaagaagagcaaccccaagacacgtaattgtcagattcaccaaagctgaaatgaaggaaaaaattttaagggcagccagagagaaaggtcatgttacccataaagggaagcccatcagactaacagcggatctctcggcagaaactctacaagccagaagagagtgggggccaatattcaccattcttaaagaaaagaattttcaacccagaatttcatatctagccaaactaagcttcataagtgaaggagaaataaaatcctttacagacaagcaaatgctgagagattttagtaaatgggctaaatgctccaattaaaagacagactggcagtttggataaagagtcaagacccatcagtgtgctgtattcaggagacccatctcacatgcagagacacacataggctcaaaataaagggatggaggaagatctaccaagcaaatgggaaacaaaaaaaagcaggggttgcaatcctagtctctgacaaaacagactttaaaccaacaaagatcaaaagagacaaagaaggccattacataatggtaaagggatcaattcaacaagaagagctaactatcctaaatatatatgcacccaatacaggagcacccagattcataaagcaagaccttagagacctacaaagagacttagactcccacacaataataatgggagactttaaacaccccactgtcaacattagacagatcaacgagacagaaagttaacacggaaatccaggaattgaattcagctctgcaccaagtggacctaatagacatctacagaactctccaccccaaatcaacagaatatacattcttctcagcaccacatcgcacttattccaaaattgatcacagagttggaagtaaagcactcctcagcaaatgtaaaagaacagaaattataacaaactgtctctcagaccacagtgcaatcaaactagaactcaggattaagaaactcactcaaaaccacacaactacatggaaactgaacaacctgctgctgaatgactactgggtacataacgaaatgaaggcagaaataaagatgttctttgaaaccaatgagaacaaagacacaacataccagaatctctgggacatatttaaagcagtgtatagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactaagggagatagagacacaaaaaacccttcaaaaaaaatcaatgaatccaggaagcggttttttgaaaagatcaacaaaattgatagaccgctagcaagactaataaagatgaaaagacagaagaatcaaatagacgcaataaaaaatgataaaggggatatcaccacccatcccacagaaatacaaactaccatcagagaatactataaacacctctacgcaaataaactagaaaatctagaagaaatggatagatttctggacacatacaccctcctaagactaaaccaggaagaacttgaatccctgaatagaccaataacaggctctgaaattgaggcaataattaacagctaccaatcaaaaaaattccaggaccagatggattcacagctgaattctaccagaggtacaaagagaagctgataccattccttctgaaactattccaatcaatggaaaaagagggaatcctccctaactcattttttgaggccaacatcatcctgataccaaagcctggcagagatacaacaaaaaaagagaattttagaccagtatccctactgaacattgatgcaaaaatcctcaataaaatactggcaaaccgaatccagcaacacatcaaaaagcttatccaccacgatcaagttggcttcatccctgggatgcaaggctggttcaacaaatgcaaatcaataaatgtaatccagcatataaagagaaccaaagacgaaaaccacgattatctcaatagatgcagaaaaggcctttgacaaaattcaacagcccttcatgctaaaaactctgaaaaaactaggtattgatgggatgtatctcaaaataataagagctatttatgacaaacccacagccaatatcatactgaatgggcaaaaactggaagcattccctttgaaaactggctcaagacagggatgccctctctcaccactcctattcaacatagtgttggaagtcctggccatggcaatcaggcaggagagagaaagaaagaaagggtatttcattaggaaaagaggaagtcaaattgtccctgtttgcagatgacatgattgtatatttagaaaacctcattgtctcagcccaaaatccccttaagctgataagcaacttcagcaatgtctcaggatacaaaatcaatgtgcaaaaatcacaagcattcctatacaccagtaacagacaaacagagagccaaatcatgagtgaactcccattcacaattgcttcaaagagaatacaatacctaggaatccaacttataagggatgtgaaggacctcttcaaggagaactacaaaccagtgctcaacaacataaaagaggacacaaacaaatggaaggacattccatgctcatggataggaagaatcaatatcgtgaaaatgggcatactgcccaaggtaatttatagattcaatgccattcccatcaagctaccaatgactttcttcacagaattggaaaaacctacgttaaagttcatatggaaccaaaaaagagcctgcattgccaagtcaatcctaagccaaaagaacaaagctggaggcatcatgctacctgacttcaaactatactaccgagctacagtaaccaaaacagcagcgtactggtaccaaaacagagatatagaccaatggaacagaacagagccctcagaaataataccacacatttataaccatctgatctttgacaaacctgccaaaaacagaaatggggagaggattccctattcaacaaatggtgctgggaaaactggctagccatatgtagaaagctgaaactggatcccttccttacaccttatacaaaaaaattaattcaagatggattaaacactgaaatgttagacctaaaaccacaaaaaccctaaaagaaaacctaggcaataccattcaggacataggcatgggcaaggagttcatgactaaaacaccaaaaacaatggcaacaaaagccaaaattgacaaatgggatctaattaaactaaagagcttctgcacagcaaaagaaactaccatcagagtgaacaggcaacctacagaataggagaaaatttttgcaatctacccatctgacaaagggctgatatccagaatctacaaagaacttaaacaaatttacaagaaaaaaatcaagcaaccccatcaaaaagtgggcaaagaatatgaacagacacttctcaaaagaagacatttatgcagccaaaagacacatgaaaaaatgctcatcatcactggccatcagagaaatgcaaatcaaaaccacaatgagataccatctcataccagttagaatggcgataattaaaaagtcaggaaacaacaggtgctggagaggatgtggagaaacaggaacacttttacactgtaggtgggactgtaaactagttcaaccattgtgcaagacagtgtggccactcgtcaagagtctagaactagaaataccatttgacccagccatcccattactgggtatatacccaaaggattataaatcatgctgctataaagacacatgcacatgtatgcttattgcagcactattcacaatagcaaagacttggaaccaacccaaaagtccatcaatgatagactggattaagaaaatgtggcacatatacaccatggaatactatgcagtcataaaaaaaggatgacttcatgtcctttgtagggacatggataaagctggaaaccatcattctgagcaaactatcgcaaggacagaaaaccaaacactgcatgttctcactcataggtgggaactgaacaatgagaatacttggacacagggtgaggaacatcacacactggggcctgtcatggggtagggggctgagggagggatagcattaggagatatacctaatgtaaatgacgagttaatgggtacagcacaccaacatggcacatgtatacatatgtaacaaacctgcacattgtgcacatgtaccctagaacttaaagtataataaaataaataaataaataaaataaaataaaaataaagaaatgtttttaatttcagagtcggaaaggtattatttattatacccaacttacacatgctataaaagaaaagactattttaaaatgtcattcaaatatattaaaaagaaaaaccaaactttaaaagaaaacagagaagaattttcatgtcataaaggcacacagatgcacacagtcctaccaagtaaaaaaaaaaaaaaagagagaaaaagactaaccaatctaatgtccaaagggacatcagatatggttatgtcattcacagaaaaagtatagaaatggctcatagatctaccaaatacatagtctcattcttaataagagaaatgcaaaataaaactatactgaataccatatttcaactatcaaattggcaaagattcaaaactttgatagcacactgtgttcctgaagctgtagggaaacaggaaatctcctacactgatggtagagacgtaaactgctgtctattgacagtactctggcaacatccatcaaaattaaaaggatacatactctgtaatggagtaattccatttgtaggaatttctccaacaaatatgctaccacatacgtaaaattacttatgtatgaggtttttacatggcagataataggaaaatactataaacaatctaaatatccatctgtgaaaaattgattaaataataataaatccctatacatatcaataggaaaggatcttcaggacatactgttaagctaaaataaaatgggtagaacagcatgttcaaaaggctaggggattgaataatatatatttgaatttgtgtgtgtatatatgtgtgtataaaatgtatatacatttatacatatgtatataaatcatatatataaattctgggacaatacacacacaaaaaaccacaagttacctgcttgaaggtcagggtggccactgcactaatgaggacaaaaaatacggagagctgttttgcatttttaatttttccccatttaaaaaccccagtaaaaatagaaaatgaaaaataaaattaatgaaatagtggaatttgaactaaacttcaactaaattcatcatcaaaaatgaaattgaaggtaaaaaacgataaaagatttctacttgttacagcatggaaaattagatactttgaagggccctcccactatgaaacaactggtatttcttgtaaatttgaacttacacatattatattccactcccagaaactcttatacatgtgcacccatagaaatgttcaaaaatgttcataataatattgtttataatcacaaaatcctgaaaatatcccaactgtggaccaacagatgaatggataaatcattatgggatattcacatagtggatgaaatactttatgtaacaaaacaaaataatcttaaattgcaatcttaagtggggggcgggagagggcagaattccagagggcaatataccatacgacgctatttttctaaagtttaaaaaaaaaagcaaaattaaataagtactgataaggactcatttatttgatgaaattatgaggaataaagggtggggcgactacatataaaattcagagatagtggctacttctgctgggggaggcatagccaatgggggatatgaaagaggagaacaaaggtgaaggtaaatatattggtaatgtctagttcttaaattgggcggtgggttcatgggtgttcattatcttgcttcataagttatataagtgttaaatacgttatgcatcaaatattgcctatttttctttaaaaataatagcagttaatgtttcttcacaaattgtaatacactttaagattttataaaactccatctttctagacaaactgaatgagtaattaggagcattacctttattttctccttatgcttactgtaaagtttctttgctaacagagaaaagcaattaagtagttcttaatacttcaactttgaatttctgcaagatatttatctgtgttatcattacagtctgctcctaattttgaaaagactaattttaaacaccttttgatccccatagacctcttagaatacacagtacatattctaaatttcagcatacatttcagaaattgaaatttcattcagactctagaaaactgtttcttcttctttaccttcagaaaagtttcctcaagacttcagtatacagataattctgcttccctagctgtttaaatataatatttatggccgggtacactggctcacgcctgtaatcccagcactttgggaggccaaggtgggcagatcacaaggtcaggagatcgagaccatcctggctaacacaatgaaaccccgtctctactaaaaatacaaaaaattagccgggcgtggtggcaggcgcctatagtcccagctactgggaaggctgaggcaggagagggcatgaacccgggaggcgaagcttgcagtgagccaagattgcgccactgcactccagcctgggcgacagagcaagactccatctcaaaaaaaaaaaaaattatatatatatatatacacacacatatatataatatttatgtttaaatgcagtcagattgtgtatttcaggccaaagtttgtaaatgtaagtgttttaaatattcatttttttctgattataaaaccagtatatgttcattatggaaaactaatctatttttccgtatgttttagccaagccctacaaagaaatgggcctaagctctgtatacttatggctaattcccttcagaatgacaataagtcagagtcccatcagcagcatgtgacagtctgtttccccaacagttggaagtatcatttttaaatccctgacaatttgcgtggatcagaaatttcataacatttatttttaatccccattttcctgattgctaaacattttttcatgatttcttatctgctctttttaaatgtcttcttaagacctttggccattggggtgtttgcctttttttaaaaaattgacttttatgtgtcctttgcatatattcaatttgttgctatgctgcaatttatactgtcatttgcctttttattttcttatgcggctccttgaacttgtttttagcatttacgtatataaatccatcttttttactttatggtttcatccgttgctcttatgcttagaaaaactatcatactgcaatgaataaatgcatcctaaaaatgctcatattatttccatttttaaaaaaaatgtatctgatatctttttacatgtaaaaatgagccaagcgagtttttaaaatcacaatttaaattcattaaatctttccggagaatattgcagaaaaacatgttatctgtgctaatctgattaaaaacttactctctaatttcagattctttttcctttaaatcaatggatcttcagagacagactcaactggtatgactaaaacagaggcaagcttaacattacctctaatcttccttcctagcttcagtaggcaagaaaggagaattcttgtcaatgtaattttttaaagactatagcttctcaccactcaggtaggtctaatatacagtcatcaatgtaaaagaaggatgatatcattctgaaatatttggatctttcctcctgtgttcagaggagaagcagcaattctacctgcaggctcaaatggacagcaatgagaatatgtatgttcccattgctcccaattgcttcagatagccctctatttacgggacctttgtttgaaaacaaccagatattcagggactgggctgcccagtacaagtaacccaccaatccttctaaataagatcactaaaagctggctacattcttacatttctaacacagtatttatgtctaaagaaataattaagttggatcactcagctttatatttacatccaattggctccaactgttttaactgtctcactacaaagtggtttctactatgggaaccccaaagggaatttgttcagggagctctctcaaaacactattaaagaaagtatatattaatctgtcaccttaaaagtccaacacttatatacctcccttctatctcccacccctacccacccccccaaaaaaaccaaaaaaacactagaggttctaaatatagtacatagcatttgggaaaccagcaggcaatctacccaatgtcatatcactgggacagtgtagcctcctggtttcaggatgttcagtgtttaataatacatgcatatgaaacaaaagtgacaaaaatattggtaagtcaactaagatcctaaagaggtcaataagaatgctatctcattccacaagtatttgtctttggtcatctctaatgaacctacaagtgccagcatatttcacaggggctaaataaaactttttaaaaggttaacggaaaaatatttatgtgaaaaatgcctccgaataatcttttagtgggtggatttggcacataccagtgaatacctttgagcttagtccaatcttgaattaagctacagttcaccttcaagaaactatgaacctgcttttaagtaaaagcctgtattaataagaaacatggaatgtgaatacaaaaagagatgttatcagctgaactgtatctaaatattttacaaagttttccaagagccgtgagctgtcagtagatctttaaaattcatgatctttttttaaaaaagttattcattcatctgtaaaaatctagttttttatgtgtacaccaagcataaaattgccctatgctaaacttaacataaacctcacattacagagttatgtgtttttattcttcaacataactattacagtgattcaaaggataaaaacacacttagaatagtctaccttctgctgcatttcagtacaatgaagaaagcctgagcagcacccaaaaactaggtccatattttaaatctgcaggcaatcaagcaaggaaaataaattgaggaaccaggctatgtaatcacaatcacttgcaaaaccatttaaactattttctagttgtaattgttagcagtttcctatgactgtaatcttttaaaaaatatcttccacttaaaaaattaaatgcacatgtacattaatgttttttgtctacttatagttaggtgctatgccagattaaaattcccctctttcccctttccaattctacattcccttttcatttttgtacattatggttccaagctaatttcgtattatttatccaaataatgggtggctaaaaatttgatctttaaaactacaattttgaagcaatgtagagtttaacaaaacataacaaacaaaaaaccatagtgagttagccatttcatgatgacagtgtttttcacaaagtaatatgttaccttttcagatgttattcaaggatgggtaatcattttataaatgttacataattaaagattctcaacattataaattagtatgcataactcttaacagagaaaattgaataataagatgtaaattgagttgttcaaggtcagacagtatgtcagtgaggcagccagcactggcaatctcaaattcctgtcttcccccacatgtgccatcccacaagatccctgctctaacctttgcctgcaaaatgctaactctggtattcttcacaggacagaaaccatttagaatagaatttcaaacttaagaaactgattaagaagttaacctaaatattaccataatatatgaatttaaattaattttcagctaattggtccatcatctgaatgatcaattcctaagcacagtccaacttcttcctaatgttgtatttaagtgccaatgagctggctcaaggggactcaggtttcacttgtgagaactaacccttggggaatgaaacagctacttttcagagctgggctgcccttatcctctatcgtaatccaaggaagggacaatccagtgttcattcaaagaactcttagagcagctttctcacctccttacagctgggaagagataacagaacattcttatttcaaagccttaatctgaaccattgtagaccatgaattcctaaagcattaaccgtctggttaagatttaagctggcttcaaatagttttctcacttctaactttatgtctcaagcaaacccgttatgcattcttacacatttctgatcacttaaactcactggcctctttgtgatattccttcccatgtctgcacaggacagaagtatcccccacttgtcatcccatgagatgtatcccttagcaagttaaaaaaaaacaaacacataaagctaggggccaaaacatcattgtttaatgatggagcctgcaggttatctataaagtgatttcacgttaaaattgtcaagttaataactatttgatctttatattaaaatacataaagtttatattctttgaaaaaaaagtttagtgcctgaatgtaactattcaataataagctatatattcttggtcaccatatgtatgcacaaaccatctgacagacaaaagtataagaatggaatttctggcacgcctacatagaatagtatcatttttataaaagacaagagggaggaggcatggaaggaaatcaacattcattacgtgcttactaggaaacaggtactgtgctaagtactttacataaaactgcaatcaatttcatgtttattacattccctcaccaaatcattataaaccaatatattcaaacatcaaaggaactgaacacaaactctaggaatcctgaactgattccattttttccttgggctatgtgctaaggccatcatattcatcacccctatttatacaggccaagggctcagaagcacattaatttaaattattcccagaaagcagccccaaaatgccattacctcactgaaataattcttttcaagaggctagttttgataatccaagaattcaattcttatgagcatactttgataagaatttgttactaatttcattatacatcaagagacgagccactaatatcaaagactaaaaccatggattacgataatttacagatttaagctttttcagtgcccagaggttgtaaagaagatagatagggttggaaatgggatagactgggtgtttttactagccaaatgttttgattcactgatttacagtaaaatgttaacttcagtgaaatagatacttttcaggaagtgagggagagtattaaggaaaaatgtctaaacgtccaatgtaaaatatcttgatcatatacatttgaaaaaaattagtaaactgaaattgttttttaagtgtttgacaatactgtaagtggaacaaagcagcaattttattcttacacttctgacatttcacttagtgactttaataaaatattaaaattctaatgactcagcaaaacgcaaaaaatgcttaggcaatgttaagtgaaaacaataaaattttatgtatatcataattatataaaaatttgtgtgcataaaaaataattggaactttgaaagttgatttgacagtataatcagcttatagataattacttctttatttttattataaaaattatttttatattatttaaattattttttatatttttatattttttataatgttgtttcaataaaaatggcaactttaaaaaagcatgtgatcactacatgtattaaatggcagtctgtctgcaatggcttaactgtgttaagtgtatctgtgtcttagttttccagctattctgtcagttccaggaaagcaaacaccaggactcctttgtaccctccaaaatacttaacacagcctctcagacccagacagacccaaccaatcccagtgacagctagtcactgagccactgatgaacaccaagtgcagacaacataaaaatgagaacttactattatttgttggttcaggaaacccaggctttggaccactccatcctttgttttcccctgtctgaaagattaaatcaatcgttcaaatccagagaaacaagcttattcaaaaagaaaaaaaaaaaggtgaccaattaagcaaaggcaaagtcctctcacatggttattctgcatattatctctatctttgaccctgggatgatggctacaaaagaaactaacatgaagggtatcatttattccttttctgcacctaaatctacttatgtccttctacttttgtctgatcatgtaaatttataattcaaggcataaagccaatattcaatatatgtattattagaatgtaagctctagctaggtggtgaaaaaaataaatctttttttttttttttgagacagagtctcattctgtcgcccaggctggaatgtaatggcttggtctcagctcatcgcaacctccacctcctagattcaaggattctcctgcctcagcctcccgagtagctgggattagaagtgcctgccaccacgcccggctaatttttgtatttttagtagagatggggtttcgccatgttagccaggctggtctcaaactactgacctcaaatgatccacccactttggcctcccaaagtgctgggattataagtgtgagccactaagcctggccaaaaagtaaatcttattaaaatagtaaataataatcatcaccacaaatgcttaagtgaccaaaagagcttttgtatgattcccgaggtcaaattaacaacctaacaatcaaacatttctgtagacaaaaatgttactatgtccatctagaaaagtcctatggtaagggtcaccaaatactgctataatgacatatacaaaaaatacaaatataaaaaaaataaaaaaataaaaaaatgacatatacaaaaaaattgaaaactaagtcctaactttaagtcctaactttaagcaaactaagtcctaactttaagcaaaacatgtaatattctgacttttgccaaatgattagtgtttggtataaaatacattctgaaatgtagatgctttgaagtagtaagtattcaaatcaaattaataagtgactttagttatattatctttctgtacagctggtaacttatctcttatgatgatcagcattttatatttatgttaacggtcaaaggtcaaatagataattaagcctagatataaacacaaaatacaattgctgcaaatagtttacccatgttcatttttaaaaaaaagttgttcttattgaattcattcctttttaatcatacatcttagggtgacaaggaaatatatagtggcagacagcagaagcaaaactgaaaataaagaatcctgaagagtaagttgacagtatgttagaaacaaccagcagcttcatatgaactagggagcatctctttctctctctaattagctcttttatctctttaaaacacaaattcctgtcttcatcaacatttaccatcctgagagattgctgctataacctttgactgcaaaatgctaacacaggcatccttcacaagagagaaattactatgtaataaaatagactgatagtagtaatagctaatagctaacactgaagatttaaaagtggggttgctaatgcgctaagtgttttgcataaatatggattatctcattttcatcctcacaaaaatttggtaagataagtgatattaacattcaattttacagacaagcaaacagggttagagttcctgtaattactctaaggtcacacagataatatgcacaggtgccaggacatcaaactacatcttctaactagaggagagtaatcatgctacctttgtactgccattatcaggagagaaaaaagaagctaaagaaaggaatgagcaaaaaagttacagattaagtaaaactgtgccatctaagaatgaaaagaaaaacagtgagatgaagaacagagtttggaactattaagaagaatgctctaaaggtacggccaggatggaaaggactactgcaaaaacaaatgagagaaaacagaagtagaccagttccaagggatgaaagaaatttaaaagattttgaaaagcagctaaaataattattcacatgaaaacctggtgaacagaaagaaacaaagtatgttcaatttttcttttacattcctaccatacttttaattttattcatacctccaaaacatagcctgtacttatcaaagtgctgacaactgtttaggttcttagagaaataattacgtttccagaatcctggagcagttctacaattagccacaggattctagtctttctaaacaagtttttcatttttaataagtggaattaataaaatctgttttatttgactaaactaatttcttctattcttaccttatgttacctcaatactatacaattggctggatgtggtggctcaagcctgtaatcccagcactttgggaggccgaggcgagcggctcacctgaggtcgggagttcaagaccagcctgaccaacatggagaaaccccgtctctactaaaactacaaaattagccaggcatggtggcccatgccggtaatcccagatactcaggaggctgaggcaggagaatcgcttgaacccgggaggcggaggttgcagtgagctgagatcgtgccattgcacaccagcctggacaacgagagtgaaactccgtctcaaaacatgtatatattatacaatttatccagtaggtaacatatgattttcatctgagagctatgcctaacttcaaaatttctttcttttaaagatcattgtttgaagagtaaggggaagaggtcaggagagatgaggtcaaagtaattactacgagaacttctctcttgaaaaggagaaacccagcaagcacaaagtacagttcatctcccaatccttactttctgtatttcttctactgtacccctcagacacaaacgagaaatataaaaggagatgatatggtttggctctgtgtccccaccaaaatctcacctttaattgtaataatccccacgtctcaagggtggaaccaggtagagataactgaatcaagtgggtggttccctcatgttgctctcttgatggtgaatgagtctgacaagatctgatggctttataaggggtttccccttttactcggtattcatttctctttcctgctgccctataaagaggtgccttttggcacaattttaagtttcctgaggcctccccagccagccctgcagaactgtgagtcaattaaacctcttcctttataaattacccaatctctagcagttctttatagcaaacaaatataggaggcaacagcaggaggtaagtcaaagtctggaaagtggaaagcagatgaagaagttgtagctagcttagcagatgtgagtaactgaaacctaacctgcagaggaagaagccaacaaagagctcacagtaaggtgatgtgtcacccagaaccctagaaagcctccagaattaggagtacacctggtacatttaaagatgaatcctggaaggggctgaaacagaaagatttgtctggaagtcttttcaaggtattatgaaatctccctatcaactctttgaccccatgcagtcaggtgcctaccccttcctaataggggtttcctgttgggagaggctaaaacagagaggctctggataccaggcatagttgagggtgaaatccatgtgtcaccctgcaaataaggagatgggagttccaaggtttcatactgaaaaataagattccaagactcttttctcatttgcccctcagaagacacatccagggttccaaaccacaggaacagaaagataatgaggagaacagaagaaaaaaaatgcaaaaaaaaaaaaaaaaaaaaatcctcaggcacataagagaaagactacacccattaaacaagaataggaaggcttaaaaggaatattctgagaatgaggaagaactctgggaaatcaaaaataaaatagctgatgtgaaaatgtcagagagggactagaaaacaaacttgaggaaatcttcctagaaaacagaacaacaacaaaaacagaaagagggggagaaaagaaaaaccacaagaccatccataagattggcatctcagaaataaataacagcaaaaataaaagtaaagaaattattaaagaaataagaaatttctcagtttaaagtatatgaatttctagattaaaactcaaatgtccaacacaatttatcaaatacacatataaaatacacatatctcagaacccctgagaaaatagaaaagcatcgagagggaagagaagggtaaaagtttcatatacaggctgaagaatcaggtgttgaaattttaacagcaatgctgggaggtacaagacaagggtgcgatgccttcccaactccgtgaaaatttacttccaatttagaattacagcttagaaaaaaactatcaagtgtgtggcaaatataaaaaaatttcagaccacaagatctcaaaaaaaaagtttacttcccatgtatccttcacagggaaggccctaaagtatgtactccattaaaacaagaaagtaaaccaagaacaagggaaactgtccagaaaatagtcaactcaacaaaggacagaggccagagaaattttcaggataatggtgaagagaagaaccttaacagcagctctgcagcaggcatatcgatcaatctgcaatacaagaggaggataaagagctctaagggttgggtagggtgtacgttgggaaaggaacgaaaaaaactgcatgatgtgcttgactggtaaagactttggggacagaaagatgtagaaaagtgtatgtgtggagtatgtaccagagttaaaccctcattttccatagcagaaagtacatttaatttttttacttttatattacttctcataatatttaaacatgagaaaccaagagatagcacaaactacccatagtggtaagtaataaaataaatagttacaataggtggtaaagtggttgcctctggcaaaggggaagcagaaatggccagtggcagggaaggagaacaggatattttggtattttaaattataaaccttgagtttttatactattaatcttgtataaattctgcctttttatatatgtattattttgagtatgagtactactttgatgaatataatgatcaaatacaaaaaagagtagtcatgtcttgacttcaacaaactccaagatattaagaaaaactctaagatatctgaatgaagaaaatcaagatgcaagaatggcatataaaaaagaggtgaagagagtattccacttttccttagaatctggaaacataacaatgacaaacagccaatctgaaaaagacaattgcaacttttcttgaaccctttagagacctgagattacaaggtaaacaagcaaaatgaattctagtgagtgataaatccttctgggagagataggactcacaaaaatgttaacagctttggcagggcagggatagcagagatgactgccatgaatgtaagtaagaagaaagtagatgaaatgttaaattcttaaagcctgagtatgagctagcatgatagtttagaaaaactgggagctccagacagcagctcttttccattgtcctgccctggattctcagaaggacaactggggctacagctgcagaccagagagagcccaacttggtgcaggaatgcagctggttaatggctgcactgagggataagcacagaaccttgccacttctctaggccattctccaatacaaaacaaaaaatttaagccaccgggggaagggtagaaacaaatcctatatgccgttggggcaaaggcaggaaattctctggtcctaagagctcagtaaagcttcattgcttctgaagaggattgaaagcaaaagctatatgctcctggggaaaaaaaaagatagaaaacctacttgagagtaagacactacaccagtataaagcagaggtctgcaaatgctgggaaatgtacaggaaactctctcatgcccaaactgcccaaaaatccaagataaaatttggttaccacagagaagacagcaaaaacagaaagatccacctctgacatccaggctcacagaatctgccagaaaatgaagctggacaaaaaaatcaagaactatgacacccaccacaatcccaggattaaataataaatagcagcagtctactacagagcctgaagagagataaccccatgccatgacacagcaaagaagagacctctaaacctgagggctgagcagagaaactgtgaaaaaatcctctcaaaacctcacattacacaaagcatgggtaacagcatatcactattgaaggaatttgtagttaacagtgactatggcaataacaaaacccaaaatgaattcagttaataactagactgatgcaaccctcgatccaaaaagtctgagagagagacatatgctgatttctcaacaaatactatttgacttagcctctactatttttctgttgcaaggtccaacactcattcaaaaattatgagatacccaaaactgcaagaagaaataaaccactgccaaaacacagggaagtcaacaaaacagggcccagggatgaccctgatgctagacctttcagaaaggtattttacaacacctatgattcataggttgaaagaccaactggaaaaagcagataacatacatgagcatatggggaatttcagcacaccaatagaaaccacagaacaaaaacataaggaaatcctaaacgaaaaatattagagatcaaaacattgatgtcattattaataatgcattaattcagactgcacacagctgaagaaatattgttgaacttgtagacaaatcaacagaaattactcaaactgtttaataaagaaaatcctataagacaataccaatggtctaatgaatgtataaatggaaactccaaggaaaagagggagaaaacaaggaataaaatatattttaaaagataatagctaagaacttgtcaaaataactgattccatgacatcaaatcacagatccaaaatgctcagagaaccctataaggacaaggaggatgacaaagatgaggatgaggatgaggaaggaagagaagcaggaggaggaagaggaagaggaggaggataaagaagacaaggaaaaggagaagggaagaagaaagaggagggaggaggagaaggaagagggaagaggagagaagaagaacaatagggaaggaggaagagaagaaagaataaagaggagatagaagaaagaggagaaggaagtagggggagaaggaagtaggaggagaagaaaaaacgagagaagaaatgagaagaaggaaggaagaggataagaaggagaagaagaaaaggtggaggaaaaggagaaggaagaaaaatagaaagaagggaggaagaagggtgggaaaagagtacaggggcagaggagaaaggaagaaacaaaaaaaatcaattagatacatcacaaccaaattgttggaaaataaagaaaagaaatatattaaaggctgagagaggaaaaaaaatacatcaacaagaacaagtaagaattacaacagactttacattgaaaattatgcctatcaggagacaagggagcaagatctttaaagtactaaaagaaacaggaaacccagaatcctatatccagaaaaaaataactttcaaaaatgaaggtgattcattggaggcttaaaaaagaaaaaataacgtgaaattttctgctagagcagtcactgaagagcagcagccatagttctgcattaccccatgcccatgggcctcaaccagggcccaaggtgaacaagaatatgagcaagctgaggcagggctgccaccctggacaccttaccaagcacacaaagcttgtgtaagacatcatctgggaggtgtgtggcttccccctgaaagtggcatgccatgaagctgctcaaagtctccaaggacaagcgggccctcaagttcattaagaaaaggatgaaaacacacatatgcaccaacaggaagcaagaggagctgaggcaatatcctgactgccatgaggaaagcagctgccaagaaggtctgagcccccaccccactttgtgtataataaaacctgcaaagaaaaaaaatgaaagtgaaataaagacttttttggcaaacaaaagctgagagaatgcactgcctacagatctgctaaaataagtaatattaaaggaagtccttcaagcaaggaaggggtataataccagaaagaaatttgaatttacacaaataaatgaaggatattgaaaataatcaaaatgagagtaaatataaaaggcattttctgctgattttaatcacttaaaaagataactgactatataaagcaaaattagtaacagtgaattgtacggtttgaaaaatatagaaaactaaaatgtatagccacaataggaggtcagagaaacttagagaagtaacctatgtgaccacaatagaggtcaaaaaagaaaaaaagtaaacagagtaagtgcggggaaaaaaaaaggcaactaataaaatggtgtgtttaaatacaacaatctcaataacttcagtaagtgcaaatggtctaatcaccctaactaaagggcaaagtttgtcaaattaaattttaaagaacaagacccaattatatgctttctaaaagaaaccaatttaaagataggttaaaagtaagcacagggaaaaaaatatcccatgcaaacaccagtcaaaataaaactggagtagctatattaatatcaaacaaaacagatttcagaacaaggaataaagggaaatatccaatagaagtggtcaagtcaacaaagacacaacactaactgtatacatatataacaacaaagtttcaaaatgcataaaacaaaaactaataaaactgtaagaagtagaagtaggaaaatccaaacttatagttggaaactttaacactggacaaaacaagtaatcataacagatacagggcctgaaagaagaaatcaagagggaaatcagaacatattttgagttgaatgaaagtaaaaacccatacagcgtgtatcccagaggtaaaaaaaaaaaaaaaaaaaaaaaaaaaaaaaacaagagagagacaagaaaaacccaacttgtcaaaatgtgtagggcagagctaaatcagtacttaaagaaaaattcacagcattaaatgcttatattagaaaaaagaaagttctcagatgtatagcctaagcttctacctcacaaaattagaaaagaacaaaaaattaaaaacaaaaacaagtgaaggataaaataaagagcagaaatcaaaaaaactgaaaatagaaaaacagagaaaaatcaatgcaactaaaacctaattgtttgaaaagacttaaaattttataaaccccctagctaaactgaacagaagaaaaagagaaaagaaataaatgatcaatatcagaaatgaaagtgagtatcattacagattctgctactactaaaagagtaaagaaatgttatttagattttgccactattaaaagaaaaagggaatgttataaacaattttatactagtaaattcaacaacttagatgaaatcaactaattctttgaaagactaaaactgccaaagttcattcaagcagaagtaggtaacctaagtaaccctatctatttttaaaatctgagtttgtagttaaaaaaccctttccacagagaaaattctaagcccaaaagccttcactggtaacttctaccaaataattaagaaataccaaccaggtgaggtgcctcacgcctgtaatcccagcaccttgggaagccaaggcaggcggatcatttgaggtcaggagagcaagaccagcccagccaacaaggtgaaaccgcttctttactaaaaatacaaaaaatcagccaggcatggtggtgcacactgtaataccagctactcgggaggctgaggagggagaatcgcttgaacctgagaggcggaggttgcagtaagccaagatcgcaccactgcactccagcctgggtgacagagctagactccgtctcaaaaaaacaacaaaaaaatcctgtttttgctggttttaaatattgcttttgccacactcatcaaaagtcttattgataaatcaatatattcagtcctcttatttgatctctctgcagcatctgactaccacctagcagtcattctctattcctttttgcaggtagtctttcctcctcttttttcctgtaccttgcatgcatcttatctactattcaaatcttacccattacatttgtgaaatatctctggagtctttccattcctcctctctaccttcactgtctcagttcagaccctcaatatctctcacctaaacaactctggttgcctcctgactggcctttctgcctttggtttcactctgctcaaatccatgctccccattacttagagttatcttttgaagaatgcaaaccagatcaattcacattcatgttcaaatcttaaataagcatttcttcaaaccttctacttcgcataataacagtgacctcagcttttcctgactttccaggttcatcctctagttttgttatatggttaaaattcctcactccctgcacttaaagaacgatcagctccttgagtgcagagaccaagtctcagtcatcttattaaaatcagtcattttaagtgtctggcatttagtgagtgtgatgattaactttacatgtcaacttctctgggccacagtgccaaatggtcaaacattattctgagtgtttctgcaagagtgtttttgggtgagatttacatttaaagtggtgaactctgagtaaagcagatcaccctccacaatgtgggtagtcctcatctaatcagctgaagggcctgaacagaacaaaacgctgacctccctgggcaagtgggaattttccagtagactgtttttggactgaaatttcaactctttcctgagtctccatcctgtcaggctgtcccatcagattttacactagccaagcctccacaatcacatgggccaattccttaatatatatacacagacagacacacacatacacacacacacacacacacacacacgttgatggttctttttctttggagaaccctgacttatacagtggttatgcaaaaaatgtttttcaaattaatgaaattaattaatgctggttttttgttgtgtttgctttcacttaatttacaaatacatgtctgtgaggagatttattttgacatatttttatagatcactcaccagttttaagtcaatataaatgtgttaagttaaaacaacatatatacaatataaggactatagaaactggaacacatgttaggtttcacgttacaaatacttttaaaagaagaaaaagtgttgactagccaggttataaaaacagaattgaaatctctagcaataatacacagacaaagattttttaaaatcattcaaaagaattgcctagaaaacaaaaaagtacatctaagtgtctttatatatttttgtttctaattctaaacttttaaaatgtgttcctgtagaaactaaaaaaatctctgaaacagaattcttgtgtgagaagatggcctggtctaaagcatattacttttgataaaagtaattagtaagcctgttttgtgaatgttcacataaataaaatgtttggtagaaataatgtctacatatccacagataacaaaatgatacttaatacaaaatggaaataagccaatttctgccaagttatctgccaagttctgaattcagggttctctgcttcccttgtaacagatgtaggtgttaatgatgtcattaactgttgcagaaaaaataggggaccatgaacacaggtcttggcagaaaataaacaacctatgagttcacctttaaatttaaagtaaatagaaaaattagtttatagagtgtctgtccaatacagttcctgccctaaagggataagtcagaatttttatttccagtgttttcagctgtattccaaaaataaaggctaacaacctgtgttcttaaaaggcacaaattaagactgtgtctatatggcaaaaacaaccagtcaacaagttaaaaatgttaaattggtattacataaaatatgtacaaccatacaacaaactttttgtattttctaatcataagattataaatactcattaatatctcatcttactccatatgttattttgtgcttggatcatctatctttgtattgcctcagaaaagttaaaattgacatttactttaatatcagttaagatcaaaatttattaatcactttgatattatgacagataggatacatacatgtaaacttaactcttaccttctcaagttgatcctgaagattagtggatgctttataaccaagttgtaacagcattgcttctgcagcattttttttggctatctttttattaggtcctgttcctgtagcaacttcattgcctaccttcacctgataagattaaagaaataaattaaagaaatacatttatgataaatttaaacaggaagtccttacatcataaagcaattctactctctagcatttgaaaacataaagttcagtccaaagtaaaaatggcaactaagataacatttatgtaatgttgtatatgtacatgaaaaaatggtccttaaagtatcaatggaggattatctcaggatggtagaattttatagaatttttacttccatatatatttatatgctatttgattttttaaacactaaatttatattatttatataagcagaaaaataaaatttacattttaacagcgttcatgttggttatgactacattttagcattcttatatttcaattaataaactgaaaaggctaaaattcatattggtgccatttaaaataatgttcaaattgcaatattatgtaaacattcaagtttacaaagatttatattaaatagttcctgaagagaattaatatacaagtgttcctacaacattatgattaaaaacaaggcttctggccaggcgcagtggctcacagctgtaatcccactttgggaggccaaggcaggaggatcacaaggtcaggagtttgagaccagcctggccaatatggtgaaaccccgtctctactaaaaatacaaaaattagccaggtgtgatggaacacacctgtagtcctagctactcaggaggctgaggcaagagaatcgcttgaacccagtaagtagaggttgcagtgagccacgattgcgccactgcactccagcctggggccacagagcaatactccatctttaaaaaaaaaaaaaaaggcttccaagtcagattgggatatgaaactcaactctattatttcctagctgtacgaactggtacaaattatttaatatctctaagcctcaggtttttcatcagtaaagccggggtaataccaactactgcacaatgttgctttgaaaattaaacaagataatgtatgtaaaccacagcatttaatccatcacaattgctccaaaaaaaagatttttatcattagaactattctacagttatcttctgtgagcaatttatacatgtacttaaatacacatcaaccatacaactataaaaagtaaagtagatagcaaaaaaggatagaattacaaggagaaatagaaaatacacaactatagttgaatttctttttacacagtggtctcagtaagtgattgaagaagtagttaaatagttaatcacaactttggaaattaaacagtgtaattctggtcaggtgtggtggcttatacctgtaattccaacactaggaggattgtttgaggccaggagtttgagacccgcctgggcaatatagtgagaccccatttttacaaaaaaaattttaattagctaggcatgatggtgcatggctgtagtcccagctacttgggaggctgaggtgggaagactgcttgagcccaggagttcagggctgcagtgaaccgtgatcacatcaccacactgcaccctgggcaacagagtaagaccacatctctaaaaaaattaaaattaaaaattaaaaattttataaacaatgtaattccaaattacctaagggcaaaagaagaaattccagtgaaaactagaaaatattttaaataatccatggacatatatcaaaacttgaaggacacagcaaaaggagggtctagaagaaaatgcatagccgttaacagcttacaggagggcaaaaaagtaatgagctaaacatccacctcaagaagtcccaaacatatcagcaaaacaaacccagagaaaatagaagaataaaaagcaaaaaggaaatacaaaacaaagtacaataaagttagaaaagccaaaagttggttctctaataagactaataaaacaataaaccaaaagtaagactgatcaagaaaaaaaatacgagttcttctctgagatgggtatttttaaaaaagaaaagaagaagagaagacacaaataagaaatgaaataattaaaaagggagattaccatcacttctgtagcattacaaaataataaggattactgaggccgggtggagtagctcactacctgtaatctcagcactttgggaggccaaggcaggtggatcacttgaggtcaggagttggaggccaggttggccaacatggtgaaaccctgtcttactaaaaatacaaaaataaaaaaaaaaaaaaaattagccaggcatgatggcaagtgcctgtaatcccagctacttgaaaggctgatgcaggagaattgcctggacccaggagaaagaggctgcagtgagccgagatcatgctactgcactccagcctgggcgatagagtgagtctctgtctcaaaaaaaaaaaaaaaaaaaaaaaaaggaatactgagagcaatttcatgctaaaatttaaaaacatatttagatacaatggaaaaattcctagacaatacagattaccaaattgccacagaataagcctaaagaatatgactaaaactactaatgaaatcaaaccataattaaaaacttcgcaaaaaggactcttcagatcttctccataaagttctactcaatatttaaggaagaattatgctattcttttcatccaaattcatccataaaacacgaaatgagaaatcagtccccaattattttatgagctctcattttgattccaaatcccaacaagaacagtataagaaaatttacagaacagtttcactcatgaacatagatgcaaaagttttaaacagtataatgaataaagcaatatagaaaaagaaaaagattcatgacaaagttaggtttattgcaggaatgcaagtttggtttaacatttgaaattcaaactagaaatcgacatttattcataatgaaaattattagcaaactaggaaaagaagaaaactttttttttttttttttttgggatggagtctcactctgtcacccaggctggagtgcagtggcacaatctcggctcactgcaacctccaccttccgggttcacgccattctcctgcctcagcctcctgagtagctggaactataggtgcccgccaccatgcccggctaattttttgtatttacagtacagatggggtttcaccgtgttagccaggatggtttcgatctcctgacctcgtgatccgcccacctcggcctcccaaagtgctgggattacaggtgtgagccaccacgcccagtagaagaaaaccttttaaatatgataaagggcattttacaaaacacctacagcaaacctcaggaaacactgtacttaatgttgaacgaaactaattagaaacaagacaaggatgttccctattattactactgtttaacagtttacacaaatcctagacagagaaataaggcaaggaaaagtaaaaaaagaagcagaagggaaaagaactcattatttatagatgtgatttcatatataaggaatctaagaaactccacagatgaattataagaattgattagattgtaataagctcagtatgaaaaagaggactgcatttctacattccatccacattcaagtagaagatgaaaaatattaaaaagataacatttacattaaatgaaaatcaaatacctatgatgtgcaaatcttctacatagaaaacaaagtcttattgagaaactttaagaaaaacctcataaacagagcaaaatgccatgttcatggattgaagacaatactaatgtaatagtatcagttctcttcaaattgacctaaactcaattaattgaactcaatgaaaactcaatcaaaattccatatatctttttacaatacttgaacaagatgattccaaaatttacatggaaatgtgaagtgctaagaacagccaaaatccttttgaggaagagcaaggtgtgggacacttatttgtctggatatctagacttattatgaagttaatataaagaaaaaatttaaatttgactacactaaaaattactcttgttcttctaaaagcattatttagaaaggaaagtcacaacacaagaggaggtatttaaaatgccatataactgcaaagggcttgcatccagaatatacaggaggttcccatatatcagtttttttaaaaaacgagcagaaaaatgagcaagaaaagtgggcaatccatatctgaaaagttgaattgttttaccagttatcattttacttaaaaaaaagttagaaagtttcaataatagtttcatgccactttaatacatttcacaatgacaacaaaattcagttttcagctatacagcatgatactctaaccatacttttcttttttgtctattgtgtaaaatcataatattggctgtttcatctgtcccagaacatacagattcccatttggtatccacacttgagtactgttcatcatttattcttacatccttatttacagtttttatttgtgttattatttccaacagtactttttttttttttgagacggagtctcgctctgtcacccaggttctggagtgcagtggcgcaaactcggctcactgcaagctccgcctcccgggttcatgccattctcctgcctcagcctcccgagtagctaggactacaggtgcccaccaccatgtccggctaatttttttgtatttttagtagagacggggtttcactgtgttagccaggatagtctcgatctcctgacctcgtgatccacctgcctcggcctcccaaagtgctgggattacaggcgtgagccaccacgcccagcctccaacagtacttttaagcttcagtgaaccacccaattttaaggaactgggagaatatacaacaaaatggtaagaaaatacaaacttaaacataaacaatgtacaaatgatataaaaaaggtgctgtactctcttttaacagagtttcagtaaagacaaactaaatgacagttcatacagcacatgaaacgctgaaaacatattcattacagaatttctgtaacaactatcacaaattgcatagtttaaacctgtgaaatattttttaaatatttcattgcctttttttctgaaactggaaaccactatgtcgtgacaaatcagaagcagtctttggacctcactctgagaaggacaaatctagtacagtcagaccaggtactcagagccagatgaatacacaccacctgccgtaacagtgtctgcctcaacatggcaggccctatggataatctactcaaatccctggctagagtacctctgctccctgttattttttccaatgctttgtttgttcccccagcttcatcagtccctatgttgctgctggaatccttgctggtgaaaagattaggccagttatgtcagaagcttcctctactgctctgaggcctggtcttggacttgtcagctgtaatgctgttcccattcctgtattcaccttgtctctccgtctgctagatttccatctggcctattctgataccttcaagacttacttcttctaaaacaagtgcttcccagattcatttacccattcacccagcccttgcctcatgcaaattttaataatcgcatggttgaatagtttgtaagcagttatcctaatttgttaatataaaaagaccacattgccaaaggactttcattccctgctaataaacacaatggtcactcaaaacatcactttattataaaagttaagtaagtttataaatttcacaagtcatcttccttgagaagtcacaaattttataactattgtaaatatggtctctacatttaaatgttaatttctatctgtaaagaagctcaattattttaccatgcagtaaatttaagactgccaaatgtttgtctttaaatttaacagctcattcacatgaatcaaatcctcaaaaacctaagaaactaaaaagttctgaaataggatttaccaaaaacttaatttttatttattttttaacaacctggtgatctcaatcacaggctgaaaagttagtaatacagtgtgctgatatgcaatttggtttagttatcattattttctgtttgaaagattaaaatactcctcaccaaaaaaatgaaaagctttaagaaatctgctctggaataaaatacccaaataatgtcatcggagattttctttcgtttatctagtaatcaacataagtaactgcatccattttttaatatatagactttttctttggtaacagataaaaatgagcatctcatctctagatattttgctgccacattcaattataacaaatgataacattgcctaagtagtttatacaaaggccgttactttgataaaattgctgcaatactgtaatgaatccactggggcttccagaaggggaaaaaacaatatgaattcagtgcgaaaacatttaaaagcacagccaaatgtccccatttgactagaatgtttatgaatacccataaaatggaagctggcctaagatatgctaaattcctctttcaaaaggggtactcaatatactctgtagaaaaggatttgtttaataaagccaaagccagtttatattcccaatacatgtctaaaattcaggcgatttttttcttcaagctttggcattcaaagtatatgttccagaattcttcaaagttaagaatgttaaggaaaaaaatagtgaacatattttaccagtgaaaataatgaaacaatcatgtgctggatcctaataacatcttgacaataatgtgattactaaccagagaattcccctctttttggatatctgggttcccaggagtgacttatctatgactacattataagttaacatctccaaaaaaaaaccatacaggcagaaaggcaggcagcaaatatctatcaaatgtttattaaggtcctactatttacaaaccactgtattgggtactgaaagataaagaaacatggagattataaattgggagggaaggcacaacttagctatacacttaaacttaatcaatatgagacactgtatttgagtgccaaaatgtctaccacatggtcagcacttaatatttgttgattttatctaagttacataaaatgtgagatccttggatttgactaaaaagtttctgtgactaaccaattatttaaaaaacagtttgagactaagcacagtggctcacgcctgtaatcctaacactttgagaggctgaagcaggaggatcacttgaagccaggagtttaagactagcctgggctacatagtaagatcctgttgctataaacaacaacaataaaacaacatttaattagctggccatggtagtgtatgcgtgtaatcctaggctactcaggaggctgaaaagggaggatctcttgagcccaggaaatcaaggctgcagtgagccatgatcatgccaccgtactccagcctggctgacagaacaagaccctgttgccccaccaaaaaaaaaaaaaaacaaaaaattaaaaaacagcttggggaaaataataatttaaatatagactgggtattagatgattctaatgaatcatgtctaatgtaagaaaagctttcatatttcttagaaacatacactgaatatgtaaggctgaaatgacatgtagttagaaattatctttgaaatacttcagtaaaagaagagagaaaggaagaaagagagggagaagagaaaaattaatagctgaatcaagtgtggcaaaaatcttaataactgttgtgtttgagtgatgggcatattaatggtccattattattctctccccacctttggatatgtttgaaattgtaataaaaaagtaaaagaaaaatttcttaagactggagtttgagctggcaaatgaagatgaataggtaggggttgaaaaggagagcattttaggcattctacttcattcctagcccatctgccaatacactagcagccattccttgattttcttggctccacaatgcagcagtcagatctcagcaatcctgagtgcctcagcccccaccatggttagctagcctgcttactctctttttctaactttcctgacagcccacaagctcaggattttggccctgatccatctactacatccatccttctaaattttgtttctaattccatgtgtctccaattcccagtagttaacagactccggctacaaaatgtaacacaaaaagttaaaagataggcattaaatgataaactccatggtaaataacctgtgtgaactcagagtcccttggaaaactcatgttgtctattgtaacatgtccttgacacttgaatgtttccaccaagttggtaggtgagcctggacagaatgaatgctttaactggaaacagttttactttctgctcttaagtcctagtttgcctttcgcccaaatgcctattccatcctggggatttctaaatcttttcaatagttttaaaaggttagaaatacctgcatcacaaattctcgacgtcgaggcattcctctttctgaaagcaaaacataatccggctccttttcctttttggcctgttgaatttgcgccaggcggctaatagggttcatcccttggccatattctggtccggcctaaaaattaatttaagaaaaagttttaaaatatgcttgtgaaacctgttattgaatccttaaagaaacagtgcttcttccctccacccccacaccccaaaactgtgactagaaaagataaatgagtcatttatgaatatttataaaggaaaatcataaaatagacctgtaaccaaggcttctatgggacttggggcttagatgtattaatggcaaggtgtcaactatgctttttaaattgggcacactcttcagtataccagaggtgcttcacaacttctgttcatcaagaaacatcaaaaagaacagaagaagaccaaccatgaactgggaggagatctctgcaacacattatcattttattttattttatttatttttttgagacagagtttcattctgtcgcccaggctggagtgtggtagtgcaatttcagctcaccacaaactccacctgccgggttcaagcgattctcgtgcctcagcctcccaaatagctggaactacaggcgcgcccacaccatgcccagctaatttttatatttttagtagagatggggtttcatcatgttggccaacctgatcttgaactcctgacctcaggtgatcccactggccttggcctcccaaagtgctgggattacaggtgtgagccgcagcacccggccacaacacacataattttaaaaagacgtatccggtatccaaaatatattttttaagacccctaaaaagtactaagaaaaagagaatataaaagggaaatgggcaaaagagataaatacttcacataaggaaaaactcaatatatgaaatgataactaacctctaggacacagaaaatacatattaaaaacctcagtgagttactatttcacatccaccaaattagcaaaaattaagaagtctaacagccccaagtggtgagaatggggagtaacagaaactcttataaaacactgggagtactataaatcggaaaacaacctggcaatgtctagtaaagcctgagatggtacatcctaccccaattagcctattcctaggcacatataaaccctagaaaaccgtaacccatgcacagtagctcatatgtacaggaatatccacagatgcattatttgaaataggaaaaaaaaactagaatattcatcaataaaagaacagataaattacagcatgttcatataatggaatggtatatagcagtgaaaatgaattaattattgctacatgcatcaagatgaatgattttcagaaagaatagtaagtaaaaaaggcaagctacagaataatatatatatagtatattttatgtaaagcctgctaaaactacaaaatactgctgaaattaagatctaaatagtcaatacatcatgttcatcgatcagaagactcaacaataagatgtcaattctcctcaaaatcccagtaggcttttttcctttttttttttttttttttttggcagagtctcactctgttgcccaggctggagtgcagtggcatgatctcagctaacagcaacctctgtatcctgggttcaagcgattctcttgcctaagcttcctgagtagctgggactacaggcgcacgccaccatgcctggttaatctctgtatttttcatagagacagggtttcaccatgttggccaggctggtctcaaactcgtgacctcaagtgatccttccacctcggcctcccaaagtgctcagattacgggcatgagccaccgcacctggcccccagttggctttttaaaatttaatgtgtaagctgatactaaaattcatatggaaatgcaaaggacaaagaaccaaaattttgggggaaaaaaaaagactcagactacctaatttcaagattataaaactatggcattcaagacagtgtgtgtagtattggtataaagacagacaaagggaccaatgaaacagaataagtgcccagacacagatatatatacacacatacacatacacacacacacacacacacacacacacacacacatacacacacacacacacacacacacacacacacacacacacggtcacatgattttcaacaaaggcacaaaaggaattcagtggggtagtcttttcagccaatagtgttgggacaattggctattcatatgtaaaaagaaaaagaaaaagaaaaaaaaatcttcaagccaaacctcataacatttataaaaataattaactcaaaatgcctcacagacgtaaatgtaatttctaaaactataagatttccagaagaaaaatttttgtaacttggttaggtaacaatttcttagatataacaccaaaatcacgttccatgtaaaaaaactaataataataaaatgaaacaatataaataataataaaataaacataataaatcttcaaaattaataacttctgctctttgaaaaagacaagtcacagacttgaagaaaatatttgcaaagtacatatgtaataaagcacctgtatccagagtatataaagacctctaaaaattcaataataaatttattattatttgaaataagcaattaaaatttgttaagctggcaaaaaatttaaataaacacttcatcaggcctcatgtgacagtaaacacataaaaaattcttgatatcatctgccacagaggaaatgtaaattaaaaccaaaatgagatatcaatacccatctacatgaacatctgaaattttaaaaactatgctaggtgttagcaaggatgtgaaacaattggagttatcacacactgctgatgagaatgtaaaagtgcacagctgctacaactttgaaaaactaaagttgactatatacctactaaatgaccaagccattccactttgaaggatttacccaagagaaatgaaagcatatgctcttaagatacacacacaaatattcatagctgctttatgagtaacaatcaaaaattagaaacagcccaaatatccactgacaggtgaatggataaacaagtggtggtatatcaattcaatgaaatattacctgcaaaaaaacagaactaccaattcatgcatgcaacaataaggatgaatctcaaaataattatgctgggttaaagaagccagccaaaaaaaagagtggtttctcggcaaattaaggtagaagattacaaaggggcataaggaaaattctgggaggaatggatgggttcattatcttgatggtggttatagttttacacatgcaaacaaatacgaaaacatatcaaacagtgcactttaaacatgtacaagtcactctatgtcaattatacctcaataaagttgtttaaaggaactaaacaaataactttagaaaaacaaacatagtaaaactataaggtaggaaatggtcatacaaaactagtgatagaggttgcctagggaaggttgcatgaggacgtgatggaagaagagcatacagagagcttcaaagcttattgagaaatgttttatactcaagttgggcagtaggtctttctcacacttacttagtatgctttttaacttatacacaagtttatatatagctttttgtatgtattataacataaaagcaaaaattcaggccgggcgtgatggctcatgcctgtaatctcagcactttgggaggccgaggcgggcagatcacctgaggtcgggagttcgagaccagcctaaccaacacagagaaaccccatctctactaaaaaaaaacatacaaaaaattagccgggcatggtggcacatgtctgtaatcccagctactagggaggctgaggcaggagaatcactttaacctgggaggaggaggttgcggtgagccaagatcacaccattgcactccagcctgggcaacaagagcgaaactccgtctcaaaaaaaaaaaaaaaagcaaaaattcttggaaaccaaattatctttctgcatatgaactttcttcatgtatttttcctagaaataaaagtctgcgtatatcatacggtcaaaactttatttccacctatgaaaatttattcttgtctctactatctgtagagacatggagacatggataatcactctgttacagattacacgttacactaaacttatgtaagagccactatgcagtcttagctcttccggatgattgctgccatttcatcttgacaatctgtagtttggtgctccaggtacagcatccaggcagatccctcatggtctttcaaactatgtttaggattttggactttatccaaagagtaagaaaattactaagaggttttaagcagaggcatgatatgattagacaggtgtctctaaaagatcatactttttaaacgatcatttggtgtcaagagtacttgtagccagttaaaaccttaactgtagtagttcaggttaatagatgtctgtgagttggacaaaagagtggcagaagggatggaaaaaaaggaaccaacttaaaaaacattaggtgacaaggccaagcacagtggctcactcctgtaatcccagcactttgagaggccaaggcagggcggatcacaaggtcaggagttcgagaccagcctgaccaacatggtgaaagcccgtctctactaaaaaaacaaaaattagccacgcgtggtggcgcacgcctgtaatcccagctactcaggaggctgaggaaggcaggagaattgcttgaacccaggaggcggaggttacagtgagccaagatcatgccactgcactccagcttgggtgacagagcaagactccgtcccataaaaaaaaaaaaagaaaaagaaaaaaaagaaatattagctaacagagtaataggacttaatgactgataggacgtaaggggtaagagagaagttaaacgtcgggcgcagtggctcacgcctgtaatcccagcactttgggaggctgaggtgggtggatcacaaggtcaggagttcaagaccagcctggccgacatggtgaaaccccatctctactaaaaatacaaaaattagtcgggcatggtggtgggcacctgtaatcccagctgaggcatgagaatcgcttgaacccaggaggcagaggttgcagtgagccgagacagtgccattgcactccagcctgggcaacaagagcaaaactccatcttcaaaaaaaaagagaagttaaaaatgacccccagcagtttcagcagctggatgtttgtgccagtcactgagataaagaatgctgcaggagaaagaggtttagaagggaaaatgatgaatttgggcccaaaacttgaggcacctgtgaaatactaagtggggatgtctaataggtagtgcagagcatacggtattcaggaatcatctatttaaagatgaaattgaacccccagaagtagaagaacagcttagggaaagaggaggaaaaagactgagaacttcactgttgcaatggttagatgaagggaaaggaaagagcaaaggaaacttttagcttttgataaaatactggtttcaacttccacttatatcctgaaaaaaaaaattaaataaagggccgggcgcggtggctcatgtctgtaattccagcactttgggaggccgaggcaggtggaacatgaggtcaggagatcaagaccagcctggccaacatggttaaacactgtctctactaaaaatacaaaaaaattagctgagcatggtggtgtgcacctgtaatcccagctactcgggaggctgaggcaggagaatcgattgaacccaggaggtggaggttgcagtgagccgagatcatgccattgcactccagcctggcaacagagcgagaccctgtctcaattaaaaaaaaattaaattaattataaggggaatgaagagggactgatgagaaaagacaaatccacataataatttataagtctaagattgaaatcccaatgaaaaggtaaagagaagctctgagtctagcactagaagtagtatgcccagttcatgaagatgttaaataagtaggaatgtgtttccagtggcatactgtctttatttctgtttaatttgactcaaagaatgtctctgagttccaaggaaattattgttgatatagattgcaatgaaaagaatcagatacataaatccaatttagataatgatggagttcagtgtacattaagaattgcttggggctgggcacagtggctcatgcctttaatcgcagcactttgggaggccaaggtaggcagatcacttgagcccaggagtttgagacctgcctgcacaacgttgcaaaaccctgtctctacaaaaaatacaaaaaattagctgtgcatggtggtgttgtgcctgtagtcccaactacttgggaggtgggaggatcactcgagaccagaaaaatcaaagctgcagtgagctgagatcctaccattgcactccagcctgggcaacaagtgagaccctgtttaaaaaaaaaaaaaacaactctgggtggcaaaggcaggcagatcactttaggtcaggagttcaagaccagcctggccaacacagtgaaaccccatctctaccaaaaaataccaaaattagctaggtatggtggcacatgcctagtcccagctactctggaggttgacatgggagaatcgtttgaacccaggaggcagaagttgcagccagccaagatcatggtgccactgcactccagcttgggagacagagttagaccccgtctcaaaaaaaaaaaaaaaaaaaaggcagcgggggaggggatgacttggtttcttgctctgattgaaatgaactaccagcacccttgacaattaagttattccttggacagcaaatcttaaatcatcattctatataccaataaggacagtcttgtaataattgtgtccagaacatttgatctctaagattagaaagccttctttgtagtctcgtcttatagaggagaattacatttaaaaacagaatgtaaacacaaagacattatcagggcagttttacatgttaacaggataaccctatacagtgactctgaaaatccaaaagttcacaattaaccaatatcaaatgggcactggagtcagatgtgacaactggatctgaaagctgattctgctacaggatcttggataggtttcttaaatataaagggcctcatctgtaagatggaaatgaatgctgcatcacagagtgattaagtgatcaaatgagacaatgtgattattttattactttaaataaaaccaaggcaaataatcatagatattttacctgcttccattgagtgtaacaaactatagaccctcaatgtataagccatacaaggaagtgaggaatatgctaaaaatcaggatactattccaagctgatccatttactgacatattataaggtatgaacatacttaaaattatctagattccaactcattatacacatgttgttctctcaaaataatcttacatttcagagggtatctacaagctttattttaacataagacagacatggcaaaagtaactccaagtgtgatgtatatgaggaaaaatgcaggaggctaacctagtctgggagtaggagaggaccagaggagttcctaaaaaagtcaagtttatgctgagatctgaatgatgcataggagggaagttctgggataatattacttatatactggaagcagtagcaaataactgagaattcaaaatgtttctcctgtctcccacctctggggaataacatttaaataataatcttgcttttaatagctatagttaaaacaagagttagatttatatcctactatagaaatgtacagatcttttccagcctaacagtttattatgatgattattattatgattattattattattatcattttgagatggaatctcattctgtcaccaaggctggagtgcagtggcagtgatcttggctcacctcaacctctgcctcctaggttcaagcgattctcatgcctcagcctcctgagctgtagctgggattagagacgcatgccaccacaaccgactaatttttgtatttttagtagagaccaagtttcgccatgttggccatgctggtctcgaactcctagcctcaaatgatccacccgcctcagcctcccaaaagtgctgggattacaggcatgagccaccgtgcccagcctggtttgcctggtttattattcttaatttatcaagataaaacttagtttaatagagcagacagaagttatgtgaccagttttgtgccaccattccaacataaaatgctgttcctccatcacagaaaagccatagattttatatattaatagatttaagaaaacagttcatggatatattcacataaacataaaatgtgaataggtagtattagatacaaaataccaatagttaatatgtgttatttattatagtatttgcattatcattaataacaatgaatacttaataattactaatgcattttgtgcattgtttcagttaatacttataacaatcccatacagcaaggtcagttactattcccactttataaatgaagaaatatttttaaagttaggtaacttgctcaggccacagggattcatactcagaactgactccaaagttcattctcttaatagctatattctactcctgactgtgtaggaggagcatatgaatgaaagtgccagtcctctttggaaccactatgactcatgataagtggatctatttgtatttatttttagtctaccttacatataacatataattccagttcagggaatgcattacctactacatcttctaagtgaagtcatgtcagtattcattaaaaacaaatatttaagtagttatttttgtatatatgtatatatgtattttaaataaaggtacaaaggtataaaacctgtaaaaatacctaaattgtgccattgtgcaatcaaaagaaatccattgagattaaatatatttcttatctgtaatccttcatttgtatagcctgatcagaagaaggctgctaaatcagtgaggctgagccagcaactaaaatgctggcaatttaaggctttctctggaaacacagaactctagctccagacatgtcatacgtgtcaagcattcacaggcactgtcctgtactaaatgctgattcatctcattcctctgatatttaccttgcttctcttattaatgtaaataaattctgacccaataaaagagtcacaatatcttgaaaagctgtgtgctctatattcttctttggcaaggtatacacatctgaacgaatggcaacaaaataacaccatctacttcatatggttgctatgtggattaaatgtgattaaagcatgcaaagtgttgggacaaagtctggcacatagactgctttatgatttccagctgctgtagctatcattgttagtattagtcacatgatttttttgtgtgtatcctgttaccatttcatgatatcctaagaagttactatgcaacagccatgtgtgcagaaagaacactggattagagatcagagcggttcaggaggtttgacatgattgctgaataaaaatgggcaaactctttgaacacgttttgtaaaatcttatttgtaaaatgagggctaacatcatctaccttatacggtcatgagggggattatagtaaaggtgacatgaatggtaaagcactttttaaacaacaaagaaatacataaatacctaaggtattatgattatttgatgtacaaatgcaggtgcacaggtatttaaaaagcaaaatagaattgtcattaatttatagtcacatgtcctgccctcatttcaggactgtatatagtccataagttcagggatctgccttatagaaaaatgcttatctatagctactataatatttatttagtaaaactgactgatgttcacaaatataaacttacctttactattgttttagggcgttttttaaaaaatagttttggcttttccaccacaggaagaggtggaagttttttaagctcctgtaagacggtggtcgcagcgcgcttcttggagagttttttgctatttccttctccttctgcagagaactctcctactgacactcgagtaacaaagcttttcatatgtggtggtccactttctttaataacctattaaatacaagtaaaatattaaataatggataggcacttgagatgtattcttaaagtatgacttaatattcatatcaaaaccaaaattagtattatgccaaaattatagtatttctttaagaaagctattatgaaggtattatactgggactatttatgacacttgatgcttaatgcaattgaaacaaaagaaatctaaataaacacatttgattcatagtcaaaatgatttattactttaaaacagatcattctaattacagtttctccatgtcttatggaacacaaatttaagaacatcaaagataccattagattagataccatattagattggtcatctagaatgataatttgtatataattacatacctaacttcctcctatgtacgagtaagttgctggagaaacgagtagttctataaaccacaaggcactgtgcctgtggaagcctctcaaaaacagtcaatggataaaaataagctgtttttgatagggatgtcaaaagctgttttacagaaagggatatttattcttgtgacacgattttaaaaaggtaagtaggtatgccaaaaaaattcctagctttctagagtaatgagttatggacctgtcaactatgaatgtaatgttcctaaaccttgtttaatctgcaatactaaatatttaacctttaattgttcacattagatcatcattataaacatcagatatcctacatcataatatattgatgttcccaagaacacctaagaataataaaactgtctgttcttactcattgtagcctttaaaaaaaatcccaataattttttagtataagcaattactttttacaggttttccaaattttccgtatcatttcttgctggaccaataggatctcaagtacattctctccctgacttcctcattttgctgcttttaacaagctgtggaccgagaactgagataatgcaacttgtaagaatgtgtccaagagaaagcaaacagtttctcagtccaactcagatgatcctgccaatgagtaagatgtgggagctttctagtaggtgaatgtcatacaatgtgagggaagaatctccacaactctttcagcttatttcctggttcttgtctactttccagacatgagttgtaaaattagtgacctcttaataaaagaagtattataataattatttttttaagttttcttttttgaaatttcatacaattttatgaatatatttgcaatatatttatctagctgttaagtcaagagttgcttcattacatcttacttcttggtgattttgttagttgaggttaaagtgaaacatattttggcctccacacaattgaaaaaaaaattggatattaacatgtatgtcactaaatcttaacttgaataaatttaatttaatcctatttaaaatgccaaatcttataggataccacaaattatctatacccagaaaataacttttataataaaaattgaaataccatgtatacaaaaggcttaatacagaaaagaaaaaaatcagaaggaatctgtgttatcatcatgatttctattttcaccagggcctagatcatttcataatactgggtttgaacatatagaagcacactaactcttgcaggatactaatacaccagttaatttgatttgtttgtttaaaataaccacagcaagggaaaaaatgggaagatctctaccgagtacatacctcaaaactgacaggcatatttcgcttcagagcaatttcaaacactaagctgatctcagacttatttgcatctttgtcatcatccacatcctttcctgattcaccattctaaatcacaaaaaataggataacactgaatcttgacattataacaaactttacttttattctacagtcaagatggcctatttaaattacaagaagaaacaacaaactatatagactgtatctgctgcattctcctgtaaccacagcggtcaagggctttgctgccaggctttttgttactcgatttttagcttgttttccttgaaggaaaagcatttaatgcagactttggaaatcttttactcaaccatacactaatttgagtttagcctacatccctaaacctggcactcttgttttagagttctctacccacccaacccccaacacccaggaattcccccactggtgttctaatgtgatctatgaggatgaagttacagaaagagtacaggatgcaaaccaggagcatcctaattggagatctatgtctggcacaggcattggtttactttattcacttatttaacacatacttctggaaggcctcatatatgctgaacttactataactattagaaagagacagtattccttgctgtcaagaactgggagagaatgatctagtgggaaaacagatcaagaaatagataggagctctcatgaaagagtacaagcagaaaaacacctaagtctgccattaagataaatatcaaaggagaaagaaacaattggtttggggaaaggaaaactgtagaggttgaactgtagggtaagtaagaagctcactatgctgccgggcatggtggctcacgcctgtaatcccagcattttaggaggccgaggcaggcaaatcacgaggtcaagagatcgagaacatcctggttaacacagtgaaaccccatctctgctaaaaatacaaaaaattagctgggcgtggtagcatgagcctatggtcccagctactcaagaggctgaggcaggagaatcgcttgaacccgggaggcagaggttgcagtgagctgagatcctgccactgcattccagcctgggcaacagagcgaggctccatctcaaaaaaaaaaggaagctcactatgctatgtataggacatgcctgagctagagatactattttgaagtcaatcaagaaagtagctgaagccatgagaatgagtgagattacttaagaacagcctcaatgtcatttgtaaaacaaaagaggactgaaaaatccataaaatctcttccactttaaatccttgattctagattcacacaatgtaatctatattcaataaacatagtatgaaatataagccaaatcaatgttatttctcatcctcatatacatccccaaatccccagttgcctgggaagtgaactcaagggaagaaccaaagctctgaaaggtagtcaccctgcaggaacacatgaagcaagactgtcaggtcttcactctagtattcttccctatcagaacagattatttattttaattataaaatgctctgatttgtttcactgggaaagtagaaagaacagactgtcacatgcagcagcaccacacctgaggagatctttctggaataggttcattctgcagtgcttggagggctttcattgcagcattgtgtctagcagcttgtcgagtctttccttccccaaaaaattcattatttcctacagtgagctgaacataaaagatcttaggcactgggcaatgatacctaaaataagaaaataaaaacattaaagttagcttaataaaaccactctataatcattcataagatttgtttaaaatgataccaattatataatgtgctatactcttaataaaactttaacctcaaaaacatacttttttgataaaatgtgagtcaatacatctatagataatagcttatactgatctccatgaaaaacatatatagaatacaacattaaacataaaacaatacagtaaaaattatttaattatatcacaggatacttcctggtgagaagttttcggtcagattttgacagaagtaagagaacagtctgatgaagctacaacagaggctgggtcaggcaagactgttcaggcgacaacatgtagattaccgtgctttttgcagaagataattacgattagaaatatagattagaaatggaccgactacaatgcaaagtaataaggagagcagattcagcataagaataaggagtttaggccagttcttaagcaggaagtgttatattcatacattttacggtgcctgaggtaatgaggctaatgaggtgtgactaaaaagctgcaataatgcagatatgaagagataacagagaatgtaagaagaaacaaaaaaaccaaaagaaattaagcagaaaaaattaagatatgtaataaaatccattaattcaacaattatttatggagcgtcttctatttgacaggggactatgacaatgaacaacaacacttagagtggggaagataaacaataagaaaaatatgtagaatacctagtatgttagatgtagatgtaagaaaaagtaaagaggaaagggttcagaagtgtcagggaggtaggttttagatagggtggccaagagaagtttcattgagaaaatatcaattgtgtaaagacatgaaataagttagggaacaagccatgcagatctctgggacagtgcatctgaagcagagagtataccagcagcaagggcagcgaggcgggagtgtgccacacatgttcaagtaactcggaggaagcctgtctggcaaaagtttagggagacaggaaaagctagatgagaagaggtggcaagattccatagggccttccctacaaattgctgtaggcatttttaacccaagtgaaatgaccagccactggaaggttctgcacagagaagtgacaaaatctgacttatctcttggaataaccatctgactactattttgaggacacactgtaggggaacaatgctggaagcaaggatatctaataggctactgggataatcaaggggaaaggtgacagtggcctgaactagggtgtagcaatggaagtaacgagaagtcattgtttctagatgaattttgaaagtagagatgatgggtttacccaaagactggctatggaatatgagaggggagtcagggatgacatcacggtttcggaactaaacaactggaaaatggagtacccatctattgagacagtgaagattgcaaaagaaatgggtttgctgggggtggatttcaacagctctgttttggggatattcaattattagacctattagatatccaagtgtagatgtcaactggacaactgaatttattagtctggacttcaggaaagaggtccaagatagaaataatatttgggaatcatcagtatataggtggtatttaaaggcataatataatgagaactctgtgggagggtgtgatgggagaaaagccaagcaagcacgatgtccttcctgaaagtcaaacaggaaaaaagtctatcaaggagaagggagggattaactggatctaatgctactaacaggtcaagtaaaatgatgactgagaaatatgaccactgaattgagcaacttagcaaaataaacagaatcgattttgatggaatggtggatttacaactgcaatgctgaaaaaaatgagttaaaaatcactccagtcctaaaaaatgtttgtttccaagcaaaaagaagtccaattgaggtcctactatattttagataattactgcacatccaagtagtgacgctctatgtccaacctgagataaactggatagagcgcatcatgtaagcattcaccaggcagatgggactaatcaatgaaggtttactgaaggtgaagaactagaaatgttgattggtactgaagatgcagatttgtgaggcaataattgaaaccatgcaagtggataagcacctggaaagggtaagtgtaaaggaatcaaaaaagagcctaaggctcggaactgattaatgcctgtgatcaaagtgcaagggaaacaatagacagcagtgaaagagatgaaaaagggtcaaagttagaagaaaaattacaacacaatgtcagggacaggagtaattaacagtgtcaaatgaaggagaggaattcagagtatgaaaaaaaagaaaaagttgctgttttaaatgcttaacctaaaatcaattttcttgaactacagttttctattaatttaagataacgcattttaaatgtttttattataaacaaagattaaaaagcattaaaaaactataatcttttttgctttttggttacaacaattaaatattgtgtactgaagtgcacaatttcctatcatctattttattttaatccctttaatgcagaaatttattttaattccttaatgcagaaatctgacagactaatatgaataacgccggtcatcttcacttcatatttctcaaaattcaattttcccacctccacataactttgtttatttttaactggtggtactataaaactttaaaacagacaacttgaaatcagaaatttactcctgaagtgagatctcatatggcaaactttcaccatagagcaaatgtttacaattaattataaacttctgaaaatagaaggtccacaactgaaatgctaacagacctttaactacagtagagggagtgggcgccactataatcactaaggcctgctgacaattacaaaactcattttggtttgccacagagacaaacaaaatttctgttcattgtaactttactggaatatgatgtcataacacataaccatactgaaacaatctgctgattttctggccaaaatattaattgcacaccaaagagcccttggggcctctccctttttggtcatcaaatatggctcaatgtatgtgtatgtgcatgcatgtggatatatatgtatatataaattatattgtgtaagtatcagaggaaaaattaagtatgttgcatttttaacataaaaggtaaaaattctagcactaacaacaggaaataccaagactggatgcctgacttatttcattctgtttcacttcatcctcttacttaacaatgattcttaataatataccccacatggtttgaataccttatatatcacatctcctcataccatcatgacaatcaagattagccagagcactctcattaattgcatccagattgaattacaggggagatgatgcagaatggtttttgtgtgataggtctggtctcaaaatacttacttcctttggtaaagaaatacccaaagtttattaattataaagatcgatatgttctatttagtggatttccttctactttcacttatttcaagtattaagctcacttttagtaaggtatttgatatggtttggctgtgtccccactcaaaatctcatcttgaattgtaatccaaattgtaatctccatgtgtcgtgggagggacctggttggaggttaagtgaatcatgggggcggtttcccccatggtattctcatgatagggagtgagttctcacaagatctgacggttttataagcgtctggcatttcccctgctggcattcatttcctctcctgctgtcctgtgaagaggtgccttctgccatcctgaggcctccccagccatgcagaactgtcagtcaattaaacctcttttctttataaatcacccagttcagtctcgggtatttcttcacagcaacatgagatcagactaacacagtaggtataataagtgatgtacatatttttacaaattagtatatttacctaagcagacatagctattcttgaatgatttttctcaagtagaattctgtggtcaatgtttagatccccataatgattactgttaaaagatgaaccacgaaaactcccccatccaagttatttaagtttcagggtcaaatggttgcatttcttttaaatcccaaaaaagtcttgggatttgaaagatcctactttcatcagaattatcttccatgcttgttaaaaatgaagattcctgtgatccaagcctgatctgctgcatcagagtttctgaggatggaaccataattttaagctgccctgctgactctctgcacgataaaggtccaggattatcaccacatcccacaatgtggcccatgtgacttggcaattgcttcagagtccattcaaggagaccacacacaatgcttactgcacaatggttaggtctttctctcttttttttttttttttttttcctgagacgaagtctcgctctgctgcccaggctagagtgcagtggctagatctcggctccccgcaagctccgcctcccgggttctcgccattctcctgcctcagcctcccgagtagctgggactacaggcgcccgccaccatgcccagctaattttttttttttttttttttttgagacggagtctcgctgtcgcccaggctggaatgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcactgtgttagccaggatcgtctcaatctccgaccttgtgatccgcccgcctcggcctctcaaagtgctgagattacgggcgtgagccaccacgcctggccaggtctttcatatctctttttcatttaatcctcactacagcctggtgaggcaggagatgtccccaaggtcaccttaagaggtaacaaatgtccccaaaagagttgctgggaaccaaatttaagtctgcctaactgcagagtccaggaaattccgtatggagcttcctaaaaatctgctttatcttcttccatttttgttaatttttgtttattaaattgtctatcttcatggaaggccagagaacctaatgcaagggatctaaagtaaggcccactgatagacttcagagatgttttattgagtgaatggctgctgaaacaaacagacaaccatgatgaaacactgtgtttctgcagcatgtcagatcaaatagacacaagtgcatgacgtaaaatcaaagtgaaacatcaaaatgaacagcgttgtgtgccacattacttaacagactaaatctgacaaatgctgcttgcaaggcctttttatccccatgtctccttgccttctaactgctggaagtcttgcaaaaaataaataaaattgtaaataaaataaaatagaatcttcctttcctttagatcccaaacaagtcttgagattcagcctatcttcaagataccacaagtcaatacaacagtaagaaagaatgtatactggttcctttgatttaatacttgatattccttacagtttttttgagtaaaggaaagattttacattcacttatatctgactgttagttgtagcaactttttataccacatatccttgccaacctccctaaagttacttcatttaatgccctctttatggactcattttgtattatctttctaaacaactaaaatcccgtatgtcctccctaccattctgtgactgttttattctccaacatctccactttcctgagtatcatttttacaaggtgagaaagacatatcccaaataacattaggatttttacaaattgaaaaataattacctcattctatttgatagcattattcataaatctcaacacagcttaaacattcatatctcccctacagacttacatcttaaaatatatgaaaatgctatcttccgatctaataaggagaggctttggatttctgtgtttatttctaacattgactggaaacagaaatgtcacttaacctttctatctcagtttacttatctacaaaatatttgtagaatttatgtttaaaggaccctaaaggccaaaactaagaattcaaatgacatgtcgattattttgactctttgtacactttttggcactgctaagcattctttttcttgctgtagaaaaacagcaggtttttatcatagagctataaaatagtccttggcacattttcaaacttgtatgtatataaaatatctagatagaagacagttctttctctattcatatctacaaattttgaaaaatatatcttttatgagatctaactgttaattcttgaggaatttcaaatattaggactgattagaaaagattcacaggtcagatgaaaatatgctttaaaagaggtgtatggatattctatttgtagaattactgtaagtatgttttaaatgcctagaggaaatatagaaagatatgcactaaaagctaggatagggtgttttgaaatgatagcattataaatgatgttctttcctctcataatttcaagttttaaaaaataatacggtacactagaataaaaatggaaaaaaaaatacttaattgaaggaagtctagtccctatccaaacaaaggtaaatctgtgtttgaaattaaatttgataaactagtggaatgatttatggaatacagaacacaaatcaagagaataagtaacttgtactgtatcactgacagtagtgccataatcaggactatgcaaagcacagcacgttatcaaagagccccattattgtaaacacacaatcaccaccctcaatctcatacttggaaccaacataaacttgttcttgccccttctctaaatggatatatagataaatcattatcacatcaccattatcataattagagctaaaacatacaaagcacttactatgtgccaggcactattccaagcatttagatactaatctcactgaatcctcacaaccccacttcattttacagatgaggaaactgaagaatagagatattcactaaccttcccagggccacccgacttgagctcacatttgagcccaggcagtctcactccagaacccatgctcataactgctataccatgctgcctctgaatgaactggatagatgaacactataaactgcagaagtactaactataaactctgaagaagtcatgctggactgggaatatcaaagcaacttaagtctctctagatgtatgagatctggcagattctgaagatctctgtacgccaaaagtcaggtgcaggatatcagctgccaaaggcaatgatggggacactgtaagtctagaagaccaagttgactgcaaagtcctatttcctctctgctcattttttgtctcctcttaacccacccatctggagcccaggtttaaatgttctcattagggaaatgcaaatccaaaccacaataagacactacttcacacacccactaggatggctatagtttaaaaaaaaaaagtcataaagacatggcaaattggaaccctcatacattctggtgggaatgtaaaatggtgcagttgctatggaaaatagtttaccagttcctcaaaaaattaaaagcagaattaccacttgacccagcagtttcacttctaaatatatacccaagagaaatgaaaactggggttcaaacaaaaactcgtaggtaaatgtttacagcagcattattcctaatagtcagaaagtggaaataacccaaatgtcccgatgaataaataaaatgtggtatgtccccacaatggagtgttttacagtcgtacaaaggaatgaagtataattacatgctacaacataaacgaacttacattatgctaagtgaaagaagctagatacaaaagagtatatactctatgattccatttagacaaaatatccagaataggcaaacccatagagacagaaagtagattagtggttgccaggagctgggaggatggagtttgaggagtaactgttaacaggtatggggtttcttttaggagtgatagatatgttttgaaattagaccacggtgatggctgtacaacactgtgaatgtactaaatgcacaatgaattgtatactttaaaatagttaatcttgtgttacgtaaattttatttcaatacaaatcatttttttaaaaaatgttgatactccctagggttctattttgtttctcactgacaagacagtttttgtaggtgatctcacctactctcattcacattcttggcagactcccacaaactagcctaccaaattttgtaaagggaagtgtaaaagacctcccttttgcactctaggatgttactgacctggtcttcttcctactcttgtctaattgctaggggggtatgtgaattacattaataattcaacatatacttattaaaggcctacttcatgctgggatggagttttagtttctagagatggaggactgccctcaggaaactatcaatcaagtaagtacacatacacacacacacacacacacacacacacagacacatacacatcaacaaatgagatgagctaggaagaaaaataaagcatggtatagaaaaagattaacaggggctcctttaggaggtgacatttgaacacagatttgaataaagtgagaattctaggcatggaaatgccagaaagaaaaagtgctctaagcaaataagacagcaagtgcaaaggccctgcagaaataacatgttggttggtccatttttgagaaagggcaagtgttccttgtacctgacaagccctgagtcaaggaatgattagtaggaaactaggtctgagaagtcaccaggcagcaaatcagaacttaattccacatgatggaagccactggaaagttttaagcaggaaagtggcacaatctgacatgatttaaaaggatcttgttgctatttacccgaggagaggcaagaagagaataggtgacaagccattccatagtgcaggaaaagtcatctctaaaaataggagactgaactgctcaagaaaatataggattgcaggcagtgctacaatttcacttaaggattgtggtcattatatcaaggtggactagtcagcatagatgtttttctgtagcttcctaggagcaactgcagcagagtcagaggagctggaattaaccagttacagttttgccaagcatcgctgctcattccaactgggaggcagtagaacacacaggaattaggtagccataggactagtgaaaaatgggtgatcaactctagtgaaaagcagccacgctgaatctggcaggtgaggaaagggtgcacccagcctggaggttctgctcaaagtcttcaggtgctaaaggacaccaccctatttcttgccctcctggtggtcagacagtgtgtggcagaagcagtaagatgtgcctcccctgtggtggctgacaagcaaagcagtgctggaagtgttcctactttgcaactgtgaagaagggtccctggcaaggcgatctgggggcctcttcttccagtgtgctgccactgtgttcccctgggtgctgcagcaggcctgtctgagaggtaaatggctagcactgtggaaaccagcagaattgtggagtgatgctgcaggaatacggcggggggggggggggaggggggggcaggagggcgggttccctggagtagtatttctcaagtgggtcccacatagaaaacactggagtcttcctaatggggtctagaaacacttgctaaaaagcagattcagggctgaccaaagggattcaggatggagtccaggaatgcgcacattacctaacagcctaggtggtttgcacacatgctacagattgagaagggcctcgtcacaggggccttcttccctgtttgtgaatacaaaggcttctgattcctgaatatcaactttgtactcatctgccttacagagtgctcttcctgtctttaatgggattttagttaattctctcaccatttgtttcataagaaaaaattaggattttcctattatttccagaatttgtttttcctatttatttccacaatttattttgctaattttgttgatccaaacttccaaaagaatactaaatagcagctgataaagaatattcttatttcttacttgaatgggaacacggctagtaaatactcattaaaccttgttaaaaaaaaaaaaaaaacactgacagtgtggacagaggaaaatatttttaggtttagaataagatctactggatttaagttccagctactagatctataaagactttgggcaagaagccttatgttctctaagagccatcagtaataagaacaattttgtctgtatcaactttcagctttattcaagtgacaaaccagttgaaaattattatacttttcatgaaatatagcatatctgtgtactgagggacaattttcaaatagatatatatgttcacacatatactctgcagttcaaaaacatacaattttttttaaaatgtaagttttttttttttgaaacagggtctcgttctgtcacccaggctggagtgcagagcatgattatggttaactgcggcctcaacctgctgggctcaagcaatcctcccatctcagtctctcaagtagctgggaccacaagcatgtgccatcatgcctggctaattttttttttttgtagagacaggcactccctatgttgcctaggctggtcttgaattcctgggctaaagcaatcctcccaactcgggcgcccaaagtgctgagattataggcatgagtcactgtgcccagccacttttaacttttcaatatatattcactaaatactgcatgctagtaatctaatagcagaatcttacgtactaaaaacttatggaaaatatggcttattgtttctttgagttgtaagaatattcctattatttaattccagcagcagatatcatctttggttaagggttctctgagaatgcactttgaaaacaactagtgtagaaaatctctcaagtccttcccaccaacaaaaggattcacgaaacgagctctagaaaatacttataaaacttctatctctccattaagtccacaagcatatgtttttgaaaagtttgttagaagtataaaaagcatgaaagtataaaagatacaaacatactggattttttaaaagagggtttacactctttttcgataaattaattttataatgtctataataaaagattcaaatggatgattacgtttgcactaaaatcttccaagaagtttaaaaactgtttgctttattacaacgtccagcccaggcatctactccagtgcttttgctgatcagaattaactatcaactttggatgtttgcccacttcacatactcccaaaagtaacatggagacattacatcagcggtattgcagaaagattaatgtgctttgtttggagatgcaaactaattatacttactgcatacttctagtattctgtctctttcactcaaatctaaatgaatttagtcatacatttgcatacagtttaatgataacaataatgtatagttaatagatactcactggaacagaaaaaatttacttggcattttcccagctaattgtttttacagcttgacttcactttatacattaggtgcattcataaaaaggtttacataaagcaaatattttcatactaaatcccattttcccactgttgcccaatattaaatcttgagttatatttctacaggaaaatgctggctccaacacatcataaaaattataattaaaaatctaaacatacatgccaaggaataggtatgtttaatacattattttacaaaacactttatcctctcacctgcgataagaattaatctaaaagataatcattttgtttcatagtctcacaatcattagaaggacacgtatgttttaaaaaaattgcagggttttaaagtagcttcgtagaaactaaaagtagaaatataatttattagctggaactgccacatggagatctcctgtcagattttaggcaatgcaaatagtctcagattattgacagtaatcatttaagggtcttagaaatttcttcggctatgagtaacacactttggggggttcattacaatccaaaccagatgatttactggaattatacagatgctctggagccaataccactgtctgactcgaagcccacttttcttttttgaggcagggtctccctctgtcacccaggctgaagtgtagtcgtgcgattatgcctcactgcagcctcaactttcaaggctcaagcaatcctcccaagtaacaggaaccacaggcgtgcactaccacacttggctaatttttttttatttttatgttttatagagatgcttttcaaagaaataggaaaatgaactttgctcaactacctggatcctttcatactgtttaatattaaaagtgtaaaaaaagcaacatttgctaaaatagtacagtacttggaactttaagaaaactcttccacttttaaagtaccttggattaacgttaaacaatttataattttcagtcattttaaattaatttgtaaaatttttcctgcacaaatcctctggggaatgcactatgtggatttcaattacctatgctctccttttcctgcattgctgcagatacgcaaggtatgcttttacatcggttagtcagtgtgaactgtctcttattccaggatgcacactaagctgagaactatccaatcctctttatctttgccatgtaccctgaggtaaaacacagcaacaaataagggagatgatattggtagagacaatattgatatccagtctgactaccacacataggaagaggctgaagtaatacttagagctttgaaaggctaacagttttggcctcgggttatgatggtttactcctgttcacaatacagatacgtgtattttagtcacactaaatacaaagtgtggccaaagacattcttttctgtggacaaaatagtttttgaagatattctgaaataactcagtcatcatgacatcctactattcccaaagagtggatgttgacatgagttagtgtagcatagcagaaaaagcacgagctttgatgacatattactcctgggctggagggccagctcagccctttactagctgtgtcaccctatgcaagatacatgctgtgtcagaacatagtagccccaggaaatcatagttgttggcctctttccctcttgacaactaatccatcagccttctttgatattctacaatgtttctatgaagctgcagcatctctaaagcttttggttattccctgtaaagaatacccttagctgtggttatgctggcagaatctctagactttcatttcacacgctcagtggcacccctagtttcccattagcgcttgtaccatacccgggagaacatcacttcatgcctgtctaggagatctgacatttggttcattggtcactcaagaatgccaatctaggccaggcacagtggctcacacctataatcccagcactttaggaggccaaggcaggaggatcacttgaggccaggagtttgagaccagccttgccaaaatagcaagactgtctctacaaaaaacataaaaaattatctgggcatggtggtacacccttgtagttccagctactcagaagcggaggcaggagcattgcttgagcccaggaattcaagggtacagtgagctcagcatcaaatgtacccttgcggtttgagtaccactgcactccagcctaggcaatagagtgagacctcatctcttaaaaaaaaaaaaaagaggaataaaaaatgaacaccaatgcagttcaaaacaccaagcagtgtgcagaagataagctgataaattcagatactataaaaaccagtagaaatcaactaaataagcctctggaagaatttaatgtaaaataataaataacattactacaatttttaaaaattgtaaaggccatttatttacatgtttggggttctgttctacacagactgttctgtatagactgttctgtgacctgtcagtcaattacagtacaggagtctagtaactcatttatctttaaagaagtgcatcttgaccagagaacatgagaatgtcaacaaatcataaggaaataaataaagcaagttggtcaaggtccttgtaactgaagccaagaaaaagcctgggaaattaatgaataataagctcccaggaaactcaaactgagaaaagcagtaagccatgatgagaataatacctgagatgattaaatatatagtccaaatattactgcctacgatcctaaatcttacccacccgcaaaagagaacagccaaaaagctgaagttgctcatttttatctcaatgagagagaggagggataaggacgaggcaagaaggggggaggagagggagggagggagggaggaagacagagggaggaaaggagagagagacagcacacgaacacgagcaagagaacaagggcaaaaaatacttgctgacagtaggtatgatattaagaatattgtattatattgcattagaaatatagacgattgaaagctgacataaagaactgatttggatttagaaaagatcagaatataagatagttttatttccattttaaaatgagtatgtaaacaactattaagttcagtacattaaaaaaaaaaaaagtcttgctgcctttattgatttggagaaagcctgccacatactcttacaaagacaggatgtcaagcaaaccaataagtcattcaaacccagtgtatataaggttccttaagtatttgaggaatcaacatggagaattctgaaaatctgagacccacatgggagtaaagaaagaatgcatcttaagcaaattttacttattgttctctttgttatcctgaaaaagtcactcaagagaacaaaaaagggtttgcaaataagaccatataatcctatttgcagaggatgacacttcttatgagacttagaaacctgcaatacaatctgagcttataagactgagaactccaaagcaggagagtgatcaagactgacaagagtatgaccatggtgatctctcaggaagctaaaatcaccccagttatgcataagaaattctggccagaaactgaacacttcagagctggtgaactcatgataaaatcaaacagatgaagagctaaacttataatcttagttgtcacttgactcttgtttaatcaaaatgtaattctaatataatcaaaataagtatatcctgttacttctcaaatttagaaaggccagactcccctgcaaatgcttgagaaccctgtattagacctcatagttcctcaacaaagggaaaagtttagagtaaatgatacgcatgctattccaggaatagtgttctaggaaggctacaaaagggacaatttctgcttatacacagggaaaaagggagttgtattcactgcagccctagtgtatggtatccagcatgatacctagcacttaaaaggagtccactacatatctgttaaatgaaggagaggttatagctaacaattactgagtggtttactatatgccggcactgagcatgcagtaactcatctaatcctcacaatagcctgataaggcaaatacatattgttatcatttccattttacagttgaggaaactgaaaaacagagaagataagttgcttggcctaggcggaaccaggtttcaaatgaagatagagtggctccacagcaccccctaacctcaatactacattactatattcctctcaacttaaaagtgaatgattgcaagggagagacaggaccagcaagggccaggttctcagctatgtgggagtaaagcaatcaggactagcagaaggacaagttcaaagtgaaaggatgcatgtgagatctgaatggggaagtgctgggagtgaatgtactttgtgactatagactccaagtacctcttaacattgggcatgatctgaccttgaggcggctacaagatgaggatgggctagatcagtggtttcatctttgcctatataccggaagtacatgaggagctttaaaaaatactgaggacaagtcagtaagaaaaagaccactgaggccaggcacggtggctcatgcttgtaatcccaacactttgggaggccgaggcggctggatcacctgaggccaggagttcaagaccagtctggacaacatggtgaaaccccatttctactaaaaatacaaaaattagccaggcgtggtggtgggtgcctgtaatcccagctactcaggaggctgaggcagaactgcttgatcccaagagacagaagttgcagtgagccgagatcatgccacggaactccagcctgagtgacaaagcgagactccatctcaaaaaaaagaaaaagactactgaatcagcacaaaaactagcacaggttatacacttacagaccacagaaaaggaaatataaatgattttatgcatatgagaagatgtttgacctcattcataatcaaagaaatgcaaattaaaatgccaaagaggtatcattcttcacctaattatattggtaaaaaactccaaaacattcaaaacagcctcgtctctagtctagattattgtaataacctcccaactgctctcttaatcagcaaaacggtttttatttatttatttatttattttttgctcaaaacctgcgttggccggggtgggcggatcacgaggtcaagagattgagaccatcctggtcaacatggtgaaaccccatctccactaaaaatacaaaaattagctgggtgtggtggcacacacctgtaatcccagctccttgggaggctgaggcaggagaatcatttgaacctgggaggcagaagacatagtaagctgagattgcgccactgcactccagcctggcaacagagtgagacaccgtctcaaaaaaacaaaaaataaaaaaacctacattggttttgcatttcattcatagtagccagaatctttacaatggcctacaaggccttacataaatcaggctcccagtcacatctctggcttcttctaccactcacctcttcacttactcttctctagccacactagtctcctttctgctcctcaaactcaccatataagcctccacgttagggcctttacaatggctgatctcctgcttctccctcagacatcctcaaggctcactctctcaccttcttaaagtcttcgctcaaatctcacctctcagcaagacctaattcaaattgtgattcccatccttttactcaaacagggctctattcttcctatataagcacttttcactttctaatctactatacaatgtacttgtatttattttttattttctatctcccccaactagaatgtacacttcatgaggacagaaatgtctgttgatgtactccaagtacccataagaatgtctcaccacgtgtatgtataaagatacattctgcaacactgataacatcagaagattcaaaacaactaaatgtccatgaatacaggactaagaagttaaataaattacagagaaatcacacagtgggatactaaaccgttcttaaataaataaagcagtaaccctatttccagtatggccaagtaaactctcactgaactgattctcctgcaggaaacaataaattctgaacaaactgtaaaaaaacaatcatctaaaggtaccaaaaagtcaatgaaacaggtggacactggaggcaagttaacatctggaaaaaaagaacagcataggatgcatttctctcccttttttttcttttaatagcttgaatttgaaggcaagcccatctattccatgtgaaatagctaaaatgccactggaaaatagtcatactggtttgaagacccagcgataagggctcatattccaaagcccctggaatatggaggaggaaatattagaaataaaaatctgaggccgagggcggtggctcatgcctgtaatcccagcacttttggaggccaaggtgggtggatcatgaggtcaggagtttgagaccagcctggccaatatggtgaaaccccatctctattaaaaatttaaaaattagccaggcatggtggcaggcaactgtaatcccagctactcgggaggctgaggcagaagaattgcttgaacccaggaggcagaggttgcagtgagccgagaccgcgccactgcactccagcttgggcaacagagtaaggctccgtctaaataaataaataaataatctggagagagagggagcttcatattctatgtataaaactgttcgaatctctatctgacccctgaaccacacacacacacacacacacacacacacacacacacacacacccctggaaccaattcaaagaaatttagctacgagattagaatttgaggtgcctgccacccaatgcagaaaagttttgttgagaccccagccaactaactgcctgcctaaaaaatttttttggccaggcatagtggctcacgcctataatcctaacacctttgggaggccaaggcgggaagattgcttgaacccaggagttagagaccaggctgggcaacatagcaaaaccccatatctataaagataagacaacaaaaccccatatctacaaaaaattagctgggcatggcagcatgtgcctatagtcctagctactcaggaggcggaggtggggggatcacctgagcctgggaggtggaggttgcagtgagccaagattgcaccactgcactccagcctgggtgacagagtgagggcctgtctaaaacatacacacacacacatacacacacttcacaggaacataatagaatctaggttctacaacatataattttacaatgtccagaatacaatccaaaattattcaacatatgaaacaggaaaaaatgatccattctcaagagaaaaaaaactgtaagcagaaaactaccctgaaatgaccgagatgttagaattagcagcaaagggccgggtgtggtggctcatgcctgtaatcccagcactttggtaggctggggtgggtgggtcacttgaggctatgagttcgagaccagcctcaccaacatggcaaaatcctgtctctactaaaaatataagaattagccgagtgtggtggcacacagctgtaatcccagctactcaggaggctgaggcatgagaatcgcttgaacctgggaggcagaggttacagtgagccaagatcacaccaccgcactccagcctgggtgacagaggagactctgtattcaaaaaaaaaaaaaaaggaactaacagcaaagttatactatgttcaaagagatcaaagaaaatatgcttttaatgaataaatgtatggagaatttcagcagagaacagtaattataaaaagtagccaaacaaattctagaatatgatattcaaatttaaaattcactggatagacataatagccaaaaggagatgaccaaggaattaagattaatcaacagaaattatactacctaactattagaaaaaaagaagttaaaaaaatgaactgaagcttagggacctgttagacaaaattaaaaataattaaaattaaaaaaaaggtctaacagaaggagaggaggaaaaggggggaacagaaaaatattaaaagacctaagacccaaaaatttcctttggtaaaaggcatatttacatattcaagaagctcagtgaactagattaatataaagaaaaccacacaagatatgttatagtttaactgctaaaagctaaaaagacatattatttatggggagcaacaattcaaatgatggatgacttctcaagagaaaaaatctgaggccaggagacaagtggaacaacatctttaaagtctttataaagtgctgaaagtaaaaaaaaaaaaaaaaaaaaaaaaaaaagaaaagaaaaaaaagaaaaactgtcaactccgaattctatattcaatgaaaatatcttcaaaactgaaggcaaaataaagatgttttcagtaaacaaaaattcagagaaatcattgccagaagacctgcactacaggaaatactaaagggtgttcaaactgaagagaagtaaagccagacagaaatctggatcttcagagaaaacaaaaacaaaaacaaacacaaacacaaaaacaaaacaaaaaaagggaaatgatagatatgtgggcaaataaattcaagacctttttctcttaatttctttaagatatagactaaagcaaaaaatcataacattgtggaagttatgatctatataaatgtaatacaaatgacatctatatatggggtgggagttaaatagacctatatggttgcagggtttctaaaattttcataatcagtttagaaaaaataatgcagcttcttacatactgacatggaatgctgtttaaggtatttttcaaaggaaaaaaaaacagattcggaatactattacagaatgatactttcttaaagtaaatacatatacatatacatatccagagaatatcctgaaaggataatacatgaaactggcaggggcaggggcaaaattgggtaactggaatgcaggggtggcatagtatttacattaatatttgaattttttatattttatactgtataaaataaatacaaaaaattaaatacccacaaaaataaaaaagtaaaggctctgagaacttctacaataagaaaacgtttaaattttccttgatccagcattttacaaacctatatgactataggaaactgactcctctccctttttcaaataatagctatttctatcccaacagtgactgtgtattgcttacaccatattaaaaaacacttatttttttaaatcaattttttactagttgtaccaactaaatctagtaagaatataacccaggtcatttgaaatattcttttttttttttttttttaaaaagagtccatcagagtaacttcaaatataattgcaatttcactggcagtctaataaaattccacccactaaagttctagacttaatattttccaagacattcttaaattcagtcactgtcccatgcttacctgtttttaaaaactcattaggtacctctgttattactgtccaaactgaatgatatcaactatttctgaaaacataaaaaattgcttgttgaacatacaaatgattccataagaagatgccacaatatattttagttgctaaagattaatatgaaatgatcacatgacctgagtcatattcttactagatttagttggtacaagtagtaaaaaattgatttaaaaaaatgtgttttttaatatggtgtaagcaataccagtcagtgttgcaacagaaatagttgattaatatgaaatgatatcaactatttctgaaaacataaaaaactgcttgttgaacatacaaatgattccataagaagatgccacaatatattttagttgctaaagattaatatgaaatataaccattattttgatacaaaaaagaaaaacaaacccacaaattcttgttaaagttcaacagatattatttaaattgtagtatcttgtttttaacaatttaacagtttaatagtgaaaattttttctatgatacattaatttcactggttcgagtttctaaatccacttgaaaattttctttaatagtatattttattcaatttatctttgtacctacactaacaaaggaaaaagaatacaatttgtgaatacccagaaattccttaatcatggagaatgtatacaattgtttctatgctctttgaagggaggacatgatcctagtttcatttgtgctaacaaggagaatttattaccaaaacatctgggagatgaatgagatgctaaaacgaaagacatggaagcctagcaacatattctagtctagctaacccttcctaagaaaaaaagatagtactaatagtaaggtgctaatgagccgtacttggtaccctcatgctcgacaaccttctcagatcactcaggttgaaaataaacttctgtattacaactgaaactaaaaattacactgaaaaggacgtgtttagcaccgtagaggctcctacatatttaaagctacttctttaaaattccatgttttagatgtttgaacaagacatcaataattccattatccttgttctggtttgatattatttttatctctcccaaaccataaaatttgcaaaagaaaaaattcaactgcaaaattattcaatatttggaaacgaaaatttaacaaaccctcttaagaaccaataaaagctatcaaatagaatacaaatagatacataaaattttatacactggtaacagcattcaaatcaaagaggtgaagtattctaagaatatttactccagttgtgttaggaacaaactaaattatgacttcctcgggccaactaaatccagtaagaataacattctgttgctaatatgatcatatgaaataattatttttaaaaagaacttagcctatcaaagtcaacttcaaatataaaaagtgttccccatcaatcaactgtatagaaacaatataaaattattcaagatttattttacaaagatacttctcaaacccaagtgcttcctataataatacacatcatatactgtttactgatcaataggaaaaaagaaaaaaatgaaacaaaattagaataaaatatacaacttctaccagaaaaaaaaagagactagaaccagcagggacaaataagtggaactgattagaagacactgacttaaagaattggttatatataaaacatagcttcctatattggatatacctaaacttataatcccatacactctattattcattaatacagactagaggtccacaaacgttctgaaaagagccaaatagtaaatattttaggctttgcaggccataaggtttctaacacaccttctcaatactgctgttgtattgagaaagcagtcatagacaatacatcaacaaatgagggtggtggtgctccaataaaattttgtttttatggacactgaaatctgaatttcatataatttctacacatcacaaaccaatcttctactaattttttcaatgatttttaaatatacaaccttagatcatgggacatacataaaaagaaagctgtgggctctagactgccaacccctgcctcatctagaaatacatgaaaagtagttactagaaatactttccaaacattctttctaataactgaatatcaataatgttgcatttttactatgccattatttttaccatatgtaagttctaaaacagtataatctgccaaaataatgacggaatcaaagctaagaaagctaaaatgaagtattcttaatatttcaaagccacaaaaaagaagcaataaaaaaaacagaaaagtgttgtttcattacacattcctaggtcataaatttcacgtagacttaaactaactctatataatacttgcccactgagtgatacaaagttattagttatattatgccaaatttagaatttcattaattccaaatgtaatatagtattaaaatgtggccaaaagaatcctggagcctgggtgacatggtgaaacctcgtctctacaaaagacacaaaaattagccaggcatagtggcccttggaccacctggtctatattaacgagctactagggaggctgaggtgggaggatggcttgaccccagaaagtggtggttgcagtgagccaagatggtgccactgcactccagcttgggcaacagaatgagacccctgtcctcctacccttgcaaaaaaaaaaagaatcctggtagtttcatagttaacactgtttcatatggtaatactgaaatgtcttagaaaactcaaaggacaaagttgtgaaaactgtattttaattatagcttaccctttaactagttgttaagatcttcagcaaatcatgtcagccagcatttcctaaagtttgccctgtatccacagatcattcattaatgtaacaggatctatggccaattgagtctgagaaatgctacacattatatacatctctagaagatttataatgtacttaagcagatcataaattctgagaagttccgcagtaaagaaaactgttggtttaatctggtattgtccaaacttaaccactttttgtgtgtcatacttattaacatccaaaaaaacctaaaatttcttaaaacatactttagaaaattttctaatctctagtcgaaatcagataaacatccctttgggttctaaattttagaattctgtgagactaattctaagtggtaattttgtgaaagctgttcaactattaagttcaggtttacaaacctggaacctctggatcaaatgtactcttttatactcccacaacactatgaacttcctctactagagcacttatctttaagtagacatcatttctctaactttctagacttactccttaagtgggagatggaaccatcctagtttcttcaacacttaggagaatgcttggatcactcactaaatgtgtttcggttttggttttgtttctattttattgcaataatctcccacttgatctacccataaccactcttgcctttctcctactgcttctctatgcaaacatggtcaggtctcccccactcaaaaactttcatctttgccaggtgcggtggctcacgcctgtaatcccagcactttatgaggccaaggtgggtggatcatgaggtcaggagatcaagaccatcctggccaacatggtgaaaccccatctctactaaaaatacaaaaattagctgggcgtggtggcatgtgcctgtaatcccagctactcacgaggctgaggtaggagaatctcttgaacccgggaggcggaggtcacagtgagccaagatcgcgccactgcactccagcgtggcgacagagcaagactccgtccaaaaataaaaaaaaaaaactttcatcttccactcttctgaaaatgaagaccaaatttcgtaaaatagccctggaggatctagtctctgcctaccctctcctgctttacctcttttatcactgcttttctttattttatctgctttagccatacaaagctaataaagatgaaactagacggcatagagaaaaaagcaaggcaggggcctggggaatgtcagggtaggacagggtggagtgggttggggtgaaatgaaaggcaagactgaaaaggttacattagaccttggcaaatgagagagaacagaaaataaatacctctaaaatgggagtatacctgacttgtttggaaactgcagccagtgtggctggagtgaagttggaacagcagggagcagcaggtgggttagagaagtaataaaggtctgaaaaagcagggctttgtagggtgatgtatatgcaatcaactcccatagttacctctctcatctagatctctcctgagtccagtctcctacatgaaacacatatttgacaactcctcttggatgtcttacagacatgtctatccccgaagtcttaactgcactccaaatctgtttcttctccattctttcccatctcagtaaatggcagtaacctctatccactggcaaaagcaagaatcctaaaaggttctcccactaaatttagaatagacatgaaattccaattaaacatcctccacactaggcagctatagcctttaattaatatagcaaatatggtaaagaccctaatcccatacatacagtactccgttaagtattaccacccagtcacatattacacacatacaagaaggaaatcacttgcatctgagtcccaatcaaggagttcacattcctatgggggcagagactaggtgaagtgggacagtgaatctgcatatcctctgaaatgcccaatgtccatctaagacaaaatggtacctgtacccagagggttagcccaaatagtataatagcttcgagctaagaggtagccatcatggaggaagaggtccttatggcctctgacaatatcaatttaaaaacaggaggtccagtgagcccatcaagcaagatcaacataccatatacctgtacttttatactctaaaaagagatgggaacacagactaggaactactgccgtgtttgaaaatgcccccatgtttgttttctgtgctactgtctgttacttcatagtgactagaaacaaactctacaacaaaaatgacaatacattatggtgtattactacagcagaatactatgtaaatttattaaatagttgtacacttagttacatggaaactcataacacattctgaagtgaaagcatagtatataatttgcataaatagatacactcatataaaatgctacagctgcacctctggtaagccaaaggtttgtatggacttgtcctagaaagcaggaaagtgaggaactaagaaggcaaaatgaaaaattagaaatagattttgaaaagtaagttttacaaacttacctgacaaatttaagagaagtgaaattatacatagtgtattcactgaccacaatggaatcagactaaacatcaataacaaagataacaggaaaaatctccaaacacttggaaactacacttctaaaataatccaggggtcaatgaattaacaagggaaatttttaaactgaacgaaaataaaatacaatatatcaaaatttgtgagatgcagaagtgagaaaaattcataacactaaatacatagatcagaattagccaggtgtgcacctgtagtcctagccactcaggaggctgaagcagaaggatcacttgagcccaggagtttggggctgcagtgaactatgattatgccactgcactccagcctaggcaacagagtaagatcctgtctcttaaaaaaaaaaaaatgttatgaagaatggtctgagaaaaaaaagaaagaaaagacgaaacgtttcaaataaataatctaagcccacacctcaagaacaaagaacaagaaggggaaagtaaatctaaagaaagcagaaggtagtaaatctaagaagagaaatcaataaaactggaaacagaaaaaaactatacataaaagcaattaaacaaaatcttggttctttgaaaaggataataaaactgacaaacttccagcaacactgacaaagaaaaaagaagacacaaatcatcaatatcagaaaagaatcagggattatcactagagatcctgtagacatcaaaagaataagggaatactaagatcaattctacacacagaaatttgacaattagacaaaatgagccaaatcctcaaaaagcacaagctatcacaacttacccaatatgaagatgacttgaaaagccctataagtattcaataaattgaactcatacatttaaaactcctaaaaaagaaaatctccagttgtgggtgttttcaggaagaattctgccaaacttttaaagatgtaatgtctactctataaaatctcttccagaaaacagaagaggagagaatgtctcccaactctttttatgagtacaatagtatcctgatataaaaatcagaaaaagaatgccaaaggggttatggtggggggaactacagacaaatatcgtccatgactatagagacaaaaaaccttaatagaatattagcaagtagaatttagcaacatacataaagaatcttagaccatgaccaagtatcgtttattgcaagcatacaaggctggttcaatgtttaaaattcaatcaatgtaatctatcacattaacaggtcaaaaatgagaaatcatatgatcagttaattgatgcagcaaaacatttaacaaaattcaacacccattcacgataaaaaaaattctcaaaaaactaggaagaagaacatgtccagttggatttaaaatatttactaaaaatctacacctaaaatcagacttaatggtgaaagactgaatgttttgtacatgaagaatgaggcaaggaggtccactcccactactcttacacaacacagtgcttgaagatctagccagtgcaataaggtaagaaatgaaacacgtattagtccgttctcacattgctataaagaaatacctgagaccaggtaaattataagaagagttttaattggcttatggttctgcaggctgtacagggagcattgaggcttctgcttctgggaggcctcaggaaatgtacaatcatggtggaaggcaaaggggaagcaggcacatcttacatggccaaagcaggaggaagagagaaaggagggaggtgctacaattttaaacaaccagatctcatgataagtcactcattatcacgagaacagcaccaaggggatggtgctaaaccattcatgagaaaccatccccatgatccaatcacctcccaccccacccaacctccaacattggtacaattgaatatgagatttgtgtggggacacagatccaaaccttatcaaaatgaaaggcaagcagatcagaaacaaagaaataaaaatgtccctatttaaagatgaaataattgtctgtgtagaaagaaacatatttttaattacctagaactaataagtgaattagcaagtttataggacacaagatcaaaatacaaaaattgaaatgtaggtctacataccagcaataaatgcatggaaggtgaaagtaaaaatacaagaaaagatttactctaaaatttacatggaaaggcaaagaaagcagagtattcaattttgaaaaagaataaagcataagaaaccactctatattattttaacacttattatgtaacttcagtaataacactgtgaggagttggcagagacacagagttcaacagaacgtaatagagaacccagaaacagacccacactagtgtggccaactgtctttacacaaaggtgaaaaagcaattcaatggaggaaggagagctatccaacaaatggtgctgaacaactggataaccacaggcaaaaaaccgaaacaaaaacctttgacctaaacatgacacctgataaaaagaagctaattcaaaatgtacatttaaatgtaaaccataaaacctttaaaagaaaacctaggagaacacctttggggatctagatttggtgaggagatttagacttgatacccaaagcacactcacaaaaaaaactgataaactggacttcatcaaaataaaaaacttctgctctatgaaaaactatgttaagaggatggaaagacaaactatgaacagggagaaaagatttgcaaaccacatatctaacaaaggatttatatctaaaatatatacaaaactctcaaaactcaacagtaaaaaaaaaacaattttatagaaaatgtgcataagacagagatatttcaccaaagacacacagccagacacacacacacacacacacacacacacacacacacgaaaagatgttcaacatccctaaccattatggaaatgtcaaattaaagccataatgatatataactacacatcagaatgaccaaaataaaaatagtgacaaccacaaatgctgtggaggatgagaagaaactgaatctctcatacattcctgattgtgatgccagacagttcagcaactctggaaaatagtgtagcagtttcctagaacactaaacatatatttactacacaactgaggtatcacactcctgtgtatttatcccaaagaaataaacatttatgtccatacaaaacccatacatagatattcacagcagctttatatgtatagctaaaaactgaagaaaaacaaaacatccctcaataggtgaagggttcaacaaactgtggtacacagaacactactcaaaaacatagaatactattcaaaaagtcacatactatgattccatttatgtaatattcttgaaatgacaaaagcatagagatggagaacacattcatggttgccaagggctagagatagtagggtagcagaggtgaagagaagagtagttaagggacaacataaggaagagctttgtggtgacagaataattctgcatcttttttttttttttttggagacagtctcactctgttgcccaggctggagtgcagtggtgtgatcatggctcgtagtagcctcaaattcctggtatcaagcaaccctcccacctcagcctcccaagtagccaggacaacacacatgtaccaccatgtctggctaatttatttttatttttgtagagataggatctcactatgttgcccaggctggtctcacactcctggtctcaagctatctgtcccacctgggcctttcaaaagagctaagattataggcatgagtcaccatgcctggccgagttctgcatcttgtttgctgcagtgcttgcatgaatctacatgtgacaaaatgaaacagaactacaacacatacatttaccaatgtcagtatactggtttgaaatattgtcctacaagtctgtaaaatgtaaccaatgggggagactgagtgcagagtacatgggcttctgtgtgccatttttacaactttcagtgaatctctaattatttctaaataaaaagatttttcaaaaggaagacagaataactaaatcaatagtaattagcagtatctacattctcaagtttccaaatacgtatcttgaaaatttacatcccacatatactatcattcctagtattttcttgaatgattttatttcatggtgatttttattctagaaaaaatacgttctgaagtgaggcttcgagtgttttacttcacagtatccaaaatacccaataacaaaattattttgtaaaatgggtttgagtcttgcagaaatagatttataatccaattctataacttacttcataaatgatactgagcaaattaaacttgagtctctgtttcttcgtaactaaaacagggataaaatatatataccttggagaaccaccacgtctgtgtataaagaaactggcagtgttctacacacagtagactacataacttttactgttatcatcttatctccctgaaggtaacacacattcctatgggcaggaacaatttcatgtatttcccttgaatcaccttactgctgtcagcatggtgataagtatacaaaaaatacccaacatgcaattttctttgaacttttaacttctgccattaaaattaccctttttctttactgtaaatggttatcctctgattttctgaaaagggttaggtttggagtctttcagttgtgtcttgtttttcaaatgcgagttttcttgtttttgttttttagagacacagtctctctctgttacacaggctggagtacagtggtaccatcatagctcactgcagcctcaaacttgttggctcaggcgatcctcctgcctcagcctccctagtagctgggactacaggcctgcaccacatgcccaacttattttttaattttttgtagagactaagtcttgctatgttgcccaggctggtctcaaactcctggcctcaagcaatcctcccaccttgccctcccaaagtgctgggccaccaggccagcctccaataagagctttttgatgaagctaatatgtagtttctaaaggcatcaagccaagaaagagtagttcaatggtgtaatagttcagagatgcaaaacaaagaccgagatttccaaacattctgcacatcccatattcttgtttctaactcagccagttaaaaatatttttttgatatccaataagtggcatttttccaacgtctcatcacttcatacagatcattattcttgcttaccatttaagtaaagacttctatttgtatttaaattgactaacactgctccccattacccctttctcaacacagaggtccaggttgccgaccctgatctttgcaattttctagaaattatctctaaactcacctattcctcattatatttgttccatcacaatagaaattataaaaaagataataccagcccccactctgtaatttggtatcttctctgaagaatttattctactaattcttctcctagttctaaactcctaaaaggaactgtcaagtaactatcaaataggattaacaaactcaactttaatactgctcactaagcttctttctcttacttataaaagtcatattaaaatgtactatgatggacagggcagtttgtatgatattatcatcaatatatcacaacaaaagttccaaacacaacgctttagatgtctttgagaaggttttagatatctttgagagcacactactcaaagatgctcttctatatttaattttttataagttagtatatatgtcttctatataattttatatatatatatatatatatatatatatatatatatatggtgcaaagatagcacagagttcccacacacccttcatctagctttccctaacattagcaactgacaaaaacacagtaacactggtcaaaactggaaactgaacattgatacaacagtattaagtaaatcgcagattttattcaaagattctgtactttttgagtaactggtgacactggacttccagatatgatggggataactgaatatccagatgtcttgggagaatttctattatcattcctaatttaacatggtcccagctgctctatgatgagctttgattctctatgagagcatagagtcatgctaacatagaatcttatgttggatgaaaccttggaaatcatttaaattttttttaagtataaattatgacccattaacaggtcatgaaataaatttaataaaccacaactataattttttaataaaacaaaatagaaaatattagagtataatacagatgttatcgtatcataaattttttgttttagtgatatatgtaaaaatgtatatgtgtgtggatgtaggtatgtatttatatactgggtcacattatttttaaaaattccttagcaaaggtcagagtcaaaaatgttttaaaagtcactcatctatatcaaaccaaagaaagttctctttaatattcctgacaaatgataacccccatctctaactaaacactattaaaggtagaatatttgctacttatacatcagacggtaatacgtattaggacatttttaatgtggaaccaacatttctctgttgacttttgatctacaactcacaaaaagggtgggttttttccttctaaagaaaaatactgtgcaatcctatttctttttttccatcaaattagtgaacagaagttcttacacctagaaatcaaaagttccaaaagaaagtttccttttcagttcccaagaagagactctgaaaataaagggcaataatagaagaacagaaaaatatatatgtaaggactctaaatgggagaatagaagtaatgccaagcaaaaacgtcaagtcgataaaggaacatctttgaggaaatgatataaatattggatcctgcccctggccagccctgcccggccatgcgtccctcctcctccccaccttgtggcgggcagcagccctctagctttggctccgtggactggctctcccaaagcagctgctcagggccgacccacacccccaggcctgccgaggtctccctggggagcctccctggcccggaccaggcatcgggccccgaggagccccctcaggccgtcagcatcaaggaggctaggtcctcaaatctgcctccgccagagagggctatggctgggttgaggaaagggccaaacgcctggcgggccccactgtgtccacacagccttcaccacggagcaggtccgtggcttggagggcatcttccagcaccaccagtacctgggccctctggagtggaagaggctggccagggaaatgcagctgtcggaggtccagataaaaacctggtttcaaaatcgccgcatgaaacacgaacggcaaatgcaggactcccagctgaacagcctcttctcggagtcactgcacgcacccctggctttccactcaccgtcttctggccttgccaatggcctgcacctgctgtgcccttgggcacccctgcctgggccccagactctgatgctgtcccctggctccttctggggtctctgcaagtggaacaagaggccctggcctctgagtgggcctgctgctgtgggcagcctctggcgtaccaccccccaaagcccaggaagtggcatgcatacgctgggaccagccctgtccacggggccctggggcctggtgtgctctgccggagacgggatgcattttgaggaaatgcctctgactccaggcctcccatacaggtctgtgcagattgcacctggcacctacccagagaactcagctgttctgtttacattgtggaggcacctctcaccctgacccacgcaaaggttctggagatttctggagaatatatttattaaagccacctcttcaccaaaagttaccaaaagggttggtttaggaagtaaatgaagggtcagtgtagagtcaaacgcagaagtgggcttgttatagggagggctttcagcatatgataaaagggtaatttgttttttaaaaagtgttggaaaaactggttttccagttggaaaaagtaaaggttgtaggctttgtgtgtaaaaaagaaaaccatgaaggattggaagggggaaaaaaaagaaattatataaataaaattatcaaactcaggcagataatttcatagaagtatgcattacttactagcaaatcttctcattttggaaaatgtttcactttttaatttttttagacacacaaataagaagaaaaacttccacattcaaaagaaagactaaaccatgcacaaatgaaccctttctgtttcctttaacatacaagaaagtgatttcatgaaatttattaaaactgttatttctggccaggcgcggtggctcacgcctgtaatcccagcactttgggaggccaaggcacacagatcacgagatcaggagttccaagaccagcctggccaacatagtgaaaccccatctctactaaaaatacaaaaaaaaaaattagccaggcgtgctggcgggcatgctggcaggcgcctgcaatcccagctactcgggaggctgcggcaggagaatcacttgaacctgggaggtggaagttgcagtgagcagagatcgcgccattgcactccagcctaggtgacagagcaagactctgtcccaaaaaaaaaaaaaaactgttatttctgtccaattccaagcaaccaaagtacttcatgtcattaaatatgtatgtgtaacacacatacacatacatatatacatatagatattcaccaaaccattattcaactatctggccacttcattctactcaaaatgcagatccttagcaaaatttatgacagaaaaaaataaattctgaagtaaaaaaattcaccaactagataaaactcgatgttttccacagttaaggggacatcttagggcgtaattaaagccctgctactcttactttgccccaaattcaaacaataatatcggttttcaagataatagcaattgaaaagcatcaaagaaaggagcaagcaatatgcaaaggtgcactgacaaaaacaagaaataagatgacaatctgactgacaacaatgatttggaaagtaactaaaagcacacttgggtactctagaaacagatgtctaggattatctggtataaggacaaaccatgtacatatctcatgaggcttgtaatacttattgtttataaggttgataatgagtcaacagcaaggattcttcatgctaagaattgtggcattttctatttaaggatataaaaaatatatgccataacttttagaaatatttctatccaaaattactgaactaagtaaagttttaggttccaaaaaaaagtgaaccctcagcaatgtggggaagctagctgtccagaacaattatccttaaggagtgtggttaactgtaattcttcccttcttctttacttctttcaaaagttctatgactattcaaaccatctcataatctttgatgttaatagagggtaatgtgttttgggttgtggggaccagtatttaaatgactggacatagaattacttggggaagttttaaaaaacagtgcggttcaagctctgcaaccagaaattctgatttaattagtccacataaagtctgggcatcagaatttttaaagctgcccaggaaagcctgatgttcagtcagtgttaggaaccacttaggtaaacagttttcttcatgacacctttaggagtcttcaagagagatacagtatgcagcatttccaaaatttgtcttcaaatcccttttaccatggaacatcttataacactgacttaggtaactcttcatctgaaaatcaaggtaaatattaagtttagaatcaagttgtatagcttttcaaactttgtaaaagttctaatgtggttaggaagagggaaggggagggaaaaaataaaaggatgacttacttttatcttgctaccacattttttatattacaaaaattccaaatgaaatattttaattttaacttaaaatttcatagtttattttaatcatgcttatattaagcctgtgactcaaaagcatttacatgttgtgaaagctaatttcaaagataaaaccgtgctgccctctaatggttcaagataaatatttttacctatacatagtagtaaggtgataaatacaattttattattttataaatgggaggattacattatataccagaaaagaaaaataagatttcaatttttggtataactgagcccaaaaacttaactatgactgctatgttcaagctcaagacccttttaactgtccaggcacactggctgacccctgtaatcccaacactttgggaggccaaggcgggaggattgtttgagcccaggagtttgagaccagcctgagcaacatagtgagaccccatctctacaaaaaataaaaaattagccagacatcatggtgtcccaactactagagagactgaggtggaaggatcacttgagaccagaaggtcatggctgcactgagccgtgatcatgccactgtactccagcctagatgacagaacaagattgtctcaaaaaaaaaaaaaaaaaaaaaaaagaactcttttaattatcaaacctttttttttttttttttttttgagacggagtttcgctctgtcgcccaggctggagtgcagtggcacgatctcgactcactgcaagctccgcctcccgggttcacgccattctcctgcctcagcctcctgtgtagctgggactacaggcgcgcgccaccatgcccggctaatttttgtatttttagtagagacggggtttcaccgtgttagccaggatggtctcgatctcctgacctcgtgatctgcccgtctcggcctcccaaagtgatgggattacaggcgtgagccaccgcgcccggcccaaaccatttcttaaaccaccacatttgcctatgcatgtgtaaatcaggataaaaatgtacacctcttctgcattctgcaatagccatctctaacttagcttctttttcaaataaatctatggcagtagtgttcaaacttgaatgcttgtaccctacaaaaacattttagaaagttacacatattcttgcatatttcttcttacagctaaagttttaattcacatttttaaaatttcattaagtacttgcaaaggatgtagtttctaatttactgtaaatatttacattttaaaataaaattatgtcactcttttaagtgtatccaaaaactgaactatcatagcaagctgacatccacctttatctactcaaaaaatacataaattctgttaaatacaacagaaattttacaccagctgtatcttgtttaacttgcattttactgcactctctccatttcatcctaatttcatattttataactaaaagtcttttattcctcattctaccataattctatgcaacaaaaatagatatattaattaaaattataggagtttgtacttccatgtaagttagaaaatattttgtgcaatgagccattattgaaattattagcagataatgaaacaaatattataattttaatacatcttttttttttttttttttttttttttggagacagagtcttgctctgtcgcccaggctggagtgcagtggcgcgatctcggctcactgcaagctccacctcctgggttcacgccattctcctgcctcagcctcccgagtagctgggactacaggtgcctgccaccacacccggctaattttttgtatttttagtagagacagggtttcaccgtgttagccaggatagtctcaatctcctgacctcgtgattcgcccgcctcggcctcccaaagtgctgggattacaggcatgagccactgcgctgggctaatttttttgtatttttagtagagatggggtttcaccgtgttagccaggatggtctcaatctcctgaccttgtgatccgcccgcctcagtctcccgaagtgctgggattacaggcatgagtcaccgtgccaggccacataatttttaaacaaaaagtaaaatattaatggacatgaaactcactgacatttacagagctttttttctttatattgatgtatctaagaaagaatatttcttactgctaaaatgagataagttctcaattctactcttatttcacttatttcaggtataatcactaagaaatgtaattcacattaaaaactaaatcactctgagttttgttataacaaggtcactcaattttttctatgccaaaacacacactgtgatctaccatcagaaattatttttaatgacgtggcaattgatgttaagtcctctcacaatttgctgaaagcaagtaaccagaaactacctgacttacaaaggatgcattacacatttgctacaattattcagattctccatttctgggaaatattccaaaacagtattactatgacttatcaaatgattatgaattatacctgctattgtttcccttagcagtttaattttatatagtccaaaagggtagaaaacatcaaaatattgttaattccaatatccttttgctgaaataacatttgttttataaaatgttttgatcttatcatacacttcaaatatattttacccaaatggtagagctgcaaacagctcatttaatttatggtaaacacccgctgtcaaccaaatgccaaatcaaaatctgcctttatttctcaactcaaatacatttcaggcttaaacaaaaaagattttaaatttgtctcataaaacaaggcccaaatatacactacatacaagagacaccaaaaacagagaaaagctaaaaagttgtactagcttaatgaaaacggaaagcagtgattgttatgctgatatcagacaaagcagagttcaagcaaaaaggtattaatggcgaacactaggtattaatgctaaaacctgcaattcttcagtgatatataacagttatgaatacctatgcaccaaataatgcagcagccacctgaagccaaaaactacaggagatgcaaggagatataaacagaagcacacaaatactaagagattttaacacatcactctcagtacaacacagatcaagtggacaaaaaaacatataaaagaccaaagcaacaaactcttacagaagatgttatgctgtatatgtgtgtacatatgatcctccatttgatctcaaagaaagcataaggaagtgccacaaggtggagatattacagtctcaaatcaaaatataacaaactagaaattaataacaaaattttaaaaagcaaagggcccttctacttgaaaaataaaccttttattaagtaatttgtacatgaaagggaaaatacaaactagaaaatcaatactgaaagaataataaaaatactacatagcagaaactatagtacaaatgtaaaacaatggtcgaaggagaattcataaccttcaacagttatagcaataaacgtattcaaatgaatgaattaaattcaacataaatttttagaaggtatatattattactaatttcatattagattttatttgctcatttttttcttctatatttatattggtattagactgcaacttccttttctgtactgtctttaccaggtttaggtgtcaatgacaactttatttgctaaaaagaattcagaggccgggtacagtggttcatgcctgtaatcccagcactttgggaggccgaggtaggcagatcacctgaggtcaggagttcaaaaccagccaggccaaaatagtgaaaccttgtctctactaaaaatacaaaaattagctgggtgtggtggcgcacacctgtaatcccagctactagggaagctgaggcacaaggatcgcttgaacccaggaggcggaggttgcagtgaaccaagattgcaccactgcactccagcttggcgacagagcaacactccattaaaaaaaaaaaatatttaaaaggcacaatagtcacactcagtaacacggggttttaagaactatcttgggggactgggcacggtggctcacgcctgtaatcccagcactctgagaggctgaggtgggcgaatcacctgaggtcaggagttcaagaccagcctgaccaacatggtgaaaccccatctctactaaaaaaaaattaaaaaattagccgggcgtggtggcccacgcctgtagtcccagctacttgggagggtgaggcatgagaatctcttgaacccaggtaggggaagttacagtgagcgaagatcgtgctattgcattccagcctgggcaacagagcaacactccatctcaattaaaaaaaaaaattatcttgggaagttcaccaccatttatcacaatgtttctatgagaaaatacattccaagtttccagtaatcaacataaaaacaaagtttggaacaaggcctatttgatgatcacccaaaatcttacccagaatttattagacacaatattacatttccaagaaattatgttattgcagaaacttctataaacatgtaacataaaccctcattaatagtcaaagcaaatttgttttaaaaaccatacttatgccgggcatggtggctcatgcctgtaatcccagcactttgggagcccgaggcgggtgaatcacgaggtcaggagttcaagaccagcctggccaacatggtgaaaccccgtcttcactacaaatacaaaaattagctgggcatggtggcacgtgcctgtagtcccagctactctggaggctgaggcagaagaatcgcttgaacctgggaggcggaggttgcagtgagccaagatcaagccactgtactccagcctgggcgacagagagaaactccgtctcaaaaaacaacaacaacaacaacaaaaacaacaaaaaaaaaaaaccaaccatacttaaattgctttctaaatccaacggacactaaaacttcacaaaaccttcactgaaaatcagtatttgaagaaaatgcataaaaagtgattgagcattaaggagaaacagctggtggataacgttttttgattcataaaggaaccctccaaaacaaagcagaaaaaaaagcttcaaaagtttttcggaatttttagagcaatgactggcaacctatataaacctttcagaattctgaatactgaaagcccacgtatttatatgtcacatgacatattaaaaagagcttcatggcctagcttggtggctcatgcctgtaatcccagcactttgggaggctgaggcgggcagatcacctgaggtcgggagttcgagaccagcctgaccaacatggagaaaacctgtctctactaaaaacacaaaattagcctggcatggtggcacatgcctgttgtcccagctactcaggaggctgaggcaggagaattgcttgaacccgggaggcggaggttgcagtgagctgagatcgcgccattgcactccagcctgggcaacaagagcgaaactctgtctcaaaaaaagaagagcttcataatttaaactgtcattgtacccagatttttttttaaacacaagtaaataaacattgctaagcaagattttgctcaactgaacaaaaaaataaagatattggtgaaagagcattgcttcaaacacaaaataaaccaagtatttttcagagcttgagcaacagattaataaaactagcctcaaataaaagaatagagaatgctatttatttctccctttctagacaaaagttgttaaaatttttaaataactttaggactagaaagatagaccccttgttgtaaaaacattacgaattcagtattaatcagatttaagtcatggctatattttcctaaataatcgcaacaaacttgaggggagaaaaacttacggtaattatctttttgttgccactttgtttatattcacttttgtagagaataatgcttaaacttttagcataaagaactcaaaaaggatttcaatagcattaaaaaaaagtgaccaaatgaaaatcagactaaggtcaacccaaaattatagacattttttaatttaagaattggctctgtttacttatgcttttgtttttgtctaaaggggatatgaaaaatgttaaacttgtgtgacatatcctgtaatcccagcactttgggaggctgaggtgggcggatcacaaggtcaggagttcaagaccagcctgaccaacatggtgaaaccctgtctctactaaaaacacaaaaattagctgggcatggtggtgcatgcctgtaatcccagctactcaggaggctgaggcaggagaatcacttgaacccgaaggcgaaggctgcagtgagctgagatcgcatcattgcactccagcctgggtgacagagcgagacaccggctcaggaccaagattaagtggtgatccctgggcctgcctggctgcctctaaaaacagaacaaaggagcatggagtcctgaagttctatcatggtaaatgtattaccaagttattagtacttgaatactaactctgtggcaagaaaacagaccagatattccttgggaatgaacgctgagaaagctgaaagaccagcttgaatggctatcaagctagacaaggcagaagaggtatgtgtataaaatgctgcatataattacacaaaggccacagattttccaaagctcatgtttaaatcctaacttaataactcctgatatgcgcagttttctaagggagaaatgattctctgggtaacattattccagggtcaagtaaattttaacacgggccaaaaatatccatatgcaatagagaatcagccattcctcctataaagcatacacccagaaataataacagaatcacagcctgatttaatttttttaattaagcagatgtaaattcttttaaatctcccacagtaacaatgtccagtacaaatacactgatatttagattcttttaaaggaactcaaaacactacagtaaagtaaggtaaagggtcatgcatggtcactgaattactttattaaaacctgaaaacaacactgtaaggaagcgttatttattctcctaacttacaggtgaattaaccgagaattagaagtcgaataacctgctcaaatccacataactatgattccaactccagagtttgtacttgtaactaaacaagctaaaatgcaataaaggctaacaattataataacaatcagtgcacaaaggcagaagctaagcaactgaaccagcctatcattctgtcctcaaacaccctataaggtaaatattattttaacctctagaaaaacatttacaatgtttttggccaaatgcttgagaagcaaaaatctggcgctttcttataaatatttttagcctcaaagaaaatggaggattacaaaatgttattttttaaatcaatgttattgaggtaaaatttacatttaatgaaatgtgcctattttaggctcagagtttgatgaattttgacatacactcatattaacaatcaccaaaatgaaaatacagaacatttctatcacccccaaaactttccttgtataggaaattcccagccccaaatctagacaatcaaagaacctctttctgtcactacggattagtttcgcctattctagaattccacaaaaatagaatcttacagtacctacactatgtatctgtcctgtcttcttttgctcagcatattgtttctgagattcatgcatatcattggatgaatcacaagttttgctgttgaatagtatgccaagtcatggttacattacagtgtaaccatttacctagtggtagatatttgggttgtttccaatttggggctattataaagaaaaatgctacaaactttcatgtataagtctttgaatggccatatattttcatttatcttaggtaaataccacatggaattgctgggtggtaagataagtactacatgcttaacttcataagaacatcataaactctgacaaggtgcctgtaccattttatatccccagcagcaatatatgagacttccagttgccccaccatgacactaggtgttgtcagtctttttaaactttagctatggttttaatttgcatttccctgatgactaatcactttgagcatcttttcatgtgtttattagccattcttatctctattgtctattcaaaaatattgtccatttttgccttattaatgagttgtaggtattcctttatatattctgaagtcctctttcaaatatatgtattacgaatgtttccttctaatatatgtcttgctttttcattttgtaaaaagtgtctttctagtaccagaagtttaaattttgatgacttataatttctcaattttttcatgatccatgtttaaattttgatgacatgtaatttctcaattgttgcatgatccgtgctttttgtgttctaagaaatctttgtctatttccaaagtagcaaagtattttcttctggaaattttactttaacttttacatatatgtctatgacccatttctgatttatttttgtctgtggtgtgaagtcaaggttcaggggtttttgttgttgttgttgttgttgttgttgttgtttttgagacagagtttcactcctgttgccaggctggagtgcaatggcacaatctcagctcaccacaacctctgcctcccgggttcaagcaattctcctgcctcagcctcctgagtagctggggttacaggcatgcgccaccatgccaggctaattttgtatttttagtagagacaggttttctccatgttggtcaggctggtctcgaactcctgacctcaggtaatccacctgcctcagcctcccaaagtgctgggattacaggcatgagccaccgcgcccagcccaggttcttttttttttctgtcagaaaggccaattattttactattatttgttggaaagagtatcctttccccattagcaccttcactggaattaattttgaaagaattaaattgttcatatatggattgatctatttcttgcctccatattccagagatcagcaaacttctgtaaagggcccaatataaaatattttgggctttgcaggccatatgatctattacatctattcgactctgctgttgtaacacaaaagcagactataaataagcaagtatatacaacacataagcaagtgactgtggctgtgttccaatgacactttactgacacacactagaatttcaatttcatctaaatgtcatgtgttgtaaaatatcattttatttttgatgtttttccaaccacttgcaaatgtaaaaaacattacttagcttgcaagccatacaaaaacaggcaagccagacgtgacccatgggctatagtttgccaactgctgttttattctgttccactgatccatatatctgtccctatgttaattttctgctgtcttgattattgtagctttatagcaaatcttgaagtcaggtagtgtgggccagccaattttgttcttttcaaaattgctttggctactgcaaaaacaatttgcagtagccaaattgtttttttgcatctccaaatgtcagcactactttattaattttaccaaaaaaaaaaaaactctactatgatttttgttacaactgcattgcatcttcacatcaactttgagagaactgaaatcttaaataatagagtcttctttaatttgagcagtattttatagccttcattatacaggttgtgtacctattttattaaatttatctctgaatatgttttcacgctatttaattccccaactgctcattactatttactagaaataccactgatttttgtatactaaccttgcaacttgtggccttactaaattcacttattcagtagcttttcagtacttttgatttattattttctacatacagaatcatggtgtctatgaagatagttttatatctcctattccaatattcccccatttgtttcttcttattgttgcacttgatagaactcaagtataatgtggggttctttgttgtttttttgaggtggggtctcactgcgttgcctaggctggaatgcagtggcgatcacagctcactgaagccttgacttcccaggcccaggcaatcctcccacctcagtctcccaagtagctgggactagaggcacacgccaacagagatggggtttggtcatgtttcccaggctggcctcaaactcctaagctcaagcaatctgcccacctcgacctcccaaagtgctgggattacaggcatgagccaccgtaccagtccttaagtataatgttgaacagaagtgataacagtgtgtattactgccttgttcctgatcttacaagtattcagtctttcactataaagcataatgttatctggaggttgtttgaagaagccctttatcagattaagaaagttctcttccattcctagtttgctgagtctatatcattagtgagcgctgacttctgtcaaatgttttttctgcacctaatgagatactgatatggttgttctcctttattctattaattgggttaattactttgattactgaatactaaattcatcttgctttcctagaataaacttcatttaatcataatgttatttaaattcggctgaatttaatttgctgatattttgttaagaatttttatctggctgggcatggtggctcatgcctgtaatcccagcactttgggaggacgaggtgggcagatcacttgaggtctgcagatcaagaccagcctgggcaacatgttgaaaccctgtctctaccaaaaatgcaaaaaattagccaggtgtggtggcatgcgcctgtagtcccaggtactcgggaaattgaggcatgagaatcgctcgaacctgggaagcaaaagttgcagtgagccaagatcaggccactatactccagcctgggcaacagagcaagactgtctcaaaaaataataataataatttttatatctgtgaccatgggggatactgatcttaagttcactcttcctcatccttgctttggtaacttgttcaaattttcttctctggtttatgagagttttaaaaagacatttctaatgcgtctttgttatgggtttaggttaatttctcccaaataaaaaaaaatcctaatttaacattaatgttaataatttaacattatttttaacaaaatatttaaaaagttaccttgctgcctatctttcagttctacatctattctataaagtgatatctacatgaagtagaatcagtttaagagttctgacacacattccatgtgtaaagcatatgagaaaagagaaaagaatatattccccaaaccaagggatgtagtatacaaaaggcaaagttctatatctattgaaacaaattgggcttttcaccactttatgcttacttcatttatccaagagaatttaatgttgtatacttggatgactttttcctattgggttgaacatatgaaactgacatatttgtaggtcaaagaaacgtcaaatattggcagtttcatacggtttaacctctaatttaatggccttggaatagtaaccaaagtgagctcacccagtctgtatgttgtttgatcagtatacaagcaccatctggtggcagaaaccaaaactgtaggtttgtaactgttcatatcactgctggtacaaatacagtcatccctaggttatctgtggggaattgtttccaggaccttcacccttaccccctacagataccaaaatccatggctgctcaagcccctgatataaaatgctcaagtccctgatataaaatattaatattttaatatttgcatataacctatgcacatcctcccatatacattaagtcatctctagattacttataatatctaatacaatgtaaatgctatgaaaatagtagttacactgcgttgtttaggaaataatgacaagaaaaaaatgtctgtacatgttcaatacagatgcaaccaccctttttttcctgaatattttcaatccacaattggctggatccatgaatgctgagcccatggatacagaacccagggatacgaggggccaactgaatattcaacatcaactgttgtactttccaatatgctttttaagagggtgttacaaatgagtgaaaaatcttatatgcaaagtttgaacaacctcagaataaatagcacaccaacatcacaatacttagcaacaaatcatcagcctatataacataaactgaaatgtaataaacaagctgttttcataaatcagaatcttggctattattaattttactgataattaacataatgcaatcaagtcaatttggatgtttcaaaaaacttctttcgccctatcaaatttccactgatagccatcactatctgtaaaatgatttccgtgtctcacagatttatttcacaggggtacaatgaaaaaccaagaagccttaagtaagtgtctaattctggccatagaaacaagtaacattcaggcaaaatagtccaaattgttttcttcttgtttaacttgctatgactcaacatatattaaaagaaaataacttgaccaacctagctataagagattgggccaagaactggatacattagctaaaggtaaccttgacataaaatatactaaacacatctaatgagaatgtaggccataaacttgttccaaactgagtgttaacaaataaacaaaccctttggggaagaaaggatacaccttcaatgaacaaagagctgataggtcactcaaacttgggttgaatcctaaactgccattttcttaagatatattacacaaacctattctgaaagctctagatgttatactacctcttgccacgtctacttccaacaagtctttaaagtcaaagataatctttgctacccttcattgtggccataaagagtgataaaatgactcctaaatacttcgtaggcaatttaaatgcaacatagtgcaaattaaactcttcatctttccaaaaacctgctccaactactcttgtggtgaacagtattactagccatccaaatatctgaagttatccttaataccccaaatgcaatcaagtctaccttctaaatatctatagacactgtcccctcctctccatctgcactattccaggcctgcatcacattatgcctgaattacaacaacattgtcgtaattctttatcccttcaagttttaggaatattgccaaagcaatattcctaaaacatatatccaattattttatccctcagcttaaaatccttcaatgactcccaatcaccttcagaataaaatccaaacctcgtggcatggacaattcaggacattcaaatcggggccctgcctagacttcactcttctcattccagacttaccgaactgtttctaagtccatgaatgaactaaacttctcaggattcctagcctttgttgccaaaatctgtattacttttccttgccctcctcacctggctaaatcctagttaaccttgaagattcagttcatccctcctggaaggcttctttggtgccccaatctggatggggtgcttagttccttcctaatgtttccatagcaccatcggggcacatctatcattctgttctttcgttttcctcttctactaaacttaagtctattagactgcctgtctttcctcaaagtctctactcaaacacaacatgtggcaatgagtaggcatgcaataaatgtctgctgaatgaagatgacctcacgaaagtccttcatttgctattactatctctgttttgcaaatgaggaaattaatggaggtccagagccttgtgcaagatcacttaactaaaagcatcagaactaggaactgaaccaaatgttctgactgtaatggaaataattttctctaaaaatctttgcttttgaggaaccgctccataaaataattgtaccctgcggagtagtttggatggggctaacctgtttctccaggttggacatataacccaggcttggctaaagtaaagtatgtccctacccccaaccaagtttgaatgattaattccaggatggacagtttactccaagtgtttgtggggacttttctaatgactatcaaaaaaaaaacttcaccttcttcactacaagtctacagactatacagtgtatgaagtatagcaaatgggaattggcttatttgaaaacaaagtagagaaaaaaagaaacaagagctagaaagagagaaatagaaaatgaggaagaacaacactaaagccctacatccaactatgcctgtacatctccccaagagatatcccagttacatagctcaaaaattcccatttgcacataacctagtttgagttttggccccatggaaatctacaccagcagatcaaggggccatttggtctgctggtctgccattttggccatttgctaagcaataatatttttttatctgtgaatatacaaaattgaaaaactgtctaaattcagccattctatttctctaatgtacataatttttataagaaagatgggagaacaaaagcacgaagtgttctccaagctttaccttgtactttgtcaaatgaatttttatatgctttctgcttcataatatatctgttagtgaaaagtgcctcaaatgataaagaaaaatacataaccggatgtaattattgtcaaacatcttgggcataataaaaggagacaggtacttcagaatccaagttgtatctacagagtttgctcatggataaatgtttttttctccactcatcattaaaaaagaagaaaaattcagttcttcttaggcctttgaataagttcaagtggagaaacatcatcagtagagggtggtaaaacagcataggtaatacctaattttgcttaatattactttaagtagaaaataaaaggaccttttcaaaaatccctctaaatgatacctgtttcttggacttcacctttcattccctgccttaagaagctaatgattaatctgggttctgacaaggaaaagacatctccttggatctttggctccagagtccctgtaatccattcaagtgttgccatctataaattaaaataaatatgagaaatcatggttgtaacagcctactgagtaatggttaggtctgcgcttctgtgagcagaaagagcttttcagttgaaacatggcttggtagcttactagtactttccgatattctttttacctttttgtgatctgcagaatatcataaaataaagacactccaaaaaaggaaaagtccatattatctattcatggaatggcctaaggcacatcctttatttatgactttggagaaatcataaataaaattattgtacccctcacaacaaccataagaattagatcttggaactagaaactgccaacaaagaaaaaatgccgacattcttaacagaaaatttagaaaagaaaaaaagaaaatcaaaatcacatgatccctgtctaatttcacatactaactcctctctcccttggttcactctgatcaagccacattggcctcttgaggccaatgccaggcacacttctactgcggggagtacttgctatttcttgagcctggaattctctctctctctctctctctctctctctctctcaacattcacactgctttttctctctcttcctttgaggtctttatcaaaagcaaccttctcagtgactaaccacttcttattgactgactacctcccctacaagaacatgagctccataaggacagggattagtgtctgacttttcattgctttagcaccagactttttaaaagtaataaatttagaagtaataaaagtagtttatttccatttaaaagtaataaattcactagtcagaactgtagcaaaatttcaataaaggaccacagataccaaaataaaacaaatataaagatgtaatactctcataaatctatttactagagtacattagcaataaaattagtatataataggctaggtgttccttactcaggtgactaaagatatctactgtgttgaagtgggcaactagctttatttatttacattggggaacgtcagattaaacataaaggcaatgcgtatattatacagagaaagagaaaataaaacaactacaagagaaatgtgttgtcccttgtgcctcctatgcggtgtggacaccaagctgagggctgggaagcctgccattgtatgcatcacaattagaagcagagatgttacaggagagaatgaaatataccaaggaagccaagaaaagctgagggtttaggcccattagcaaggggaagatagtagatacactctggaagcattacctaagggagaaaaagacggactagatgccaccaactgcaagtttccacacctcgtggacaaggcacacgaccacaaagaaaagaggaactaaaggacaacacaagatgcctctacagaggtgaggtatatagatgcctctcccttcctagcatagagaaagctcccccaggcatacctgagaggaaaagggaagggcagaagtctaatacagtgtgcaaattcttcttagagaacctaaacaataatatttaaaggaactatttacaattgaatagaactaagttttaaatggatacaattaaagataatttttcccctagcaagcaagaaaccaaaaagtatcagattatttatggactaaataaatatcttccctacacatctaagttatggtatcagtaaatacataaaaccataacaaaagcaccagcaaatatctgatcaaatataggaaagaatttctcaggcataaaagaagtgagagaaataaagaaaaatcaatagataagaccacataaaattttaaaactacaggatattaaaaacaaatacacaattaaaagccaaattttttaaagcaggaaaattacaacaaacaaaatagactgaaggttaacatcctcaacacataaacatttgaaaactggtgaagcaatggaataaaaatcagcaaattaaaatagacaaatcaaaaaggataacaaatatctaaaaaaaaaactgttcagcctcactagtaatcaataaaattgaattttaaaaactactacttgatggccacgtgaggtggctcatgtctgcaatcctaacactttgagaggctgagagaggcggataacttgaggtcaggagtttgagatcagccttgctaacatggtaaaaccctgtttctactaaaaatacaaaaattagccggaaatcgcttgaacccaggaggcggagggtgcagtgagctgagaccacaccatggcactccaacctgggtgacagagtgagacttcatctaaaaaacaaacaaacaaacaaaaaaaaacaaaaaaaacactactttttaactaccaaagaagacaaaaacctttttaactcagtgttctcagaatagaataagcattctcatatactgtaagaaattagtacaaactttagtgcaattgggcaatgctttattctttttaaagaatattccccttatagtaatataaggaaggaaataatcagtgatgtgaacaaagatttacatagtgattatttactgcagcaatcttaacaaaaaagagggcataaacaacctagataaaaaaatagacatacatttatataccttatgaagccatatgaagcattatgtagccatcaaaatcattttgtgccaggcacaggggctaacgcctgtaatcccagcactttgggaggccgaggcggacagatcacttaaggtcagaagttcaagacccccagcctggccaacatagtgaaaccccatctctactaaaatacaaaaattagccaggcatggtggcaggtgcctgtaatcccagctactcaggaggctgacacacaagaatcacttgaacccgggaggctgtgggtgcagtgagacaagatcacaccactgtactccagcctgggtgacagagtgagactgcgtctcaaaaaaaaagaaagaaaagaaaaaaaaattcttaaatatatgacaaatggccactatattaagtgaaaagagagtgcttgttttgcatatacaagatacacaaattatgatatatccatacaaagtacactaaccagcaataaaaaagggcaaaacccagatataagcaacatggatgaatccccaaacaagaaaatcattatacaaagtaaaagaagccagatgcacataaatactgtatgagtctagatataaaaagttcaacaacaggcaaaaactagtctatgataataaaatagtgattatttctgggagaaggatgtgtcaaagacaaagaggtctgaggaaactctcagaggtgattgggaacattctgtatctcgatctgagtggtgatcacgtgaggctatacgtatgtaaaaagtcatcaaataaagtataaatacatatatacatacataaaataaagtcatcaagaggtatacttaagatttgtacattttactgtatgtctatcataccttcataaagtactacaaaaactgcatataaaggacaacttcaacttggttaaatatatttaaatgcaaagaaaaaaagaatgtaaagtacatgaaaatataaaaggtggcaaattctgggattacattatttacattttttcttttttccctataaattacaaacattcatgttcactaatgtatttagacaaatcaagaaaaaaactgagctctgcttggtaaatgaatgagaaagtcaacactataaactgtgaaatgactttaagacttggtcttccctgcaacaaatacagggccctcatgacacaataaaaactagttccttcagatcttttacgtttgtggggtaggggaaaaaaaaaaaaaactagttcctgaaaactgggtttctttaagttattaatttaaatattccttgtgaacctgctttatctaaattccatgcacaatgcccaaggtcaattagatttacaatgaaaatactcttttgagtgtgagaaacttttataacatggataaaataataattaagaacaaaaccaaaaaagacatacaaacctctgattgtacatgccccgaaagttgtaattagctctataatttgggaatggctttggatctaatggcctgtagatggcaggctctccccttttcatagcaagcccattcagttccacagttggagttatactgcctgtttaaaaaaaaaacattaaaggcacacaagtgaaatatcttcacaattaaacatgcaagctatatttatacaacgcttaaataccatggaagaaggtaagaatggatggaccacctgtatgattttctaaggaactgcgaaaacaaagtaaaaaaccaagaaaatagttcctaataaaatcttgggattttgcaatgttttctgtacattaatgacaaaaaatctgagtgtgcaatcattactatcaaaacatagtaaacagatgattcttagattgctaaccgtgaatattattttttaaagtactgcatttcatcattacttaccccagaaagcttgcatgtatttaatcattaaaaacatcatctgtgaatatttttatttatactttggtaattaaataactaagcattggcaagaaagtcatcagtggttcttggacttatctaatgaaaaaagttttttgaattttttctataaccaacaaaacagagtaaatataagcaatgtttcctgaaactaaaatgtcatcgaatatattcctagcaaatattaaagatacgtacaagtagcattatcgataaaaacaaaagactgaaaacaacctaaacaaccatcaatgcagcatcagttatataaatgtccatagcataaaacactgaacagctataaaaggaggaagactactacacaccttgcttcttttattttacttaatatacctcggaggttataccttagcagtgtagggtataatgttaaacgaaaaaaagcaaggtaccaaatagtgtgtgctttatattatcttttgtctaagaaaggtgaaaatgaaaatataaatatatatttgcttactttttttaaagaataaacccaaaactaaaaaaaaaaaaaaaaaacttacttaggaatggaagctgtatgtctctgaatgtacactgtttcatagattttattttgaaaacatgaattttttgcataattacagaaatcaaaatttcatccaaaaggggtgggggagcaatctctaaaatcgaaagaaaactggaactaaatctatctacagtgacttaaccacaaagagaattatttcaaaagacttaaaaaactgtaaaatagccatgagatcctaaagagaaaaaaaaatcttaaattgttttcagtaatcacattgttagtaacaagtaatatgcttttacttaagtcaaacaaaattaaataaaaatggagacaaagtaatctctataaagaaaacaaagcaattaaaacctaattgattggtggccctaatcatacgaagaacagttatttcaaataactttaaaatatagtcaaataaccacatattctaaagatttttttaaaccctgcaaataaatcataaactatttttagtaatcatgctgttagtaatattggcgtccctgtctcactgcaattgctattataaaattattttatatatatataaaatatacataaaatagactaaagaattaatgtcagaaacaaaggtttttagcataaagagacacaaatataaaatcaaacacactacctaaaaccctgtagttttaaatcctaactgaaatcctaactgaaaatatagtcttaaatcctaactgaaaatatcacaatgaattcatgatgtattttctcttaaggaaaaaaaaaagtactaggtatttcctagcttaagtatccacttaagaggcctaaaagccataacccaacaactgcaaaatgcacattgtattcatcaacacatggaacatattccaagacagaccacataagccacaaaacaagtcacagtacatttaagaaaatcaaaattatatcaactactctctcagaccacagtggcataaaattggacatcaactgcaaaaggaacactcaaaaagcatgcaaatacatggaaattaaataacctgctcctgaatgattgttgggtcaacgatgaaatcaaaatggaaatttaagaatttgaactgaatgataatagtgacacaacttatcaaaacctctgggatacagaaaaagtggtgctaagagcaaagtttacagcactgaatgcctgcatgaaaaagtctgaaagagcacaaataagacatacatgtatacacacacacacacacacacacacacacacacaggctcaaaatgtctcctcagaaaatacttattacttactattcaacaacaaaacatacggattaattaactttacagcaaagaagcctggcatactcctcaccgcatgacaaaagtcgtcactgatgggacaagtcaatctcaggcgtctcctcatagaaagcactaaggtaagtccaagtcatttttctggtattcatgctaaaatgcataaatcatgaggaaacaccagacaaactcaattgaggggcattctaaaaactctgtggtcccatactcttcataaatattatggtcataaaaggtaagaaagactgaggaactgtttgttacagattgaagtggaatgaagagaaatgttaagtacatgtaacacatggtcttgattagctcctggagctgtaaaggtttgggatgattagtgaaatctgaaatggagtctgtggattaaatggtaatatggatcaaagttaacttcccgatagaacggtgtccgtgtccttaagaaatatacattgaaatattaaggggtaatgggacatcatgtctacaacttattcccagatggttcagaaatgctatcaatggggaataaaggtgaaggatacatgggaagtctatgtactatttccacaaattgtatataaatctgaaattacttccatagtttaaaaaaaaataaaagggagaaagcaaaacagttctataatatattcccaattactaacagatcaaccatgctgcaaatgaacttaactcctcattaggatataacttctttttaagacccatctacacactgtggagtcaagactggatctttcctccacagacctattacttctcaatactgagttacagtcaccaggtttataacaaaggtgccactacactgcagaggggaatggactatcttttcaataaatggtgctggattaaatgaatgtccatatattttttaaatgaagaaaaatattgaactctacctcacatcatacattaaactcgattcctgacagactgtagatctaaactgtaaagatctaataatactgcttctaaaactaacatgaggttatcttcacaaacttgtaagagacacaggtgtattaaatggcacaccaaaaaagcgctaactataaaggaaaagactaataaattagcttccactaaacaagaattttgtttttgttttgttttgttttttgtttttgagacggagtctcgctctcacccaggctagagtgcagtggtgcaatctcagctcattgcaacctccgcctcccaggttcaagcgattctcctgcttcagcctcctgagtagctgggattacaggtgcacaccatcacgcccagctaatttttgtatttttagtaaagttggggtttcaccatgttggccaggctggtctcaaactcctgacctcaagtgatccacccaccttggcctcccaaagtgctgggattacaggtgtgagctaccgtacctggtctcattgaaaagaatttctattcatcaaaatgtacccttaggagtatagaaagatatttgcaatatacatatctgataaattatatgaatccagaatatgtaagaaccctgtaagccagtaaaaagtagaaaaaattttaaaacagacaatgcagatttttaagtgggaaaaacattccaaccagcactttacaacagagcctagcctaatgccaacaggcatatggaaagatgctcacctgcatttgttattagagaaatgcaaattaaaaacacaatgaattactattatacctctcagcataatagctaaaattttgaaagctggagatatcaaatgttgatgaggatgtggacagctctcataccgctggtgggaaggtaaactgacattctttgacattatgtattaataccaaatacattcataactatgacccaacagttccaatcctagatatattcccaagagaaatgtatgcattttaagaatactgttcacagcagtattatttctaatagctcaaaactggaaacaattcaaatacgtataatagtacaatgaataatatgtaaattatgtatacttatgcaatagaatactacatagcaatgaaatactataccattaaatgcaacatagatgactctcacacacaatattgagaaaaatgagctatcacaagagtctactgtctgattccaacaagaaggcacaactaatctggtagaaatcagaatattggtttcctttagagttgtttaaccaactgaagtgggcatgagggaagcttccatagcactagtaaaacatgtggtgaagtgttcacagcataaaaattcatcaagctctataactgtaatgtgcccttgtctgtatacagtattagactttattttaaaagtttacaccaaataatcgattcattctctcagcttactataacactcaaccatggaaattcttatctccactggggcctttcagacactctcctgtttccttcctctgactcttgctggtttacttcctgctataatcctctaaatatggacttgacccagagctcagcacacaattaactgctcttgctttacattatatgcctttgctttacattatatgccttagacagcttgttctgttccattccaaatgccactctcaacactcctgcagagcgggaggcatacagtactcaatgcacgtgagtctctttctttcttcacccataaactatgacaatggttttttagtgtctcccaccttccctttacatgtcaaactgagcttcctaaaatactcctttaaatgcatcatgcactgctcatgaatattaattcctcccagctacgtataaaacttaatctcgtaaagctggcattcaagtcgtcccaattcactcactaactacatctccagtcttacctcctactagtcatttacctgctctaattaaaaaccatctataaaattttttttttaccaaatccattgtccagattcctacttcaaagcctttcctcatagtattccctctggctaaaatattctttcctctcatctataactgcctacttttcggtcaaggcctgtatcttacttcaactacttcagtccatgtttatcattacctgtaatactgatggctgttattgtctacttggcacttaatctttaccatcaaattacgtgttcatatataagactgtaagacactcactgaaagggacaatgttttatttctcttagatatgtaaaaagcaagtgttaaatatatcatggtggtggtatgctactaatgatcaaccagtattctgaagaggcttttaaaaattaaagaaatggacaatcttttaggaacttcaaaatgaagagaataagttttttttctattgtaataatattttggcttatttaagcttaataaatactgcaatcagttgaacagaagcagagacttgcaatcagaaagccatggattctgcagagtagtccttgaaagagcagagaatgtcaacctagcacagaccacatgagaatgaaacaagtgtctatgtgatttgattatgaatataaccaagtagagaatgattaaatacattttagagttattgttgacaggcacaaaatctttcttaacctccataacaaaaatatctaaggcgaaattaatattgactagaaggtaaccacttgaattaatcagttaacaaatgaatgagtaaatggatatatggctggtactaaagttatagtaattccattaacctaatgttatcaattaatacactatgtccaaaatacaggtttgcctttcccaatagataacgggacatatagattcactgaggtcacccggagaaaatgatggatatcaggcaggactaacttgaggctcccactcaggacaaaacagcatgtggagactcacagtgtaaactctgctccaagaaccaccacaagaacataccaggaaaactgaaagaattcacagaccctttgaaagaagcagcttgccgctgcaaactccatgagacagccaaaacaccgtgagtgcccaaagtgtgagagggggaaagtctgcctccaaacacacatcctcactggggaacctgaaaatccagatcacagaagaatttaaccttacctaggactgaaacaaatttagagagctgagcgaaatataaaagtagaagaagcaggccaggaatggtgggtcatgcctgtaatcccaacactttgggaggccaaggtgagtggatcgcttgagcccagtttgagacaagcctggctaatatggtgaaaccctgtttctactaaaaatacaaaaaaaaaaaaaattagctgggcaaggtggtgcacacctgtaatcccagctacttgggaggctgaggcaggagaattgcttgagcccaggaggcggaggctgcagtaagccaagatcaacgccactgcactccaacctgggtgacagactgagactccacctaaaaaaaaaaacaaaacaaaaacaaaaacaaaaactagaagcagcagcgataagagacccctgtagacactcccagtccctagggaagccattttttttttttttttttttttttttactttcatctcacagtggtccttggggaaggcagtcagtggaactagggaagtaccacagtgagaaagacttctagctgaacgctgtcataattttgactgaatgcaaattttcctgggcagaatctgggtggggggtgggggaggaggtgggaatagggggccggcgggaatagggggccaatggaaagtacagatatgagaacagaagccactgcaggcatggaagggcaaggcctgaaagccctgcttgctttcttagcaggaagacttctagcctagggcaaatgctttttctgcagacactccccaataccagcctggagtccagtagctccactgggtagctagacccagaagaaaaataaccatcgctgcagttcagctctcaggaagccccattcatagggaaacggggagagaaccacatcaagggatcatcccgtgggataaaagaatctgaacagcagattcaagatcttgcctctgacacagtatatccaaatgagaagaaaccagaaaaacaattctggtaatatgacaaaacaaggttctataacaccctcaaaagatcacactagttcaccagcgatggatccaaaccaggaagaaatatctgaattaccagaaaaagaattcagtaggtcggttattaagcagctcaaggaggcactagagaaaggtgaaaggcaacttaaagaaatttttaaaataatacaagacatggatgaaaaaatttccagagaaatagaatcataaataaaaaagagtcacaacttctgaaaatgaaagacacacttagaggcatgcaaaatatactgcaaagtttcaacaatagaatcaaacaagcagaagaaagaacttcagagctcaaagacaaggcctaatcaaattaacccaatctgacacagacaaaggaaaaagaattttaaaaaatgaacaaagcctccaagaagtttgggattatgttaaatgaccaaacctaagaataagtggtgttcctgaggaagaagaaaaatctaaaagtttggaaaacttagagggaataatcaaggaaaacttcctggccttgctggagatctagacatccaaatacaagaaggtcaaggaacacccagggaattcattgcaaaaagatcatcacctaggcacacagtcaatcaggttatctaaagtcaagtcaaaggaaataatcttaagatctgtgaggcaaaagcaccaggtaacctataaagaaaaacctatccgataaatagcagatttctcagcataaaatctacaagccagatggaattgaggtcctatctttagcctccttaaataaaataattatcagtcaagaattttatgtccagtgaaactaagcttcattaatgacggaaagataaaagtctttttcaggcaaacaaatgctgagagaatttgccactatcaagtcagcactaaagaagtaataaaatgaattattaaatcttgaaacaaagcctcagaatacaccaaaacagaacctccttaaagcataaatctcacagggcctataaaacaataacacaatgagaaaaaacagacaaaaggtattggggcaacaactagcacaatggatagaatagtacctcacatcttaatactaatgttgaatgtaaatggcctaaatgctccacttaaaagatacagaatggcagaatggataagaattcaccaaccaagtatctgctgttttcaagggactcacctaacacataaggactcacataaactgaaggtaaaggggtagaaagagatatttcatgcaaacagacaccaaaagccagcaggagtagctattcttacatcagataaaacagactttaaagcaacaacagttaaaaatgacaaagagggacattacataatgataaacggactagtccaacaggaaaatatcacaatcctaaatataaatgcacctaacactggagttcccaatttataaaacaattactactagaccttaataaatgagacagagggcaaaataataatagtgagggacttcaatattccactgacagcactagacaggtcgttaagacagaaagtcaacaaaaaaacaatggacttaaactataccctacaacaaatggatttaacagatatatacagaacattctacccaacaactgcaaaatgcacattgtattcatcaacacatggaacatattccaagacagaccacataagccacaaaacaagtcacagtatatttaagaaaatcaaaattatatcaactactctctcagaccacagtggcataaaattggacatcaactgcaaaaggaacactcaaaaagcatgcaaatacatggaaattaaataacctgctcctgaatgattgttgggtcaacaatgaaatcaaaatggaaatttaagaatttgaactgaatgataatagtgacacaacttatcaaaacctctgggatacagaaaaagtggtgctaagagcaaagtttacagcactgaatgcctgcatgaaaaagtctgaaagagcacaaataagacaatctagggtcacacctcaagaactagagaaacaagaacaaaccaaacccagcagaagaaaagaaataacaaagatgagagcagaactaaatgaaattgaaacaaaagaaatacaaaagataaataaaacaaaaagttggttctttgaaaagataaacaaaattgatagaacattagcaagattaaccaaaaaaagaagacagaagatccaaataagctcaattagaaacaaacaggagatataacaactgataccagagaaatacaaaatatcattcaaggctactatgaacacctttacacacacaaactagaaaacctagaggagctggataaattcctggaaatatacaacccttctaggttaaaccaggaagaaacagaaactctgaactgaccacagcaagactgaaatggtaattttaaaactgacaacaacaataaaaaaagcccaggaccagacggattcacagctgaattctaacagactttcaaaaaaagaactggtattaatcctattggcactattccaaaagacagagaaagagggaatcctccctaaatcattcaatgaagccattatcaccctaataccaaaaacagggaagtacataacaaaaaaagaaagccacagaccaatatccctgatgaacatagatgcaaaaaatcctcaacaaaatataagctaactgaatccaacagcgtatcgaaaaggtaattcaccatgaacaagtgggtttcataccagggatgcagggatagtttaacgtccacaagtcaataaatgtgatacaccacagaaacagaattaaaaacaaaaatcacatgacatctcaacaaagaaaaagcattttacaaaatccagcatccctatatgattaaaaccctcagcaaaatcggcatagaagggacataccttaaggtaataaaagcatctataacaaacccatagccaacgttatactgaacagggaacaagttgaaagcattccccctgagaactggaacaagacaaagatgcccactttcaccacttctattcaacacagtactggaagtcctagccggagcaatcgacaagagaaagaaataaagggcatccaaatcgataaagaggaagtcaaactgttgctgtttgctgatgatatgatcgtatacctagaaaaccctaaagactcaaccaaaaagctcctagatctgataaatgaattcagtaaagtttcaagatacaaaataaacgtacacaagtcagtagctctgctatacaccaacagcgaccaagctgagaatcaaatcaagaactcaaaccctttcacaatagctgcaaaaaaatgaaatacttaggaatgtacctaatgaagaaggtggaaagaactctacgacaaaaactacaaaacactgctgaaagaaatcatagaggatacaaacaaatggaagcacatcccaaactcttggatgggcagaatcaatattgtggaaatagcatactgccaaaagctatctacaaattctatgcaattcgcatcaaaataccatcatcatttttcacactactagaaaaaacaatgctaaaattcatatggaaccaaaaaagagcccacataactaaagcaagactaagcataatgagcaaatctggaggcatcacattacctgacttcatactacattataaggctatagtctccaaaacagcacgatactgctataaaaataggcacatagaccaatggcacagaatagagaacccagaaataaagcccaatacttagagcaaactgattttcatcacagcacacaaaaaatataaagtggggaaaggacatcctattcaacaaatggtgctgggataattggcaagtcacatggagaagaatgaaactggatcctcatctctcacttgatataaaaattaactcaagatggatcaaagacttaaatcaaggcctgaaaccataaaaattctagaagataacattggaaaaactcttctagacattggcttaggcaaaggcttcatgaccaagaacccaaaagcaaatgcaacaaaaacaaagataaacagatgggacttaattaaactaaaaagcttctgcacagttaaataaataatcagcaaagtaaacacacaacccatagagtaggagaaaatcttcacaaactatgtatctgacaaaggactaatatccagaatctacaaggaactcaaatcagcaagaaaaaaataatgccatcaaaaagtcagctaaggacacgaatagataattctcaaaagaaaatatacaaatggccaacaaacatgaaaaaatgttcaacatcatgaattatcagagtaatgcaaatcaaaaccacaatgcaataccaactgatatggtttggctgtgtccccacccaaatctcatcttgaattgtaatccccataatctccatgtgtcaagggagagacaaagtggaggtaatttgaatcatgggggcggtttcccccttgctgttcccatgatagtgactgagttctcacaagatctgatagttttgtaagggtttggcaagttcctccttcagtctttttctctcttgccaccttatgaagaagatgcctgcctcccattcacctttaaccatgactgtaagtttcctgaggcctctcaagccatatagaactgtgagtcaattaaacttcctcctttccttcataaattacccagaatcaggaagttctttatagcagtgtgagaacagactaacacaccaccttactcctgcaagaatggccataatttaaaaataaaaaaataaaggatgttggcgtggatgtggtgaaaagaaacactttttttttcttttttttttttttgagatggagcctcgctctgtcaccaggctggagtgcagtggtgcgatctcagctcactgcaacctccgcctcccgggttcacaccattctcctgcctcagcctcccaagtagctgggactacaggggcccgccactgcccggctaattatttttgtatttttagtagagacagggtttcaccgtgttagccaggatggtctcgatctcctaacctcgtgatctgcccacctcagtctcccaaagtgctgggattacaggcatgagccactgcgcccagccaaaaagaaacacttttacaccactggtgggaatgtcaactagtaaaaccactatggaaaacagtatggagattccttaaagaactaaaagtagaactaccatttgatccagcaatcccactactgggtatctacccagaggaaaataagtcattatatgaaagagacacttgtatacacatgtttatagcagcacaattcacaattgcgaaaacataaaaccagcccaaatgcccaccaatcaacgaacggataaagaaaatgtggtgtacatatataccatagaatactactcagccataaaaaggaatgaaataatggcatttacagctaactggatggagttggagaccattattctaagtaaagtcacacaggaatggaaaaccaaatgtagtatgttctcataaatgggaggtaagctacaaggacacaaaggcattgagaatgatacaatgggccgggcccggtggctcacgcctgtaatcccaacactttgggaggccaaagcagatggatcacgaagtcaggagatggagaccatcctggctaacatggtgaaaccctgtctctactaaaaatacaaaaaaattaggccaggcacagtggctcacacctgtaatcccagcactttgggaggccggggtgggcagatcatgaggtcaggagatcgagaccatcctggctaacacagtgaaaccccgtctctactaaaaatacaaaaaattagtcaggcgtggtggcacatgcctgtagtcccagctacttgggaggctgagggagaagaattgcttgaacccgggaggcagaggttacagtgagccgagattgcaccactgcactccagcctggtgacagagcgagactccccctcaaaaaaaaaaaaaaacaatggattttggggatctgggagaaggttgggaggggaatgaggggtaaagactacacattgggtacagcatacactgcatgggtgatgggtgcaacaaaatctcagaaatcatcacggaagaatttatcaatgtaaccgaataccacctgttccccaaaaactattgaaataaaaaaaaaaagataatgacatataatgttgttcgtattgtatgcaattagaacaactctttaaaattattcttaggagcttaaaattagaacagtaatttacttagcagtattttacatgcaggtggtttgcggaatttgtgatggggtttctttcttttttttttttcttttgagacagagtcttgctctgtcgcccaggctggagtgtagtggcgtgatctcggctcactgaaacctccgcctgccaggttcaagcaattctcctgcctcaacctcctaagtagtggggactacaggcacgcgccaccatgcccagccaatttttgtatttttagtagagacggggtttcaccatgctggccaggctatatataaatatatagttttatatattatataaatttatataaattatatttatataattatgtataattatataatatatacaatatattataaattttttaatttaaatataaacttaaatataaattaatttaaatataaattaatttatatttctattaatttacatttataaaaatttatatttatatttataaatataatttatatttatatttataaatataatttatatttataatttatataatataaatataatttataatttatatttataaaaataatatatttatatttaaattaatttaaatataaatatatatttataatatataaatatataatatataaaataaaatatatataattatataatatataaaatatagttttttatatatataactatatatttaaactatatatttaaaaagagaaattaatcattttttgtaattttttttttgcaggggtagaaacaaggtcttgctatattgcccaggctgctctcaaattcttgggttcaagcaatcctcttacccaggcctcccaaagtgctaggattacaggtgggagccactgcaccaagccactatcatttttgtttgtttgttttttgagacagagtctcgctctgtcgcccaggctggagtgcagtggcacgatcttggctcactgcaacctctgcctcccgggttcacgccattctcctgcctcggcctcctgagtagctgggactacaggcacccgccaccatgtccagctaatttttttgtatttttttagtagagacagggtttcactgtgttagccaggatggtctcaatctcctgacctcgtgatccacctgcctcggcctcccaaagtgctgggatgacaggcgtgagccaccgcgcccggcctactatctttactttaaaaaaaaaaaactcagtcaaattttctgtgctttgtattcaaatatgtttttgccaacattaaaaaagtaaacaatgcacttttatagtatccactaaagcaaattttaaaaacaattacaattactttcttcatcctctcaccttcattttttttttttttttgagatggagtttcgctcttgttgcccaggctggagtgcaatggcgcgatcttggctcactgcaacctccatctcccagattcaagcaattctcccgcctcagcctcctgggtagctgggattataggcacctggctaattttttatatttttagtagagacagggtttcaccatgttggccaggatggtctcgaactaattacctaacatgatccacccgcctcggcctcccaaagtgctgggattacaggcgtgagccaacgcaccaagcctccttcagttatttttatgctaccgtgtgtgtgtgtgtgtgtgtgtgtgtgtgtgtgtgtgtgtgtaggtatgggcatatgtgtactattaatacttgctcactctgttactagcctactataaatgaaacatacaacaagcagaacacacatagcagacaacataacagaaggagtcactgccatacctgggttattgttaacattacttttgggtggcttctgaactggtttgggaagcgtagattcagtcaaagctttattggcaacagcctgctgagccttctttatactgctgccttcggattcccatgtctgctcaccaagactcagctgcactgagaacatcttagaaaaacataaatagacaaagaaaacattaagacttttccaagaaataaaattggctgtctgagagaaaaataaacatcatagaatcagaattttagagctagaggtgaccttacctacagatcatctgcaacaaaatcttactctacctagtgaagaaattttaagagagtaccaaattctgttctatcctatccaaaagcttagtagcagatctaggtgtacattctgggtagaataaatcaagaagcaatctttcctctaaatggaatcacaatgttaatgtcattcaaatggtcctcacaaaagcagaataagtagaaataataagagaaactgtaagagaagccaaaagaccatgtgtctataatactttcataaaatctaattccttgaatgttacatttagcacaatctaggcaatgagtcaggcaattctattaaatattatactaccaaaaaactctgaatctccacaacaaacattgagccaatcactaaattctgtccattttaacatcataaatatttctcaaatcttcttcctctctctgccaactggatccagcctttcatcatctttagcttggacataatattcttccagctgatcactgctaaaactatctttctaaaacacaaatccaacttcatcaccccaatcaacatcaggttaaaacccttcaactgttcctgttttagcatggcacaaaggctctacctgtgcatcctcatctcacacacatccttccactaacatgctctgaattccattctcactgtatttccatatgagcccccaaacctattcttcacctttaaaattcagaatcaagttacatgatatgcgcataattggtttcactccagactgcatattactttctaggaatactaagtattaacttaaaattacttattacaaaaaaatatatattattgtagaaaggagatcagatagaaaataccttcactaagttagcatcaccaataatcatacaaattgacgtcatgtgccccctgatacaatccagtgagaagtatatatcaacaaccatgtacaattcttggccaaaaatgtttaatctgaatctaatcacagggaaacaaccagagagatctagattatgggacattctataaaacaaatggcctaggctccaaaaatgtcaatgtcataaaaggaaaaaaaaaacaaagaatgcagggaggacactaaagagacatgaaggccgtgcacagtggctcacgcctgtaatcccagcactttgggaggctgagatgggcggatcacaaggtcaggagattgagaccatcctggctaacacagtgaatccccatccctactaaaaatacaaaaaatttagccagacgtggtggcgggtgcctgtagtcccagctactcgggaggctgaggcaggagaatggcatgaacccaggaagcggagcttgcagtgagccgagattgcgccactgcactccagcctgggtgacagagcgagactctgtctcaaaaaaaaaaaaaaaaaaggaaaagaaaagagacatgaaaagacatgataaataccatgcatgatccttcattatatctaaaatgggaaggggaaaaaagctgtaaaggacattcagaggacaactggggaaatgtgactatgaactatacattaagtaataggtttagccaggattaaatttcttgtgtgattaacagtattgtgattatgaagaacgtctttagtcttacaagatagatatgtaagtatttaagagtgaagtgtcatggtagctgaaatttactttcaaattgttcaaggaaaaattatatgtcaatatagagggagcaagaaataaagtaatgtggcaaataaattaacgatcggtgaatctaaaccatacatgagtgtctattacaccactctttccattttttctgtagatttttaattaatcaaaatagagaattgggatttgtcatttgaaattcacaacataaacatacctgtttaaagtgattaaattttcttttattctaattcagtttaaaatatatacctaaaatgtatctttaatactctctctggtttcagaatgatttttcaatgactagctctttttcttcaaattttggtatttaacaaagaactttgccacaaagtaagaaagttcaaaggtttcacatgatatatataatatacataatcttgcatatagctcatatgcttgaaaacagaaatacccacataaatgaccttgagattcctgattgcatcaggaaagcatattaaatttactctgcatgtctccagacctgacctctcctaaacaacaatcacataaatctaactgtctacttggtatttccacaaactcaagaggtaaaaggtcaaacaaaacactgcctcctccactctaccccctccaaatcagttcataccccaaaatgtttaatccattatctcccaatagttcaggttcaaacctcattagtttcgtttatccttgccttcctaaggcttatttaacatctcataactcttcgttgtaatttatattgtcacctccttggtctaaggtttctataaactcagactcagtatacttcatttagctcctatctctaatctttcctgcctcctaatcatccagatgtcaccattttcccaatctcatgagccagacacctttgagaggtcttcccttctctcctgcttgcaattaacaactactgactcaacttaaatgtttttcagacctggcctcctctctttatactaagatatatacatgcaccaatgtctttatactaagatatatacatgcaccaatgatatgtggacaatatcagtatctctcccctaaactaccacaacaccacctgtggtatataagaaatatgtatttggtctccggccctggttcctaacacagagctcccaaaaccttgtaatttccggaaggacaggagaactaggagcatttttgttctaatatttggtctttgatcccaatttctaacacagagctcttaaattccttggaatttcctgggtgataggaaatttttattctaatgagccaactcttggcaggcccctggatagagagctagtctgagggccagtcaccagaaaaactaagccatggttagaaacttcatttttagccccatcccattcctatccaccacggaggaaagaggggctggagactgagttaataatcgatcatgcctatgtgacagagcctccataaatatccctaaaagatagggtacaaaaagcttgcaggctggtgaacacactgaggtgctgcagggtggcacacccagacagggcttggaagctccatttcccttctcacacacttcatcctacgtacttcttttttttttttttccccggagatggagtcttgctctgtcgccaaggttggagtgcatggcacaatctcgtctcattgcaacctccgcctcccaagttcaagtgattctcctacctcagccccccaagtagctggcatcacaggcacaagccaccatgccgggctaatttttgtatttttagtagagacggggtttcactatgttggccaggctggtctcgaactcttgacctcgtgatccacccacctcagcctcccaaagtgctgggattacaggcgtgagccaccacgccggccctcctatgtactctttatctggctgttcacctatatactttagaatatcctttataataaactagtaaatataagtatgtgttcccctgagtcttgtgagctgttttaacaaattatggaacctgagaagagggtgctgagagcccccggtttatagccagttggtcacaagtttagaagacccagatttgtgactgtcatgtgaggtgagagcagtgttgtgggactgagcccttaacctgcagggtctgcactaaccgtgggcagttagtgtcagaatttagttaaatagtaggacatccagtcaatgtatggggacaattgcagaattcgctggcgtggaaaaaaaccccacatatttagtgtcagaaatgaagtgttacagccaggtgtggtggcttatgcctggaatcccagcactttgggaggccaaggtgggaggatcacttgagctcagaagttcgagaccagcctgggcaacacagggagacctcagcactaccacaaatgtaaaaaattatccaggcatggtggtgcgcacctatagtcccagctactgaggaagctgaagcagggggatcccttgagcccaggagatgaacgctgcagtgagctatgactgcacaactgcactccagcctaggcaacacagcaagaccctatctcggaaacaaattttttaatttaaaaaaaagtgggctgggtgcggtggctcacgcctgtaatcccagcactttgggaggccgaggcgggcggatcacgaggtcaggagatcgagaccatcttggctaacacggtgaaaccccatctctactaaaaatacaaaaaaaattagccgggcgtggtagcaggtgcctgtagtcccagctactcgggaggctgaggcaggagaatggcgtgaacccgggaggtggagcttgcagtgagccaagacagcgccactgcagtccagcctgggcgaaagagtgagactccgtctcaaaaaaaaaaaaaaaaaagtgttggaagtatagaaaaaaatttctttttactatcttaaagcagttcccttaatatgaccttcccattcaaactaccattcttaccaccatcgacatgaacattctgtaaaaccatcaacatgaacattctgtaaaatataagtatttccaaggcaatcctatgcttttctacaatctctcttaagattcctactacagtaaaaagtgtagtagttttaagacggaatgctggagacacactgtttatgaatttaagccttggcttcgccatttactatgtacaacactgggaagttaattattctttctaactctcagcttcttacctctttagtgaaatgaggctaataagaacacatggttagttgtgaaaattagaacaaaatggtgtaaacacccccacttgaaagtcagagattgtcaaactagataaaaatgcaaaatcaaactacatgctacctacaaaaactgtacttcaaatataaaagcacatatagttttaaagtaatgagaaaaacatatactgacataaatcaaggagaaattagaatggctatattaatatcagactaagtggattccagagtaaagactattaccagtggtaacgaaggtcatttcatatgaataaagaaagcaattaagaagacattgatatcctaaacatttaggcacctaataacacagcttaaataaatgaagcaaaaactgacaaaacttaaactataaaattgacaattaaagtcagattcaatactccttatcaaaaactgatataacaagcaaaaaaaatcaccaagaatatagtacagttgaacaacactatcagccaacacaatcttatcaacactgttagaatactccaaccaagaaaagcagaatatacacttgctctcaattgttcacaggacatttaccaagacagaccatattctgggccataaaataagtctcaataaatacaaagaattcagaccacacacaaagtatgttcattgggtaaagttacagaagagggtagagtaaaattacagaggagggtagagcaagatggtggaacaaaagcctatatatcattcatcacccccagtggaacaccaaattttaacaactatggacacaaaaaagcaccgttacaagaaacaaaaatcaggtgaacaatcacagtgtctggctttaacttcatattgccaaaagaggcattgaggagggtaggagagtcttgaatcaccaacatcaaccctctcccacactcccagcagcagccatgtggcgtggagagaaaatctgtacactttgagggaggagagcacggctattggaaaacagtacattaaactcagtgctgccctgtcacagcagacaatgaaaatgtgctggactcagccagcacctgcacagggagggaggatttggaccagcactagctggaggggaattgcccatcatagcagttggaacttgaatttcttggcaagacttgccaccacaggctgaagtgctccggggtcctagataaatctgaaaggcagtctaggacacgagactgtgcttcctaggcaactcctagtgtgaggctgggcttagagccagtgaactaggatggcacgcaacctagggagacaccagctggaatggctaagggagtgcttatgccatccctcccctaaccccaggaagtgcaacttgtagcaacgaaagtatctacttccttctgcttaaggagaggagagtgaagaaaaaagagaactttgtcttgcattttggatatcagctaagccaccataggataaggcaccaggcagagccgtgaggcccccattccaggccctagctccaagataacatttgtagacacaccctgggccagaaaggaacccactgccttgaaggtaaggactcaatcctggcaggattcattacctgctgaccaaagaaccaatgggtcctgaataatcaccactgatacccaaggagtatgcagtgggccctgggctctgacatgtactggcttcaggggtgacccagcacattcccagctgtggtggctattgtgaaagactcctgtttaagaaaagcagacagaaaagtaaagggaacattgtcttgtgccctaggtaccagctcagccacagcaggaagagcaaaaagcaggctcttggggtccctgagtccacacctacgctggacagcatttccggatctacttcagggagcccactgccctgaagaatgagcccatggaccagtggtggtgttggtggccacacaaggagaggttcctctgcctgtggaaaggggagggaagagtgggagggattttgtattatggattgagtgccagcttagccacaatagaagaaaacatcaggtaaattgctaaggtttttgactccaatccctggctctcagacagcacctctggacacacctggaacccagggaaaaacccgccaccctgaagggaagggccttgggcaaggccagtgctgtgctggcttcaggtctgacccagagcaatcccagggatgatgaccacagaggtgcctgcatcaccacacccccaattccaagtggcttagcactccatttgtttgggagaaagtaaagaaaaagaacaacaatctctgcctggtaatcctgagaattcttccggatcttatccaaggctgccaaggctgtacctctaacaagtctccaaaagccacagcattgttgggcttggggcccaagtcccttcaaattcctgggaaagccttcccaaggacaggcataaacaaactcagactctgaagactacaataaatacctaactgtttaaagcccagacaccaacaagtatctacaaccatcgacaccattcaggaaaacatgacctaaccaaatgaactaatataaagcacaagggatcaatcctggaaaaacagagatacatgacctttcaggcagagaattcaaaatagctgttttgaggaaactcaaagaaattcaagacaacacagaaagggaatttggaattcttatcagataaatttaaccaagagatcaaaattaaaaagaatcaagctgatattccagagtttaaaaatgcaactgacatgatgaggactacatcaaagtctcttaacaacagaaatgattaagaagaattagtgagcttgaagacaggctatttgaaattacacagttagaaaagacaaaagaaaaaaattaaaaagcaatgaggcacaccaaaaacatctagaaaatagcctcaaaggggcaaatgtaagacttactggccttaaagaaaaggtagaaaaagagataacagtagaaagtttattcaaagggataataacagagaatttcccaaacgagaaagataacattcaaatacaagaaggttatagaacaccaagcagatttaacccaatgatgactacctcaaagcatttaagaatctaattccctaaggtcaaatataaagaaaggatcctaaaaacagccagaaaaaaagaaataaataacatacaatagagctccaatacaactggcagcagacttttgttgttttgttttgttttgttttgttttgaaacagagtctcactctgtcacccaggctggaatgcagtgatgcgatcttgcctcactgcaacctccacctcccaggttcaggcaattatcctgcctcagcctcctgagtagctgagattacaggcgtgcaccaccatacccagctaattggcagcagacttttcagtggaaactttaaaggtgaggagagtgtggcaagacatattttaagtgctgaaggaaaaaaactttcacctagaatagtatatctggtgaaaatatcctttaattatgaaggagagataaagtctttcccagacaaacaaaagccgaaggatttcatcaacaccagacttgttctacaagaaatcctgaagggagttcttcaatctgaaagaaaaggatattaatgaaagaagaaatcatctgaaggtacaaaatgcactggtaacggtaagcatacagaaaaatacagaagagtataacactgtacctgtggtgtataaactactcttaactgaagtagaaagactaaataatgaaccaatcaaaaataatagctacaacaacttttcaagaaatagtgtaataagacataaagagaaacaacaaaaagttaaaaagctggcagcggggacaaagttaaagtgtagagttttaattaactttctttttgcaagtttgtttctgcaattgtgttaagctgtcatcagtttaaaataatgcgttataagtattagtatttgcaccggcgcagtggctcacacttgtaatcccagtactttgggaggccaaggcaggtagactgcttgaggtcagaagtttgagaccagccttgccatcacggtgaaaccccatctctactaaaaatacaaaaattagccaggtgtggtggtgcacacatgtaatcccagctacttgggaggctgaggcatgagaatcgcttgaacctgggaggcagagattgcagtgagccaagatcacgccactgtactccagcctgagagacagagcaatactctgtctcaaaaaaaagaaaattaatttaaaaaagatagtatttgcaagcctcatagtaacctcaaatcaaaaaacatacaacagatacacaaaaaaataaaatgcaagaaattaaagcataccaccacagaaaatcactttcactaaaaggaagacaggaagaaaggaaagaaggaagaaaagactgaaaaccaccagaaaacaaataacaaaatggcaggagaaagttcctatttagcaataataacactgaatgtaaatgaactaaattccccagtcaaaagacatagagtggctgaatggagaaacaaacaagatccaatgatctaaacacaccccacctatgaagacacacacagacagaaaagagagggatggagaaacatattccatggcaacggaaaccaaaaaagagcagacacagctatactcatatcagaaaaagtagtatagatttcaagacaaaaactgtaaggagagacaaaaaaggtcattatataatgataaaggggtcaattcagcaagaggatataataattgtaaatatatatgcaaccaacactggagcactcagatacataaagcaaatattattagacctaaagagaaagacagaccccaatacaataacagctggagacttcaacaccccgctttcagcattgcacagatctcccagaaagaaaatcaacaaagaaacatcagagttattctgcactatagacaaaatggatctagtagatatttacacatttcatccaatggctgcagaatacacatttttctcctcgacacatggatcattctcaaggataaaccatgttaggtcacaaaacgagtcttaaaacattaaaaaaaaaaaaagagagagagagagaaaaagaaaaaagaaagaaaacctaaaataatatcaagcatcttcactgaccacaatggaataaaactacaaatcaataacaagaggaattttggaaactacacaaacacatgagaattaaacaatatgctcctgaatgaccatttcaatgaagaaattaagaagggaattgaaaaattccttgaaacgaatggtaaaccaaagcctatgggatacagcaaaagcagtactcagagggaggcttatagctacacacacctacatcaaaaaagtggaaaaatttcaaacaaacaatctaacaatgcaccttaaagaactagaaaaataagagcaaactaaactcaaaattagtagaagaaaagaaataataaagatcagagcagaaataaatgaatttgaaatgaaaaaattatacgagatcactagaacaaaaagttggtgtttgagaagataaacaaaattgacaaacgatttagccagactaagaaaaaaagaaagaaggcccaagtaaataaaaccagagatgaaaaaggagacattacaatggatacaacagaaattcaaaggatcgttagtgactaccgtgagcaactatatgccaaaaaattgaaaaatcttgaagaaacagacaaattcctagacacatacaccctacaaagattgaacccggaagaaatccaaaacctgagcagaccaataacaagtgaggagatcaaagcagtaatgaaaagcttcccagtaaagaaaaggccaggacccaacagctttactgctgaattctaccaaatatttaaagtggaactaataccaatcctactcaaactattctgaaaaatagaggaggacggaatgcttccaaactcattctgtgaggccagtattaccctgataccaaaaaccaaacacacatcaaaaaaaaaaaaaaaaaaacctacagaccaatacctctgatgaatattgatgcaaaaaccctcaacaaaatactagcaaacctaatccaacaatacatttaaaagatcattcatcatgaccaagtgggatttatcacagtgatgcaaggatggctcaacacacacaaaccaatcaatgtgatacatcacatcaacaaaatgaaggacaaaaaccatacatttcaattggtgccaaaaaagcatctgataaagttcaacatcactttgtgataaaaaccctcaaataactgggcataaaaggaacatgcctgaacataataaaagccatatatgacagatccacaactagtatcataatgaatggggaaaaactgaaagcctttcctcttaggtctgtaacacaacaaagatgcccactttcaccactgttattcaacataatactgaaagtactagctagagcaatcaggcaagagaaagaaagaaagggcatccaaattggaaaagaagaagtcaaattatcattgtttgcagatgatatgatcttatatttaaaaaaacctaaagactccaacaaaaaactattagaacagataaacaaatttagtaaagttgcaggatacaaaataaatatactaaatcagtagcatttctatatgccaacagtaaacaatctgaaaaagaaatcaaaaaagtaatcccatttataatagccttaaataaaatttaatacctaggaattaactcaaccaaggaagtgaacgatctctacaatgaaaactataaaacactgatgaaagaaactgaagaggacatgaaaaaataaattggaagaatcaaagcaacctacagactcaacgcattccctatcaaaatatcaatgacattcttcagagaaataggaaaaacaattctaaaatttatatggaatcacaaaagaaccagaatagccaaagctatcctgagcaaaaagaacataactggagggaccacattatctgacttcaaattatactacagagctatagaaaccaaaacaacagggtactacataaaaataaacacacagaccaatggaacagaagagagaatccagaaacaaatccacacacctacgatgaactcatttttgacaatagtgtcaagaacatacactggggaaaagacagtctcttcaataaatggtactgggaaagctagatatccatatgcagaaaaatgaaactagacccctatctcttgccatacacaaaaaaaatcaaatcaaaatggattaaaggcttaaatctaagacctcaaactatgaaactattacaagacgacattaaggaaaattttcaggatgctggagtgggcaaacatttcttgagtaataccccacaggcagaggcaaccaaagcaacaatggacaaatgggatcacatcaagttaaaaaccttctgcacagcaaaggaaacagtcaacaaagtgaagaaacaacccacagaatgggagagaaatatgtgcaaactatccatctgacaaggtattaataatcaaaatatataagaagctcaaataactctataggaaaaaaatctaataatccaatttaaacaacaaacaggtatatgaaaaggtgctcaacatcactgatcatcagagaaatgcaaatcaaaactacactgagatatcatcttgctcaagttaaaatggcttttatccaaaagtcaggcaataataaatgctggcaaggttgtggagaaaagggtaccctcatacgttgttagcaagaatgtaaattagtacaaccactatggagaacagtttggaggttcctcaaaaaactaaaaatagaactaccatgcaatccagcaatcccgctgctgggtatattcccaaaagaaaagaaatcagtatgttgaaaagatatctacactcccatgttttttaggagtgcttacaatagctaagatttcgaatcaacctaagtgtccatcaatagatgaatggataaagagtggtatttatacacaatggagtactattcagccataaaaaagaatgagatcctgtcatttgcaataacatggatagaactggacgtcactatgttaagtgaaataagccaggtacagagagacaaacatcacatgttgtcacttatttgtgaggtctaaaaatcaaaacaattgaattcacagagatagagaatagaaggatggttactagagattgggaaaggtagcaggaaggttgaggggatgggaagatggttaatgggtaccaaaaaaaaattagttagaaagaatggataagacctagtatttgacagcacatagggggactacagtcaataataatttaattttacactttaaaataactaaaagagtataagtagattgttcgtaacacaaaggataaatgcttgaggctttggatacccaatttccattatgtgattattatgcattgcgtgtctaatctatgtgaaaaaaagattagtagctgcctggggtctcaggtacaaagagagatgattacaacaaggaatgagaaaattttgtgggacaatggaaatgtttgttctttttcttcacatagatattttggtacatgcaacataccaaatacgttgtatgcattgggtataccaaaatatctcatgtacttcataaatatatatacctcataaatatatatacctactatgtacccacaaaaattaaaaataattttttaattaaaaaagagacaaagaatattattattgataaaagggttaattcatcaagaagataaaacaattataaacatatgcaccaaacaacagaataaagaacttctcaaaactgaacaataaaacaaacccaataaaaaataatgggcaaagatctgaacagacacttcactaaaggtatacactgatgacaaacacacaaaaagatagccagcattatcagtcactacggaagtgcaaactgaaaccacaatgagattccaccacatacctattagaatggctaaaattagaaaggctgactatataacctgtaggcaagggggcagaaaaactagaactctcatacaccgctgaggggaatgtaaaatggtacaactatattttgcaaaaaaatttggcaatgtcttaaaaagttaaacatgcacctgctatacattcctgacactcttattaccaaagaaatagagaaaataaaatagagaaagagaaaaggtaatatatgtctgatatggtttggatccgtgtccccacccaaatttcatgttggattgtaatccccaatgttggaggtggggtctggggactggatcatgggggtggatttctcatgaatggtttagcgccatcccttggtactgtcctcacaatagtgagttatcatgagatctggtcatataaaagtgtgtgggacccccccaatccccacattgctcctgcttttaccatatgacatgccttttacttccaccatgattggaagcatcctgaggcccccccaaaagcagatgctgctatgcttcctgtagagcctgcagaaccatgagctaactaaacctcttttcttataaattagccagtctcaactatttatagcaatacaagaatggactaatacaatgtctatatgaagacttgtatatagatgttcaaattagctttattataatagcaaaaagctaaaaacaaccaaaatatccatcaacagatgaatgtccaaaaaacaaagtgtgctatatacacataatggactactcctcaataataaaaaggaagaaatactgacacacacaaaacatgagcaaactcaaaataactatgctaagtgaaaatagtctggtaggagtacataccactatatgattacatttatatagttttagaaactgcaaactcatctatagtcacagaaagcagattagtagctgtgtggggtcccaggtacaaagagagatgattacgacaaggaacgaaaaaatgttgtaggacactggaaatgtttgttctttttttcccacacagatataaagcagaaacaatacttttggcatgggttaaattatgaaagaagtcagtttgcattgcttcaaaaaatgttctcccatctttttagtattttctctctcatgactctttactacatttcccttccactatcctcactctcttatcctatacttccactgcaaatgtacatagaaagaaaatgatgatttcatcatgcctgaaaattatgtattcaagaggcacatcctacagctcaaaatctctgctctagcccaatactcatcaactgatgaaatcccctcatataacaatcactacatacaatcagccaaattcaagatgtagaacattttataggacaaattactctatttctccaacaaatcaatgtcataggaaaagaggggatggggataaaaggagtgttagtattaataaataaaagagaccaaagagacatagccaccaaatgtaatacatgatccttgtttggaccctatttgaacaaaccaaatgtaaaaagacatctctaagtctaattaaaaaaaagatggatacagaccatgtattacataatatttgggcttcttaatctagtcataatgacggtgtagtgcgctatttttttaaaggtccttatcagttacagatgcataccaaagcacttatgaatgaacagacatagttcttttaaaaactttagttcaaaaaagtgggtaggggatggtaaataaatttatcttggcaaaatattcaacgttggtatctatttcaaatttttcataataaattaaaagtaagatttttgtttgttttttgagatggagtctccctctgtcgccaggctggagtgcagtggcgcgatctcagctcacggcaacctccgcctcccaggttcaagcaattctcctgcctcagcctcccgagcagctgggactaaaggctcgtgccaccacgcctggctaatttttgtagttttagtagagacagggtttcgccattttgaccaggatgatctcaatctcctgatctcataatctgcccaccttggcctcccaaagtgctgggattacaggcaaaagtaagatcttaagatgttgtgggtttcataatgaatgttatgagacaaaactcctaacagcatgatatgcaccttatttattttcagtgcaggaacagtgcctgccacatagtaaatactcaacagaccttttactaaggggttgttttagtcctatatatgactaataagcaatgatataattatttgggtacctccatcatcaacacaatgcttaagaacttataaatcgtcactccattataccactttatgaggtattatattactccatttacagataagaaaactgagactttaaattagttgttcaaggtcacataagctcggcaatgaagggcaaagatcaagctgggcaactctagcgaagatttttttttaaagactacttggcttaagggccagtggatgacattgcctccctcagtgatacccattccaaagtaaaccatctcaaagtatcagcactagtacaatttacttgaaacttagccaggcttaccaacaaattatcagaataggaaaataatggaaaagaagaaaataccattttatgttattcatggctctcttcctcatattctaattaaaacagccttctttcgagatttgagcaaaccaaaacaataatctgtagaaaaaataactgtatacaggtacctaggaaataaactaatattacaataactcccattattataaggtatactaacttgtttcagagttcaattaaaaactgagcagaaaaataaaagaagacaaggcaaagactaaaataattattattttaatagtcacatattacaagttgttcagaatttgtgatactcatgggggaaggaggaaatcatgtaaacgtaagataggtcactacctgtcagcatgatataagagaagacaattccataccatactgaagacattaacctctgtcctgtgtttccaaactctggctgtacttttgagtcatttcagagctttaaaaaattcctgatgtgtgtgcttcacccaagaccgattaaattaacgggatgagactcaggcataagtattttttaaagctcctgaaatgattccaattaacagccaaagttgagaaccacttctcacctatgtcagcatatgtgtagtatgtgtgtgaattgccatataattaatgtaccaagaaaaaaaattttttttttgagaccgagtctcactctgtagcccaaactggagtgcagtggtgcaatcttggctcactgcaacctctacctcccaggttcaagcaattctcctgcctcagcctcccgagtaggtgggattatagtcacgcaccaccacaccccggctaatttttgtatttttagtagagaagggtttcaccatgttggccaggctgttctcaaactcctgacctcaagtgatcctcccgcctcggcctcctgaagttctgggattacaggcatgagtcaccatgcccagccccaagaaaattaatgagttgaaactaggtttaaatttttcttaccagagattatcattaatttcattaaaatacattttatgtctcacctaaaggccactgatagacatacatgaatgaaaatgattttgcttttcacaaaaaggatccagacttagccaattaggattaatattaactatattattatgtgaacttatcaatatcatgtttcactcaacaacatgccaattattctagtactctttttaaaaataagcaagctacaggctaaggggggtggtgtatcaccaaagcacctacagcaactggcacaggttggcaaaagggatctccaaatctccttaaaaccaagggaatcctgggactattgagaaataagaagagacccactgtcatctactttcatcacaaccaacctgtttagcctttaaaaccccagcagtgagacaaggagatagataaaaggtcagttcataaacccttccaaaaattacaatggattcctaaagaatcttaatgaaaaccaaatcctcctaagagtcctccagaaacttcccaggtaggctgaccttcctttaccatatatagaggatagggatgatgtcactaactgttaaaggcagtctagctcttcactcttgggagaagaaggcagaagaagcaaaactggagaaatggccttgaagaggtgaaacaggttgggatccaggacacaatggaggagctgggcaagtcagctgagggtacctacataaaaggcacacaacatttaagcaggttaaagagctatgtgaggattggggaaagaaaggaatagtaaaatggtggcagaatcaatggatctgcagtatgaaaggactgtggaagtcaaattactagacggaatgaactagaaagttaagaggcaagtgtcacagaaagatgaaagactgaaattaacattatgcagttattggtaatgataaggtcaagaatgtgattataggcatgagtggctgaaggacagtagagaacaagatcaccggagatgttaaagaaactaaaaggtcaacatgctggaacaatcatctatttaagtgttgaaatcaccaaaaattaaaatggggaatgctaaagagagtgaaagtgagccataagaaatgtgatggaatcacccagatgtaaatgacaatcatgagggaatgtgggaagtgtgtctgctaatatgaaactcaaaactgggggactgtctcaaggaagaatacctggaattggcaatgaggagcaaagagtatatactacagggaccaagaaatgtaaacgagtaaaatacacacccaaaaacaagctcagtctagcacaaaactaatgaccaacatatattactgtactataacacagtaacggctaccacagagaactataggtcccactggaggcccagtagaggaatcagaggtttcacaaacgtgtggaagatgtaacatggagctgagtgctcaacaatgagtaagggcaaaagcaccttcaaggcagaaagacactacaacttaggcaaaggcagagagatgtgaaaagaacataaagcgttctgagaaatgcaaacagttcaacatgattaagggcagaatgagtcagaaagagagtcaggacatatagctggaaaggtagaccaaggctacaactattttttctgttaaagcaagaacaaaagatatgaacaaattaaattgttgcccctaaatccttcataaaaaccattaatagaaaacaaaattgacaaattgtagtttcctcttattttccttagtttgtaggagatgccaggatgcaaataacctaatagccagttgctttaagaagattaatcaacccttagagaacaaatgctgccacattatatacaaattttatgatcattatgataatctccaatagccaagatataaatgtgccatagaaaattatgcacaactaagatattgtaagcaactgaatagagctcaaacataaatgcattagttgtagatttgtaacatgtatatatgcaaacataaatgtatacagctatatataaataaaaattgctttccatttaaaaaaacaatataagtgaatgcagagataataagaacagtggtatatacaacttttataaatgattaatgttagaattaaatatcacattggaaaagatgtctcactaggtaactgttggtatatttactctgtctccatttctactttagcagctgtgatttaatggaaagcacaccatatttgggagccaaagaaaatatattcaagtactggcactggcacttatgaactattaagcaagtcacttaactttcctgtgcctgagtttaaattacaaaatggaaatcaaaaatccatatatcatgtggttttattaagatttatatgaagtactatatctaaaagagctttgtaaaccacagtgagctacaaaatagtttagttacatactttgaaatattattaatgtagaactaaaagccttcaagccatctgctgaacccccactccccaaaataaagcacgattaaaatctgagatgataaatctgttagtctgataagtatgtctcaccacctctcttcataaccttacctttgaatgagcaggccctctttcattcagaagtttatactggggttggactctattgaaacgggctaactcatttaccagacacattgcagttttctcttttgggtttgccattttatcttggagagaagctgtaaataaaaaggctataaagtttttgtgaagaatgactttacaaaatggaagaaaaactagttttgactttgaaggtagattgtatatttaaattattttcatgaattttgtattttaaaaattcaaattacctaatgtcttccattacatgcaacagaaatatgtatcacattttaaacaataaattaaggtaaaatttttcctaagtacctaagttgttctatgtatataacagcatgcttaaagattttaaagtaaaattataataattttttatcttaaaaactttcctttcccctcaaaaaatttactagaaacacatacgtttcctggttcttattactatgaaactaaattttgtctaccttcttgatcgtttcatctcaatttttttccttctcattatgaggcagtgtgttagaaaaagctctagtcttgggaatcaggtcctaagtttaagtactagctcttccaactacaatttttcggtaactctaaacaaattaactcccctttctgtttttttaaataaattttcaaagttgtaaaaagaataatttaacaagtgcccatgtacctaacacccagtgcttattaaccatgttccatgtttaactcttattaaaaaaaaaataagtggtattccattcctgttaagttccttattatcttttacagagtattgatgtatgtggttctagactcacataaatggtattatagcattataataaacattctcacagtttactttcttcactcttcattgtgttctcaagacttttacttatataaatctagcacattaattttaactaccatagaatttcttttacaatattgcaccagtttttttatccactcctctactgagacactgggttgtttccaattcttcactcttaaagagagcatgctgtcaaatagctctcaaaatgactgtaccaaattaccttcccctaccgtttctcctcaagctcaaaaacatggaatataatcaaatattttaatttctgataatttgatatttgacaaacagtatcccattattgttctttgcatatttttctccactactattttatgtttgtttgggttttttcttgttcagagacagtctcactatgttgcccaggctggactctaaccctgggttcaagctattttccctactcagcctcccaagtagctgaattacaggcttctatccttttttttttttttttgtattatagttaccaacttttccttttatggtctgtgctttttacgtcttgtttaggaagtcctctctaactgtcaagatctcaatgattttacttaaactcactaagccttctattctttctataaaatgagagaaataaatctatcccgcttaagtcccaaagttgttgtgagattaagagttgtaaatgtatgatatggttttctaaactatatcgcaaatacaaggtactattatagcttcagaatatttttctaataccacattattttaacctatatttttcctttctctcatttatagacacatttaattacttttttctttcacttcccataaaaaatgccaaaatatattttaaaatctaagcataaaacatgcaagtggattacttcctgctcatttaaactatagtcacaataaatacagttcaattgtagccacaagaatacttaaaatgaatgaaaatggctggctttaggaacttcatctacaaacttcctaggccaaagtttaatattaaaaataatattcttttacatttctaatactcttaacaggcccaataatttgtacaatggcttgattgtgataattatgattaagaaactattttataagaaaactacgtaagcacctggtaagacctaagtaaaaagaaggaatctaagcaaccaattgtagggccaagacagctgacagtagattctacaattaagccattgtaagtggcttgcaaaaaaaaaaaaaaaaaaaaaaaaaactagtaattattacttttgggaaaagtacaaaaaagacaaaagtcaagacagttttgagaaaacctgcattttacctattccattgcatgtcacacaaattttataaaacatcctgttcaatttggaaagtcagtcgttataagaaaatacaaggtaacctgagacgataatcagttttggcctttgcataccattgcatgaattcaagtgcaacagacagcacagccaatttaatatcaaaaagcaaaagcagaataattggttaaaatgagaaaatattaaagtctgataaaaatcagccaattttgcataacacaaatagcatttataccaccactgtgtaattttcataattcagtaatgctgcatattcatctgttacaatgcaaaacatattagaagcatacaaacatagtgtgaaaattttatactatgaaaattgctaatagcataggttctacacatattaaacagcgatttaaatggttcatttataatgaacccgtttggtatgaaaacctaatctaaatcctctaaaggaaaatgttaacaaataacatggtataaaacttatattccattaattctgacttcctgcttcataaaagttaacatgaatccaataacacattttaatgggtgactgaagttttagtgtgagaagggtccaagatcccactttgataaagcttcaaaattaaaatcaaaatgtttaaagttgataacttaggaaataattagtcatagttgttttattttaaaaagggattaaaacaaatagttgttcctttatttaatgagaaatcttaataggattcttacttgacagagagctcagtaatacagcaataacttttaaattacaccaaaatttagatagagcatctataaaaacaaactggtctataaaatctgagacacataaaaaagttatataaatcttttttagagaagtcaatagtgcaaaaaagtgagaaatgcacataatgttacacaggtatgcattttcaaagacctatagatgttatcactgaagatagtttgaaatagtcttcaagtccatttggtggctggaatagtagagacctacttagaagtaaataaaattaataaaaatggattcacaatctcagactctgccactttgaaagaacaactgccacatgatggttaagagcctgttttggatatctctgtcacttactaatatctgtgtgaccttgagaaagtacttaaatctcactttcccacaaagtaaaatagagataatagttgttcttatctcactagataattgcatggattgaatgagataataccaaacactgttaacaatgattaaaaattcattattattctgatttaaacatttgttaaaacaattacactatcatcaaatattaaaacagtgacataaaaagtcatgaaaaaagtttataaaactaagtaaaaatattcttagccaaaatattctgttacgataaattgattttactcatacaaatatacttcttggctgggcatagtggctcacatctgtaatcccagtacattgggaggcagaggcgggaggatcgcttaaggccaggggtttgagaacagcctggacaacatagcgagacctcatctctacaaaaaaataaaaatattagccatatgtcatggcacatgcctgtactccttgacactcagaaggctgagatagaaggattgcttgagcccaggagttccagactgcaatccagcctgggtgacagagtgagatcctctctcaaaacaaaacaaaacaaaaaacaagtatatttctgtagtagtctgtgaaaagcatgtatttgttattattttttccactgacttataaacccataagttcgtttccactgaaaaattctcaaatatgatataaattatattaaaggtttacatgtgctaggaaatattctaccttcactgatacgaaacttggttagatataacttacaactttgataagaaacactggtaaaatacatatttataataacagtatttgcatatccaacaaaaacataaatatactctatttttagattcactctatttttatgtcttcacaaaatgtcctggactctggaatttgaatcttcattttgcctgttcatttgtatgtgtaggaaccagtgaagaaacacagcaactgtgttcaagtcactgaacaagctacaaaataatgtagctcacaggcaaaatgatctgtccccaaaggagttcacagtctgatagaagaaacagacacagacaatagacaaacacaataaatcacaatataagtactataataaggctgttacaaaaactccttagacaaagggtgtatggaaaggcaagttttaagaggtggtgattagataaggaaagcaaaaattcacttaggtaacaagggaacgtgagagacagtccaagcttttcaaggagtatagacacaggagaaagcacataaaacaacataactttctggcaaatgcaagcagaaaactggcagaatacagaacgcatgagaaaaaacagcagaataaaactatgtgaccagaattcactagaacaccaaaagtttcctaaaccagaacttaaagtagcattttttaaagtagctatattccagccagaactgttgctactaaggtcacagactacctcgcttcgcaaggcaaatcattccaaagaatcctttccatccttggtcccagaaatgacttaaacacggtttctttccttttttttttgagacagagtttcactcttgttgcccaggctgtagtgcaagggcgcgatctcggctcactgcaacctccacctcctggattcaggtgattctcctgcctcagcctcccgagtagctggaattacaggcatgcaccaccacgcccagctaattttgtttttttagtagagacggggtttctccatattggtcacgctggtctcgaactcccgacctcaggtgatccgcccacctcagcctcccgaagtggtgggattacaggcgtgagccaccacgcccggccttaaacacagtttctatgtctctttactggttcccctttctctattctctgctattggagggaactcatcctaattcccaagtaaaataagaaagaaaaaagtcaaaagagcaaaggaccctttcatgggctcttgccttctaggagcaatctgacagatatgtccccagctattaactaaaacaaaccctctattttcaaattagaccctaacataaggctgtccaagcaaaattatcgacaaactacccaggcatcaaactgctccatttttaacagtctgtccattaggaaaaaatttaagttcctctctcacataaacacaaagataaatttcagaaatattaaaatgcaaaatacaaaaatttcacaaaaactaacggaaattagctaaatatctgtcatactcctgtaacacagaaggccttcctagatatgaaaaggaacctagaagccataaaggcaaaaactgatagttaacaacataaaaataataaaacttctctaaagcaaaacataccacatatgacactaaagtctaagccattttgagttactttttgtatacagaagaaatacttgcaatatgtgaagaaaggccaggcgtggtggctcacgtctggaatcccagcactttgggaggtcaaggcgggcagatcacctgaggtcaggagttccagaccagcctggccaacatggtgaaaccccgtctctacaaaaatatacaaattagccaggcatgatggcgggtgcctgtaatcccagctactcaggaggctgaggcgagagaatcacttgaacccgggaggtggtggttgcaagtggaaccaagatcgcaccactgcactccaccctaagcaacagagcgagactccgtctcaaaaaaaaaaaaaaaagtgaagacaaactgttaacattcataaaataaaaagatactataaatcaatttttttaaagccaataggaaaaaagggcaaagttacacacaattcacataatttcttgagtaaatatacctgttcaaaagaatgttaaagagcctggccaacatggtgaaagcctggccaacatggtgaaaccctgtctctattaaaaatacaaaaatcagccaggcatggtggcacatgcctgtagtccgagctattcgggaggctgaggcaccagaatcgcttgaacctgggaggtggaagttgcagtgaaccgagatggcaccactacactctagcctgggcaacagagtgagactgtcaaaaaaaaaaaaaaagaaagaaagaaagaaaaattcaaattccagtgatatataattttcccctattagactgataaagattttttttaataatcatttaagtattaacaagtatgtggggaaaatgggtgagaattctgttggtgcaaatacaaattagtacaaaatttctgatgggcaacattgattaaagtttcaattgtacctatctttaaaacagcaattattaatctgaggattcatactacaggaagacatttgcaatgataatctggaaaacaagactataatagcaaaaactataaatgagataaatattattatttaccaaaaattggttaaactacatgaatcatgcagctttgaaaagagaaagaggtacagagcttatgaatcaacatgggaaaactttgcaaactggtgaatgacaaaagttacagcagcttactgtgtgatcgtatatttatcttcttttttttttgagacggagtctcactctgtcacccaggctacagtgcagtggcgcaatctcggctcactgcaagctccgcctcccaagctcaagcgattcttctgcctcagcctcctgagtagctgggattacaggcatgcgccaccatgcccagctaatttttttttcttttttttttttttgagacaagagtctcgctctgtcacccaggctggagtgcagtggtgtgatcttggctcactgcaagctccgcctcccgggttcacgccattctcctgcctcagcctcccaagtagctgggactacaggcgcccgccaccacgcccagctaattttttgtatttttagtagagacggggtttctccatgttggacaggccagtctcgaactcctgaccccaggtgatccacccgcctcggcctcccaaagtgctgggattacaggcgtgagccactgcgcccggccagagtaagttctttctagtcttgacagtgccaccatggtcctgaaaaacagaaaaataatgctcaaggatctgatttaaagcaggccatgttgtgcctccatctccaacttttccagtgaagctatctagagatttaaacaggacaaaaacacagtgtgtccttaccagtatttagtttggtcagtcttcttaacttcagtcattctaaatatgtgtataatgatacctcgtgattttaatttgcatctccctaatgaatactgttaattaacttttttcatttgcttatatgtcatctgtatctcctgtggtgaagtgtctgaatattttacttttgatttttttttcttattgctgaatttgaagagttctttacacatcctacatacaagttactgattagacatatgcttggtaaagattttcttctaggccaggcgcggtggctcacgcctgtaatcccagtactttgggaggccaaggcaggtggatcgttttaggtcaggagttcaaaaccagtctgggcaacatggtaccccgcctctattaaaaatacaaaaagtagctgggcacggtagtgtgcgcctgtgatcccacctactcaggaggctgaggcacaagaatcacttgagcccaagaggtgaggggctgcagtgagccaagaaggtaccactgcactccagcctggggaacagagcaagactctgtctccaaaaaaaataaataaagtagtaggaaaaagatgaattgctaacaaagttggagcaaatggacagtcatcttagaaaataataaagaggaatcactacgaaaaaaataaaaatttttttcccaaactgtggcttttctctttattctcttaccagtgtcttttaaagagcagattttaatagtctaatttatcaatttttatagtttgtacttttaatgtatatctaaaaaattattacctaactgaggtctaaaaatttttttctcctgttttcttccacgaacattatagttttaggttttacatttaagtccagaagccattttgagttagttttcctatacagcgcaaggtatgaatccattttttgtatatcaatatccaattgtttccaactgtggaaaaggctacatttctcccactacattgcctttatgtctttgtcaaaattattagttatctacatataaggagtttatttctggactaccaattctgtttccactgatctatttgtcttttgttgttgttgttgttgttgttgttgttgttgttgttgttttgagacggagtctcgctctgtcgcccaggctggagtgcagtggcgcgatctcagctcactgcaacctccacctcctgggttcaagcgattctgccgcctatttacctatttttacgccaaactattttacagcttttaattcttgaaatcaggtagtgttggctcccacactgttctttttcacagttgtttaaagttctttaaatttccacatgaattttagaatcaccctgtgcagttctataaaaaagcctgcaaagattgaaatataagtctcttaaatctataatttggtgaaaatcaacattttaacaaagttgagtattccaacccatgaaaaggatacacagtcacttctcattattgagataataatatgtcaatgactgttatgtgaatcagcaattatagagccattgctcccaggggaactaacgtattaggttcttgcaagcttctgctgacatttttgtgaactgatcatatgtcatgttttatgtgtttctgtttagagacttcttgtttagtatgtattactaatatatgttactgattcattaacattgaactcatgtccaatagtactgtttaactcctgcctgaataaagcttatctaatgcacatatattctccgtaaggcatatcagagcctcctggtacttagaaacactatatggcacttaaacattacactttaaacattttaaacatcaaaataaccatctttgtaaacatcaaaataaccaacaaaaagcacaaacatgcaaaaaatgcagcactaaataaaccaagaaagggctacttgcttacagtatgaaacccaaaataagaaagcagagcattgtcttgtttgatcccagctgggtatatacatgtgcactgggtgattcaaaatgttttgcccctgcaagtgtctgagaatgaccacaaaagcactgcaagtattggttttggggttacaaataaaaattagtgagtaagccaattcctaggtaaagaatccatgaataatgagaatcaactgtatcttattcaggtatcctttaatttcttgcagcagtattttgtagttctcattttctttaacatattttgttagacttatctctaagtagttcatatttttgatgcttttgaaaatgctactcttttattttcatttatgattgttctctgctaatgtatagaaacacaattggtttttgcatactgctcttctatcctgcaactctgctatagtaatttattagttctagtaggattccatcagattttctacatagacaatcaggtcatctgtgaataaggacagttttattcatttctttccaatctgaacaccatgcatttccttctcttgcatgatggcatgggctagaacctccacggcaacgtcaaacggaactggttaaagtggacatcccgtcttctttttttaaaataagtgtccagttttggccaggtgtggtggctcacgcctgtaatcccagcactttgggaggccgaggcaggtggatcacaaggtcaggagatcgagaccatcttggccaacctggtgaaaccccgtctctactaaaaaatacaaaaaaattagccagacatagtggcgggtgtctgtagtcccagctactacagaggctgaggcaggagaatggcacgaactcacaagggggagctttcagtgagccgagatcgtgccacttcagcctgggcaacagagcgagactgtctcaaaaaaaaaggtgtccagtttttcaccaataagtacaaggtcagctaataaggtttttcatagaagcacattagcaggctgggaaagttcacttccacttctagtttgctgagagtctttatgatactgaatattagattttatcaaatgatttttctgcatctattgagatgatcatgtgatttttgctttttagttcattaatatgttaaattacactactgattttttggaacactaaaccaaccccacattcctgggataaaccccacatggttatgacatattatccttttaataaactgttgaattagatttgctgaaactttgtttagatttttgcaattatatttatgagacatactggtctgtaatttccttaaaatgtatttgtctgattctggtatcccagtaatgctggcatcatgagccttgtaaaaaattccttccacttcaatatttttaaaagcatataaaattgatattattttttccttaacttgtataattcaccagtgaaactatccggacctagagttttctttttaagtagacttttactacaatttttatttctttagcatataaaaagctactcagggctaggcatgatagctcatgtctgtaaccctaccacttcaggccaaagcaagaggatcacttgagcccaggagttggagaccagtcagtacaacatggtgaaaccttatctctacaaacattaaaaataaaaaaattagccaggcatggtagcatgtgcctgaagtcccagctaggaggctgaagtgggaagatcacttgaggtcaaggccacagtgagctatcatcggaccactgctctccagcctgggcgacagagtgagaccctgtctcaaaaaaaaagctattcaggttatccattttcttcttcttcctttgggattaatttgttcttctttttctagtcttttaagatggaagctgaagtcaaatatttgagctatttgagttcattcttctttcaaaatatatacatttggagctataaatttctccctaaatactgttttagcaatatctcctaatgttgtattgctgttgtcatttagtttaaaatactttcttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacagggtttcaccttgttaaccaggatggtctcgatctcctgacctcatgatccacccgcctcggcctcccaaagtgctgggattacaggcgtgagccaccgcgcccggcctagtttaaaatactttctaatttacctttccttctttttaaaccatagattacttatattttttaatttccaaatatttagagatttcccaagaatctttctgttaatgattcctaattccactgtaatcagatacaattttttaatgacttgaatccttttgaattcatttaagacttgtttcatggccaggcaccatggctcacgcatgcaatcctaggagtttgggaggcagaggcaggaggatcacctgaacccaggagttctagaccaacctgggcaacacagtaagatcccaacactacaaaaaaaaaaaaaaaaaaagaatattagctgggtgtggcggcacacatttatagtcctagatactcggggagcagaaatgggaggattgtttgagcccaggaggtcaaggctgcagtcagccatggtggtaccacttcactacagcgtgaacaaagcaaaaccccacctccaaaaaaaaaaaaaaaaaaaaaaaaaaaagtcctttatggcccaaaatacagtttatcgttgcaaatgttttggataaacttgtgaacaaatacgtattctactctttttaggtagagtgttctataaatgcaattaggtcaagttgcttaacagttactcaagtctactatatctttgatgattttctgtccacttctatcaattattgacaggggttactaaaatctccaattatgactggatttctcaatttctccttgcatttctatcaggttttgtttcatgtgttttgaagctctgttattaggtgcataaacatgtaacatcattatgtcctcttaactgacctctttaccattataaatgaaatgaccttctttatccctggaaatattccttgctctcaaatatactttaatattaatatagccactccaagttgcttttgactaggttaccatattatatcttttcccattctttcacttttaacctgtttgtttacaaactatttcttgtaggcaagcatatagttggatcttgcttttatatccaatctgacaaattcagcctttaaactggagtgtttagacaatttacatttagtgtgactattcatatggttaggtttgattctatcatcttgctatttattttatatttttcccatttggtgtttgttccttttttcttctttttggacttctgttgaattattttgtgtgactccattttatctcctttttattggcttattagttgtaactctctattttgctattttaggggctagagtttacagtatacatttttaacttaccacagtctatcttccagtgatattatcacctcacacagagcaaaagaatcttataacagtatacctccatttctccctccctgccttttagctattgttatcatgcattttacttttagataagttataaaccccacaacagcttgttaatatttttgctttaagcagtcacttatcttttaaggagatttaactgataagaaaaaaaatctcatgtatttacccaagtagttaccatttctagtgttctttctttcatgtaactccatatttgcatctggtatcattttcctgctgtctgaagaattgcttttaaattttcttccagaggggaaatgttagcaataaattctttctgcttctgtgttgtaaacatctttatctcatctttattttagaaacatatttttgtcagatacagaattatagattgacatttttcatctttcagtactttaaagatgcttccccagtttgcttgcttatatcgtttctgataaatctattaagataatcatctttatctttcttcctctacacacaaaatgaccatatctctttctctgactgcttttcagattttctctttatcatttgctttcaacaatttgattataatgtacagtaagtcctcacttaacatcatcaataggtccttggaagctgcaacttcaagtgaaacaaagtagaacagaacccaatttaccatggtccaatcgacataaacaagtgttaagttcctacagtgtatttctagttacaaaaacatcaccgaacttctaataccaaaacacttctaatattaaacaatgaaatgaatgtgagctacacatacacttaagaaagattaataaaaacaagtaagataattattcacccaatttttctagttcagggtcacaggtggtcagagcgtatcctagccgctcagggcacaaggcagaaaccagccttagacagaatgctattccacactagagtgcgtgcgtgcccacacacccacacacacacacacacatacacacacacacacaacagactaactcatactggaacaatctagagaagccaattaacctaatgctcacatctccctaatgtgggaggaaactgaagtcccaaagaaaacccatgcagacatgggaagaacatgaaaacatcacaccaatactggccccagccaggaatcaattctttttctctcatcaacattatgacaaaatgatgttgaaagaaacattatttgaggacctgctataccttggtgtagttttatgtttcttatacttaaaactcattcaacttctttatctgtagatttatggcttaagtctaaaacatttttggccattatttcttaaaatatattcttctgtatattatgtcccttgagaactacaattattcatctatttggctgcttgagtgtgtcccacagctcactgacttttttttcttctttctctatgcttcattctggatggtttctattgctctgccttcaagttcattcataattttttctgcaatgtctaatttaccattaatctcataccgtatatttttcatctcagttgtagttttcatcactgtaagtctgatatgggtctttttgtctcttctgtatctctaactttttgaatacatggaatacagttataatgttttaatgccctctgctaattctatcatctgtgtcagttctgtgtcaattttgacggaagattctcataattatgggtcatatttcatgcttctttgcatacatggtaatctttaactgaatgacataccttgttaattttaccttgctatatgactcctataaatctttttggactttgtccaggcatacagttgagtaatttggaaatagtttgttcctttcaagtcttgtttttataatttactagttcgctccagagcagcaacatcttctcaactcagagtctgccagactccacatctcagtttctactctctatgtcacatcctggaaaatctctcagtgcagtaggcctggggcaattgtaggactcaccttgtttgtttcttctctctcaagaatcacttgattcttgagattaagacctgaatgtcttaatcattgttgtttctacatattttgtttttttggagaagaggggtaggattgtttcaagaggacagtaaacacgatccttgttacaccacatggaccagaggcaaaagtccccatccgtccttcttatttaatctatctgtatctatttgagtttcttgtaaacatcataaatataccgtccctgacttacgatggttcaccttatgattcaactttaccatagtgacaaagtgatatgcactcagtagaaaccatactgaagtacctatataagcattctatttttcactttcagtatcacattcaataaattataatgagatatttaacactttattataaaatagggtgtatttagatgattttgcccaactgtagtctaacttaagtgttctgagcacatttaaggtaggctaggctaagctatgatgttcagtaggttgtgtgtgtgtgtgtgtgtgtgtatatatatatatatattttttttttttttctgagtcaaggtcccactctgtcacccagactagaatgcaatgaagactataactcactgcagccttgacctcctgggctcaagcaaccctcacacttcagcctcccaagtagctaggactacaggtgcacaccaccacatccagctaatttttgtattttttgtagagatgggttttcaccatgttgtccaggctggtcttgaactcctaggttcaaattatctgccagccttggcctcccaaagtgctgggatacaggcatgagccaccatgcccagttaattatgtgtatgaaatacatttttgactttcaatattttcatcttacaatgggtttatcaggacctaacaccatcataagtcaaggagcatctgtacttgagtcttgctcttctatacaatctgacaatctttgccatttaaattgagcatttaagtcatttacatttagtatagttgtcaatattactagatttatatctactgttttgttatgtttttgtccttttatttgttcctttcttcaactttatcttcttttagactgattatttttagtacccattttatatcctacataggcttactatttttattttgtcgtataggaattgttctaaaacatacacagcctaccttcaaatatcattccacttcatgtttgatatcagcacctaaaaattctatacttccctttcccttatccctttctttatgctactgacatcaattaatttctatgtataagccctcaaggcactgttagtatttttgttttagtcaattatctttttaaaagttaaaaatgggccaggcatggtggctcacacctgtaatcccaacactttgggaggccaaggtgggcggatcactggaggtcaggagttcaagaccagcctggccaacatggcaaaaccccatctctactaaaaataaaaaaattaactgagcatagtggctcatgcctgtaatcccagccctttgggaggccgaggcaggtgaatcacttgagtccaggagttgggagaccaacctgagcaacatggcaaaacaccttctcaacaaaatatataaaaattagccggatatagtggtgcatgcctgtaatcccagctacttgagaggctgaggtgggaggactgcttcagcctgggaggtcgaggctgcagtgagccatcatcgtgccactgcactccagcctgggaaacctgtctcaagacctgtctcaacaacaacaacaacaaaatttttatttcaataccaccaattttcagctatttgattatgatgtgcgtggttaggttttttttttttttaatatttcttctactttaggttgacttcttaccatcatctacaggtttatagtttctactaaacagagaacagaggtttaaagtcattatttcttaatgtcattcgcagcaacctggatggaactggagacttattctaactgaaataactctggaatggaaaaccaaacgtcatatattctcactcataagtgggagctaaatttgtgaggatgtaaaggtgtaagaatgatacaatggactttggggacttggggaaagggtgaaagtggtatgaggtataaaagactacacattgagtacagtgtacactgcttgggtgatgggtgcaccaaagtctcagaaatcaccactaaagaacttattcatgtaaccaaacaccacctgtttcccaaaaactgttgaaataaaaaataaataaaagtcattatttcttataatattttctgttgcccctcccttctcctaggattctaattacacgtcttaggccactcgatatttcccacagctcactgatgctgtttttttctttagtccttccaccctgtgcttcattttggatagtcactattgttatctattcaagcccactgatgtgtgtcttatctgctattaatcccatccaatatatattttatttcagatactgcattcttcatctctatttttatattttctatgtatttccacatcatctttctgttttcccctcgtgtcttgaacatttagagcatattagtaagaactgtttctatatctttgtctgctaaaccatctttatcatttctgggtctctttcttttcagaaaatgtttaaatcctggctatgggtcatattttcattcttctttgtaagcattttaatattttattgaggtagaattgacataatatctaattaatccattcaaagtgaacgttcggctgggcacggtggctcactcctgtaatcccagcactttgggaggccgaggcaggtggatcacttgaggtcaggagttcaagaccagcctggccaacatggtgaaaccccgtctctactaaaaatacaaaatttagctgggcgtggcggcaggtgcctgtaatcccagctactgaggaggctgaggcaggagaatcccttgaacccgggaggcagaggttgcagtgagctgagatcacaccactgcactccagactgagcgacagagggagactacatctcaaaaaaataaataaataaaaaataaactgaatattccagtggtatttagtccactcacagtgttgtacaactaccacctatacctagttccaaaacactgttatgaccccaaaagggaattcaacacccattaggcagttgcttctcattcacccttaatcccaggccctggcaagcaacaatctacattctgtctcatagattacctattgtggatatttcacataaatggaatcatacaatatgtgaccatttgtgtgtgtcttctttcacttaatatgttttctaggttcatctgcatcgtagcatgtatctgtacttcatttctttactgctagacaatttatggaatacagactactgcaatttgtttactcattcatccactgatggacatttgggttgtttccaccatttagctattgcaaatagtaatgctatgaacatgtgtggtcatatatttgtttgagtacctgctttcaattcttcagggtatatacctaggagtggaattgctgggtcatatgacaagtctatgtgttcctttgaggaattgtcaaactcttttttccacagaggctgaaccatttaacattcccaccagcaacatacgagggttccagtttctccacatcgtcctcaaaaccagttactgcccgtcttttgattctggccatcctagtaggtgagaagtggtatcttactgtggttttcatttgcatctccctgatcactaatgatgttgagtattaatgatgtgtttatcttctcagagtaactgtctattccaagtcctttgcccattttttagttgagcttttttttgctgttgagttgtaagttttcgttcttgtattttggccattggtccattatgagttaatttttatacatggcatgaagtaggggtccaactttattgttttgcatgtgcatctccaggggtccccaaaccatttgaagagattattctttccccactgaatcatcctggcatgtttgttaaaaatcaattgcctacatatatattaattctggactctcaattctattagtctatacatctatccttatgccagtaccacactattttgatcattgtagctttgcagtaagtttcttaattgggaaatatgagtcctctggctttattcttcctttttcaagatggttttggctatttggatctgttgcaattccatatgaatatgaggatcagctttccaacttttgcaaaaaaaaaaaaaaaaggccaatggaattttgatagagattgcattgaatctggagattgctttggacagtattgccatcctaacggcaatgtaaagtcttccaattcatgaacacaaaatgtctttccacttatttaggtcttctttatttcaacatgttttatagtttacagtgcacaagtctttcataagcaagtcaactcctttaggcttttggatgctattataaatgcaatcttttaaaatttctttttgtattgttcattccgagtacacagaaacacaaatgctttttgtgtgttaccttgtacctacaactttgctcaagttatttattagctttagtggaggtttttctggattctttgggattttctatatataggaccatgtcatctgcaaacagagacagttttatttcttccttccaaatctgtatgtctttgtttctttttcttgtcacactgctctggctataacttccactacaacttgaataactggtgagaatgggtatccgtgccttgttcctgatcataagggcaaggatttcagtcttttactattgagttggatgttagctgtgggttttttcataaacgctgaatgttgaggaaatgtttaaaaaaaaagttccctactattcctgattttgagcctttctatcaagaacagctgttgaattttgtcaactgcctactgtatcaattgaaacaatcacgtgggggttttccccgcttcattctattaatgtgttgtactacaccacccttgcaatcctgggaataagtcccacttggccatggtgcatattcctttaaatatgctgctagattcagtttgctagtattttgttgaagatttttgcatctttattaataaggaatattggtctgtaattttcgcattacgtctttgtttggctttggtatcagggtaataatactggcctcaaagagtgagttaggaagtattcttactctctcctctccaattttttggaagagtttgagagcgattctcatactctttaaatatttaaatatttggtattcttctttaaatatttggtagaatccaccagagaagcaatatggtactggacttctgattgggagtttttgttttgttttgagatagggtctcactctatcacccaggttggagtgcaatggcataatcatggatcactgcagtctcaacctcccaggctcaagtaatcttagtttgggaggttttttaactaattcaatctgttcacttgtaagtctgttatattttctgtttcttctgagtcagttttagtaatgcgtatttctaaaactgtgtccatttcatgtaggttatctaatctgtgcataaaattgctcacagtattctctttaatcctttttgtttaaggtcagtagtaatgtccccacactcacgtctagttttagttatacctatctgtgttttttctttgtcagtctagcaaaaggtttgtcaatttcattgatcttttcaaagaatcaaacttttggtttcactaattctctatattattttcctattctctatttcatttatctccactctaatctttatttacttccttttttctggtagctttgcattttctagtttctttaaaatgtaaagtaagattatttatttgaggcctttcttattctttaatgtagatgtttattgctaataatttccctctcaggactgttttcactgcatcatttaagtcacatatattgtttccattttaatttatttctaagtattctctaattcccacatatttgtaaatttccatatatttgtaaattttccagtattccttctgttaatgattactaacttcattccactgtgactggagaagatacatagcatgatttcaatctttttaaatttactgaaacttgttttgtggcctaatacagcctggagaatgtttcatgtatactttaaaagaatatatattttggcagggtgcagtggctcacgcctataatccctgcactttgggaggccgaggagggtggatcacctgaggtcaggagtctgagaccagtctggccaacatggcaaaaccccgtctctactaaaaatacaaaaattagctgggtgtggtggtggacacctgtaatcctagctactcaggaggctgaggcaggagaatcacttgaaccccggaggcagaggttgcggtgagccaagatggagacattgcactctgggctgggtaacagagcaagactacgtctttcaaaaaaaaaaaaaaaaaaaagacaaaaaaaaaagaatacatattttgctgttgctgaatgttctgtatatgtctgttaggtctagttgattaatactgttgttgaggtcctctagtcccttactgatattctgtctagatgttctatccattgctaacgtcaaagcaagcattttttgactgaatgacaaaaactaaattttacattgttgggttctgaattttgttgtattcctctaaatagtgttctggtgcagttaagttacttggaatcatttggagccttctgaggactcttcccagtgccccatgtattctacaacatactttactctgcatagtaggaacacgactatttgaagccttattgtgaactctggaaattgtttttcttagtgctttccaagtgttttcttctctggcctcaggtagggcctgtcaagcatctacgaaatcagaactcagcaaaagactccaggagaaccctctggagatctccaaaatgcatgctcacttgttcatgctctcttgctttttagtttatgcctccccaacgccaatcccaacccccttagctcttttttctctggtactctgccctgtaattctaatcgccttgatcttcccaaatttttatctttgtctttttatctcagtaggactgctgggctctgttttggttcctccacaccttgcactgcagccaataaactgcctctaggctctgcagtaagctgttacaattgaagggctttaccttcacttgttcctattctctcagggatcacagtctggtgctgcctgtcatcaatgtctaaaagctattgtttatatattttataaattctcaagttatttaaagaggaagagtagatttttgctacataacaaattacctccaattttgtggctttaaaaatcaagcattggccaggcacggtgactcacgcctgtaattccagcactttgggaggccaaggcaggaggatcacctgaggtcaggaatttgagaccagcctgcccaacatgatgaaaccccatctctactaaaaatacaaaaaattagccaggtgcggtggtgcacgtctgtagtcccagctactcaggaggctgaggcaggagaatcacctgaacctgggagacagaggttgcagtgagctgagatcgtaccactgcactctagcctgggtgacagaccaagacttcaactcaaaaaaagctaaaaaaaatttaaaaacaaacaaaacaagcatttctttttttcacacagtttctgagggttggcaatcagggaacagcttagatgggtagttctggctcaggatctctcatgaggttgcagtcaagatgtcagcaggacagatgtttaggactggaagcttgactaaagctgagacatctgcttccaagaaggctcgttcacatgctgttggctagagaggcctcagttccttgttggctgttggcaggaggcctcagtttcccacagcatgggcctccccatcgggccattcacaacatggcagctaactattctcagagtgagtaatccaaggttgggggtagtgaggggaaggaggtggagccacatttgtattataaataacctatcctaagaaatgatccatcacttctgttacattctattggttccacagataaacctcaatacagtgtgtatggggattacaccatggtgtaaatatcgggatgccgggatcattgggggccatcttggaagctggctacatataaaataaatccagttcccattataccagcataggggaaagtagaagtctttcttacacatttttaacctccttatgtttactatttttcttatcccctaactgtaggctatattctatggctacaagagacatgagcagattacagagctccacacccagtcttggaaagaaaagtaactactactaagtagcagcaacttttaagagaaaagaatagagttcctggtgcttgtggcaagaagcaggaggaccttgaagccaatctgggcttgagaaagtggttcattcccccaaatacttcactcaatgatctacctaaatgtctgccgtctgccctcctttcccaccaatttccagtcaggcagcaatagccaacagcaatattaatagtaaaattaatagcagtagtaccagcaccaatgctaagcattttgcctttgttatctcaattactcctcacaacaaacctctgagatagctgtcattattccttacactctagactttgtttcttggtagtcatactctggtcttacactatccagtgtaataaaaactttttttttttttttaataacacctggctccctcttgccctacacggttctgctactccttcgacacggaaaaattctgtcttgtcctgcctgtcatctcttccacttcagttaggccttaaagcttcctcttagctaccatgttcccaatatctactatcaaacctcactaaaaagaatcaccagattattttgatccctgtaaattcccagttgctaggctctcccaatactacaaccgcctaatatagacttttccaattccttaggacacactgacctgtcaagcctacctcaccagctaatctccaaaacttggccctacttcagctactcatttaaaaatattattcacagcatgtatcttcgtaatttatatttgctgtagcttactgctaaaatgagttccttttcccgggggacctataattaatgatcagggagaaagggccaaaatataccatactggtaaatattatggtaccccagaaaccagtatactcccgttggttatctgttgaataatgactgaaaagtataaagtaatgattataaatactaactcagaaaattatcagagggcataatccaaagaatgttatttacaaataaaaagaaatagatgacagtagacacatataagcaatccacaaaaggcaaaacacgaaagaacaaaaaatatttaaatattatagaaacacaaaataaaataccaccttttgtcagacagataagcaaagactgaaattttgtcaaggaagtaaggaaacaggtagatacacttctggcagatataattttgtctttttgggagctatacaccaaatatctttaaaatccacatacatctttgactagtatttccatttctaataattaattctaagaaaataattggacaaagagatatacatttaaaaaatttactatggcactaactacaatataaaaatctgtccaacaataagggcttggttaaattttagtacatccaaactaagaattattattaaatcacttcaaaacattacatattgtataatcccagtttttaaaaagtaacatatattcacataaaaacatacctgcatagaaaaaaaatctagaagtatacaccccaaaatgttaccagtgattatctctgtaatagaagtggaattttttgtgattttttttgtttgtttttcagggtttgtttttttttttttttgcttatcacacctaattttctacagtaagcataagttgcacatggataataacacacattcttaaaaggcaaaaacaacaactatgatcacaatttaaaggcagaaaagtgctattatcttaacagaacatggaacatccatgttctatgataataataaagttaggcaaagttaatatcaaataacctgatattcaatagcctagtttttaattagttttagtaacacatatggaagaatctgttatgaataaaaaaccatgtaggccgggcacggtggctcacgcctgtaatcccagcactttgaaaggccaaggcaggcagaccacgaggtcagaagttcgagaccagcctgaccaacatggtgaaactccatctctactaagaatacaaaaattagccgggcgtggtggcatgcgcttgtgatcccagctactcaggaggctgaaacagaagaattgcttgaattcggaaggcggaggatgcagtgagccaagatcatgccactgcactccagcatgggcaacagagtgagactccatctcaaaaaataaaaaataaaaaagcatctaattcaggtattttaagaaaacaaaagccttcccaaataaaaatgtagtactaatcctagagacaacgttgaaaatcacgtagtaaaaatctcaactctttcaagctgagaatcaacttaaatcccctttgcatgcctagggtctcattctgttacccaggctggagtgcagtggtatgatcacagttcactgcagcctcaacctcccaggctcaagagatcctccaccccagcctcccaagtagctgagactacaggcatgtgtcaccatatctaactttttttattttttgtagagacagggtcctactatgttgcccaagctggtctcaaaatcctgggctcaagcaatcctcctgcttcagcctcccaaagtgctgggattacaggcatgggccaccacactgggcccctttacacatttaccttgagaaccctcactgttatgagaaagtggttgcccagaaagtaagattcaaaaatcactcatgaatttaagaattcaactctatgtttagctgaagagagtcttcatctcagacttgaacagtttgggggatgacagttatagtcagtaacaagaagggggggtctcttaaattgttctaggaatacacttctgttaagattgagcatcctaaatccaaaaatctgaaatccaaaatctccaagatttcaaacttcttttgtaccaacataatgctcaaaggaaatgctcattggagcattttggattttcgatttttggattagggatgctcaacctgtaggcaaaattccaaaatctaaaaaaatctgaaatccaaaacacttccagtgccaagcattttggataaggaatactcaacctgtacaatttaagtatgtatatctccaggcactgtgtacgatttctagccaacatccagggaattgcttgtggccatgtagagaattgcctaggaactgtttgcaatgcctgattcaacatgacctgcaacatagccagtcagtaaatcctcattaggactaatccataaactataattttcaatgaagttggctagcataaaatggtcatttccaaatgtctgtggcagaagatgaaaaattattttaattgtaaccaaataattaatggcaggtatccatagaaagttatttagtggcaacttcacagctataacagtttgcaaataaggtctcataatgcttccactgggatttgagagcagctgtgaggaaacaggaagcactaagcacaggacagcactacgatttctttaaattattagtaatgtttttgattaaagtaatttttgttgcactagggaagtttctagtacaggagaaaactaaataataactttacatgagggagagttagttgcatttgtgtaacacaagcagcatataacaccaaaactgacaacataattacgtggttattgttgaaaaataaatatctccttgctttagtgacaactctagcaccattcatatattcatacacccaacaaataaatgtatgaaaactatttacattgtttattctaggacctggaaatataagagtaaacaagaaaagtcactgtcttcatgaaacaaactgtctaacaagggagacagatgttacaacaaataattacatatttgactataactacaaatgtcatgttattaaactaaagagcaaggtgctataacagcatatagcaggactgcagtcaagcaagccaaacccaggggtggggaagagaggtccagcagaggaaatctgtgcaaatccctgtagccagaacaaccttacccaatctaggaactgaaacggtccagtaaaactgaagcactgagattatttctagggcacacattaagtctaagatgtataaagacatccaagagatcaaggtggtaaatgctacatgagtttggagctcagaaaaaaaaggtctagaccaggtataaacttagaagtcattagcttagagatggcatgggatgcacaggaactggaaatttctttggcaaggtgagcaggactatatgtcggaaggcagggggtcaagattactttctttttttggaacgcatctcgctctgtagcccaggctggagtgcagtggtgtgatctcagctcactgcaacctccgtctgctgggttcaagcaactcttctgcctcagcctcccaagtagctgggactacaggtgtgcaccaccatgactggctgatttttttgtatttttagtaaagatggggtttcaccatgttggccatgctggtcttgatctcctgatctcaggtgatctacctgccttcgtctcccaaagtgctgggattacaggcgtgagcgaccacgcctggccaagattacttttgttttttttttgagacagtctcactctttttgcccagggtggagtgcaatggcacgatcttggctcaccgcaacctccgcctcccgggttcaagtgattctcctgcctcagcctcccgagtagctgggattacaggcacgcaccaccatgcctggctaattttgtattttttagtagagacggggtttccccatgttggccaggctggtctcggactcccgacctcaggtgatctgcccgccttggcctcccaaagtgctgggattacaggtgtgagccaccgtgcccagtcgattactttcttaatcacaggggaaaagaaaaaaagtttaattacttctctgttgatttgcaatcaaaagaaataaaagtattttgtttctttccttttttttttttttgtttttaagagacagggtcttactacgttacccagtctggctcaaactcctgggctcaagagatcctcccacctcacctcagaaagtgctgggactacaggtttgagccacccagcctggccaaaagtattttctaacactatagttatgatacaatgttctatttgatcgggaaaggtaaaattaaatgtataaagttcttggagaaacgtcaagaactaagaaaagcacttctttcagtgagtctaaagtattaaatgctgtagtttatcagggcacttccttctagtgtttttcagtgccctggaaagtgaactttaaaaaaaaaaaaaaaacagatacaactacttcacaagatttgtcactaaaaatgctttgagtctgcagaactgccacctactgaagctgtatcatgatcataagcattctgaacacattaacaagtcctaaagggatgtgacatcaagaagaacagacaaaccttctgccttgcacaaccagaagttatcaactttcagaagatcattctaatccttaaacaacctgccctacacagcctccaatgatgactatacagtaggtaactgctttaaaaagtgatgagtcaggttacagttatagaaaagaaaagctgagttaaaatgttccacaatttacagccaaagcaccatgtaagcatgaaaaatgccttaacacaaactcacctgatttatttgaagcatgttaagacaatattgaccaaactgctgtatccctcacggctccaaaaactggaaaacgaaaatgaagaaataaagttcaacttagctgataacctcaatgactggtattttaaacacatgcccttgatcaaaatcaaatataaaatgtaatttatccagatctccatagaactttctatgatgataaaaatgttctgtacttgcactgtccaatctggaagtcattagccacatgtggctactgagcacttgaaatgtggctagagcaatcaagaaaataatatttaattttctttcatgttcacttgaataactacgtcactagtagccaccatactggacagtacagatctgaacaaagctccttctgcttctagacttctaagacaatcccaacaaaagtgaagctgttaaaaataaatctgagagtttcaggttaatatttaatgtatacttccctttttgcagtcctgttttaaacagctttgttcccatcttctatacgataaattaatcctaaagaagatgcaacaccacaagtattctcttagatggtatggaaaagagcatatagtacaattatcttgctgaatagtttctttttctctgtcattttgtctgttatcatcagtataaaaatagtatgtatattaaaatttcaggctgggcgtggtaatcccagcattttgggaggccaaggtgggtggatcatttgagttcaggagttcgggaccagcctggccaacatggtgaaaaccctgcctctaccaaaaatacaaaaattagccaggcatggtggcgcgtgcctgtaatctcagctactcaggaggctgaggcaggagaattgcttgaacccaggaggcagaggttgcagtgagccgagattgcgccattgcactccagcctaggcgacagagcgagactccatctcaaaaaaaaaaaaaaaaaaaattttaatttgaaaacagatgccaatgaagggcaggaaagtccaaattacaaataaataaatcatgggatcttgtaatgaaaaaaagtttatataaaatataaattatatacagacctctcccctaaaaattatctaaagcaacaacacaattgtgatacacagcaaaaggcctatatctaatcacctgtatagaaactgttatgctgctaaattttaatattgaactttcccctggaagcaaacgttttgtaagtacacacatacatacacaaacacacacccatatttggctaccattttttcaagatgacaaactagagtccattcaaaatgactttgaaaactttaatatttttcttacaatagtgtcctcagcatctgcatcaatttttatttattttctaattactgtcacatttcctatgagaacgggatgctgtataaagagcacacggcctggatattggtgaatttgagttttagtcaaagttcttcagattaccttctgagccttggttcaaattactttgtgtatctttgagttcttctttttctgtcttcttttttttcttcaatctttaaaaagtaagctaaagtccttgtggtaggcagcctctaacaaatagaatatagcagaaataatgagataccacttccaagattaggttataaaaattcttaggtgtcaccttctctcactcatttgctcagagggaggcagatgccaaactgtggtgccctttggagaggcccatatggcaaagaactgagaaaagcctctggccaacagccagcaacaattgatttcttcagtccaagagccccaggaaactgaaccctgcaagagccacatgaatgagttcagaaacagatcttccaccagtagagcttccagatgtgactgcaaccccaactgacagcttgactaccacctcttttatgagccacaggcacccagctaagctgcacccagatttctaacccacagaaactgtaagataatgtttgttgtcttaagtccttaaattctggtgcaatgtgctatgcaacaataaataagactatcctgtccaactctataattcaatattcccatggtgctttaggtattaattaatatttggataggcaaaaaaataaaataaaatccctgttcaacatgagcaaatgagtaacattagaacttcaaagtggcaaattataaaacttaaacatttatattttcaattcaaaaaatgagattattcacaagtgtagcattagtcacatggtgttaaaatacacccgctttcaataggaatggagtatctcattaaaaaaatacactagctataacttaaaatacaaacacaaccaatcatctttttttttaactgaaaacagttcatttaaaaagtaaagtgtgaataaccactaaagcatctcagtgacttagtgtcccttgctttctagaatttatcattactggtcgggtgtagtggctcacgcttgtaactcagcactccgggaggccgaggtggggggatcacctgaggtcaggagttcaagaccagcctggccaacatggtgaaaccctgtctctactaaaaatacaaaaattagctgggcatagtaacacatgcctgtaatcccagctactcgggaggctgaggcagaagaaataaatgcttgaacccaggaggccaaggttgcagtgagccaagatcatgccactgcactccagtccaggtgacagagcaagacttcatctcagaaaaaaaaaaaaaaaaaggccaggcgcagtggctcacgcctgtaatcccagcactttgggaggcagaggcgggcggatcatgaggtcaggagatcgagaccatcctggctaacacagtgaaaccccgcctctactaaaaatacaaaatattagccgggcgtggtggcgggcgcctgtagtcccagctactcgggaggctgaggcaggagaatggcgtgaacccgggaggcggagcttgcagtgagccaagatcgcgccactgcactccagcctgggcgacagagcaagactccgtctcaaaaaaaaaaaaattaacattattaagcattcaccaactttgaaaaactccactttgtctttattagtatacgttgctaaagttacaaatgcttatctacagatctctatgtatttcttcaatattagaggctgataacactggtggctgattccaagaagcaagcagagtaagatattggggtacctttttgaaagttctaacctttttttttttctttttttttgagacggagtcttgccctgtcacccagagtggagtgcaacagctcaatctcagctcactgcaacctccacctaccaggctcaagtgattctcctgcctcagactccccagtagctggggatacaggtacacaccaccatgcctggctaatttttgtattttttgtagagacggggtttcaccatgttggccaggctggtctcgaactcctggcctcgggtgatccatctgcctcggcctcccaaagtgccaagattacaggcgtgagccaccacgcccggcccgaaacttctagtcttctgacacggaaaagatattccatgaagtaacaaaaaataaaactttatgaacataaaattaaccatacgatttaaatattctgtaagccttttctttacaatataaagagctgtagaaattaaaacacatgaaactaatgtctataacagcactctgtaattggctaacattctgaaaattatacttttttaagcaaaccagttattttagatttacatcaatttaaaaattgtagtttgtaattataccatggacaattcagaatgttcacagtggcacgtctttaagactctgtttctactttaaagacacgcccagtctactgtcacatattttaaacaatttgctaaaatatcaagacatatcaataaaatgcagagcagttttatactacctttggtttcataaaatccacctcctcagctgggtgtggtggctcacgcctgtaatcccagcacttttggagtctgaggcggacggatcacctgaggtcaggagttcgagactagcctggcgaacacggcaaaatcgtctctactaaaaatacaaaaattagccaggcatggaggcacgcacctgtagtccaggtactcaggaggctgaggcaggtgaatcgcttgaacccaggaggcggaggctgcagtgagtggagattgcgccactgcactctagcctgggtgacagagtaagactccatctcaaaaaataaaaataattaaaaaaaaaatccacctcctctatcacaaaagtttccagctacagttgattccaattacaactaagcgcttttagagaaatgtatccatgcgtcccaaaaatgccctatctggtcaggcatatgaagacaggcaattctagattccaaactactaaatgaaaacaagcaggattatagggagacggctggggaagacgtgatgctcatgaagaatggcccaacctgtaactgcaatgtactgctgatataagtcgtactttaattatgaattacattttgcccatctgagaaattaaaagctgcacagaaatctatataatccccaataattaaactgctttataaaacggcactgttactaaatatgtataaattttttatatcagcacccatcctacagttgataggcaattctcacttaaatgtcttatttgacaacatgaaaagcaaaaaaaatttactatctctactcttagactacaaactgctacaaaactatcaattcaatgcttattactctaaaaaagatatacggtcctttaaagagctttttaaaatgtttttcattttgatttttcaaagtgggtacccaaaaacactgcttttatgtaaggaaaacagaagtcttacgccacaaactattctagtggaaaactctaaataacacaggccagaaaaaaaaaaaaggaaactaacatttttcagacaccaattgtatacgctaggtgccacattttgccatttttacatcaactcatttaatcctcatcatcttgggatgtaggcattatctccatttttctagaggttgggttatttgcctacagtcacattgctaggtttagaacggttcattctggcccaaagtcgtcttttcttcactatacaccaaattaaaaaagacttgccttctttttaatttttttttttttttttttttttgagacggagttccactcttgctgcccaggctggagtgcaatgggcaccatgtcggctcaccgcaagatccgcctcctggtttcaaatgattctcctgcctcagcctcctgagtagctgcgattacaggcatgcgccaccacggccggctaattttacatttttagtagagacggggtttctccatgttcgtcaggctggtctcgaacccccaaccctcaggtgattcacccacctcggcctcccaaagtgctgggattacaagcatgagccaccatgcccggacatttttttttttttttgagactgagtctcactctgtcacccaggctggagtgcaatggcgccatctcagctcactgcaacctctgcctcccgggttcaagcgattctcctgcctcagcctcccgagtagctgggattacaggcgcgcaccaccacacccagctaatttttgtatttttagtagagacggggtttcaccatgttggccaggctggtctcgaactcctgacctcctgatccacctgcctcggcctcccaaagtgctgggattacaggcatgagccaccccacctggccaattttttttattttctatgatcagcttggtgaaaaataaaagatttgccttcttataatttttcctggaacaaagtcaagggcttgacctctaggacaacataatggcaaagctcctatatagaacttggggaggattatttaaaatcaaacgatgcacacataaataaaaatgataattattactgattctagacatctagtattttgtgtacctataagaggcacaaatatatctatatgtgaataatcatactgtgcgtgtctcaaactatgcagtctaagagaattcaattttgcagtatctagagttttccctctttattatgatctgtacctataaatgatcagattcccagcactgaacgtgcacaaaacaagataataataggaataaagagaagggtaggcacaaaggaaaaaaaaaaaaaaacctaccatatcttctagaacctaaacaggaaaaccgctctgcctcgatttctggattgtttgtatatttaaaagcttgatgactatcttagattttttttatattcatactatttgttgaaaagcaaaccaagccactcttcctagcacttcattccagacaagccaagtaagctaaaatgtaaaatttgcatggttttccaagctcaagtatttaggagttaaggatcacaatgtatgtaacttacccttaaatggtccaggggaaaaatattttgtgtgtgatagagagcaaataataaatacataaaatgttaacaggtgaatctgaataaaggttacaaagattttctttgtattattcttattcttgccatttgtctgtaagcttgaaattatttccaaataaagttaaaatttaaaaattacacagcattttatttgaaattaacaatacatacttggattacacagcaacattcttacaaatacaaaacactggtttttatggggaaaaatgcagtaatttgtgagcaagtatgtaccatatcctaccaacttatcatcacttaggaataaatttcagactagcctaccatataataaaatatggcaatagtgacttgacttgaaaccatagcaggaaaacacaaacacaccagatagtttggcataactgcttcgcaaatttaatacaggcctgctgcaaaatgcagcaatctacaattaaagtgttatgtgatatctcttgtttgcagtaagatacaaactgaacaatgaaaatctggccatactacaaaacagagatggagagtaagtcttggttttggtagttttattaaataagatttttccaccgcagctgagttcacaacagtgtacttgaatcatctaaagaaagcaaggacggggaagaaatatcctggagaaatgttgaaatcttttctcctccaaggttactatcaccctgcctgtccatcacaattttgatttcaagtattcacgatgctggtctgaaacacaggatgcatcagaagccaagtaatgctcagcaaaagttcaccaaaattgtgaaagcaaacattaaataaaaaacgttttcaattaacagtaaaatatctttaaaggatcatctctagcctttctttctgcaggatccacccactttaaaatcctttggtaaattcccaggtctaccctaattgaatggtccctctctatctgctcaagcagttcttaaccctttggagtggggatgggggtaaggggacatcacagcaaatatggacccttaccaaagaaaattattcacaaatgcaaaattctacacacatttccaaagacttccagaatcccacggccattacccccaccgcctccctaagaatcccagagtggcgtgcttctcaatggcctctgcggagcacccccagcccccaagccacagcccccggctcgaccccgaagagactagagttcctgctctcacacagcggattccgtaactgagctttgtctcctcgcccaactcccttcaccccggcaaggtcactaccgccaactacccctttaagccgagccatcacggtaggagttcgtaacagccacagcagaacttgcctgtcataggatatattttgtcccctcggccccacctaccctccccatttcggcaagttacgtctttaccactagcccattctacagaaatagctgccgccgccaccctccggcgcgccccggccccgccgctccgcctccagcgcccccaggcccatttcccgcagaccctccccgggccgccctcccctgccctactctaggcgctccctctccctcgcagccacaccgtggctgcactcgccgtcctctcttccggccgctaccaccccggccccctagaaccccagcctcccgcgcccgcagccgcgttcctgtctccccgacctccgcacccccacttggcccggcctcctcgccttcctcccggctcctcccctcaggacacctgtgtcgtcccaccccctccaccacacacgcaccccccaccccaattccttcgcctccctgtcctccctcccccgccggtctcccctccccgctgctgccccgagagcccgatgtgggagggaaggcgcgggggaggggaggccgcgaagggggctgcttttctccgggttccccgtgctgcggaactgcagggctccccagcgccctctgccttcttcgccggcggcgcggaagtcggggtctcccggacgcccccgatgagggtatttaccttcttgccggggacactttgcagacggctccaacattggcaaacactacagagaactgaccccgctcggccgccgccggcttccacccctcgggctccccgccccccgcctccgcccgcctccgcccgcctccccggcgctccc

SEQ ID NO: 721 - DNA, 197327 bp, Homo sapiens; identical to SEQ ID NO: 720

SEQ ID NO: 722 - DNA, 516281 bp, Homo sapiens
ttgcctctcaagcagcctctggtcatctatctgcctttgagccatcaagatgccgatgtcttctcttccagcagctattttgtctcacatgacagctattaacaatgtgcctcctcctccacttcacagtataccaagtgagtgggaaatactttgatgctcttattcacctaccattgttttcagcggttcttaccccagctatgaaaattgggggtatttcagggttgatagggacattgggaatcttattgacagtgctgaagaatggaaagaacatagatgtgtaaatcctgcttggtctacttgaagtcatttcagtactctaggtcttaagtattttttctctgtaaaatgaggatctttacgaactcttagagcttcagatacattgaaatatttctaaagatgaaagaaaacaaagatttagagaggccacatgttccaccagctatcaggttcctttttctagcagatcttctactccctaccaagagttggtcctactacgcttaatgggataattaatacttaatattctctaggagaattctcatttcaatttgacaaggaaaaaaagataattcctactattctgactgtgaaatttattcctatttaacttttttattttctagtcttacttataagaattaagtatagaactagatatttcaaagtttatataattgacagtattttctcattttatgtaattagtctaaacctataacgttttcttaagattgtaaacacttctcatggccatcgaatttataagatctattatttgaacaccatcattctgactagcaatatgtatgagttccagtgttagttaagatttttaaaaaatatctggataacaaaggtaatacttgtgatccttttcaacttcaataaagcattaactcttattttattattcattgggcagatttatagtattgatttgaagaagctaagccatccatccttttcccttcctgtgaaagttaatttctccaaatacattttaaaaaattaatgctcatagtctccaggttaaaaggtataacaggtggcagttgatactccttgaaggggtacactgatgtcttgaatagtgttagacaaaatccttatgttaaacaaaattaattccatttgtattatagtgaaaataatcttgcatctggtcaaagttttctatttctacttgagtggaaataagaattaagtgcaattttgctgaagaaacacagcttctactattcatgttttatttgtgaaaaagaaaataaaagtcaccataaaataatatttttaaaaagcccaggaaactcggtagctgggagttaaaagatcaaattaatttagaatcaatgagatgagatttgtgctaccctctgtagtgcctcccaaggacacttaacttctgtgaagtgattaaaagacgaaaaatcagcagcaatttagatctcagaactgaatagagcataatggaaagcggtggagctcccagtgttcctttagaggttcgcacttgatgtttctatgtctgcaacttctctttgaggacgtgccctgcttgccttaataactgtgtctttttgctaactgtagcaagacaataattttccttagcaagcactgattgtctcactgctgaaacaatgatctcatggaagccaatgtgtaatgaatgctttcaatttatgaaatgactgaacctgaattacaaaggatatataaatgagttttaaatgcagtgggcataaataggaatgcacatttacatacctaaaaagaaaatccagccattgtatacatccttgatactttgtatttgttgagttaggttggatttagtgactcatattcaccttctctgtaagtatttatttatttatttattcatttttatttatttttgagatgaagtcttgctctgttgcccaggctggagtgcagtggcacgatctcagctcaccacaacctccgcctcctgggttcaagcgattatcctgcctcagcctcttgagtagctgggactacaggtgtgcctggctaatttttgtatttttagtagagatggggtttcactgtgttggccaggctggtctctatctcctcacctcgtgatctgcccccctcagcctcccaaagtgctaggatttacaggcgtgagctaccacgccccggctgtctgtatttatatgtgaatattgttaattgagtgctttctgtagttagtatgtaaacatttagcacgttatgttatttcatgtatttcttacaagaactctatgtcttcggtggacagaattaacggtcccagtgatatccatgccttaattcacaaaacttatgaataggttatactacatgttagggggaattgaggctgcacatgcaattaaagcagctaattggctccacttgagatgggagaatattccggtttgtctgggtaccagccacaattgtgagagcccttataagcaaaagaggaaggcgagagagtcagaatgatatgtgagaaagactcgactggcccttgctggctttgaagatggaggggggacaaaagccaaggaattcaggcagcctctagaagcagggaaaggcaaagaaatggattctcccctagcgtctccagaagaattgcagtcctgctgatgtgattttagcccagtgaaatcaggttcagagttctcatttccagaactgttagataatacgtttttatttttttaagccactaaggcagtggcaatcttttacagcagcaatataaaattaatacgtgttccagtttacacttaaggataataaggcttaggtttcatactaaggttcacacagatgttaagtagcagaggctcctcgtagcgtcatctgtgtaaacaaactctactcacaacaacaacaaagctggcagcattccgggttgccccttacctcctgccctgaatttcttgcccatttggctacttaaatgctattaatatatgggaggcaacatgtcacacatcttcaaaccctcctccactgctatcttgttgactctgaaattcagactcagacacttcaagtagttaagcttcttgagctagtttgctgcttgtggttctttcttctttgaaactttcaagtcttttccttctctggtctctttgacttctgtctcaggattcttcacagtttgctaaccttaagggaggaatgaatgttctcaaaagcagaagagctgttccacttttcattctggatgagaattattttaaaaacatcatagctaacaaactgtacagttttaccacctaagtgaaatggcatctggtttaagtacacacatgacccattatttttataagttgatttcctgaagagatagaaaaaaagaaaaaaaaattcttattttaaaaaatttttaatggaaggcaagaagctgtccttcaccgtttggtttatggtccagttaacttcctttgttgggataaatttgctgctactctattttcttcacactaattaggcttattcttctgaggaagaatgggtttaaaaatatgctttacattttgactactggttgacttgaaaaaaaaatttctgtgcttttccagttccaaaaatgttttaattcaccagacatttctaggtatctttcatttattccaacatatgagttggaaaaaaaaaagcattcaagataagaccagagacacatcaagaaatttagaaacaagatagtactctttttttttttttttctgagacggaatctcgctctgtcgcccaggctggagtgcagtggcgtgatttcatttcactgcaaactctgcctcctgagttcacgccattctcctgcctcagtctcctgaatatctgggactacagtatatgttagtcgcagccacgcctggctaatttttttgtatttttttagtagagacgggctttcaccgtgttggccagaatggtctcgatctcctgacctcgtgatccacccgcctcggcctctcaaagtgctgggattacagatgtgagccaccgcgcctggccaacacgatagtactcttaagcgaatgtttttcttcgctctttttcattttatggctttacatttactgcaaatctgaaaacactgtgtcatcattcctaagcgttcaaaggcgttttctataatttgagagtttttcagttctttggtagccaaggattaaaggtatatatttgaaaaagtgaatattgtaccatttaaaagttttaaaccattcaaatcctaggaatgcaggtaagaaaaaaaggaggcttgtcagtgacgaagaaaaacagggaagtgggttgtataatgtataaagaaaccaagtttaaggaaaagaaagaactaaaataaataagaatgaaaattccaagaaggagtaaaaggtgggaaaaaggttgaatgtttgtgtccatttctgtgtctatataatcaatgatagtcccaatggaatgtgccatcataaaattcagaagtattgaaaaatttttttcctcaccttaattttttaggataaaagtcaaatttttaatcccaaggagaaaagatggatgttttattgtaaagcaaacatttagtatttttttcctactactgttataactattttgatgtactttttgtcaaaccattttgagtggcgtttagaaattaagctatgggaacttaaatgtgagcttgatggtacctgggacttcaggcaggaaacaggaaatggtgaagtaaattgcagtgccttgcaaatcacatctccactagatgtcaggctaggtctcctctgagtctcaggctactgctctatctgcctatatcagagattagtcctgttattagttccatgttaccaatccttcagacaactgaagatgctggtcctccagcatctttcacagaactgatctctggtcttccttccaacatatactgtgaactagatttacttgtctgataggacgattaaactttttgataactttaactctacactcaaaagctgtcagggtcctactctcctttaaaacttacattacaatctattttccacaatctggcatttaaatctttcatgattaagctaaaatctgtctcttgtgttctagatctcattcttccatctatgtaactctccactacagctaaaacactttgttattccttaagcctatctgccaatactgattagaggtacaggaagatttcaaaggttaaacattcagatggacacacttggcaaatatgtaaagttacagctttccataaggacactgttaggggttccccttctgtggaagaagtccccagatgcctaggctgcatcccacacagccagccctctttggccacctatatagtagctcaggttcaaggtagtgagagtcacatagggcagatgctgaattgccctggcttaaaaccctcataaaccatcgtttttaataaaaattccaaaggcacttcttccaagtttcctgtaagaaatctctcaattactagagttaaagtactcagcgtagctcatttcagtgactgctcatcaggtattcgtacatcatctgtagtgctttctagtccaaatgcaagtcatcaatccaagatcattgttatcataagcaatgttgcctagcaacactgttaactctaccttaatctggcctataaggaacagagctggagagttatcatgctgacaggaaaaatattcccttaattacaccatcataatcttcaccatattgtcatgccttagctcatgtttcctgtgtttggggttccctttgctcttcctttatttgttcttatcatttcagttcttcagagttttcctaaattactttaatctccacaaagactctcctggcttttccagtatgaagaaattatatatactattttaatgtatttgtatttattaattataatcacattttatataatcacatttataaaatttttatgtagtcactatagaggcagaagtaggattattggatcatatggtaattctattgttaatattttgaggaactttcatactgctttccaaaatgactatattaatttacattctcaccaacagtatatcagggttccctttcctccactttctctctaacacttatctttagatttttgatagtagccatgttaacaggtacggagtggtatctcgctgtggatttaatttgtatttccctgatgattagagatattgacttttttttgttggccattcatgggtcttattctgaaaaatgtctgttcaggccctttgcccatttttcaagttggactatgtgtttgcttgttactgaattgtttgagttccctatatattttggatattacccccttatcataggtataatttgcaaatatagtctccattctgtgggttgtctcttcactctgttgtttccttttctgtgcagaagctttgtagagtgatgtaatctcatttatctacattgacttttgttccctgtgtatatgagaaagctgaggcaggaggatcgcttgagcccaggaatttgaggtgaatttcagtaagctacgatcatgctactgcactccagcctgagcaacagcacaaggccctgtttttgttgttgttgttgttgttgttttagtttttttttttttttgagatggagtttcactcttgttgcccagactggagtgcagtggcacgatcttggttcaccgtaacttctgcctcccgggttcaagagattcacctgcctcagcctcccaggtagctgggattacaggcatgcgccaccacacccggctaattttgtatttttagtagagacggggtttctccctgttgatcaggcttgtctcaaactcccaacctcgggtgatctgcccgcctcggcctcccaaagtgctaggattacaggtgtgagccaccacacctggccaagaccctgttttttttaaaaaaggattaatttgtggagaattgacatatttataatattgagtcttcctactcaataactggtatctttacaatgctcagtcttcctacttctcaggctgaatggctcacacctgtaatcccagcactttgggaggctgagatgggaggatccctggaggccaggagtttgagactagccttggcaacatagtgagaccctgtttctaccaaaaaacaaatccataagtaaataaatcttccccttgaatttatgtaagtgttcttgcatgccactaaataaaatttattcctgggtattttatcttttttctattatgaatgatatctttttctaactgtaaagtcagtatgtgagaaatattaaatttaaatttttaaaaagcttttgaaataatcataatcttacagatgttggaagttcagattaaaggaacttatttttctagagcaatttgacattccgtcatccccatatttcagtgtgtatttttaaaaaaacattgttacataattacaatacaactatcaagatcaggaaaattaacattgatacattactgtaatctaatccttggaccccattcaaatttggtcagttgttctgataatgtcctttctagtaaaacaatccaattcaaaatctcatgtttttctggtcaatgtgtctgttttatgccagcaccatactgttatgatagctttgtattttgaaatcagacagtgtgatagttttagctttgttcttttttcttcagattgctttgactctttaggatcttgctgtcttgtctcttcaattctttcagtctggaatagtttctcagttttccttgactttcatgaccttgatactgggagacaacaaagcagttattttgtagaatatctttcaatttggtttgtttgatatttcctcatgattagatttgaggtagacatctttgtcagcaatatcacaggagttatttcatgttctccttccatcttatcaggggccatatgatctcagtttgccccactcttgatgatattcactttaataatgattaaggtattacatagagagctttccagttgtaaatgtactcttttctctttttaaattaatatgttttgtgaagatgtattttaaggtgtataaatattccatttctcatgaaatattaaattaaatacattgaccgttctttatttgggttaaaaaataaaaattaaatataggaactctggggtttctattttattcaaagagttttaaggagttatttttattatatattttgatcacattgttcatagtttggacagtgggagccacttcaagttggtttgagcatttctttgcttctgacacaatgggatttttcaagctcttttcatactttctttgtcttatccctggaatcagacattttccctaagagccctgttttgttttaatgaaaatttaagatctgggtgctctgtgcatcattgatcttaggatgccattactcccaggccctctcagtggacagatctagggaatacaaattcacatttatatttgtttgtaaatcaatttatatatatatatatatatatatatatatatatatgtattaaaaattgtgagtttacactgatttctttaatcctaatgcagcaccacaggctcattcttatcttctccctttctgtatttctaactcccatctctgaagtgataaagctttctcctattagctttaacataacacttttgagtagtttccttgtttgtaatctatcttccatattcactgccatccattctgacatttagctctgggacactccctctgtctcacacctcgcagctgtcctccttacctggttgttctgagactctgcacagtcccaccttaatgtggatgccctccacaccctggtcttggatgctgtgataccttacctttcaccctacctactcctggtatagatgtctaccatctgctgctgtcacattggttttaggactcactgttcgaggaaaaaggcaagctattgaattagttacttctggaataagccactttggcaagtactctaatgggtttctggtctatgtactttttttaaatctatataattacaataatagcaaacactgatttgtatctttctttctaatttctaaatcttgtgcatttcttttattaaattgtgtcctttggtactttcagaaatttgtagcactagtatatatctttatctcgttcctgaatttattgctattgcctctggtgtttcaacattaaacatgattctgtcttttggtttgatctacttaccagcttaaaaaaaataaacttttttcaatttaagctgctaagaactatgttgaattttactggatactttttctgtatttagggagattataattttaaaaatttcaacttattgtggaaaattatattgctatattctctaattgaattttctttgattatttggataaatcttactttgttgtatgatctttgttaatatgttgccgggcactataccctcgtatatatttttggaaaatattcatgtgtatttgtgagattaatctctggtttcctttttcatgttttgtcatatttgcatctaattgttttgcttgcttcatcaaataaatttgaaagcttttctatgtttcaatatttaacaagcatatgtattgtctcttccatgaagatttgatggaatccactgtgataatgccttgtttgatacctgtgtgtgtgtgtttgtgtgtgtgtgtgtgtgtgtgtgtgtgtttgtggtggaggaaaactgctttgagattattccccatttttttcaaggcaattaatttacttaggcttttctcttttttctaatgtcaaatataagtaatatacattttccttaaaaaatcatttttgtttagtttcagtttttttgaccttacatctttgtgtaaaaccttcttttctgatttctttttaatgatatatactgttagttagttcccagttttcttatgttgagtacttaagctattctttttgtttagatatgcctgtggtttactttttcctttccaaagaaccagctcttgatttttactttctatattttttctgttttataaatttattcattgcttttctttgttttctcctttccatttttcttatgtattttaattttcttgtactacttgagttaaaagctaattttttattttattctatcttcttgtaatatcagtcatttttttcttcagagaaatacatattttaactatattccataggttcatgaaaggcttcactatttttactttatattttatagttttagttttaatatcctcttttgatttaagaataaaatttggtacatgattaatatatgtaaaatctacatccttagtgattcatttcctatttgatttttgtttgacaacaaagggaagttattggggtttattttgcctccatttatacctgcaatttttgctttatgaattttgatggtatataatctgagaacaaaaatgtttaatagtttgattctatacctaaatcaaatgtctatttcttgatttatcaactttagaaaatgcatatttataacctagtatgaaatgagaaaaatttccctcttcacatgttgattttgttgcaacaaatatttaagtctttggtcagttatattcatatctttaaatgttattaaatattatttttaatatttcttaaactgtaactattaattatctactttgtaagggaatatgtacagatatatattacattttctcctctgctgaaacttcacatttgttactcattatttatactatctccattataatctatgaataagttatttatgttaatgtttacaaaatttgcctacactttattagtacattttgcatcctatttaagtcttagttgtatgggtatgtgatttcttcacccagtgcttactaggcgaaatttgatatccaaataatatctctgaggtttcatatttattagttggggaataaaattcatgagtcacatttttttcttccctgaggttgccctactctttgccaggacattgctgtggagaagtctgtgaccaaagtttttcacacttggagaaggcttcctcttttggcttgctgctaaaataattctttatctttgaaatatggtaacaattagctgctaatcgagtaacacctagaacatctaatctttttgtaaatcatgtatcatgatttctctttgcctttctgggtcatcgtattatatttaattctccagattcaagtgtttatataagaaaagtattattgcattatatctttgagcattttttgtctactcttatttctgtttgcttactcagaaatcatttttacatatagtatctgctccctattttcatttgttattttctcctttctttatgtgtttcctatttatttgaatgtgttagcctctgtgtctatggctatattttcttaaatctttgtcatttttgcagtttcccatgtggattttatttctgtcattattttatcttcctcttatttcctgaatattgcctgcttgtaatttctttctgttttcctatttatggttaatgccatgtaattttgtttttctttcatcaaagctgtgtgtgtgtgtgtgtgtgtgtgtgagagagagagagagagagagagagacggagaagcacagatttttgcttatttcctggcataattattattctagtgcatactgcatactatttgatttttatttgctattataaattaatcatttttaccttttcccttagagcatattgtgcttaggttccaggattattaaatagtggttattttttgaagatagattacttgttagaaaataaatggtggtggagagtgcactagttcagcagacagattgaattttcttgtatgttaatgttgaacacttttcatcaactttgttctgttctcttccctaaacaatatgctcctaatttgtgctgtcatcgtttaaattccaaaggttctgtgtagttatttggccatgatctatttcttttcagtgactgagatcagctgcttctatgttgattgccacttaacattgtcctctgtattatcacaactttattctgaaaaaaaaaaaaaaatgagtgttatgtggaaccgttgtttaaccccgcctttcatgaatgtcactggttcaaggatatccccttagtctgtccatgtctgaacatcttcccatttcaagtaaggtttagtggctgcatccttcagagctgtatcagcttcccctggagaactcttcctatttcctcaaacaagaccagtatgcattttctcttgtacctcttttacagtttattgatgtttcactatttggttgatattattcagaattcatagttagaaaatatggttaatcctcagttttactgaagatcaggcttcttcctctaacttttatgttttactctttatgttatttagtgggctgtttgtcatgatgaatagatttttaatgccaaaaaaatgacattgacttgatgttcaatctcatgtagatgggagataaaataattaaaatatgatcttctgcaagaagcagggtgtttttagatttttgaaagtattcctttaataacatttttacttccacttatctgtctttgttattttttcttgatttgattttcattgcatacaactgattctcacctgacaaattagagtcacattattattatttattcattataatttactaaatattatttaaatccaatcattatgataagttctagtgttttggttcaagatgaatagaaaatggaccctgttctaaggggagcatcataaatctgaagaaacatagatataaattaaaaagtcataaagaaagatattatttgctttagtgcaactattcttgtggtgctgtaagagcacaatggaaaagacatttacctttttctatggaagacgagtttcaaaaagtgtcactggttaatttctgaggtggatctaaaagtatggatgagttttttaagttgagtaatgatccaaagagaatataatatcaaaaagacaagatatgttcatggagcacccagaacatgcgttgttgaaagatggcgagaatgagggcaggtgctgtggctcatgcctgtaattccagcactttgggaggccaaggcgggtggatcatgaggtcaggagatcgagactatcctggctaacatggtgaaaccctctctctattaaaaatacaaaaaaattagctggacatggtggcgggcgcctgtagtcccagctgctcgggagactgaggcaggagaatgacgttaacccaggaggcggaggttgcagtgagccgagattgtgccactgcactccagcctgggcgacagagcgagagtccgtcaaaaaaaaaaggaaaaaagaaagacggagagaatgggggaggaacttagagggtggtgttcaatgaggtcacagaagttaatttaggtacaattataaaaagaatgtattacatacaaagggatttaaagcaagaaagtttaacaatcacattagaattttagaaagtactgtgagagtagactggaggatgtgttggggaggaagaagctgaactcagggacattagttaggccattattgtagtattacagatgagattcaaagagaacctgaaataagatattgagctgtggcaagcatgtgaataatactacttcacaatgtacatgtcacacagccctacttggtgacttctgattaacgatccttattgtcattgggattacaggagacacacagtcagtcttttgtttctgaggtttccctgtgcagactcaaccaacttgggatcgaacatattagaaaaaataaaaaaaaacgtaatactacaataaaaataacataaaatacaaaacaatacagtataacactatttaaataggatttatattgtattaggtattaaaagtgatctagagaagatttatactatatgggaagatgtgcataggttatctgaaaatattatgccattttatatgaaagacttgagcatctatggatttttgtactggaggggtgaaagaggtgtcctagaaccaacaccccatggatattgatggacaactgtattttgaaaatatttaggatatatttcaaaagagatggaattgacagtctttataacactttggtcctgaagaggaaagggtagaataagatctcaagattggttatagatacaacaacaaaaagagaaaacttcaggccaataacctttatgaacagcaatgaaaaaatcctcaacaaaatatcggcaaacccaatccagcagcacatcaaaagcttatccaccatgatcaaggaggcttcatctctgggatgcaaggttggttcaacatatgcaaatcaagaaatatgattcatcacataaacagaactaaagacaaaaaccacatgattatctcaatagatgcagaaaaaggcttttgataaaattcaacatcccttcatgttaaaaactctcaataaactagatgttgaaggaacatacctcaaaatgataagaaccctatatgaaaaacccacagccaacatcatactgaatgggcaaaagctggcagcattcctcttgaataccagcacaagacaaggatgccctctctcaccactcctattcaacacagtattggaagttctggccagggcaatcaggcaagagaaggaaataaagggtattcaaatagtaagagaggaagtaaaactatccctgtttgcagatgacataattctatatctagaaaaccctgttgtctcaatcccaaagcttctcaagcttataagcaaagtctcaggatacagaatcaatgtgcaaaaattgctagcattcctatacgccaacaacaggcaagcagagagccaaatcatgagtgaattcccattaacaattgccacagaaagaataaaatacctaggaatacagctaacaagggaggtaaaagatctctacaaggagaactataaacaactgctcaaataaatcagaaatgacacaaacaaatggaaaaccattccatgctcatagataggacagataaatatcattaaaatggccatctgcccaaagcaatttatagattcaatgctattgccattaaactgccattcgcattcttcacaaaattagaaaaaactatttaaaaattcatatagaatcaaaaaagagcctcaatagccaggcaatcttaagcaaaaagaaaaaagctggagccatcactctacatgacttcaaactatactgcagggctacagtaaccaaaacagcatggtaccagtacaagaacagacacatagaccaatggaacagagtagtgaacccaaaaataagtccacacatctataactatctgatcttcaacaagcctgacaaaaataggtaatgggaaaaagattccctattcaatactgggaatagggaaaactgggtactgggaaaactggctagctataagcagaaaattgaaagtggaccccttttttacactatattcaataattaacttaatatggattaaagatttaaatgtaaaactccaaactataaaaaccctgtaagacaacctaggcaataccattcagaggcatgggcaaagatttcatgatgaagatgccaaaagcaattgcaacaaaagcaaaattgacaaatgagatctaattaaactagagtttcttcacagcaaaagaaactgtcagcagagtaaacacacagcctacagaatgggagaaaaattttgcaaactatgcatctgacaaaggtctaatatctagcatctataaggaacttaaacaaatttacaagaaaaaaacaaccgcattaaaaagtgggcaaaggacatgaacagacatttctcaaaagaagacataaatgtggccaacaatcatatggaaaaaagctcaacatcactggtcattagagaaatgcaaatcaaaccactgagacaccatctcacaccagtcagaatagctgttattaaaaagtaaaaaaataacagatgctggtgaggttgtagagaaaaaagaacacttacaccctgttggtgggactgtaaatcagctcaaccattgtggaagacagtgtggcaattcctcaaagacctaaagacagaaataccactgaacctagcaatcccattatttgggtatatacccaaatgaatataaatcattgtattataaagacacatgcacatatatgttcactgcagcaccattcacaatagcaaagacatggactcaacctaaatgcccatcaatgatagactgggtaaagaaaatgtggtacataaataccatggaatactatgcagccataaaaaagaataagattatgtccttcacagggacatggatggatttcgaggccatcatccttagcaaacaaactcaggaacagaacaccaaataccacgtgttttcacttgtaagtgggagctaagagatgagaacacatggacacatagaggggaacaacatacactgagacttactggagggtggaaggtgggaggaaggataggaccagaaaaaataactaatggatactaggcttaatatctgggtgatgaaataatgcatataacaaaccaccatgatacacgtttacctatataacaaaactgcacaacctgcatgttccctggaacttaaaagttaaaaaaaaaaaatagattggtgacaaagttattataattggtagggattttcttaatccagacaaaattcaggagaggatcatgttttatatggcaaaataaacatgggagaaattttgagtgaagttttggttatcttgagtttgcttttcctgggcaacattcacgtgaatattagtggagcactggttagagatctgggctggagagtttgatttgagaatcttaagatcaatgtgatcattgaagacatgaatgcagataagattatgcaaaaagaggatctaagctgagaagagaagacaagggtaatgagaatggattcttggccaacgtcaatgcttaacggaagaagatagcattcaatggagcagtctaataatgggaaagcaagaaaggagagaatggtgtcacaaaaacccagtaagaagaaacttcagtatcaaacatcacacagggcgtagtaagatgaagactgaaaggaggttatttgactagaatctaaaaggtctctgatgatcttaatgaaaaaaatttcaaaaaatatgaagaagattaattatagtagatggaagagtaaatttgggttggggaaatagaaaagataaacgtagattattttttccaaaaatgctgggtataaagagaagttattttgataatttgttgtaaaacattgcccctttcggctgggcgcggtggctcacgcctgtaatcccagcactttgggaggccgaggtgggcggatcacgaggtcaggagatcgagaccatcccggctaaaacggtgaaaccccgtctctactaaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaacaaaacaaaacaaaacaaaacaaaaaaaccttgcccctttccgtttcatgtgtccccaccactcccccactgcccccattttctcttctcaggtaatacagttctattttaacatcttaacccacccagtcaatgaacagggacaatctaggcccacttgggaattgtctctgtcagtgtgccagcatttattaatagaaaactttgactgggcattattcttttgcctctgaaggtttatttagtcaccctttttgggtgccttatgtctatctaatattatattatttaaagaaaaattacctttgagattttagaaaacaaaaactagttgaaaaatgggtagatacactatgaaccattaacataggtatgtttagtgacctcactagataggtttagacttattttaaaacatactcctccctgtaattaaatcactaatccaagtatataggaagacttagtcatgcttattgtctctgaaggatccttttctttattttctcccatccagcttcttgttcagtacttcagtcctatgctagaattcaccttctgcttattattgtataagggttgctattcttactacaaaagtttgttgccagtatttctgttgctatggctgctgaactgcttctttgtgctctaaaaatcatattaagcaaggttccatttatcattggattaattattagagtatgtactccaactactttgaagccattttacactgtgttttccagctaactctgctctgacatttccgcaggatcattgtgatatttttttctagggctatgctgtccatctctttcttgcctcctagccactcagataagcctggtctctgagtaaattgtggctatgtatttacagaatttctaagccttcacttattctattgcttcctcttagctttttgcaaagggtatttatatacctcttaaaggaaagcttgttggggaaaaatagtttagttacgtttaacacaaaaaacatttctaacttccatcacatgcatacttaatttactatatgcacacatatgaagatatatctaccttaaataatcattaacacatataaatgatcatcaatataacattcaaacaaaacattggaatttagttcttctattccaataatatacagtgggccttatatcaataaagataatcggttttttaatttctcaatgggttcctagttaaagattaattttctaacccctttccagccctctttcaaatatactctagtctaaacccttgattttaaccgtgttatagggttaagtcttttctgcttctgtcaaaagccaggctaaggcaaatccatcaggaaaaacaagactggaaaacaaatgtaaactttatactctttgaacctctttaaactttatccctgtattaaatttgatcacaagaaaagctcaacatctggtctttacaaagttacaatttcatgttgaaacctttggctttttttctttttaatgaaactgctttcaaaggcaagatccattatgttgctcaacaccctccacggaaagagccttgcaacaaatacctctcagaactgaggatcagcaaagagatgttttgatgaattaaagtgttcttctactaggctgtgagtgctatccagcccattctatttttgagtttacttggctgttccaagcctactatgaagccttgacctctactgctatagcttttctcaggcaatgttaatgttagataaaaagcaaagtagtagtttaatccttctattctttgctagcaattcttaatcttatcttctctgttctataagtcttatttttttgtcacctgctttaaatgaaggataaagaatatttacttttttaaagcctctcttttttggtcagaattccttaaaccttgacctttttccaaatctctgtggcaccatctccctttcctgtccctatcattcatcagagctattactgacactcttcttgaacaccattagaaaaacaggctaaatgaatacttcatagaagttccttcctaatctatgtatataaaaatctatgattaagattttatatatcagaaatattactagactaaaaggtagtttagatatatgtaagctgacagcttggttcatttaaaataaattattccatatgacgctaacacacaatttggtaacttttttgtttcttaaggcttacctgagcaatgtgggtaagaaaatgcctaaatcatgtaatcagtatttccaagtttattatgatatgatttatatgatatgatatggatatatatgatatgatatggataacaatcagttgtctgcttaaatttcccttatttcaatttcttatttagaaaagcagtatttgttattggtgattaaaaccaatttgttattggtgattaatctaaaggatcacaaaatttttataccaagtcaaatttaatgattcagaaaactagaagtaaaaacagataagtttggatgtcaaattccaattcttcataattagaatgtggtcaatgaatgcactttttaacgtttgagaaatacattaaaccactgattttctcaataacttttcactaaagaaaggagtaatatgcctaagtgagtatttattatttttttttacaacagttctaatagcactcattcttctgcagtaagcagaagcccatcactgtaaagatgctataatatgcaatgctctatcttcctttccatctaatttgaaggatgtccgcccattctggcactgaagaagaatgacaattagtttgctttttggctatgattactatctttctgctcttaaagactcctttatgatttgcttacatttgatctttagaaggaattgcaaactgaatccagacactagaaggtgctctgaagagggggaacaaaagatggggacctgcgtaggattgaataggccgacataagtaggattgaatcgaagggcaagagtgaaagtgagagaccaaattaagaaaactcttactcgaattgtcatgtctgaagttctggaaccagttcatcttgtaacagtgttggatagggattctgcatggcttgctttaagagaagtgacattatatgaacacagacaaacttcagcatttactggaaataaaaaaaaatgccagaccagatttgacatcaataaaaaacattaaattctttcctcaccttaatcaccctatgcagttctacttgtgtattaaacaaagactgttaatacctcacttccatagtcactgaattctttcactatgatgaatgtttgcaattaaactctatttacacacttgcttaataagattatggaaaattactcaaatttttaattgattttttttcagacttgaaaaagtctaagcacattaattatggccagttgaatgcattatgccacattagaggacaacacaggtaagctattcatgcatttctttttctgtcattcaaatgaatatgagtatttttgttttagggataaagtatagtaataaaccattgctggctctcagaggtacctgatttatcacacagataaaaacagttgaaaacctgggggttatttcttcagattgaaggggcagaatatatatgtcacatcttaaggaaacaatttagtgtgaaacaaacataactcattcctagctggctctttgtagtacttaaaaagcagtcataaggggaaaaagccttaagtggttgaaaacacacatactgaatgaaataagtacctgagcagtgaatagggaatgcctcattgaaatatactggaaccagagaactaggaaatatcactgttcaaagctcaggattcctaagatgtgtaatacttgaagatttaattttaagagatctatttccttgacaactcctttctccaagttgggtttttggaattataaaactggttatttccttccatatgcatcagtgtccatccaccctcttaccttccttcactcatccttcatgggactgttgaggaaggccttaggtttacagagttttctctctctactttaaaacatctccaagtcacatccttgtactttgcaatccatttcaaattatttttatactgttgtctattttctcatttcttctgtctcagagagagagaagaaggcatgcaactttgatattgcttggatttctgtcaagagggatcattttcccctgtgcattgctgcctcctccttgcacccagtgcctttcgacatggagtaaagaatgaagtccacacactcccgagacctattgcctgatgtgaatcctgtctcagccacttaccctctgtgtgactttagactgcttactacatttctctgccttggttttttcattggtaaaatggagataacagtactcactttaaagggttactaggatgattaaatgagcctaatatatgtaaatagcgtctggcacatagtaagggttccagaagtgttagttatttttattatttttgttatgcaaaaaagctcatccaatattttaagtgtcttgaaaaattttaacatccaagctttgaatctatcttatatgttggtcccttttctaatgcatgagatgctaatcaaggctttgaatgtcctttttgctttcattttcgttttgctttctggcccagacgcatttcatttttcaaaatacttctagtttttttttctctttggggggtcataataagagagcttgaatcatctagagctagttctctcaaagtatcccctctaaataaatgtgatcagccttactcttcctggattgaatcattcctcttgggtggtgtcgtcttgtgagacaattatctcattcaggtccaatctggctgtactgcctgactccctctagtaagtcttatgtttactatgtcttttgttagaaacccaaatcctgaaattgttggatgtgttcttttggagcactggtacacaccaggggcctgggggaacaggttttaaggtatgtgtatataggttttgcatcattctgttagaaatacaatatatagttacaaatacaaaatcagataggaagataaatatttatttggaatgaggataaaattacaacaaattaataaaagcttggaagttcaggtcccttttctcacttgacatttctttagacaatttaccagaaatacattcacaggaattatttaaaaacttcagaattcaagtgatgtcaacaaattgagaggcaatttaggaaaaatgtatttctccatattattagttctttatgtattatagatgaaaagtgaccaataaattacacttttcccctataataaaaatagaaaggctgagaattaaatgattcaaggttttaaatttttgtacatagaactcacaaagggcattagttttgattctaaaaagtttcttctgttagaataaaggcagtaggttggtatattatcctgggattttttattgaagataaaataaaaaattaataacaaaggggggatgatatcactttggatttctaaatttttgagtgcaaatttttcatcctagtagactacaagctccatgaaggcagatttattttatttattttagtgcttcctactccttgacatttggcatagagttcaatgttttgcactggattttattttgatgttcagtagaaataaatatcttctgatgattcaaaaaaatgtacaagagttttctgtgttgattataaataagttaggatagatatggatttatagtgtttttttaactattgtctggagagcggattatttttaaatattttaatcgggaagtcttaattatatacatttttgtgataaaatatgtttttgtatatgtatacaatgtggaataattaaatcaatatgtttaatatatccatcacttctcttacttttttgtgatgagacatttgaaatttgctcttctggctattatataaacaatacatttttattaactttagtcaccctgttgtgcaatagatcttaaaatctttttactcctgtttaattgaatctttataccctttcgtcaacatctccacattcctccccagcaacctggctcctagtaaccaccattctactctctgcttccacgactttcatgttttcagattccacctctatgtgagatcatatggtatatgtctttcggtgcctgctctatcttacttagcataatgtccttgatgttattcatgttgttgcagaagaattttcttctttttaagaccgaacagtattccactgtgcataagtaccacatttttttagccgtttattcactgatggacatttaggttgatttcacattttggctattgtgaacagtgctgccataaacatgggaatgcagatatctcttccacatattgatttcagtttctttggatacatacccagaagtgagattcctgcatcatatgttaattctatttttagtctttctgaggaaactccatactgttttccataatggctgtactattttacattcccactaacaatgtacctgtatgagggttcctttcagttcaggtcctcatcagcacttacctttctttttgataacagccattctaacagatatgaggtaatatctcactgtggctttagttttcatttccccattgattagtgctatcaagcatttgttattttttttttcatgaacacattggctatacatatgtcttctttggtaaagtaggtgttcaaaaactctgtccatttttaattgtttttttttcccttgctactgagttgagttccttgtatatttggatattaattccttatttgatatatagtttgcaaatattttctctcattctgtaggttgtttcttcacttcgttgattgtttccttggttgtgcagaagcttttagtttgatgtaatctcatttgattgtttttgcttttgttgcctgtgctttcaggtcatactcaaaaaatcgttgcttagaccaatgtcatggaacttttcccctatgttttatcctagcagttctatgtttaagttttagatcttttgtatttaatcattttgagtttatttttgtatatggtgagagataagggtctaatttcattcttctgctgtggatatccagttttttaaagcaccacttattagacagactgtcctttttccattgtgtgttcttggcaattttgtcaaaaatcaatttattataactgtgggtttatttctgggttttctatcctgttccattgatcagtatgtctgtttttataccagcatcatactcttttgattatactagctgtataatatattttgaattcagggagtgagatgcctttggctttgctctttttgcttgagactcttttggctgtttggggtctttagtagttccatgcaaatttcagaattgttttttctatttttgtgaagatgacattggaattgtgatacagtttgccttgaatctgtagatcacttttggtagtatggacattttaacaatattaattcttctaatcagtgaacatggatatccttctatttacgttttcaatttctttcattagtgtttcagtatacagatctttaaacttttttggttaaattcacacctaagtaatctatttttgttgttgctatagtaaatagaattatttttctaggatttttttgggtggtttgtatatagaagcatgactaatttttgtacgttgattttgtatatcctgcaactttactgaatttatttattctaatagcttttggtggagtctctaggcttttatacttataagatccatattgtctgcaaatagagagtttccctgcttccttccctattgggctgtattttttttctttattttgcctaattgctctggctaaaactttcaatactgtgttgaaaagaagtagtgaaagtgggcatacttgtcttgttcttgatcttagatgaaaaattttcaacttttcacctttgagtatagtgttaactgtaggcttatcatatatggcctttattgtgtttaggttcattccttctgttgagggtttttattattaacaaaggtcaaatacttataaaaactataacccatgaacagttggatacttataaaaactatcacctgtgaacagcttttagcccaaagtccatttataaattaattgtcaagcattcagaattttccaaagacacaatatgatagaatcatagaattgtagaacaggaagtcaactcaatcatctagtggaaactctttaacctaaatatgattgttaatcatcgttatttaaaacaaaagaactaactgacaaagtcatagagtacccaattttccctcatttgctcaaaatatatctgaaatgttatgcttttataataaagaagaaaataacattttaagatttatagtaaatctttaatgaaaaaattaaaaattgagtagtttctcattgtttcagtacatttaattagaaaagtattaagagttcgatagagacaattatgatgattttaaggaggttcctggaaaaccctttacagtatattcgttattaatttttgtttcaaaatatcttactttcctttttcttcccttttttcactcacaggatgttggtgagaacctttctttttcttaatgagaatgttttgataattctgttggctttccggacataattagacatgtatttttgtcttaagaaataaagaaatgaagagataggggacttttatttttatggatataaagtttggaagagaaaggaaagggaggagagctttaaaaggatggtttatgtacacataaaagaaatgatctgagcttcgagccattaaacattgctttgtctggaatgaagccattttttattttgaggtttcctctgatgaccactagctggcactctcaatccagaacagccctgtcttttgggatggcagaaaatgtgggcagagataggtgggatcttacatttattcaataggttgttaacaagttggaggcttataattcaaggcatgcctattcataatgttttacctaacgtgtacactcttatagccaattgtttaggcgggattttctacctagggcagtaccttcactagggagcatttgaaatgtatacacatttatagttattaccacgactagaaggaagtgggggattttaaacctttagtgatgtgaagtaaaatcttgcacactgtcccaaccaaaatgtcaataatcctccttctcccatcttcccttccccttaaggaacactggtctagatgatattatcttaaacttactcaaattagaggagttgctatagataatcgctaggatttcattaaccttcagatttccctagatcttgatttcagaaacaaatcattctttcctgaaaacttgctttctttctctatttctatccatatcactacagttagcctgtaaactcctggaaaaaaaagcaaccctattagtttggtgctcttgagagtttttattgcttatttcagtgcatgatacatagctgacattcaaaaaatacttgtggaatgcctgcatttacccagtaattaaagtatgaaaatcttgcaggcatgttttgttaccttttctctttatttctccatgtgttataattagattctgctgttccattgtatctctattgtttatcactcattttttaatctactactccactctagcttttattacctgaatccaggactaccaaacttataagtggaattacattctcaaatctcttctcatcttaattccacattatgtactacaagttaaatctattttattcatatattttaatagattaatttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccgaagtgctgggattacaggcgtgagccaccgcgcccggccaatagattaatttttgaataattttggctttacaaaaaaattgagtagaaagtataatttccatacataccttgacccctccttcctagtttcccatatgatcaatatcttgcagaagcatggtatatatgttgcaatttttagccgatgttgttatttactattaactaaagcccatttacattaggaattactgtttgtgttgaacattgcagggcttttgacaagtatataatgacatggaacaaccattccatgtaatgacgtgtgttcaatgttacagaataattttactactctaaaaatcttctgctccatctcttctccctcccttctccctatcctcaacccctgacaaccactgatttttttcctctgtttccataattttgccttttttagaatgtcatatagttggaataatactgtatatattattttcagattgccttctgtcttagtctgttttctattgctataaaagaatatcagagattagataatttataaagaaaataaatttatttctcacacttctggaggctgggaagtcaaagggcatgagactcgcatctggcaagggtgatctaatggtataagagtggaaggcgaaagcaagcttttgaaagatagagaagatagagaaagacaccaaggactagacttgctttatatcaatctcatgataattaaccttctaatgtgataatggcattaattcataagtcataccctcatgactcaatcacctttattaagccccaccttacaacactgtggcactggggattaagtttcaaaagcatgaattttggggggcacatttaaaccacagcagcttccttcactaaacaatatgtatttaaatttttttctctgtgtgtgtgtgcatggtgtgtgtgtgtgtgtgtgtgtgtgtgtttggcttgatagctcattccttttattgctgaataatatttattgtatggatataccacagtgtttttatccattcacttattgaagcacatcttggttgctttcaagttttagcaattacaaataaagctgctatgaacatttatgtgcaggtttttgtgtgaacatgggtttttgggaaaataccaaggagcatgcttgctgaatcatatgataagcttatgcttagctttataagaaactagcaaaccgttccaacgtggctgtaccattttgtattcccacccaaaatgagtgagtttcttttgctccataacctcatcatcatttgtgttgttggtgttttgaatattaggcattctagtaaatgtgtagtggtatcttgttgctttagtttgtaattccctaatgacatatgatgtttatcatcttttcataagctaatttccacctgtatgtcttcttggatgaggatctgttcagattctgtctgttttaaaattggtttctttgttttcttattgttgagttttaagagttctttgtagattttggatgccagctatttatcaaatatgtgttttgcaaatagtttctactatttctatgtcatttctgtgtcttctttggagaaatgtttattcatgtcctttgcacattttttaattgtgttgtttggttttctattgagttgtatgagttctttatacattttaaatattaatcccttatcagatatattttggttttcaaatatttttcccaagtagaggctactattgagtttatttttgtgtatggcataagataggggtacaatttcattcttttcccattttaaaattcataaggaaacataaaggaccccaaatagtaaaaacaattctgagaaaggaaaacaacgttggaggcattctatttctaattttaattattttttaaaaattatttttatgtattgtttttaaattggtatataataactgtacatgtttgggggtacatgtgatacccccaatctttataaaagtaccaatggcattcttcacagagtaccaatagtacttcgttaaagattgcattgaatctgtatattggtttggataatatgaacattctaacaatattaatttttctgatccagggatgtctttggggcagtgtatatctttctatttatttgtgtcatctgaaatttcatcactgttttataattttcagtgtacagatctttcaccttcttggtttaatttattactaaattgggtttttttgatactatcataaaggggattgctttcttgattcctttttcatttgtgttgttatttgtgtataaaaatctactaattttttattgactttgtatcctgtaaatttactgaattccttcattagttaaaaaatcataattattaaaattaaaaactcaagaccactctttgcagcttcctgtcagctagatttggccataagacagtgagtgttcttgccaacagaatgggaaaagtagttgtagaaattctgcaacatgagttaatcacaaaagaagattgatacctaaagtatgtaaataattgctacaaataacccaatagaaaaatgggaaattgctatgaatagaaaatcatcaaaaaaaattaaaatggccaataaattcatggaatacaaattaaacaagacacaaatttcatccataaaatatcaactactataaaagtttgataacttcaagtcttggtgagaatgtgggaaaagatctgctctcatatgctgctggaaaagtggcagatgtatagggagaatcaccagaaccaatttcgtgggcatgtgacttatgctccaaagggcctcatgctctgctgtcatcatcttgaaatgcttagtaatttttgaacaagctgctcacattttcattttgcactgggccccgcaaattatatagctggtcttgaaactcaccaaatcagccatgatgcaatgaaaaaacaaaaagtacctcaatatttgaaacatatgggtgtttaatacagaaatctagttaccaaagagttaaaagatccaaaagaggagggtgagttaacacaaataagtaactgcgcaaagtggctactaccctaagacgggggccttgaaagagcagacatggtatggagtatgaaaagaggctctgggattgtctaggaggaaccacccagataggctagaactgctaagaagggaccagaaagcagatagtgagtctacccaagaatggctaaagatagtgggtctacccaagaatgcagatagtgagtctacccatgaatggctgaaggcagaggaacacagccaattccagaaatgtcaccagtaacaggataaagagaaagcaaaaatataatgtttttttcctcttctgatttctagtctactacctgcgccttctattggcaaaatctaataggataagacagttggcaaggaagcctatgaagtgcagtttgctaattcccagactcaacattccagaacggatagagagtgcattatgtgtttataattaactattacatgcccagtaccctaaaagtacctcttagtattttaccccagagaagcacccacacataaataggaaggcatttacaagggtgttcactgcagcattttttttgagatagaaaaaaatgaaacaactttagtgttcatcattaggggaatagttaaataaagtatggcatattaataccatgaaatattatgaagaagttaaaaagaatgacatatctatttgttcaaatatgggcaggtctctaagtcatgttgtggatgggaaaaaagtaagttgcagatagattttataatatggtatatcttttgtatacaaagaccacacacgtaaacataaatctgtaaatatctactggttcactgaaatgtatataaagacacaaaaaagattaaaagaatattcactgatttaacatgggttttctctgagggtggtgaaaaagttcaatgttaagtgatggtcagaatagtggtcaaaataaaattcaaagtaacttacattgttttcaattttacaagagatttttctcttgcttgtatactctttgaattactaatttaaaaagaaatgaatactcagattcaagacttactataaagctacagcaatcaagacagtgtggtattagcaaaatagacaagtggatcaattaaacagaatacagagctcatgaatagacccacacaaatatgtcaactgatctttaacaaaggagcaagccaattgaatggagaaagtttggattttcaataaatgatactgaaacaactggatatccatatccaataaatatatgtgtctaggcagagaccttacattattcacaaaattaactcaaaatggatcatagacctaaatttaaaatgcaaaagtataaaaccatataagataacaaagaaaaattctaggtaacgttgggtttggtgatgacttcttaggtaatacaccaaaagcatgactgatgaaagataaaatgattaagctgaacttccttaaaatttaaatcttctgctctgtcaaagacactgttagaagaataaaaaggcaatgcaatttacctgtgtaacaaacctgcacgtgtacccctgaacctgaaataaaagtaaaaaaatagaaataaaaaatgtggtttatatacccaatggaatactattcagccctaaagaagaatgagatcttgccatttgctacaacatagatgaacccagaggcccttatgttaagttaaataagccagacacagaaagtaaaatactacatcatcccacttatatgtgaaatttaaaaaaacgcaaatacagagatagagaacagtggttactaggggcaagggtgaagggaggaaatggggagatgtaggtcagaggatacaaagtagaatatatgtaggatgaacaagtgaagagatctaatatacgatatgaggattataggtaataacattgcactgtatttggaattcatgctaaatgagtagattttagctgttcttgccacaaaaaaaaaatgggtaactatatgaaatgatggatatgttaatttgcttccctatagaaatctttttattatctgtatgtattctagaacatcatgttgtacacttaaatatatacagtaaaaataaaatttaaagatactaaaaatatatgtaattttcaatttgagaattttcacttagttcttcaagtttgactggctattcctgatattctcttgttattaatcatcattgtgattccctcctttattttcataaagattttatatataacttttatattttatatctaacatagagtaatttataggcttagggatataaatctgatgttgttgctgctggcttgcgcttatggcagcttgtctttccaggtgatctttctgtgaaagatttgcttattaacatgtaatagtaacatgtggcctaaattatgaaaaattcttcaacagagaatttatatctatctcttcctagggtcagtgtgcaccatcaagctaagctactccattctccttcaagagtccttccacaaagatggctgggctcccctccttgttccttggtcatggctcaattcctcccacccatgctccttcgtatcagtgactgccttcagcacaccctacccctcctctctgcccattggtcacatctcaagtatccactcactttcccccctcttttcttgcaatgtggtgggcctttgagacctaggtcacctttcataagaccaataatgcaccagaaatttgttatgcaggatatgtgcaacaacagggctctttagagaattaagactgccatgctgcaaaaaccttgaagattttttttctttttttgcattttggcatgtgtgcgtataaggtatgttctaaggtataaggtatgttcttctaaggtataagatacgttctacactacaggaatatgagtgccagatatttcctttttaatagttctgttctcatgataaaagtttttcctgagtctgtgtctaggtagtttttaataaagaaatctttctcataactagattttttcagtcttaatcgcatttaacatgacaggcattgcatttgtatgtattgctacaggaagatttgatcgtgactcacattcttgtccttttttccattaaaagtgaggcttctagccctgtgattttaataaaatttttaaactgtctgatatctaaatgctgtacattctgtacctggatttacattaacaattaacatttttacttgcctaatagactataaacagtgggcctgaagttttacttttattatttctagctactataacaatcctaaagataggaagtccttttctaaagataaaaaaaaatgaaaggtttaaatacttcatataaggttacaggacttcagttttatatgcaaatcagatattgattctcaaagtagggagaacttaagttagttatttcaggggaagtaaaccttttatgactgatcaatatctctctaagaggtttacattcaatcttgcagttaactttgtcaaacagatctttaaattttccttcagaactttatgaaaatgaaaagtttgagattaatcttaatatttaattgcaatggcatgtggaacttctttgaaaaaatataattttgaaggcataaaatcattggctaatgagctttgtccatgaataaggctagaaactcacatttccaaaaaatttttaaataagaacagaagagactgaatagcatgaaactttgtagtggcctaatgttaaatacactgacatttttatggaatgtttatttttcaactcattgtaataaaaggatgacatacattatgaaaatgtgtttatatatgcaatatgcatattgtatatataaaatatagagtcagcttaattcataccaaattgtacctgcctcctttatcaggatatcacttatatttcttttaattttcatcaaatacatgtgtagatgctatgatatttgtaagacaaattcaggaggaaacaatatataagtgaatgaatatattcaacttttatgatttgccttagttaacttaaaataaaaaatgtgaattgcctcgggcaaacacataaatataattaatcaataaatatcttattaaaagcttattatgttttcagacctgtgagcaaaactgaatgagatgcagaagaaatattgtattagggtatttcgggctgctatagataaacactaaatctcagtagctttgcacaatataattttatttctttcccacataatgctataaaggggtgcttttcattgacagtttgttcttttagtttaggaactcaggcctctaccaaacatttgctcttcagtctttattgtgtggcttccagggccaccttggtcctctgcatcaagctggatgggaaaaggacattgagaatcttatgtggaaggatcttttttggcacatccttctgccttctctttcatattccactgggtagaactcagccatgagaacatcgagtagactagcctagaccaggggaagggtgatcacttaaagcctttggtagtattccctgactgtatgacgtgttacttcctgccttctctaatagattttgcctctgatgagaaatggaagacccttaatcttagagcaagacaattggaatgtgttcactcatttttctactttatataagcgtaggcaggtaatttaaactttatatgcatcatttccttatccataaaatgacaaatacatttctaaataataatacatccaaatctaatatagtcagtgattttatatctaccttaaagtcttctgtatgctcctccaaactttatctactttttgggtacacagctagactacatttaccaacctcccttgtagttagagagactgcatttatcttcaaatatagtcacattgggtgtcagagctttaatatatacctttttgggagttggggggggagccatacaatccatagcagttattaacatttaaaaataagtcatttttacatgagagtacagatctctgacttctgtagaaaactacaggatctgaatacactgaacttcttttaatacatgagaaaaatggtcttaagggtgaggtcacaggtccctccatgtgggcatgctcttttcagcttaccacagttcccaccttatgacacttgcttggacacgataagcatttaattttataatccctgtatatagagaatcctgaaagtgttctagagttctgctgtgtaaacctatatattttgaatgtatttccctttcatctgcttgaggaagttggagttattttcttatagatgagtttattgcaggtaagcttcaatgaagtggcaacttctttgtccatgggtaggatttactcatagcctggtaaatcacgaaaaacatcttcaggacagaattgaagggtcagataggtatttaggtccatgatctactctccaactctaccataatgctaaacatttctttgtccctagcatgctaattattttatgtttcccctcagctacttctatattccatatttagatacatttatttacagatttcacatggttttagacaataatacttttctactgaacacacagacatatgttgttgtttcaatgagaccctcagaagtaggaatatgttccacattacatttttgggacatagaatataaattatagcattacaggccatttaggggctcaatctgaaaaatcatgtcatctctagctctagcatttgactcttccatttcaaccttccacgtatttcacttcttggacacactacttttggagacccagatcatagacactgaatccatgtacattacccaccacatcttggaaattcttgagaattaggtgaaggaggcagctaactaaggttatacacataaagtgtataagtgtaactaaggttatacacataaaaaatgacttgggtaaaagtcttagtatttggaaataaattttttatccactccaaagatgatctatccagagcacaaattggaataggattccaaattttgtagtataggctgcatatgtctacacttttgtacttctttggacctcagtatcttttcaggaacaaaatgggtaggagtatctagttaatacagttatgtaagatgcatatacattacttagaagagtgcctggcacatagcaagaactaatgtgttttattaaatgggggacagaatatcccagaggttaaaataatgggttttggagtcaatttagttttcatttgtaccgtatatcctccacttcttagttatatgaattaggcaaattattaaggttgcagtttctttttgtgcagaagggtcaataaagtatctcaaataaagtatattgtcaggttatataaatgtgcaataatacaaaacagtgtaaaagatcttagtacaatgattcgaatataacaagtatccagtgaaaaacaggtagatgtgtaaaacagatgattgtagaatgtgagttacaaacagaatttttttttttttcctgggaagcctctaataaatcagtggtcagattttaaaaagattcgatgcttggtgaatgtatctatacactgtgagaaagtgaataaaaatgcctaatatagaaaattacatcatattgtgttgtttgaatcaattatgttacatgaaataagatttttaaagtctatagaatttgtcttgtgtaaagcatcaatatggtgttttaggaacattatccaagagaagaaaaagctgttataaatatttcagaatgtgttgttattatttacaatgaaaatgaaaaagactttttaaaaaagccttctcttgaggattttgttgttcattgtcatgcggcaactattggctaagatgtttgtcagtgttcaatttgaagtatgataattttttataattattgaaataagctctcaagatgaatgtttagcattttttaaaaaattgaccaacttttcatggtgttgtcaattgaaaattgaattaggtggattttccagaaacaaatatcattacctaacatttaatgacaatgctattctctgaatcttgcttattggcatttttggtatttgccatgaatcaaggtgtagctacatataagagtcatcctgaggaatagatttaaaaaagagaagcccacccagggctctactgttggagtttatgattatcaataaatggatcagaaatttttacttacaaaaagcatcgtaggtaatttcagtgatctgaatttggaaaatgctcatcttttgttcttgtaacatatctttattctagacctaaaaaatactgcctgcgattttaacacatgatggcaaagattcaaataaatactctctctagtaatgtagatgtaaactattttaaataatttcagggggattttaattctgtagtacattatataaaactttaatcaattatagaaatatgagttttaaaaagactgaacttcaaaaattaaatttttgacattgacattatcatacattatcatacattttgtatttcttaaaatgtttctcactgagatttggatatttttaaagcacaaaatatttatattttatatttttgttagttgcttcttagactaaatagtatagaattgatacgtatatattgagttaaaaatctttctcttggaagctgttatcctatgacacttacaatttaatttctctcttctttttaagccggagtatgagcaatatcttatcagctcacgatacatttatgaagcaatatcctaaagtattcctgcaccaaaaacccagacttcctaaacttttcaaacaggaggaacaaaggtaatgataccttcttttgaaagcaaggttgatgggtgtgtatgagtgtgcttgtgctcacacaagttgaactcaaaactgaaaatatttgaccagtttcagtcaaatatttagtgtggagggctagggagcagccaaggaaacagaaattagttggtaagggtaaattcaatttttgttcagcaaaaatacgtgtccactgctaaagatcatatttatttaaactttttatcaaagaattgttgccttttactaatgaacggcagtgtttatgaaagggattaaaatattctacagggtttcatgagaaacttcccaatggaaatgattagagtgtttgtgggtggaggatatttggaggtgtgtcatgtatcaaggtataaatcacaaagtcatggggcactgaaaggcatttgtgaagccttttttactgggctcctgcttctaggtggacctacatttagatgtgctttatgtatttttaaagtcaaagaatgagattacttaagggtgttgcggaaggtgtaactgccctctcagtaaaggatgaaggtagattgccagatcacattgtgatgcagctcctctcaaattgtccctggctccagtggaactgtaagtgtcttatatcagtgcagtaccagatctagaaaggcattttcacttcctggatatagttgtctttgttgttccttaagtatcttatagtggatatggaaacctcctactccatactattcaagtagagttgatctgttcacatccttggctaccccactgccatactccctaataacttctattgccatatctgtaagactgtattttgcttgtgtgtttgctagtcagtatttttatttctgacatttagcagagggactgacctgtaattgtgaatagtagatgtgtgttgccccatgggcaaactgcttactggctgtgtaagggagctgatcaagaatatgttttcatttatttatatcaatgatacaaatgtaaaaattcaaacaaaattattgtaacaaatatgtctccaggggttggaagatatcagcatgagagacatagatctatttcattatcctatacctttcttttctttatagccatagggcagtattatgtaaaacataccatattagttgactgggaaaaatctctgggagatggagttgctctgccttttcaagaacaattctgttaaattaataaaatcttttgaaaacagagattcaaatataactttttccaagactgtatctatcatgtagatcaaactacatccctagatgtacatacatctggaatgatcatacaatgcttatactgtgatttatcaagttaacatcactctaaaaatatctgataaaaatactttgtactttttgattccaagtatactcaatttctattctaatcttgttgattagaaagagacctgtaaatgtagctctgtctatagaataagggaccaagagcttttatggatagctgatatgatcatcttgccctcatatttattcattaatctaccagcagtggtctgcttctttagttaagacattaaactttgagaggacttcagggaggcacccagtggctgtcaacatacttggtaatgaaataccatcttcatatttttaagaaaagagacagatcccaaatgtgttttaacagtaaaactgtggtttaaatgtgaaaataaagagtggactgccaaatacacaagaactaggacgatacactatactaattaagatttgtttaagtgtctgaaaagccaataaaattagcttaagaatcaaggggaattttaagaatcacattttagaaatgttttgctgtagagctaacttcaccattaaatgatggcattgggactcagtttcctctgtatctctgcctcctctttgctgggttggtttcatcgtcacacatcatgtaataggtctgggaagaccacattcatttattttactgttcaggtgagaatggaggtgttctgaaacaggcccagcaggagattcactgaaatctctaaattatatcatatccctgtattgtcactgttgtgaatttgccaatcttgaaccacatgcccacctgaagagtggggaatattgttgacactatatgaagcacatgggataagattagaagagagaaagtggaagctcagaagaaaattaggggccgggcgtggtggctcacacctgtaatcccagcactttggtaggccaaggcgggcagatcacctgaagttgggagtttgagaccatcctggccaacatggtgaaaccctgcctctactaaaatacaaaaaattagccgggcatggtggtgggcacctgtaatcccagctacttgggaggctgaggcaggggaatcacttgaacccaggaggcggaggttgcagtgagccaagattgcgccactgcactccagcctggagacagagcatgactctatctaaaaaaaaaacaaaaacaaaaaaacaaaaaaaaaccccttaaactgaattaaatagaatttcctaaagtatattaagaaaattgtgaattttcttctaagcttagtatacatagttcccacattcagtgtgatatatctatagataccctgatgattgaaactcagcttatgtaaatccaagaaatttttaaaggaataaaactgatgaggaaactttcatgttagcagacatgaaatacctacactgttaacatttacactattacagttattgatcaacaatatttacctgttatcattgtcatatatttaacactgtaattcatttaacacaaatattatgtgacagctacaacagcaagtaaggcacctgcctggttgtgggcagctggtgatgccaggtcatttgataaatattgaaggaagacagtcatgttcaaggagagtaggagaaatgctacatagaaatgttaagtccatgtggagcaaggcacacagatgaaaataagcagaagacctggctgagacgttgagaaacaattctatatgggcaaaaattgaagaataggataagaagatgaagtattgcttgggactttgatcattatttaaaatttattttattcatggattgataagaaggtaaaattttggtatattcatatatgtaggaaatcaaatagaaaagaatctgtgttgttttaaaaagaacactcagtgttgacccagaagacttggttttgtgtttttgtttcactcaatagcagaaacatgactttgaagaaagaagtctgttaactcacactcaggttttactcagaaaagggcagacaatattaatcccctacttcagagttatgcattgaaaaaacttttaaattgtgctagttttcattattatcatgcactataaatggcaatgatgttttatgtacattataccatctgtcaagaaattgaccttttttcaaacagattaaacaaccgcaacaaaaagaggcaaacttcaccttatataaagtaccagtatgtttaaagggggctgtgaaatgaaatgatttccatattccaatggccagatgaaattaacaatgttgtgattatcatcataagaattctttttttttttttttttgtgctgagggcaggagtgcagtggcctgatctcggctcactgcaacctccgcctcccaggttcaagtgattctccagcctcagcctcctgggactacaggcacccgccactacgcccagctaatttttgtatttttagtagcgacgaggtttcaccatgttggctaggatggtctggatctcttgacctcgtgatctgcccgccttggcctctcaaagtgctgggattacaggcgtgagccactgcgcggggccaagaattctttttgatgatactgtacaataattgacttacctgttcccaataaacataatggtcattttttttaaaacaacaacaacaaaatgtgattgccattttgagccatcttaactcattacagaaagatgggccataatccagatttacatctatatcttatatttagaatacataattgtaaaggtactaatttaaacaaaatgctagtttttatgtaaatagggagcccttttgctttccacatattctatgcttattttagaactttctttttcacaaaaattataacttcactaacttttgatattttcatttactttttaatgacagtcttggaagtatcgtaaagctagatggtttcctgagaatagtgcagttaaagggaatttggtaaatagtttacattttttaaatgtaattgtaactttctacacttgaaaaattcctaaataaacattgcagtgtggttttttttttattatactttcagttctagggtacatgtgcacaacgtgcaggtttgttacatatgtatacatgtgccatgttggtgtgcaacattgcagtgatttttactcagaatatgtaaactgcagctcaatctgtttgcctttgaacatttactcaaatttatactctccaaactttattgtcagtactatgatgagaaatatttttaaaatctgagaaccctggcttaagatagaaagttatgatgcttgtagtttaaatacatagaagagaaacattctgccgtcaagaaatcttccgattttgtgttaaattggacagtataaccacccttttctatattgacatccaactgtttcttttattaattaatccaattacttaccaagtagctattatatagcaggcactgtgctagtgtagagtaagatgaatgtggtccttgctcctctagagtttatgagtcagatcttctcaagggagacagccttaagcaataatcctgctaataataatttaagcacgatttgtcttcatgaattcatctttcagtttttagatcggatcatgaattagtccaggcttttagttgtaatcgaaattggactcaaaggaacataagttcctctgaggaacattaaaaaaaagttgcctattgattcgcctaacctactggaggatgggaaaagccagccttagagaaaagggatacaagatctggagtgcttgtcggactctctacttctcatccctgctcatatttgtagattatcccaattccctcttggtgattgtgacctttctccgtgtggcagggaacatggttaccaggaactttgaacttgtaacacctgtaacactggagagaaaaaggaatttttttcaaccagaataatcctgaaaaaggattgagattggctgcccagtggcatagaacctgttagcaaaagaaatgggggagggggagcatcctgcacaaagaagatagccactgtaaacaatgagtgctttcctaggtgtaagataaattaatacatatagtcacagtaaaattgctacattgtttacttcaatacatttaatatctaccctttaagcaataagaaaagacatagatttttaatcaatgtgtgtttaggtcagtttatgtcaggagtgaaaaagaaatgaagtggagtcattgtctggggtaatacccaaggtttgttccatgaccacggaaaactaggacgtggacacaacagagtgaggttaagagcagaggtttaatagacaaaagaaagggaaaagttctctcctgcagagagacggggtcccaagtgggtcttctggtccccagtgaagtgcaggaggttttatagatgagcttgaggaggtggtgtttgatttacacagggcacaaaaaattggtcggatcaggtatgctatttacataacacgaagaactggttaggattagttgtgctgtttgcatatcccacgaagaagctggctacctcaccctaatcttttattatgcaaaaggattctctacctcaccatgttgcctgcttttctactgtacatgtggtgacaaagaaaagggaagatggagcctccatgttgaacatacctggtttccaggtagcccttttctattggcacagctgttggcattcacccatgcaagcttttagcttgcttatctatgtttgcagctggattactttcaggctgctctttgttagaaaagaaattatttgggggctgctttttgttaaaaggcaagccttgctgaggactccttcaccctcactatctgcctaaataatttctttttagctcccatatcaaaagtttaaggaaatgttagtaattgaggaaacaaatagtaagcatccaaagaattatggaaacctttgttaaaaatgtatttattcaaaatgtggctttttattgatacatagtagatgtatgtatttttggacatgtgatattttgataaatttatattgtgtataataatcaaatcatggtagttgaaatatttattaccttaaacatttatctatgctgggaacatttgaattattctctactagctattttgaaatatacagtagattattgcttactgtagtcacaaagaaagaagtgatattatccttgttcataaatgacatgagcttatatttagaaaaccttaaagattccatcaaaaactgttagaaatgataaaataattcaataaaattgcaggatacaagagcaacgtaaaaaatcagtagcatttatatatgccaacagcaaacaatctgaaaaagaaatcaagaaagcaatcccatttacaatagacacaaaaattgtaaaatgcctaggaaaatatttaaccaaagaagttaaagatctctactaggaaaactataaattttaatgctgatgaaaaaaattaaagaggacacaaaaaagtaagaagatattccatgccccggactgcaagaataatattattaaaatgtcagtattacgcaaaatgtgacatttttatgggggtggaaattgaagtatttacaaagaaggctgcttacttgttataattttatttgacttttataaaaatgttatcagattttgaccattttagttccagaaggggttagtcagcattaaaatatcaaaaaaattttaaaaaattcagattaactttaacaatgtatagtatttgtactagattggtagatattaggcaaaatgtttatcaatgaggggtacatttttctaaagggtgcagaccaaaaataatgtggcagaagctaaggggaaaccaatgatgtatttgaattattagctataatacttcttccaatatgcagtcatgcactgcataacaacatttcagccaacagtggatcacatataccatggtggtcccataaaattaaaatggggctgaaaaattacctatcactcagggacttcatagctgcctgtaatgtcatactttaacatattacttatgtttttatgatgatgtcaatgtaaacaaatctattgtgctgccagttatataaaaatatagcacacacaattatgtatagtacataatacttgataatgatgactaaagactatattatttatgtatttactataacttttattgttattttagagtgtatttattctatttatattttaaaaaaaaggttaattgtaaaacaacctcagacagtcccttcaggagggattccagaagaaggcattgttatcataggaaatgacagctctgtgtgtgttattgtccctgaagaccttccagggggacaagacatgggtgtggaagacagtgatatcaatgatcctgaccctgtataggcctaggctaatgtttgtaattgtgtatgtgtaacaacaacaaaaagagcttaaaaagtaaaaataaaaataaaaaattttaaaaatagaaaaatgcttataggataaagatagaaacaaagagcatatttttgtacagctgtacaatgtgtgttttaagctaagtgtttttgcaagagtaaagacattaaacacaatgaaaaatcttataaagtcaaaatgttacaataagcaaagggtaatttgttattgaagaaagaaaaatattttacaaataaatctagtgtagcctaagtgtacagtgtttttaaattctgtattcacatacagtaatgtcctactcactcactgactcacccagagcaacttccactactgcaggctccatttaagggaagtgccctttacagatataccattttacattgttaatcctgtattttaatttagctctaccttttttgtgtttagatatgcttagatacgtaaatacttaccattgttatcgggggaacctgcccccgataattcttcattatttcacataggttattttctattttccctaagtgttggctggtctgagaaataaagggaaaaagcacaaaagagagaaattttaaagctgggtgtctgggggagacatcacatgtcggcgggttctgtgatgccccctgagccataaaacaagcaagtttttattagcaattttcaaaggggagggaatgcacaaatagggtgttgttcacagagatcacatgcttcaagggcaacaaaagatcacaaggcagaaggtcagagcgaaactagcatcactaatgaagtagacttgtcccgctgtgcacgcattgtcagggttcaagagcagagaacctgtctgagtagaattcgccaggctggaatttcctaatcctagcaagcgtgggggtgctgcaggagactagggtgtgtttcatccctatctacatctgcataaggcagaacctcccagggcagccattttagaggccccgccctgggaatgcattcttttcccagggttgttaattattaatattccttactggggaaataattcagtgatatttctcttacccgttttcagtcataagagaaatatggctctgtcccacccagcccacaggcagccagactttaagattatttcccttgttccctgaaaatcgctgttatcctgttcttaaggtgcccagatttgttattgttcaaacacacatgctttacaatttgttcagttaacgcaatcatcacagggtcctgaggcgacatacatcctcctcagtttatgcagatgacaggattaagagattaaaataaagacagacataggaaatcacaagagtattgattggggaagtgatgaatgtccatgaaatcttcacaatttatgttcttctgccatggcttcagccagtccctccgttcagggtccctgacttcccgcaacacattgtgttgcaattgcttataatatttggtacagtaacatgctgtacaggtttgtcgcctagaagccataggctataccatattagcttaggtgtatagcaggctataccatttatgtttgtgtaagcacgctctatgatgtttacccaatgacagaatttccaaatgatgcatttctcagaaagtatccctatcattagtcaacatatgactgtattcagattactcaattaatcaaaatgaaagttggttaattttgaagaaaatgttaaattaaaagtcagatatataatattaagtgaagaagtttctttttgtaaagagttaaaagcaaaaatgaaaaaaatcttgaatgatatctacctaatctacacttcccttaagctatatacttaacaaaatcaatattattttatctaaagtgcactctcagaaagaaaaaagagcagaatagttgattaatatgaattgaatgcttgagcaaatgtatcaaatggaatagtaaagaagaaacatgcttaactcaaaatggcacatgtctagcatagaaaaaagattgtaattataaccgcccaatgggttcttcttgcctgttgcccagatagagccaatttatcaaggcagggaaattgcagtagagagtttaatacacgcagagccacctgaacagggaaccacagttgtattattactcaaatcagtttctcagagaatttgggggctagggtttctcaaaggtagtttgggggaagggttgtgggtggttaggaaatgagtgcttgctactgattgattgtggatgcaaccataggaatgtgggaaatggtcctcctgtgtgctgagtagcttctgggtggggccacaggagcagttggtgggtcctggtagagccataggtcactggacatgcaaaaagcctgaaaagacatatcaaaaggccaattttagattctacaatagtgatgttaccttcaggtataattggagaagttgcacgtcttgtgacctccagcatagtggctgggaattgcttatgtctacaccttagctgaattcagtctcctctatcctcctaggtttgtggtctcccattagctttacaaatgcagttgagttttggggaagggctattatcatttaaactataaactaaatatctcccaaagttagctcggcccatgcccaggaacaattaagggcagcttgaaggccaaaggcaagatgagtgttgcccagatcaaacttccttcagtgccataattttctgttataatttttgcaatggtggtttcataatgatatattcatatacaattaactttccagacaagatgtgtaagaactctttggaaattcagatgagtactggaatccagctaataattaagagtgcattagagtgaatgtgcattgccttgacatatagtgtctattttgccactcagtaactatatgactttggagaagtcaatctatctgggcattagttaccttatatcaaaaataaaatgctcgggtagatgacagtcaattctccttttagctctattaatctaaggttccattttctagttgatgttacagatactgtagggagagaaatatatgtaatgaagataatatttttgtattaacttttgatgtatcttcccttatgagtatttccttccctgtatcccatgtgccatcatggtctcagagaaaagagcaggaaaaatattactttaagtaggaggaagatataaaatggaggtgttactggtggcaaatctgttcgggtctgcagcaacctcaatgcttgtctcctcaggagagagaatttgactaaggggcatgaggcagaaggagagactgaggcaagttttagagcaggagtgaaagtgtattaaaaagtttcagagcaggaatgaaaagacgtaaagtacacctggaagagggccaagtgggcaacaggagagatcaagtgcactgtttgacctttgacttggggttttatacgctggcatacttctggggtcttgcattccttctcccctggttcttcccttggggtgggctgtctgcatccacactggcctgctagcacttgggaggtgagcatgcacagtgtgtttactagagttgtatgcgtgctctcttgaggcattcttcccttaccacttgagtgtccctagaaagtcatatacctgttaaactctgccattttacctcattatgtgtacgtgtaagtctacttcacccaattcctgggatcttattggaaaactgctgattactagtttcaggtttttttctatcttttgggagcctgcctttctctggtgctggctgcaacattattattttattttttattttttttttgaaatagaatctcactctgtcacccaagctggagtgcagtggtgcaaacttggctcactgcaacctctgtcttctgggttcaagccattctcctgcctcatcctcctgagtagctgggattacaggtacccaccaccatgcccagctaactttttttttttttttttgagacaagatctcactctgtcacccagactggagtgcagtggcacaatcttggctcactgcaccctccacctcctgggttctagtgattctcatgccccagcctgtcaagtagctgggactacaggcaagcaccaccgtgcccagctaatttatgtattttttagtagagatggggtttcaccatgttggccaggctggtcttggtctcttgacattgtgatccagcctggtgacagagcgagactctgtctcaaaaaagaaaaaaaaagaatatctagatagttattgaggaagctgcaccttctaggacaatgataatcaacttgaactacatattagaatcaccttaggagttttgaaaaatactaatgccagatctgtgtccactgacattatgtaaattggagtccttggcttcaggctaggaccttagtaattaaaaaataacttttaggtgattattgaaaattactgctgtacaggaagacctaaattgggctcaacagaacattcaacatgaagagagaatagtacagaactggtggagacagatgtcttgtgatctacctcgagttagtgccattagatccacttggtctgtgtctagcttgcactgagggggtctagaatttcccatgaacactggtaagggtagagtgagttgccagtaggactgatgggtggtaggactctggggaggggaagaccaagctgctgagtcaggaatctgatgacgtgaggagaagagagttaagagtggatgcagaagcagaaaaatccattcattcctaagtagataccaatccagagccaacctgctggccactctgcaacaggaacatgatgatgatcagctgatagcttcctctctccaactacaatcatgtaagcaatccagccctcccccaacacacacccaaaccaagtccagaaaaagatatgaaatttacagaaaattgttaaaacagcctttatttacctgacagaaacaaagttattctaaattatactttttcaaattagtgagactgagataccataaaatggtattggaggaagaggatctgtgagctcatgagaaagttttagtttctttatagaaagtaaactattttctttgtacatcttagcatttaagtaaattttcaataccactaatctatttagctattaaaatacttatttaaactatatccttttaaaggggaatagagtaaaatgccttttaaatatgagaagctgcagaggatactgtctctttaaaacatgcaatcctaattgcccacctctcaggatgcataatggttgtagcatagttagcacggattctgtcatgacttaaaaaaaaatttgtaaacatgctttcttaaagatgcatcatacactcttcttttagtgaatggaagtgtttgacagaaaaacacctgtgtaagcaaactttgagaatatgttattagaacatgtttctttcctcactggttcatattacacaggtttacatctgctgctacaaaaggtaagtgtaagcatgctgatatgatttggttctgtccccacccaagtctcatcctgaattgtagctcccacaattcccatgtgttgtggggaggacctggtgggagattattgaatcatgggagccgtttcccccatactgttctcatggtaatgaataagtctcatgagatctgatggttttataaggggtttccccttctgcttggctctaattctgtcttctgtgctgccacataagacatgccttttgccttctgccatgattgtgaggcctccccagccagatggaactgtgagtccatcaaatctctttttatttataaattacccagtcttgggtatgtctttatctgcagtgtgaaaacaaactaatacacatgctatctttctttaaaaaaaaaaaaaaaaagatttagggagtaaaagtgcaattttgtgtaggcatcacccacatagtgtacactgtacccattacatagtttctttttcctagccccgcctttctgagtctccaatgactattatttcactctatgttcatgtgaacacattatttagcttctacttgtaagaacatgtggtatttgattttctgtttctgaaaatatcatgcttttttttttaaaaaaaaagagaaaggcaattggaactttaattttgcccctataaaaatgaaatgtcatgtatcaacaagactgaaaaataaacaatcctctcatgccctcagcagttaaccctaactatagaagacaaaacgatgtaaacaaagaaatacacataggattcattcatattgggatccagaaatacatattgtggatgacagtggcatacacactccttttggtgttaagaggaaacctttagacaaattaaatatgtaacagtttatttgagcaaagaatgattcatgaatcaggcagtactcaaaactagaagaggtttggagagccccaaccagccatgtgagcagtgagttcttataggccaaacaagggagcaaagtgtagaaattacctgattgaccagtaaggtatctgccttatttgcaaatggtgtgataaaacatctgcctttatagcacgattcaatcagttgactccctgtgattggctgaagcttagctgtttgtgattggctaaaatccagctgtttgttacaaaacgtatactcctgagttaggtttctgtttgtttacacacaaagttaagttgtggtttgttgattaggaactcaaagtactgagacagcctcaggctagtggcctcctgcttgtttaatttaacaatgggaatttattattaaaaggtaattattaactatttagaggtagaattactaggcagtcaatgacagaaagctgactttgctgtcaaagtgactttcaataaacttcagattagtgtttttcaaactttaatatgtgcacagatctcctggggagcttattaaaatgcagattccaattcagagggtcttgagtgtggcctgagattctgtgtttctaacaagctaccagctgatcctaatgatactggttcatggaccacaatttgaacagcaagtttactgtttgatatgtttctttttctttcagaatgtgaaaaaaaaaagtcaccaaactgtaacttttctattgggaaaagtttctactgggagaatttagcccacattttaaagcattaattcattcatctaagggcttatttcaatgagataaactacaaagctgtgtatgatctttggtcataatatacttgatttattaaatttagcaaccaatcgcatgttgcacttaatgtgcatagcatgtctgtttgaaatttttttggtatattttaatttaggatcttttaaagaagtccaaccagtagttattatcttaaaaagttccattttaattaggtactaaatcagataagaaaaagagagaaagaggtagcttgctaagtttaggagtttccaggcttgtaacttaaccaggtaatggtagtattttgtaaaatcattttctcttagtttgtgttatataacttacaataatttggaaggcagctatggccaccactataccaccaacacagaacttaataatttgaacagaggagaacaaaagaattttggcaatgtgcatattgtatgctccctctcccactagccccagaactccactggctactctctaatatgccaaaggcagcctgacccaaggaagtctgttgggaatgtttctcatgggctcagaagtctgtatgctcagtcacccaaattgccagtcataccaaaagctgtcaaagtacgttttaggcaaaaaattgatacataagtttggattttagattctaaagaggctaggacatcccaattgctcgaattaaagaattttactgagaattttacttctggatctaaaagcagtaaacatgtagctttgatctgggttaaaatgatgaagggcttctctgtaatactcatttttttttcccaaacacattttaagacaatcattggtatagtgtatgcatagtctagatggcctataaattctctctaaatgtgtgagagcagaaaatgttcaaaagtaaagatgaatatttggagatgaagcaactgaaaacctagagcaaatggattctgatagacttaaaaaaaatctctgcaaaattgcattttgaacttgtgagtcccttttgagtttttgcacttaatttctttctctagcatagctgaaattacccatatgatacagctacatctaagtgtacttatttcatgctagtgtggatctggcctcaggataaataataaatgtttgaaccataggctctttgaaaatatgtatttaacattagaataaatgaaattattcttgttatgactataaaacccatattttctctgagctccaaggtctgttgaatgagatgctccttgtgtttttttttaagtcagccctatagttattgttttaccaatttattctaaaaaataaaaataaaacttacactatctgaaaagaaacctcacaataatactgtattagtctgttctcacactgctaataaagacacaactgagacttggtaatttttaaagcaaagagttttcattgactcacagttccacatggctgaggaggcctcatgatcatggtggaagatcaagggacatcttacattgtgggaggcaagacagaatgagagcaaagtaaaaggggaaatgctttataaaaccatcagatctcctgacacttattcactaccacaagaacagtatgggggaaactacctccatgattcaattatctcccaccaggtctctcctacaacacatgggaattatgggaactacaattcaagatgagagttgggtggggattcagccaaactatgtcaaataacctgtcatttgtttattcagtaagacaatatacactgagcaccaactgtgtgctaagtgcaagtcagagagggcctctgtgctcagagcttggtggtgctgacagggtctgagtaagaggtggtaagtgcagtgtagggggtgtcagaggaagacttcagggcaggggtagttgcattgagagtgcttacattgagggcagatggtgtactggaagatcagagaagcagaggaggctttcttgaggaaggaatgtttaagttgaaggataagagttgtccagaagaagagaaagattatctgaggcaaaaagaaccatatctgataattcttcatgttgttgattatctaaatgctgtcaaagccaccttagctgatactctaattgcccaagttggtagttgtcaccagaaacttgttgaaaaaatttttttcaaaacctttaaatgatctcccccatgggtgtcaagatgggagtgatggcttgaggtgggagaggagacaaaaaggaagaaaggaagagaaagagaagaaagagaaataaaaaaggcaaggcgagggagaagtggacatgccaggtcataggagcaatatttggaccttttggaagttttatgaaggaaggaagaagaaagtttgtattaatagaaatctaacattgtctctgccatgctttggtcttgtcctttgtaccccaaattaacccctctaccatgacataaaaaggaaagcctggatggcttggggtattattgtagccaagtgatgacaatttgtacaaattggctacaggcataagatttgcttgcagtaaagtggaaagttacaagaaagtttcaagtctgagttaaaaaaaaatccacttatgatgataactgccactgagtaatggtagattatgctaaaaggaaggtactttcgttttatgcttccttcctgattgctttggtttgaagcatctgggtataggtgctgagaaggggtgaattgctctgcctggtagagatgttctaatttagagtcacggagcaaccaggagtgaagaaattcagagaaaaagaggacaggaaggaagcaagaggagccaggaaatgattgaagaaaggtatgcactaagtaaggagaaactacaatgttggggatgggggtgagaacattttaaaaaagaactgttaatggatttcaagtatgttgtaatatgtgatactgttaccagaaggagggccttgagagtgagttctccaggtccttggcgtttttaacaaagaattggacaaaacacacaaataaggtaacaaaggaacaaaacagcgaaggcagtgatttaataaagcgagaaagcactccacagggtgggagtggacccgagcaggcggctcaagggcccagttacaaagttttctaagtttgaagtactccttttgaagtccctatcagttatccttgtctcgatgaaggtcttgtctgtggctaattaaaggctgaggtgaattggagtcctatgcagatgaagggatggtccccgcttggcccacagccattccagggcaccttccctttctatctgagacatggtggaagggagggttgtagggagagtagcctttgatccttgctacttgggcatggggagatacggtttttccttttagtttaacttttggaagctggtgttaattggtcttagggtccctgcccctagacccaggtgttttccttttgacccagctttgggaaatcagcacagattggactcagattccccgcccccagcctttggtgttttctcttttaagaagtcagcacaaattggccttagattccttgcctccagaccccattctcctgcctcaatgcaacatctcttcaggatatcctcagtatttggtaaattctaatttcaagtgctctgcatggttgctttcatttagttcagttttgttgagaaaatattaggaaaagttggattcatttctgggtaaacaagccatagaataaagagagcatttaaagaagaatcatagaaggacaggtgacatcagaacagaatattctggggaactgctgaaagggagagctttacactttcatggatttccatgggactgtatcaagaccctaagggaccaatgagtcccagctggcatgaccatatgcaatgaagggagaaaagcccatctttgatttaaaagtagtaagttccattcaattcaattcaaaatgatatcgttcaaagtttgtaaatttcaggttttgttactattggtggcaggaaatgtacctccctatgtccttaaattggagcttctattgtcccaattagatgccccattcattacttagcactatgggactaaaatctacttgagaagtttgcaatgaaaggaaaaagaaattctgaaaattcacaggccatattttctgtaagtcttgcttgagtgaccatatacctgaatggctagaacgatgttttttcattatttctcaacaattagtaataattgtaggtagagagcatttgaaccaaggcaaattgtctacagaatgtggaaatggggttgaaaaaggagctagatgagagtcatcaagatgagggtgtaggaactccacgaatagctaatttaggaatgctaaacaaaatcaaagatccgttaaaattagataatgtagatttgtaattatccaggtgtgtcactaattcagcaatgttctgtgggtggaaaaagtagagtggttaaagtggaaaatggaaattattcattcctgggagctgagacagtgaagacaatgaatatttttttgcctgacaggagttcaacaaatgtttctgaattgaattataaatagaaggaatttaggctataagtgaaaatggaacatgatatttgatgattattttataaatacttattaatatattgctatatattaaagcttgtcttaagattatcccaactctttaatttgcttctttaatttgaatttgtacttaggaagtaaatctgtatcgtaataatcatctctgaacaagttgactttcttgcatgtttctatagcttgtcatatattctggaaaatgtattgctactttagcctaaagaatacatgtaagtccaactgttgatttttagctgtatatttttctattgcatttttggaaatgtaaagagaagaccttgagtttggcacagacattaatttagtagaaaccggggaaatattgcttacctctctctaaccttaaaatattctttcttatattataagagatgacaggatttcaatattgactgtcaagagtttatgatggaacttgtcttggactcctcaattttaaccttggatgtgtttgggaatgtgtgggacaaagtcagcactcttggttagcaaaagacaaagcctggaatttgccaacttatatcctggagcgagaatttacccatagttatttccctcgtttggtactagtgataattaagctaagcttaacagatggagttaacttagtgtacttagtgtgactgaatttaattagtatttttatgagtgaggctcacttcagtttttatttttaaaaatgatggaagaatcttacagcaaacatctttagaaagagtctgtatattactctggttctaattactacctagtaaaatatatacgggcttaccaaaaagtgtgtgtgtgtgtgtgtgtgtgtgtgtgtgtgtgtgtgtgtgtccctgtctgtatgtgatggtgggattgggggtaaaggcagtaaagaaagattttgggaactgataaaggaaaaaagtttgtaagagctataatacaggaatatatgcactttgggaggccaaggtgggtggatcactcgaggtcatgagtttgtgatcagccttgctaacatggtgaaacaccctctctactgaaaaaaataccaaaaaaaaaaaaaaaaaagaattagccaggtgtggtagagggcacctgtaatcctgtgtctggagttggttcctgctggtgggttcgtagtctcgctgacttcaagaatggagccacggaacttggcagtgagtgttacagctcttaaagatggcaggaacccaaagagggagtggtagcaaggtttattgcgaagagtgaaaggacaaagcttccacagggtaaaaggaacccaagttgtttgctgctgctggctggggtgaccagcttttattcccttattgtcccctcccatgttccatttctgtcctatcagagtgcgcttttttcaatcctccccatgattggctacttttagaatcctgctgattggtgagttttacagagcgctgattggtgcattttacaatcctctcataagacaggaaagttctccaagtccccacttgacccaggaagtccagctggcctcacctctcaatctcccctctcaactgctgttgagaactgggcaatgactgctctagctacttcctgctggataggggtgaagaaggggccctgcagttgtagtgtcctccagaggggaactctttagaccagtcaaagggccagtgggtcggtccaggtgtcctcagtagaagttttgagttgagctcatttggggttccagttgtaagaccatctgtagcttgatggccttgatcctgggggaaacaaatttgacaaggaggttaaaaatacagggcctaaaggcaagtaataccaagatggctgtcatgggacctagaaaggggagacgccatgtcacccaactccagaggttggtgtcagagtttgaaaggcattgtctgatttcagaagccttttcctgtaaacaccaggtgggtctcatactatccctgactggttggtgtaaaaacaacactctttcccctaagaaggtgcagagtactcccctctcagcagtgaggaggtccaggccccagcagtcttggagagtcaccgctgccaaagactccacctgggattgcagagtaaggacagaccctgtcatttcccataaactgtatgagaaatcctttgagagtgtgtggtagtaggataatgaagtagataaactggctattctggcttctgtagcagtagccattcctaactgtgtaagtaggggtattagttttatggccctctactgatagacttgagctttgaggggcactgatagggtctgatttcctggggcaatgtcaatgttgggacttaggaagactaaggttcaggtgcctgtgcagttggtggggaggaagatataggctgaagttccacataagaatatgccttggctgggtagacagaactggttgtatatgttaaagaggtgtgtgagtttgttgttttcattttcccatactcctagagtacttgccaaggtagctctggtgagcagctggaaaggggtgttgggagcaaactgagtggctctgtattctattttcccattggagaaaaaaccattttgtatttactaggaaccattcaagagagtaactgaaagaggggataagaaggcattcattagtgggggaggcgctgctgcagggggtccaggggtgaatggtcatgcagggagtatgcttgccattacaaaacccagactgtttgttaaacagggagaaggtgatgatttttgggggccctgagaagcagacaagctgtttgagtggacctgtttaggtgactctgaagttactatgatcagttggggcttgaagttgtagggtgtaattacattgatgggatagtaggtgccccaggggcaggcctggtaacaggttgtgttggatgcataaaggggcttggaaagttaagacagtaaacatggttgatgtgattaggattttcgtcctggcaggagctacagtatatagtcctactgcaaagagtatggttagtatactgcttaataatgtaatgatacaataaaatgattccatcaaagggacaaggagaggtgttaaagattacataggttttcacttatattttttaagtaggaaggggtttttcctcaggataagctgtaggagccttttgagtctgggatatttccttctgaaataggagacgtaagtcctccaataattcacaggtgtatcgaggctggtctggctgattttgggactcctgagctgatggtcttgcaggttcctcagggggtgtccaaagtttaactcgggtgtggtgaatccaagattccactcttgccaccttaactgcagtggaagtagagaggattactgagtatggtccttcccacaagtaatccatagatggggaggtagagggaagggacttgaccaatactagatctcctggttggaacagctctgttcccttgtctctgtgacatccttcatttagggttttaaggttttgttgatatcttgccaaagaagttatatccttgaccaagttggccgtttcctgatcaagtaggaagtcatttgtgagaaaatgtcatccatacagcatttcatatggacttacccccattttgtgaagagaatttcggattctcgacaaggccatgggcaagagaataggacatgggagatgagtttcttgtgttagtttccttaagtgcctcttgagtatttcatttacctccttgaccttccctgaggattgtggtctccaggcacagtgaaggttatattgtatccctagcgccctggaaattccctgagttaccatgactttaaaagccagaccattgtcactttgtaagctttgggggagcccaaatctaggaattatttcatgaattaggactttaactacttcctgagccttctctgtttgcaggcttctatccaatttgtgaaggtatcaacgcagaccaacaagtattgaaatccccttgacttaggcatatgggtgaagtctcactgccagttgtctccgggatagtgccctattttttgttcccctagaggggccttatgagggaccaagggattattgttttggcacacatcacaggctttgacaacttgtcagatggtctgtaggagatttggccctgtaaatagggatttggccatttgatgagtgttctcaatacccatatgaaaagtttggtggagagtcttaagtattttccactggctggctttgggtatgagtaccttactctcttctgtcattaaccaccctgaggggagaaaactatccccctgtgaaagtccccattctttttcagtcgggaaatactggggcttaatctcttggagagggttgttccataccaagggtccttccataggtatttctaatgggaagttctgcctggcagcaattttggcgtcagcgtctgcccaatggttttcttctgccttttctccttcaccattttgatggctttggcagtgtaagactgccacctctttgggtttttgcactgcatgcaataactccatgatttctttgtagtatttaatgggggttccctcagaggtaaggaactccctttctttccatattgtaccatgggcatgtaggattagagaagcatacttgctatctgtagacacatttattcttttttcccttctcagttctaaggttcaggtaagcaccagtagttctgctaactgggcgctggtccctgggggaagaggcttactttcaagtactgttacatcactaactatggcataacctgcccttcatatcccactctccacaaatgaacttccattggtatataggttaaggtcaggattagctaaagggacttctaagagattctctcaggcagcataagtctgggcaacagtttgttggtagtcatgctcgattggttccccatcctctgggagaaaaatagcagggttgaaggctgcacacatgcgaatttgaagcatcagtccctcaaggagtagtgcttggtatctaagcaggcagttgtctgatagtcataaatttcctttggcaactagtatgccatttacatcatgagtagtctagatggtgagatcctttccttgtattattttgatagcctttgatactaagatggccattcctgcaactatccgtaaacagtgaggccagccgtttgctactacatcaatttccttacttaggtatgcaactggctgtgaggttgtcacacaagtctgagtaaggactccaagagctattcccactctctctgtgacatataaagagaagttttgtcctgtgggaaggcttaaggctggagcttgtactagggcctactttaaggttttgaaggctgtttccatctctggttcccattctcctagatgagtatttgccctctgggtctccttgattagagtatagagtggcctggccatctcgctgtatccagggatccatagttggcaaaagccagtgatcccaaagaacccccgcaactgttttaatgtcttacagcaaggacaagccagtataggctgtatttgttctttgctgaggtctctgcttcctctggctaagattaggcctagatatttgacttgttgtaggcagagctgggtgtttaatttagatgccttgtacccttgattagctagaaaggtcaagagatctagagtagcctgctggcaggaggcttccgaactgggagccaaaagtaattcatccacatactgaaggaccagagtgcctggacttgagaaatggcctagatcttgggccagtgcatgaccaaacagatgagggctatccctaaatccttgggacaagactgtccacataagttgggacatgtggtctgtgggatcctcaaaggcaaagagaaactgggagtcagagtgcagaggaatgcagaagaaggcatccttgaggtccagaacagtgaaccattctgcttcctctggtatttgagagagcggggtatagaggttggttacagctggatatagcggaattactccctcattgatgagtctaagattttgcactagtctccattgactgttcagtttttgttctcctagaattggggtgttgcagggactcctgcattttcttactaagccttgaacttttaaatgtttaacaatatcctgtaatcctttacaaacttcagggcttaggggatattgcctttgtaaggaaaagcggtggggtcttttagtctgatttggattgggtgggcattttttgcccttctgaattgtccttccaagtcctagacttcagggttgtttccctcctcaagtaggggacaacaaatgggtaacttattccccatattcatgtagataatagctccagctttggctaatatgtccctccctaataagggtgtgggactttcaggcataacaagaaaggcatgtgaaaagagcaaagtctccttacaactgaggaggtgggagaaatacctggttacaggctgtcccgggattcctcagatggtaatggaccttgaggacaaggtccagggcaggagattaacactgataaggccacgccagtgtccaggaagaagtcaatttcctggccctcagtggttaaacttacctggggctcagtgagggtgatgacatgagctggcacttgccctgaggaccctcagtcctgttgttggatcatctggttgggggcttctggcccagagaacctttgtcctcttgggctgtgcaccttccagtgattgcctcggcatagtggacatgggcaagggggtggcttatttctcattgcacatttttttttaagtgtccttgcaagccacactgataacaagccctactaggtgattggcctactccgttttctgtcttttctgaaccacaaaggtttgtttgtctgagggccatgactaaggctgtggcctttctcttatcttgcttttccttttcagcctgttccttcctctttgtccctattatagaacaccaaggttgccaggtttaataatgcctccaaattttgttcagggcccaggactagctttcggaggtttctcctggtacctgtggctgattcggtaataagcttatcttttaggatcaattgaccctcaagggagtcaggttacaggggagtatattttcttaaggcctcccctagctgcttgaggaaagcagtaagattttcttcctttccctgagttatggtggacatcattgaataattcatgggctttttactaattctacttagtccttctagaacacaggtcaacagatgtttgagactccagtctccatgatctgagtctaggtcccaatggggatcaatactggggacagcttgctgaccagtagggagtttgtccctttctttggctgtcattctgtcatttacttaagataccaggtatctccaaagtctcgggctgcagctaaagccacattcttttcattaaaggccagggtttgatctaataatagcatgacacctctccaagtgaggtcgaaggtttgccctagaccctgtaggacatctatatccctatcaggattatctgaaaacttccccaggtctaccttgatctgctttaagtcagagagggagaaagggacacgtatccatgttgggccaaattcccctccccctacagcttgaaggggacataaccgatagcccagggggttttttggtcccttggagatttctttgcttgtctccttctgggtgggggagattagaggaggcttatcactaacaggaaggggagctgtagggaggctaggatatgaaggtaaactgagaggtcctcctgtgggatgtagattgcaaactttgcatagttgtggattatccttcaatgaaaggaaagcttggacataaggtatttcactccatttgccttccctcttacagaaaaggtcaagctgcaggaaagctgtaatttatacttcccttaggtggccattttttttccatcagagagagaatattggggccaggccatagtgcagaaaaaaaataagcagcttctttttcagggcttgagggtcaaattgttcccaatggattcatttcaagggtgagcttcttgatgcctgagtgtttcccatctgaaagaaaaaaaactgcctatggttttgttctgttttttttttcttccccgcccaataacctgcaatggtccctggaccctgctgtttggaatagttgcgctcactgaagcagcagcggaaacacttgttttcctcctagatcacaaagaggaccaaggaaggtcgtatttagtggcccttaccgacacattctcgaaaacctgcacccttgcctttcctcttagaccacaaagaggacggagaaaggtcggagtggagggccataccctgagggagggaagggatctccagcattggaagagtgatgccttttgtcctcacttcttatcatatggataggaaggatataccccccaattttggagtctataatttctgaggctctccatatcctagcttcgggaataaccttttactcttaagcatctcttggagaagtcttacttatataagactggtcatagtagccaagtttgtatacaaaacaaaaaaccgaacaaacttaacaaaaatccaattcactacagactagaaaaatgaaaaaacaaaacacacaaactccccccaaagtctttgtggtacatacatataatgaaatctcataaagcagtaaaatgaatgaattagtcattaaatctcatgtacacaatgttgaatacaacaagaaaagcaagttacagaatccataagaatcacttcatttctataaagtttaaaatataaaaaactaaaatggtctttgtaaatgaatacatatatctttgataaatctgtaatgaaaaccaagagaatactagcaacaaaattcaggataatggttacttatcttggaatgagggacatgtcacctagagaaatagttgtacagtagctggtaaggttccatttttaaaaacctgggtgggtacattaagattcatttttgttactctttaacttgcaatatattatgaatattcttttttatttgtttaataattaatataaacaataccaaaaaccttaaaatgtcaacatcagagaaaggaaaaattgcctttttaattactagttctatagtgtaacaatccaattgagtacattattttatgtatctctattatttatctggaataaaaattaatccataaataattggatgttatgccaaaatgcatgaacagattcatagtctattcatatattgtacagtggctacttgataggataaaaacatttttaaacaaaaatttagtatctatagaagtttattttacaggagaatgcctgataccttctccctggaatattctttgtctagctccttttcatttttttatgtctcagcttaaatccttctgtccctgacatataacatcttttcctggcaagcaaagtaggtcccccatttttatattgtaatggtacctatgattatttttcacaacacatataaattttcatattatttttaacagctttaaattacatatttatggaactgattattctatcagtgccttcgtgcattcatatgtaaggaacataacgacagaagtatggctgatttttgtatattgaacttttataccaattttattgtcagttataatatctgtggattcttttggatattccatatataagatcacgtcatctgcaaaaaataacagctttacttgtcctttccaattcttacattttgtagttattttaattttaatgcttaggaccttcactagaatgttgaatcaattaaagcaatatccatgacgtttctgattccaggggcaaagttttcaaaatttcaccttcagtataatatttgctgtattttgtgtaaataattttgtcatattaagtttcatttctctttctagtttgctaacagtttgtattacaaatagatattgaaccatatgaggtgtttttttagatacccattattttttccttacgtattttgttaatgggttaaataacaatcctggaatagtattcctgatatattcccaaatagcgtaggctttgttatcttctaaaattatccctggatttagtgttaatattttgtttagaaattttgcatctataatcagtgacactggcttgtaatcttcctttctggtaatttccttacctgctattgatatcaaggctaggctggcctcataaaacttgctggaaactacatatgacttttgtatttttctggaagcatttgggtttgtttgtttgtttatttatttatttatttatttatttatttattttgagacagagtcttgctttgttgcccaggctggagtgcaatggcgtgatctcagctcactgcaagctccacctcctgggttcacaccactcacctgcctcagtgtcccgagtagctgggactacaggcacccaccaccatgcctggctaatttttttgtatttttagtagagacagggtttcactgtgttagctaggatggtctcgatctcctgacctcgtaatccacctgcctggtcctcccaaagtgctgggattacaggcatgagccgacatgcctggctgggtttatttattaagagtttgttagaattcaccaataggaccattttgacaaggagttttctttgtaggaaggttcttagttgtattctttaaaatatttgaacaattaaaatgttatatttctacttgtgtcagtttggtaatttgtagttttgtaagtatttgttcatctaaattttcaaatttattggcatgaagttttcataatataatctttctatctttttctatctgtgggatctgtgttgaagtcttcttttccatttctgatgtaatttatgtctgccttttctgtttttgttctcaaaaattttttgccaaatttattatacattatttttgcaagattattagatttctaaataactaaattttggttttattactctaacaatttttatcctttattatatatttccttatacttattttgagtataacttactctttctttttctcattttttgagatctgatcttagctcatgaattatcagcttttcttttttaaaaaacatgcatttggggctgagcatagtgactcatgcctgtaatcctagcactttgggaggtggaggcaggagtggatcactttgagctcaggagtttgagactaacctggccaacatggcaaaaaccatctcttaaaaaaaattagctgggcattggtgttttgcacctgtagtaccagctacttgggagggtgaggtgggaggattgcatgagctgggaggcagaggttgcagtgagctgagatcatgccattgcactccatcctgggtgacaaagatcccttctcaaaaaaaaatgcatttaaagcaatatatttctttctaatttgttttatctgtgcctctttattactaactgaaaaatccttaagatagccaactgaaaagggagagctacgtaatatagcttattactaaagaaaaagggaaaaaatttttctatgcaaccacagtgatcattcaaattataaaattaaaaactcctaattacattagatacagaaatattatcacacatacaagtaacatgacaatacaaatgttatgtattttggaaaaatcttatcatggaacatgtagaatttgtttggaaaaaaatctatatggattgaggccaggcatggtggctaacacctgtaatcccagcactttgagaggcagaggtgggtggatcacgaggtcaggagaacaagaccatcctggctaacactgtgaaaccccatctctactaaaaatgcaaaaaacaattagccaggtgtggtggtaggcgcctgtagtcccagctactcaggaggctgaggcaggagaatggtgtgaacccaggaggcagagcttgcagtgagctgagatcgtaccactgcactccagcctaggtgacagagcaagactccatctcaaaaaaaaaaaaaaaaaaatctatagggattaagaataatctaaagaattaggttaccaaattagacttacaggaatcagattttacccagtatcaagttttattaaaaattcaaaggtacaggtaattgtgaaaagcagaaggatgcaaaaagtttttccagctctactagctgtgagagtttagaaaatttatataaactcttttagttacaatttccttattttataaactgaggataatattgcctactcacatggtgtattgtgtattcatctgttctcacactgctaataaagatatacctgagactgagtaatttataaaggaaagaggtttagttgactaacagttccacatggctgaggtaggactcacaatcatggtagaaggtggaggaggggcaaagtcacatcttacatggcagcaggcaaagacagaacttgtgtaggagaactgtcctttataaaaccatcagatctcatgagacttactatcatgagaacagcatgggaaagacctgcccccatgattcagatacctcccactgggtccctcccacaacacgtgggaattaaggagctacaattcaagatgggatttgggtggggacacagctaaaccatatcattctgactctggcccctccaaaatctcatgtcctcccatttcaaaaccaattgtaccttcccaacagtcccccaaagtcttaactcatttcagcattaactcagaagtccagagtccaaagtctcatctgagacaaggcaggtcccttctgcctatgagactctgaaatctaggcagaggttcccaaacctcaatttttgacttctgtgcacctgcaggctcaacaccatgtgtaaacttgcaccctctgaagcaacggtttgacctctacgttggccccttttggccatggctgggacacagggcaccaagtcctgagactgcacaaagcagcaaggctctgggcgagacccatgaaaccattttttcctcctaggccctgtggcttgtgatggtgggggctgccatgaagatctctgacatggcctggagacattttccccattgtcttggagagtaacatttggcaccttgttacttatgcaaatttctgcagccaccttgaatttctcctcagaaaataggtttttcttttctactgcattttcaggctgcaaattttctgaacttttatgctctgcttcccttttaaacataagttccaattccaaaccatatctttgtgaatacataaagctgaatgcatttaatagcacccaaatcagctcttgaacactttgcagcatagaaatttcttctgctagatactctaaatcatctccctcaagttcaaagtgctatagatctctagggaagatgcaaaatgctgccagtctctgctaaaacatagcaagagtcacctttatttaagtttctgacaagttcctcatctccatctgagaccaactcagcctagacttttttgcccatatcactatcagcattttgctcaaagccatttgacaagtctctaggaagttacaaaatttcccacatcctcttgtcttcttctgagccttccaaactgttgcaaactctgcctgttacccagttccgaagtcacttccacactttactggtaccaatttactgtattcatctgttcttacactgctaataaagacatacccaaaactgggaaatttataaaggaaagaggtttaatagactcacagttccacatggctggggaggcctcacaatcatgttcaaaggcaaatgagcaaagtcatgtcttacataggagcaggcaaatagagaccttgtgtaggcgaactctcctttataaaaccatcagatcttgtgagacttactcactatcatgagaacagtccaggaaagatctgcccccatgattcctttatctcccactgggtccctcttgtgatacatgggaattatgggagctacaattcaagatgagatttgggtggggacacagccaaaccatatcacatggttagtgttaacaggatgatgtgcatataaggttaccagagtagccagcacatttaagaatgcaacaagttatatattaatgtgataatttagtattgctgttatgattccacatatcttatatttaattttaatcttcctatgtatataattaaaggtctattatcaagatgtaatccagattcatttctgcaacctgccttactatttttttcttaaacacagacagcacttgttgtatttctcgcctatgagttttcaatgaccttttaatagaaatgcttaattctagaaatatgaatggaaaatggtcatttatttgtacatctcttagggatttaggtgtataacataccatagcacaagaataagatatggtggctatcttccaagatgtttatagattaccagtggtaaataaaagttaaataatataattttatccttggtgctaaaaaaaaacactgaaaaacaaatgtgtgagtataaatgatgttagccattgacttgaaatattttcctaaataacataagcctaatatattatgaaaggtgtttcaattgctcaggacagttataatacatataatcaaattctatacattgaaaatatttcatatattccaagttctacatgtaacagaatgacatatataactgtactatggagattgaaacattctaatgcatttaaaaagaatatgttctgaaaatgacaaattttctcaaaacagtgcatttatactcctgcaatatagtaaaagtccctgtaaataatttttatgcagtatacaacagcataaaatactatattttcttgttcagggaactcaatgaaggcaaagaggaaagtcaacatcaacaacctgatgattctaacaatatagctgtccatgttcagagagcacatggtggccatattttatatagaccaaaaagagccacagagaaatttgaagaattcctagctatcttaaagaaattgtaagtatttaaaatatattccttcttctaattgagtaattcttttgaatggctttattttttaaagtttattgtttgtgggtaagtgtactttagttatgatacagcactcatggttgattcaggagagatggacacactggagactttgtttctatataaatacagtcttcatgaattcagtcttcaatggtgtatcacggatataatgctaaacttgtgacccattattttaaaattaaactgcaagcaaaatatatattatttactgatatttcaaaattctgttaaagatgtccttagcttgggttatcggaaggctcttcacaaactgtcttcctcatccaggagtctttaaataaacttaccacatgttactttttttttttttttttttgagactgttgctcttgtgccccaggctggagtgcaatggcacagtttcggctcactgcaacctctgcttcaatggcgcaatctcaactcactgcaacctccgcctcctgggttcaagtgattctcctgcctcagccccccaagtagctgggattacaggcacctgccaccacgcctggctaatttttgtatttttagtagggacagggtttcaccatgttggccagggtggtctcgaactcctgacctcaggtgatctgcctgcctcggcctccctcggcctgggattacaggtgtgagcttccgcacccggccccattccttttaattttctagaatactttgtgctctgatagggacacaactgcctgaagaaggaggggtgtggaggagaaaattaaatctgagtgtaggctgattaccaaagatggtattggatttgtgaataaaattaaacgagtaccatgaaaattatagaagaaaatcttaaccacctgtcataggggagtaaaattaaacttgtaagctgaaaaaataggaaattcaactagaatatgtgatattagaattgagattgataacaggaacaaaaccaaaagtgtcaagactaggaatgttttcagaaaaaaatcaatagcagggaatgagtaattaaaaatttgacatttatgttctgaagaatgaactttttctttgtttagatacaaaaataccattgtggtataactgcctacagtatacagtacagtaacatgttttgcaggtttgtagcctaggaacaacaggctataccagctggcctaggtgtgtagtagactacacgatccaggtttaagtgtactctatgatgtttacagaatgacaaaatcgcatgatgacagatttctcagaatgtatccccgttgttaagtgacacatgactatgattgcaaatttgaggaaatatgatcagagcttccagaaaatttgagaatggtcagatttttatactcttaacttataataacaaaaaggaaacaatgaatactaatcactttttagtaaagcaggtatgagggaattatagaaggaaatcttaaccacctgtcatagaagagtaaaattaaacttgtaagctgaaaaaattaggaaattcaactagaatatgctcactaaattcgttaaaaatattctttaagtggtagaaaatcgctaaaacactgaaagtgatctaaggcatactatgctacaatcactttaattccattaaactctaatgttgattaatattgcatcagattccaaaattttagtttccagaaacccatgaatcactctgctgatttcaggttgtgctgggctgtaagagttttaatggcagtggtaattcctgtcttttttactatagtgagatagcagtttccagataacaaagtttctgatctgagatgtgggaggtcagtaacagggacttccaagcagctatgattctgcactgcaatgtcaaaataccaggaggtaaatctaggtcaatgtcaggatggaaactacaaatgggtaagaagcctagtaccttcttaacagtggactaccgcgaaaagcaggagccatggtagaaggtggtccaagcacagtgaataatagacaagttactttactttgctacattcttttgtggacctccatggatgctatttaatggcctgtttccaaacacccaggacaatagatgttgggtcagtatcagtttccagaacccacttcctcactcatgtgtgagaaaatggatgagtagagaagatcctgatgtactatacgtcccccctttcagtggctcagaattgggcagccaggactttgacatggcaaaactcactgctgtcaatgggtgggctgtgacagccaccaaattacagtaggagagtaaatgagaaggaaattcatttttatgagatgtttaatattaacagaaagccttaagctctctataaaaaatttgtgatttaatcctcacatcaatgctttgaggtagctatgacaaactattaatagtaagtaaaagatcaatgtatgcactaaatccacaatctatgtttgttctatagcacatgccttttctctcctcttctccttgggacactaatgtattagcttcttattgttctgtaattaattaacataaacttagtggcttacaacaacataatttagtatctctcagggtgaggtttatctggtcctctgctcagtgtctcacagatcatcagagtgtccactgggctgtgaccatttctggagcataggatcctcttccaagctcaaatggttgttggcaggattcagttccttgtggttgtaggactgacatccccactttcatgatggctttcagcagggggcccctctttctactagagactccctagatccttgccatgtggcactttctcaagctctgttagcaacacaaaagcttaaattttcaaagctagcaagggagagtctgtttctctctctgttattctgactaggtgaagtgtgatataacctaatcaggggcctatatatcccatcgggttttgcagtattcccaaatcatagattctgcccccactcccaacatttaaggaaaggggattgggtgttcccttagtcacatttagtaacatcatcagtctatttctgactctgttaattgcattagcaatggggttgtatgctttataaacacaacactaaagtaattcaattaaaatctatttattgatggataagttgtcaggtctgtggccttttgtttatctctgactaattaaaccatgatcagattgacgggctgtttaagtgatgttatctaatgaacttttgaaaatgttaccttctatactttaaaacttttcactttgtcaccctgactaaaattaaaaaaaaaaaaacattttgagtcacagtaactttttaaataaatgcaggctgggcgcagtggctcacacctgtaatcccagcactttgggaagccaaggagtgtggatcatgaggtcaagagatggaaaccatcctggccaacctggtgaaactccatctctattaaaaatacaaaaattagctgggtgtggtggcatgtgcctatagtcccagctactcgggaggctgaggcaggaattgcttgaacgcgggaggcgagccgagattgggccactgcactccagcctggtgacagagcaagactccatctcaaaaaaaaaaaaaaaaaaaaaaaaagaaatgcaaagatatctgataagattaagatactattacctattgataacttggtgtgctatagcttaatcatgttaattacatcttaacttccacttcatgtcagcagctctgagtaaatactgatagatgggaaaaataataaataattttgaaacattaaaatcattgggagaggcattaaaatcatgggggtggtgccaccataaaggagagatttgagcaaccagaggattactaaacagacagtgggagggagagaggagacagagtgagaaaaagagagttgggaggcccctttttaaaattttgttttttaaggcatatcagattgaatataagcttatcatgtgtattagttaggattttggatcataagcaacagaaactgactctggttcattaaaacaatcacaataaacaaaaagggaaggggggacagatggaagaatatcaggtagctctcagaatagaagaacaacaactagatgctggagatacaaactctaaggcaactctggaagtctcttcaaggtacaacactggaatcaatcagttacaactacttgcatttgggagttactaggctcacagcttaatttcagggatagggagtcagattgttgtagtttatttttatacccacccttgaataaatgctgagggagaagtgccctttgacaggcagttttactgagtttacatgcaattggcaaaggggcagcatttcaaaagagaaaatatttcagaagaagggggaaatgatgataagtaaagaatattaaaatctaggaactgaaacatgacttagaattttagtttctaaataattttgactcattttatttttcatccattaattaatgaatccaacatacacttttgaactcctctatgtttctgtcagtattcctggtattgggactgtgggaacacacaatatctttgccctcatggagcttacattctaatgtaagagatactaaacacatatgtattctgtcagttagtgataagtgctaggaagaaaagctaatgcagaataaggggatagagaatgatggaaatgatcagagaagtcagattttatgaaacaggagaaagaggagagagagacaattaaataccttgaagaagtgcattctagggaaagaaaacacaagtgcaagagcccaggtattgcaacatggtctgcaaatagaaaaacaaattacaaaaaataaaaaccataataattgggaagaaagtcattgttgtgaaagtgcatgagtcaaatgggagacctggtggaaatagtgcttcagaggtagccagggaccagattatcatttagggtctcatagcccatgaagggattttaaccttggtgtgactggcatgttatgatttacatggcaaaaggtcatgtgtggatgccaaaaggagtttcagagtgacctgttagagtgctgtgaaatttgtctaggtgaaagatgacagtggcccatattctgtgttagggatttagatttgacatgaagaatttgattttctctctctttttaagacatgagcaggactgaacagacagtccttgaagcaaatcaggttcattgctcagtttgaccactaacatgatggagaatcctgggcaaatcatctgatgctctcacatgttggtatttgattgcagtgcttataacaacactggcttttaaaatgcaattataaaatactatggtaaaaataattggtttcttcataaatgactaatttctggggaaaaaaagttatgtttgtatgtatttgtgggagctgtggaaagggtaggagaagagagggacttataaatgagctgtgaaatgcagattaagatcctctgagaaaacttggcccgattgttttttcttctactttctccaattaacgatgtttcctttgagcgaatgaggcatctgaagatcattatgtttcagtagagcagtgatgcaaagccacttctcaggaatgactcagaggaattgctccctggaagaacatcagggtttttgccttttagattcaggctgtttaaaatccaaatgcaatatggttcttatgctgtcgtcctctggtgaaatggcacataagatggggaattgcagtctcaaactatatttaagggctgcatgctgatcaaagaaaaacactttgtggggctattaatttgtgaaaaatacagtattttggaggaaaaccgcacttcaatggagtggaagggggattcatatctagaaaagaaagtttccatttgaacttaaaagggaacataggttaataaagaacggtgtggatactgaaagtaatttatatttctgacacaaatggtgatcatttatgacagaagaatgggaaataaaggaagagaattatttgtgttaaaatgagttagcaaaggacagaaattaaaaactcattgacagtagactggtattctaaaagcgtgtcacgctgaatcttcttgttctgtctgcggcagctagattgaaagttacatttgggatgtacatgttgcaaaatgcctggcctgcagagtcagaaagaactgtgttctcaactggactcctctaatcattagttgtatgatcttgggcaaatttctacctccaaaaattttattcacaaagttagaatgtaaagccccaaacatattacttcgtccattttaggccctatgtgaatgtcaatctcccctctcccaaagaatgttacatactgtgattgctttttaacaaaagactttgctatgttcttgctatagttgaattataaaggggttccttgtgtctctgaataataatgtgtttcatttttaatatattcaagaaagaatattcaaatttctcctacaacttatgaataaataacagctattacttctttatcatatatttgcattagtttacaaagttgcccggaaaattttcatacagcagtttaagaaactactatttgatcatatattaagtagtattcaaaaacaattgtatcttgatacctttgttctattgtttagacataagcaaacatctattataatatttcttataaaaattattttttcactgtatagatgtattatttcagcatagatgtgactattaaagctgaggcttcttgttttcggtgacatagttttgcctcttatttttccatagaaatgtcttagtaagtatttagtgtaagttctttcttattaatactaggtttataagtgtaacagaacgtacttgtcatgcagtgagacttgagaatcttatgactctattgggaatttttatcatgtgttgtattacagatttaataacaatggaacacaaagtcttttaagaatatttcttgtaacaactatctgttgaactatcacaaaaatccatgatttcattaaaagatttaatgtctgactgtacaaaaatattacttgccttcctcatgcagttattcttatagagtattaaagtcatcttgaatggtagtgctacatttatcaaaatgacttagtttcacatacatgcaattgtgttttatatgtatgagcagaatgcttttgtactcgaggatttacctcatgatatgaagaaccattttagagaaacatagataattaagtccaggctcaagtcatacaatatctagaaaattttggcaagatttggttgtttctagtagagtgtgggtctgcatggtcactgttctcagtcaaaccctgggtctatctgcagagaagtaataaacaacttggcagtctttaaaaacctggaacataattccttatttgtctctcctctttcatccactgaacatttagtctaagaaaatggtggtttagttggtttaatattcaaaggtgatattataataggcttggtttggctaaagagatgaaaatgtggtcagatgtccttagtacgtttgcagtatccatttgtggttctgaggaaatgtgtgtgtgactctacctatttgatggcttacataaaatttggtttccaaatgagccactaaattgggctcattgtacagcaaggtccatcagtgtatggttaaatgttctttcttcttcattagatatttgtcaactagactgatgtgaaatctacgttggacaaaaattcttccctggagcattcatgctcaatttcatttttttgtaaactgataatattaccatattcttgttaaaagtttccaaacactacttttcactttttatttttttatttttgtgggtacatagtagatgtatatatttatggggcacatgagatgttttgatacaggcatacaatgaataataatgacatcatggagaatggggtgttcgtgccctcaggcatttatcctttgtgttacaaacattccaattatactcttttagttattttaaaattacaattaaattattgactatagtcatcctgttatgctatcaaatagtgggtcttatttattctatttttttggtatcttttagccatccctacctcctcccaaccaccctgctacccttcccagactctggtaaccatacttctacactctatgttcatgagttcaattgttttgatttttatatcccacaaataagtgagaccatgtgatgtttgtctttctgtgcctggcttatttcatttaatataatgacctccagttccatccatgttgttgcaaataacaggatctcattattacgtatggatgaatggtactccattgtgtatatgtaccacattttctttatccattcttctgttgatggacacttaggctgcttccaaatcttggctactgtgaacagtgctgcaataaatgtgggaatagagatatctcttcaatatactgatttcctttctttggggtatatacacagcagtgggattgctggatcatatacctctaattttagttttttgaggaacctcaatactgttattcacagttcttgtactaatttagattcccaccaacagtatacaagggttcccttttctccgcatcctcaccagcatttgttattgcctatcttttggatataaaccatttaaactagagtgagatgacacctcattgtagttttgatttgcatttatcttatgatcaatgattttgaacatcttttcatatgcctatttgccatttgcatgtcatttttttgagaaacacctattcatatcttttgcccaattttaaatcagattattaaattctttcttacagagttttttgagcttcttatctattctggttattaatcccttgtcagaggggtagtttgcaaatattttcccccattctgttgattgtctcttcactttgttgattgtttccctcactgtgcgtaaactttacaacttgatgtgatctcatttgtccatttttgctttggttgcctgtgcttgcgggttattactgaagaaaatttttgcccaaaccaacgtcctggagttttccaatgtttcatagtagtttcatagtttgtgttcttagatttaagactctaatccattttgatttgatttttgtatatggggagaaataggggtctagttgttctgcatgtgaatatctagttttcccagcacattttgttgaagagattgtcctttcctcagtgtatttcttggtaccgttgtcaaaaatgagctcactgtatatatatggatttatttgtgggttctctgttctgtttctttggtctgtgtttctgtttttatgccagtaacatgccattttgtttactatagctctgtagtataatttaaagtcaagtaatgtgattcttctggttttgttccttttgcttaggataacttcagctatgcaggatcttttgtggttccatataaattttaggattattttttctctttctgtgaagaatgccattggtattttgatagagattgcattgaatctgtagattgctttgggtagtaaggacatcttaacaatattgattctgctaatacatgaacatggaatatctttccatttttggtgtcctcttcaatttctttcatcagtgttatatagttttctttatagatatatttcacatattagttaattcctgggtatttaattgtattcgtggctatagtaaatgggattacttttttgatttgtttttcaaattgttgatttttgtattttgattttgtatcttgcagttttactgaatttgttcatcagttctaatcattttaggggggagtctttaggtttttccaaatataagatcatattgtctacaaataaaaataatttgactttttcttttgcaggttagatgccctttattttttttcttttgtgtgattgctcttgctaggacttccagtactgtgttaacagtggtgaaagtggagatctttgtcatgttccagatcttagagaaaaagcttcactttttatcccattcagtatgtaccagcatgggtctgtcatatatagcttatattatgttgagatgtattccttttatacccagttttttgagggttttttattatgaagagatgttatacttcatcaaatgctttttttttttttttttttttttttttgagatggagtctcgctctgtcccccaggctggagtgcagtggtgtgatctcagctcactgcaacctctgcctcccgggtttttttttttttttttttttttttttgagatggagtctcgctctgtcccccaggctggagtgcagtggtgtgatctcagctcactgcaacctctgcctcccgggtttaagcaattctctgcctcagcttccagagtagctgggattacaggtgcgtgccaccacgcctggcaaatttttgtatttttagtagagacagtttcaccattggtttcaccatttggccaggctggtcttgaactcctcacctcatgatccacctgtctcagcctcccaaagtgctggaattacaggcatgagccactgtgcccagcctatcaactgctttttaggtatcaattaaaacaattatatgatttttgcccttcattctgttgatatgatgtatcacattgattgatttgcatatgttgaactacccttgcatccctgggataagtctcacttggtcatgatgaatgatatttttaatgcattgttgtgtttagtttgctagtattttgttgaggattttcacagcagtgttcatcagagatgttggcctgtagtttctttttttaatgtgtctttgtctggttttggtatcagagtaatactggctttgagaatgagtttggaagtgtgccattgtcccctgtttttcagaatagtttgagtaggattggtactagtgcttctttaaatgtttgatataattcagcagtgaagtcaggtcctgggcttttctttactgggagactttttattacagatttgatctttttacttattattgatctgttcagtttttggatttcttcctgtttcaatcttagtaagttttatgtgtctaggagtgtgttcatttctcctagattttccaatgtattttatgtgttcatttattctgtgttcatttattctatatattccaaaggatcatagtgactactaatgatcctttgaatttctgcagtatcagatgcaatgttccctttttcatccctgattaaacattacttttctactgtttgctttttgatatcacaaatttaataactttacagtaaattcttgtttttaagttttcagcacttaggattcttatttgaaagcaacagaagctgattcttaagctaaaagaaaaattattaaattcgtagttatttacaatgattttcttaaaatagatttaatatcaggtaaaagtacagataatgcaactattcttgatctttttagctacattcagttttggcaagaatataatagataggctgggcacggtggctcatgcttgtaatcccagcactttgggaggccgaggcaggcagatcacctgaggttaggagcttaagaccagcctggcccacgtggtgaaactccatctctactaaaagtagctgggtgtggtggtgggcacctgtaatcccagctattctggaggctgagacaggagaatcacttgaacctgggaggcagaggtttcagtgagccgagatcatgccactgcactccagcctgggtgacagagcgaggctccgtctcacaaaaaaaaaaaaaaaaaaaaaaaaaaaaaaaaaaaaaagatattgcccctaccagtaaatattagcttttaaattattttatttttaattttatagaacaacaaaagacatcttgtttaatttacagttattttaatttgcctttctttgtttccttgttaagctaaattttctttaatcatttattagctatttgtatttattcacgttgctgttgtgaaaagaaaaaaaaatcttgggattcccaaatcactaagccaaagggaaaaatcaagctgggaagtacttagggcaaacctgctccactgtattcctaaaaaagatagctactaagattaaaaagctgcatacctccctcacaattggtccacaaggaaattccttgcagacaaaggacaaacagaactcagcagaaaccctttgctcactgagataaatgcatatctaattgcttcctttggaaaggaatcagaaattcaaaataatataaccatttgtcttccatctacctatgacctggaagccccctccccactttgagttgtcctacttttctgcgccaaaccaatgtccattttaacacatattgattgatgtctcatatctccctataacatacaaaacccaagctgttccctgaccactttgggcacatgttgtcaagacttcctgaggctgtgccacaggtgcatccttaaccttggcaaaataaactttctaaattgactgagacctgtctcagttatttcgggttcacagtgtgaattatctgatagtggattttgcctatattttctactgtgctttaattatgtactgctgatatacagagctatctatattttatatagatatattacagtatagacatagtaccatttatggaatggagaataaaatttttcagaaaaatattttacctaatatatttatccaatatatatttgctggtcatgtgaaaatttaacaaatatcaaatgaaaaagaaagaatatatatgtgtgtgtacctatatatcatatataacatgttattaaatgtataagcatttttattaaagtataatttatatataataaaaatgtatattttaaactgtgcagtttgataacttttgatacatgtataaaggtgtgatataaaccatttgtgatataaactgtgcgatgtgataacttttgacacgtgtaaatctgtggtataaaccatcaccgcaatttagataatgaacataatcaaattgctcccaagagtttccttgcaacttttgtcattctttcctcttgtgtgtccttgtgcccaccctctgttccaagcaaccacttatctgctttctgtcagtaaactttattttatattttgggagggaattaaatagcattaattaatacatggaattaaatagtattattattttttagtctagcgtttttcactcggcataattatttggatcttgatccatgttgtgttgcataacaatagttattcctttttctttctgaatagcaatccactgtatgaatataccatagtttatctaagtatatgttgatgaacatttgtggctattatgaatgaagctgccatgaacatttatttataagtcttagtgtgagcatgtgccttcatctctcttgagtaaatacttagaaaagaaacaacttaataattgggtaggaaaaacttaatcatatgttaaacttctgaagcaactgccaaactgtttttcaaaatggttgtatcattaggtatagataataattgtctatgaatgtcaaaatgtcctatggtagtcacagtgaaaaacacaattaacaaagaaatttggtcacctctgtgatttacaatgacctaacacaataaccctaattatgattgataacacaacctcagacatcagaactctagaaatcccgtacaattttggaacacattttaacatttttcactaaaatatggcctgaagatcaaacaccaccttactccaacaatcctatgcaggccgagcacggtggctcatgcctgtaatcccagcactttgggaggccgaggtgggtggatcgcctgagatcaggagttcaagactagcctggccaacatagtgtgacccctgtctctacaacaatacaaaaattagccaggcatgatggtgggtgcctgtaatcccagctactcaggaggctgaggcggaaaaatcacttgaacccaggaggtggaggttgcagtgagccaagatcgtgctactgcactccagcctaggtgacagagcgagactctgtctcaaaaaaataaaaaaatcctatgtaactaaacatgttaaataatcctgtttatcactcctttggacactccaggggctctctttagcattgaaatgctagggattaggaaagacaatttcgaagctttataggcttaacacacttaataggatttcaggttattataagtcatccatttaaatcatgactcaaagtgaaaaactttattcactaaaagggaagacttagtcttccaaacaatttatctcatgtccttcccttcttttgtcagtattttattcacaaagcaaacaaaaatctttcattgcatgaaaatcttgacaaagagaaagcaacatttcacccttgcattagtctattaatgtcaaccccaattctttaaaaaataaaaccttacagacaaatccatttaatcttaatcagtttgaccatgagctgagattcttataaatcttttataacacttcataagtttttgttaaagagcatattagttcctaaggaaaaccttgttgtgtttttattttaatgttcaatttacagaaaaaccaaataatactcttttgaatttagtcaatatgttcacacacagattttctctttaaaagatcaatttttacaaaccttgcataacttgttttagccattagctttatcttatctaatttaaaacaatcctttaatcctctgaacgagatgaaaatttacattccgtgttcttatattcttttactaaagacacattttactctccttacacactttgtatgtaaatctattttcagtagactccactacatgttataatggtagctcttagcaatttttaattttgaaatacctggtaagttattttagttacatacttagatgcagataaggtctgactattttcagcatagctaggagcatggcatatgtccccaggccttaccaaactgtaaagcaggaaagttgaacaattttcttctttttctttaattatactttaagttatagggtacatgtgcacaacgtgcaggtttgttacatatgtatatatgtgccatgttggtgtgctgcacccattaacttgtcatttacattaggtatatctcctaatgcaatccctcccccctccccccactccatgacaggccccagtgtgtgatgttccccaccctgtgtccaagtgttctcattgttcatttcccaccgatgagtgagaacatgcggtgtttggtgttctgtccttgcaatagtttgctgagaatgatggtttccagcttcatccacgtccctacaaaggacatgaactcatcattttttatggctgcatagtattcatggtgtatatgtgctacattttcttaatccagtatatcattgatggacatttgggatggttccaagtctttgctattgtgaatagtgccccaaaaaacatacgtgtgcatgtgtctttatagcagcatgattgataatcctttgggtatatacccagtaatgggatgcctgggtcaaatggtatttctagttctagatccctgaggaatagccacactgtcttccaccatggttgaactagtttacagtcccaccaacagtgtaaaagtgttcctatttctccacatcctctccagcacctgttgtttcctgacttgttaatgattgccattctaactgatgtgagatggtatctcattgtggttttgatttgcatttctctaatggccagtgatgatgagcagtttttcatatgtctgttggctgcataaatatcttcttttgagaagtgtctcttcatatcctttgcccactttttgatggggttgtttgatttttccttgtaaattcaaagttctatgtagattctgcatgttaaccctttgtcagatgggtagtttgtaaaaattgtctcttgttctgtaggttgcctgttcgcactgatggtagtttcttttgctgtgcagaagctctttagtttaattggatcccatttgtcagttttggcttttgttgccattgcttttggtgttttagtcatgaagtccttgcccatgcctatatcctgaatggtattgcctaggttttcttctagggtttttatggttttaggtctaacatgtaagtctttaatccatcttgaattaatttttgtataaggtgtaaggaagggatccagtttcagctttctacatatggctagccggttttcccagcaccatttattaaatagggaatcctttccccattgcttgtttttctcaggttcgtcaaagatcagatagttgtagatatgcggagttatttctgagggctctgttctgttccattgatctatatctctgttttggtaccagtaccatgctgttttggttactgtagccttgtagtatagtttgaagtcaggtagcatgatgcctccagctttgttcttttggcttaggattgtcttggctatgtgtgctcttttttggttccatatcaactttaaagtagttttttccaattctgtgaagaaagtcattggtagcttgatggggatggcattgaatctataaattaccttgggcagtatgaccattttcacgacattgattctttctatccatgagcatggaatgttcttctatttgtttgtgtccttttttatttcactgagcagtggtttgtagttctccttgaagatgtccttcatatcccttgtaagttggattcctaggtattttattccctttgaagcaattgtgaatgggagttcattcatgatttggctctgtttttctgttattggtgtataggaatgcttgtgatttttgcacattgatttggtatcctgagactttgctgaagtgacttatcagcttaaggagattttgggctgagatgatgggtttttataaatatacaatcatgtcatctgcaaacagggacaatttgacttcctcttttcctaattgaataccctctatttctttctcctgcctgattgccctagccagaacttccaacactctgttgaacaggagtggcgaaagagggcatccctgtcttgtgccagttttcaaaggcaatgcttccagtttttgcccattcagtatgatattggctgtgggtctgtcataaatagctcttattattttgagatatgtcccatcaatacctagtttattgagagtttttagcatgaagggctgttgaatttcaccaaaggctttttctgcatctgttgaaataatcgtgtgttttgtctttggttctgtttatatgatggattacgtttattgattgctgtatgttgaactagccttgcatcccagggatgaagccaacttgattgtggtggataagctttttgatgagctgctggattcagtttgccagtattttactgaagatttttgcatcgatgttcatcagggatattgatctaaaattatgttttttttgttgtgtctctgccaggctttggtatcaggatgatgctggcctcataaaatgagttagggaggattccctctttttctattgattggaagcatttcagaaggaatggtaccagctcctctttgtacctctggtagaattcggctgtgaatccagctggtcctggactttttttggttggtaggctattaattattgcctcaatttcagatcctgttattggtctattcagggattcaacttcttcctggtttagtcttgggagggtgtatgtgtccagaaatttatccatttcttctagattttctagtttatttgcatggaggtgtttatagtattctctgatggtagtttgtatttctgtgggattggtggtgatatcccctttatcattttttattgcagctatttgattcttctctcttttcttctttattagtttttctagcagtctatcaattttgttgatcttttcaaaaaaccagctctgggttcatcgattttttgtaggatttttttgtgtctctatctccttcagttttgctctgatcttagttatttcttaccttctgctagcttttgaatgtgtttgcccttgcttctctagttcttttaattgtgaagttagggtgtcaattttagatctttcctgctttctcttgtgcgcatttagtgctataaatttccctctacacactgctttaaatgtgtcctagagattctggtatttgtgtctttgttcacattagtttcaaagaatatctttatttctgccttcatttcattatgtacccagtagtcattcaggagcaggttgttcagtttccaggtagttaagtggttttgagtgagtttcttaatcctgagttctagtttgattgcattgtggtctgagagacagtttgttataatttctgttcttttacatttgctgaggagtgctttacttcctactatgtggtcaattttggaataggtcagatgtgctgctgagaaaagagtgtatattctgttgatttggcatggagagttctgtaggtgtctattaggtcctcattgcagagctgagttcaattcctggatatccacattaacttcctgtcttgttgtctgtttaatgttgacagttgggtgttaaagtctcccattattattgtgtgggagtctaagtctctttgttggtctctagggacttgctttatgaatctgggtgctcctgtattgggtgcatatatatttagggtagttagctcttcttgttgaattgatctctttaccattaggtaacggccttctttgtctcttttggtctttattggtttaaagtctgttttatcagagactaggattgcaacccctgcttttttttgttttccatttccttggtaaatcttcccccatccctttattttcagcctatgtgtgtctctgcacatgagatgggtctcctgaatacagcacactgataggtcttgactctttatccaatttgtcagtatgtgtcttttatttggagcatttagcccatttacatttaagattaatattgttatgtgtgaatttgatcctgtcattatgatattagctggttactttactcattagttggttattttactcattagttgatgcagtttgttcctagtgtcaatggtctttacaatttggcatgtttttgcagtggctggtaccggttgttcttttccatgtttagttcttcctccaggagttcttgtaaagcaggcctggtggtgacagaatctctctgcatttgtttgtctctaaaggattttatttctccttcacttatgaagcttattttgactggatatgaaattctgggttgaaaattcttttctttaagaatgttgaatattggcctccactctcttatggcttgtacagtttctgccaagagatccactgttagtctgatgggcttccctttgtgggtaacccaacctttctctctggctgcccttaacattttttccttcatttcaattttggtgaatctgacaattatatgtcttggagttgttcttcttagtgaatatcttcatggcgttctctgtatttcctgaatttgattgttggcctgccttgctaggttgaggaagttctcctcaataatatcctgaagagtgttttccagcttggttccattctccccgtcactttcaggtacaccaatgagatgtagatttggtcttttcacatagtcccatatttcttggaggctttcttcatttctttttattctcttttctctaaagttcccttctcacttcatttcattgatttgatcttcagtcactgataccctttcttccacttgattgaatcggctactaaagcttgtgcatgcatcacatagttcttgtgccatggttttcagctccatcaggtcatttaaggtcttctctatgctgtttattctagttagccattcatctaatcttttttcaaggtttttagcttccttgcgatgggctcaaacatcctcctttagctcagagaagtttgttattactgatcatctgaagccttcttctctccactcgtcaaagtcattctccatctagctgtgttccgttgttggcgaggagctttgttcctttggagagaagaggggctctgattttcagaattttcagcttttcttctctggtttctccccatcgttgttgttttatctacctttggtctttgatgatggtgacctaccgatgtggccaaatgggaacagctccagtctacagctcccagtgtaagcaatgcacaagatgggtgatttgtgcatttccaactgaggtaccaggttcatctcactggagcttgtcggatagtgggtgcagcccacagagtgtgagccaaagcagggtggggcatcgcctcacccaggaagcacaaggggtcagggaattccctttactagccaagggaagccatgacagatagtacctggaaaatcaggacactcccactctaatactgcacttttccaagagtcttagcaaacggcacaccaggagattatatcccgctcctggctcagagggtcccacacccacagagcctcactcactgctagcacagcagtctgagatcgaactgcaaggtggcagtgaggctgggggaggggcgtccactgtcactgaggcttgagtaggtaaacaaagtggccgggaagcttgaactgggtggagcccacctcagctcaaggaagcctgcctacctctgtagactccacctctcggggcagtgcatagctgaacaaaagacagcagaaacttctgcagacttaaacgtccctgtctgacagctttgaacagagtagtggttctcccagcacggagctggagatctgagaatggacagactgcctcctcaagtgggtccctgatccctgagtagcctaactgggagacatctcccagtgggggccaagtgacacctcatacagctggatgcccctctgagacgaagcttccagaggaaggatcaggcagcaacatcttccattctgcaatatttgctgttctgcagtctccgctggtgatacccaggcaaacaggttgtggagtggacctccagcaaactccaacagacctgcagctcagggtcctgactgttagaaggaaaactaacaaacagaacaattttcaaaagccaaagcagtttatgaccttaaagcctttcaccaacctagtttctgacttgcataatttagaccatgtctacattttgaagacatttctacttttattttaccaataattttaaagctagcctgtttatatatagcaatatatgttgttataacatatgacagtaagtgtacaaataaacacatctagacatgtatacatacacaaatgaagatccaatagcttggaaccctagccataagatagcactacaagcttaccagttttactttgtttgccccaatagacaatccaatgaaggctgtgaaccaaaatttcaggtaaattggtttctatgacagtttgatttttaaaagccaaacttccccagactccaaagaacactggggccaaacagcaccaaaggagaacatcacaagttaaaacaggccccctgcttagaacagcagcacaaaaccctggatacatgcaatgcaatcttactttcctattcaacagtaaactccagattccatacaatattggggccaaacagtattgtaactgtgagagaaaattctaaggagggtttagtactagacctcagaacctctgccaagggcatcccgtttggagaggtggaggtccagaggatcccctgggatgtccccctgtgggatccaaccttagagtgtcagatgtctctgaccttaggtaggcactagtgctgctttgtcttctccctccagaggcaatggcctaccacgatctttgtaaggccatgctttctcaggcttcctgttccaccagagtgacagccatgaagtaaaaggcattgcagctttatttttctttcaaaatagttgatctaagcacttgattttctttaagccaatcagagctcttttatataaacatcatacacataacacatgtgtaactacacagactgaaggagattcagtacttgtaagatttttcatgtgccaatctcctatttgcattgctaaccctaggggtggagcacttcaagaaccaggtctaggaaaacatgcaggcaggttctatggcctaataagtaggaatagctggaagacaagaacagattttgagagggatacatccacttgtaatccctggcactccatgaggaaaacagaggtttttttcaaaaatgaatcaatgatgcctcctttgttttcccaagaagtcccaggacttcagaggttatcttggggcccttcatgtgtgcaataagaatggtaagacaaaaatggagactaattcagtcgactgataaaacctttttccagaaaaagaagatccatgagaaaagacatacaggccttttaaatatacctatagctttgataaccatggacatctacttttaaataagctaacttttaactatagcacccctttttaaagtcattttaaatctcttatttcctgactttagccatgccaaatggccatttgaattcttggaggggcagagaatacagtgatttttatccttcctgctaccagtttgcacagagaaagagaagtcagaggccgggcacagtggcttacacctgtaatcccagcactttgggaggctgaggcgggcacatcacgaggtcaggagatcaagaccatcctggctaacacggtgaaacaccgtctctactaaaaatacaaaaaacttagctgggtgtgatggcaggtgcctgtagtcccagctattcgagaggctgaggcaggagaatggcatgaacctgggaggaagagcttgcagtgagctgagatggtgccacgacactccagcctgggcaacagagcaagactccatctcaaaaaaaacacaaaaaacaaaaaacaaaacagaagctagaaatctgactggcaagaacctttacccttttgctggcatgtcaggcttctgggttcccttcccctgagacatggagtgctttgaccctggagtcctgtgaaggggaaaaagctattttctttctccagcctgagggtcaaaggagtccagtgatttaggatacacttgaggagtgcaggctgaaaatgattcactggttacccatctggaaagaggagtaaaaggcttccctttgttcctctctcttcctagcgaatacccggggtatgtgacagggagaaaaggcatccctcttaattatttcgaccttatatccctgagttccggtgacctgtgcaggtgctgaccatgggtgcaagtgcaaccttcacccatgaagttggaggcatagctgacaggcatgcacctgagcagagcctaagcctcccactctccgtcacatttgagttccctagaccctatctatgccatgtatgtaagcatgatattcccatccatgaagcaggaggcctaattgtcaggaattagtcatgctcacctgcactgtgcccttcgactcccgctgtcatctgcctcaggtctattgttccattccagggcttcaaactgaagcttcggagaaaaaggtgcctcaggggggtgtatgaacccattaaattggtcccagatagcccttgccaaattgcagctagcaactggcaggggctgctctaccattgcctccctatcacaagtaggtgaagctgtggggccaagtcctcctcaaacaagggagagagaaagggagtcccagtaactggggacctggcctacgaaggtgacaactaagagattgggtttttcctgagatgcccttcacggtcatgctaagagaggaggcggacctaggttggagaagagaactgaaaggcctgctcaagtccaggaggaggtccaacctcctttccttgatccctagaatcaccctagctcctggatggcaatgacagtctgaaccaccagagtcaacgaaaggaaccctgggaccagtcagtcctgctgcaccatttgggagatggcaatctggaccttgccacccatgtctcagggacagtctgccctccaatgatctacatttgcagcagttgacaggtgcattgtgaggactctgaggtttgtgagcctgcaagttggttattagagcctctgtctttttcttgtgtctccttccctctcttgggcctcccaatcctattttaaaaggccaaggtggccacttccagaggtcctctatagtactctctggtcgtatggcctgtttctgtagcttcctcctgatatcaggggctgaagtcccctcttagatttctgaggaaggcagtgggactctcatccaatccctggtctaccatggatagcccagtgcaatcaagaggtctagtcccagtcccttgcaagccatccaatatgcacacctgtaagggcttccttttccattctcccgtttcatcattggggtcccatttagtgttctccaatggtactgctattcttccaactagataaggctcatccccttccctggtcctatataagatgtaaagcttatcctaaaaattctctgccacttgcagggtggcctgcttttcagcagtggtcagggtttgatgcaaaagtaacatgacatccttccatgagagttcaaatagttaggttaagttctggaaggccaatatatgcctgtcagggccatctgaaaacctgcttggatcccccttaatttgctgtaagccctgaagagaaaaggggacccgaatctaaatgggaccgtgtttaccacacatctgttgtaggagcaggagtgagactgggacctgcctaaaatgacttctaagatgaggcaagcttggaagagaacctggatagggaggagtgaagggagctgattcccctgctgaaggtaccactggggtttgtttccccagttccctgggattgacccttgcagcctctcctgagatggtcactaggaaggctgaatcaatcccacaacgttggcaaagatctgggttacactacaaggcaaagaaaaatagtccaaggtcccttcacataagggacgttggactatttgccctcgtgtttatggaaaagctttcttcttgaggcaatgcttcttttctgtgcctcaaggtgcttagacctaagttgtcaaccaagtaaattacaagaacatttttaccacaagtttacatacagataccaagacatacttttctttgtctgtgctactcttaaccttatattatatactttcaatgactaagccaaatgctcattctacacagtagtatctttgtttggcaacattcttaacattttaatattgtatataaaagaagaaccatgacagcatgagaaaaaagaaagaaacaataataggaaagactaaggtcctagcgcggacaccctaatgggcagtcagggattggaattagtccaggggcctttggataacaccaaggtgtagcctcagccagatactctcagttgctccaggacctccatccagtcccaagtgactgctagacctccatgaagtgaaactgggttggaacaaaaccaacattcccaacaccagagagtgatgggggattaacagtgtcctccccagcaagcctgtcctccttaagtctggcaaccatgctagtcatttttaactggctaagagtccagtgttttttcttcattttggctattatggagtttagagactccaaaaaaaaaggacagaaagcaaattcacttttactcacccttcctgcagatgagccctcaaaatgttacgggatctttggggggtggattttctggccggaaacctctgtggctgcgggtggctttgcctgacttcttgttctgtatgcaggaagaaagaggtatgaagacaagcgaagggtgaacaagatgaagatgagctttattgagtgttccaacagctcagaggagacctgcagcaggtagctcctctcataggcagatcatccgtggagccttcagttctcaacagagaggaggccctggagagggtggcttctctctgcttgtggtcatcccattgtctccagctatcagcagagagggtacctcctctctgcagctggtcctcctgtcctgtctctgccttcttcatcctctggttgtcctctgcccttctctggctgagcccagggcttttatggacctcaaaggggaggaagtgcctgctgattggtccatggttggccatgggtgggcccagaagagccataatgagtccccactctggtctgcaggaccagcagtctggcccccagccttcgggacctccttggcctgaaggtgggggttcactgggaacctgcccccttctacccaggaatcaatctgcctccaggggccaggccaggaattaatcagcctcctggtgccagtcatggcccaggggctcttccccaactcccactccaagactggagcgggtgctggtgtgtccggaattggttgcttccggtcggttcttggtctcactgacttcaagaatgaagccgtggacccttgtggtgagtgttacagttcttaaagatggtgtatccggagtttattccttcagatgttcagatgtgtctggactttcttccttctggtgggttcttgctgacttcagaggtgaagccgcagacctttgcagtgagtgttacagctcttaaaggtggcacatccagagttgttcattcctcccggtgggttcatcgtctcactggcttcaggactgaagctgcagacctttgcggtgagtgttacagctcttaaaggtggcgcgtctggagttgttagttcctccggataggtttgtggtcttgctagcttcaggagtgaagctgcagacgtttgtggtgagtgttacagctcataaaggtagtgcagaccgaaagagtgagcagcagcaagagtttttgagaagagcaaaagaacaaagcttccacagcatggaagaggaccctagggggttgctgttgctggcttgtgtggtctgcttttattcccttatttggccccacgcacatcttgctgattggtccatcttacagagagctgatcagtccattttacagagtgctgattggtccgttttacagagtgctgattggtgtatttacaaacctttagctagacacagagcactgattggtgcatttacaatccttagctagacagaaaagttctccaagtccccacctgacccagaagcccacccggcttcacctctcaccaggagtggagagaggccaggcagccagaccagacacccttgagcctgcagaaaaagtgcgtgtggggggtccttcctggggcttccaagggtataagctgcagagacacctggtcctgtgcctaggagggtggctgaagccacacccaggaaggcagatcttgcttgctgcgggccctacccaaagagcacaagaaggctcggatacacagctgcagtttggatggctatagtcctgcccaggagggccaggctcctgtctgctctgtaaagcaggagacttgggtttgcagctgtggtttgggtgcaacccgggagctctggtcccaactcagaaggggcggggctcccactggcttcatggagtgtgcagcaccaactgagcctcccttctgcagccagtgtcatgtcttctgccatcaatgtcttctatctcagagattctttcctcagctgtctgctaatgagaccatcaaaagcattctttcttttacagtgtttatttctaacattttttaaattctttctcagaattttatcacttcttatattttccatctgttcttgcatgttgcctactctttttaataaggccattagcatagtaatcatagtttaaaaagattcctggtctggtaattccaacattcctgtcatatctcactctgaatccgttgcttgttcagttttttttttttttttaacctgcagttttgttgttgttgtttttgcctgctagtagctctgtaattttttgttgaaaggtagatattgagatactgggtaaaagaaactgcagtaaataggcctttgataatagcggtaaggtgtagggagaaagaaagtgttttatagccctgtgattaagtctcagtttttggtgagcttgtgggcctggactgggaatgttacatgtgcttctgagtatttttccccctccccttaggtgggacagaatggctagagtgggttgaagttgagcatttgccttcctcctggtggatttggctcgtctgacaaaaccctattctgttaggcttttgtaaaatagtttattttgaggacacaccttgttaagaaaaccgtattgctctgggttatttcaaaccatttttttgttttgttttgttttttaccactcacccggttggaagcttgaaaggatttttctcctatactcatcatgagggcctgataaggttctgggggtaaaattcacaaaaatgtgaattgcccccacccttgctcaagcatgagtgggtcctctggagtttctaatacctaaagaaagagtaaacactgaataaaaatgtattttctcttttagagacaagacaatcaaaatctgaattttactttgtaaatcaaagagaacgactaaggcaactctcaatcattttaggaggtttatccgccaaagttaaggacgtgcaccagggaggcaggtctatgcctttctccaaagatgattttgaaggcctcagtattcaaaggagaagggcagatatttggggaagagaaatattttttaaaagattcagtagataaaaggacagaatggttgcatccttttgagtctttgatcagcctttcacttaatatacagttttcctgtgagagggtggtagaggaaatagttactcataacttagtgtggcttagtgaatctgcattttttgtaagacaacatagacaatagggcagaggaagcaatcagatacgcatttatctcaggtgagtggaggaatgactttgagttctatcttttgtcctgcacctgtgaagataagctatcaatttacattgacaaggtgaaattcagcagaactgtttgagggtagagatcttggagcccacaaggaattttcttgtgggcaaattgtgagggaagtatgtagctttttatttttgtagccatcttatttaggaacaaaatgggagacagttttgtgtgatccagttcccagctcgaattttcctttggtttaagtgagtttggggtcccaagatttattttcctttcacaacttatttactgttttttttctctgcattttctcattttcttttaaatgttatgtttgctttatgttaactgtatttattgagtcttattgtgttttttaaaatctaactataaagctcatttaaaaacaacttttccacagataaataatacattaaacaaataagaacgcagatattttgattgaagagatgaaatttgtaaacttttctattctgttatttccccattttttgcagtgtctttataaacactccttcagaaccttctttgaaaaccactaccagtggcaaatccatcaatccttttctttgtgattttgtcccatgttttaatgtttaggaaattttacttaacagtgaactaattggtactactgttaagcttttccttataccactgaatgtttgatactttgaatctctgaaataaactgagaatggacagattaccagtagaaaaggcatacaaatttattatgtgcatacacatggagtctcacaaactataaggctcaatattatattataatattacctattacaatatgtatttttgagttattgtctaatacaaattaataatgtggaatacagtcatctaaatttttttctcctattcaactaaggactagtgttttatatatatatatacacacacacacacacacacacacacacatatatatagtgtgtgtgcgtgcatgtgtataaatcctaaaatcaatatcactagtactttaaacaatcatttttaacttagatttactcctatttttaaacttgcatttcttttcattttttttctgcctgaaatatattaatattttcattattgtggtctgctgatggcaaattctttcagattttatttgttcagaaaatgcctttattttcttttcattcttgaatgtttttgctgaatatagaattctagtttggcagtcatttttatttacaactatatggctttgtttcaactacaaactcagttatcagtctttctgttattccattgaaaataataagactctttaacctagctcatttttaacccagttgttttgaaaaattcttaaccatttacttactaaatatccctctaataagctatctttccctactccttctggaatttcacttagtaatatgttagcacttctaattatgtcctatgtgtcttatttttttctgttcttatgattttgtctcatcatgcttcagtttatgttttcttttgctcttatttcttgctcaccaattccccttttagctaggacttatctggtgtgttaatctcattcacggagttctttttttcaatttttattttagatttaggggtaaatgtgcaagtttgttacatgggtatattgtatagtgctgaagtttcaggtatgaatgatctgtcacccagttttactaagcatagtaatcaataggttttcaacccttcccctcttctctccctcccacctgtagtagtccacagtgtccattgttgccatctttaagttcctatgtatgtagtgtttagcttcctcttataattgagaacatgcagcatttcattttctattcctgccttaattcacttagaatttatgacctccagctgcatccatgttgttgcaaaggacatggtttcattcttttttatggctgtgtggcatttcattgtttacacataccaccttttctttatccaatccaccactgaagggcacctaggttgattccatgtcttggctgttgttgttcacagaattattaatttcagttatacgtttatcatttctcaaggctttcaatggattcttttttacagattacagttctttgccaaaaatcttcatgttatctttaatgtccttggacatttcaattataattattaatttgtgatgcagttttatcacattttaaatatatactttattctgtgtattagtttgttttcatactgctataaagaactatctgagactgggcaacttataaagaaaataggtttaattgtctcatacttccacatggctggggaggcctcaggaaacttatactcatggcagaaggcaaaggggaaggaaggcacatattacatggcggtgggtaaggggccagggagtggactgccaaacatttttataccatcagatcttgtgagaactcactcactattatgagaagagcatggggaaaccatgctcatgattcaattgcctcccaccaggtacctcaacaaatggggattgcaatttgagatgagatttgggtggagatgaaaagccaaatcatatcattctgtttcactgaaatttgtttagtcttatgctgatttcatattgatttaaaaatagctttagttttatgttatctttggataactgatgagacaatttattactattccgaaaatgtattatatatttaaaatagaaacttcctcactcaagaacatggtgtatattttgcatttattttagtcttttttactcaatacagttccatagagtttctatactttttttgaggtaattcctagtttttatatcgttttgtgaatattttgtgaataggattattttcttattatattttctaactaagcattgttaggatatgtaaaagctatttcactagctctctctatatttgtaaccaactgcctcaatgaacacatattaattctaaacatttcaattgtttttcttttatttatttttaagtaaacaatgcaatctgggaataattatcattttatctctcacatagatatattttattttcatttattatcttaatgcattaaatagaactttttttttttgagacagggtctcattctgttgcccaggctggagtgcagtggcatgatctcggctcactgcaacctctgcctcctgggttcaagcagttctctgcctcagcctcccaagtagctgggattacaggtgcccgccaccatgcctggctaatttttgaatttttagtagagacggggtttcaccatcttggccaggctgatcttgaactcctgacctcgtgatccacccacctcggcctcccaaagtgctgggattacaggcttgagccaccgtgcctggcctaaatagaacatttttaaacatagtattaaataattatgacaatagtgagcagttttttaatgtattttgttttaatagtatgcttctagtgatttaccatattgtgtgatgtaggctcttggtttaagggaagaaaaatgtaagagtagaagcatacttgtcaaaaagtcttgagttgaaaatctaaaatctaacttgcaactttgtagatataacatcatgaataatttatctaacctgagtctcttcatttttaaaaaggtgaagcatttagctagttcttaggatgcttatgaaacttaaggagatagtgcatatgaagtacttaaatgtacaaaattatgcacataataggtaagatacacagacacacacacacacatcttcaccatttttcactctgctttatgcctcaaccatgtgacttttacaaactgcatcagctgtactttctgaccatctagtttctggttggatttaatacaatggaagacaccagaacatattacaggtgaaaagagggtgaggtctgagttattattccctggttcctttcttgcctgttagacgaggttggctgttatcctattgccaaatgccatagtagtccctcttctgcaactgtagccctctcaggacatcaaggacccatattttccgttgtactttcaggcttacagacaacttcttgctgtcccctcatcccctcgttgacttccctcaccacttcctatttacttttgtaaataatttcttcattaaaaatccacttaagtgtcccttctgagggtgtaatcatcttgtttgatgaatctatgtaagcatatataacatttccaaacaaccctagagtgctaaaccagatccatactgtttggctcctacctactctagaattgtattctgaccactggccttgacaagtcatctgtagttttctgattgggctgctatttcatgtgcctgtgctaatgctctttcctctgctttgaatgtctcttctatccacttttcaatttcttctctgaagtcttttctgatacactaggtaaaaatttacagttatcttttaaacatctatctatacatggaattttatatagaattttctcatagtaatgcagtaataatttattttatttgcatgatcaaaagttgtacttttgttattaaactggaatctctgtaaaggatgtggccttgtcttttcatcattgtttttgccatggcttacatataattcatggcacagtaggtactgaagaaatgtttacataataaatgactctagctattattattaggagttagctcatacaatttatgttagaattgaaatattgtgagaaaggttgtaagcttcatcatgcagaagttgtgtttagtgtgaaagtagggcttatgtattttcaatgccctgacatgtttttgtagcaagttgacacattgcttttgtactaccaggtggaattccacagagcttaaaccagacagggattaacaacagtttgagctgtctgagagcactattgactctttttccagtagcattgaaacaggaaaaggaggggataaaagaaaatttaattattgcactattttaaaagcagtaatttgctgatttcggagagtgacttgatactgtggaattttgattttctccagtgctcacatagaaaagagtaaggcattaataaatatttattgactattgtacaaataaaaatttaatcttctaataaaaatttaatcttctaggaggattttttttacaatggaaaatataccccaaacggttactaagaggatggggaatgttttgtcctgtaattataatgataaatgttcaaaaatgtaattacagttttattttataattatgacaaatgtacatatgaagaaatattcagcttcataagtagtcaaggaaatacaaattaaaactatcaggaaatatgattatatgcccaacaagttgaaaaaaaattcagaagtgggaaaataaaaatttttgttaaggatatgatgctatagctgttacatgctaattttgggagtataaatccatacaattactttgagaaacaacattacctaatgtagataaacattcccatagttataattcacccttatgcctgtagtaccacagagcaactatgtatgtagttgcatatgtgtgctatacaatacttgtgcatatatgtaccaagagacacaagattattcacaatagcattgtttatgataaattgctattcacaatagaatggttgtaaattgtagcctatccacacaatagaatgctatattatggtgaatggactaagacaataatacatgcctatcatcatatttgaacctcagaatgttacatgttaaatttaaaggtgagaagcaaattatggttaataatgtgcaacatgattccatttgtatcaaatttgaaaataagtaataccaaatataatattatttaggaatataaatacacatgatgaattataaagaaaatcaaatttcttggaaatgttctattcttaagctggataatgtatgtttatgttcggtttctttttagtttattatttcaaatttacatgtgcattatgtttcatccatatcttttacatatcatataggatttttaaaaattatgtaaataaccttaaaataagtctattcccatttacaaatgcaaacactaaaaatccattaaaggcagggctaatgtgtttggaaaaaatctattgggaaactcctttaggcacagataaaatgaaaatattctctgtgttcaacaaaattaccttagtgtatacagcagattttcttgtttacattttaaaaaatattttatttttaattgacaaataatagttgtattttgtatggcttacagtgtgatgttttgaagcatgtatacgttgtggaatgattgaattaggtaaattaatatatctgtcatctcacatagttatcatttctttgtggtagaacatttaaaaccactctttttagcaatttaaaatgtacaatacattattattaactgtgcaatagacaaccagaaccttcctgtctaatgaaattttgtaccctttgatcaacatctcttcctgtctaccactgtccccatccccaccttcagcttccagtgaccaccattctactgtctacttatatgtttgacttttttagattttgcatataggtgagatcattgagtatttaactttttgtgcctggtttatttcacttagcacaatgcactctacattcacctatgttgttataaatgacagaattttcttctttttttaaggcataatagtgttccatttcgtgtatataccacttaaaaaattcatttatccattgatgagcacttcagttgtttctatatcttgactattgtgaataatgctgcaatgaatgtgggagtgcagttatctctttgacgtgctgatttccattccgttggagatatactcaaaagtgggattgctgggtcaaataataattctatttttagttttttggagaaccctcatctgttttccaaaatgtctgtcataatttatattaccaccagcaacgtacaaggagttctcttttctccccattcttaccaacacttggttatcttttttctttttgataataaccattttaacaggtgtgaggtgatatttcattttggttttaatttatatttttctgatggttagtaatgctgaatatttttttcatacctgttgaccacgcatattttttttgaaaaatgtctatcccagtcctttgcctatgttttttaaatagggatacttgttttctcattgagtaatttgagtttcttatatatttgaatattagcaccttacctgatttatgatttgcaaatattttctctcagtctgtgggttgtgcattgacctttttttttttttttttttttgctgtggataagctttttagtttgatgcaagctcatttgtctatttttgcttttgtcgtctagactttttgggtaacattaaggaaatcactatccagaccaatgtcacggagctttcccctatattttcttcttgtggttttatagtcttagttcttacatttaagtctttaatccattttgagttgattttcatataagggatgagataagggttcaactttattattctgcatgtggatatccagttttctaaacaccatttattaaagagaccttcctttctccaagattgctttggctgttggagatcttttgtaattccacataaatattagaatagtttttttctatttctgtgaagaatggctttgtaattttgatagggattgaatttaatccctagattgttttgggtagtatggatactctcacaatattaattcttcccattcatgaacatagaatatctttccatttatttgtgttttctttcaccagtgtcctgtagttttcagtatatagatctttcatgtccttagttaaatttacttctaaatatttcattttattttctgatgcttttataaatgctattgctttcttaagttcttttataaatagtttttagaaagtagaaatgatactgattgctttatgttggttttgtgacctactaatttactaagtttgcttatgagttttaacaacttttttttggaatccttaggattatcaataagatcattctatcggcaaacagaaacaattttactttttcctttcctatttcaatgtcttttatttctttctcttgcaaaattgctctgtctagaatttccattactatgctgaacagaagtggtgagagtggatattcttgttttattcctgatcttaggggaaaagtcttcaatttttcacccttgagaataatattagctgttgccttgtcacctatggcctttatagtgttggggaacatttctttaaaaattccaacaaattctttgggtttcctggatctggatttctatttcctttctcaggctatgccattatttctttcaatataatttttgtgtcatccaatctttcttctcattctgatacactaattattcatatgtcatccacttgatggtgtcccataagtctctttcctgttttcactctttattctttttctcttctttgctcctcagattggaagatttccagtgatctatctttgagttgactgattatttcttctgcaactgacaaacatttaactaggttagctaagaagcaatgagagaagactcaagtaaaatcagaaatcaaagaggagacattacaactgctaacacagaagtaaagagaattaatttaattatgagactagtataaaaattatacaacaaaaaattggataacctagaacaaaattcatcagataaattcctggaaaaataaaacctttgaagactgaatcatgaataaatcagaaaactgaacagaccaataatgagtaagtagattgaaacaggaataaaaggtctgctatcaaagaaaaacttaggaccaggtggcttcatggctgaattttaccaaacatttgaagaactaataccaatcattctcacactctttcaaaaactaaagagaagtgaatacttccaaaccattttaagagatgagtattatcatgataccaaatccagacaaaaacacaacaataaaaggaagctacaggcaaatatccctgatgaacataggtgcaaaaatactcaacaatatactagtaaactaaactcaacagtacattaaagagataatttactatgtcctctttatattaaagtaatctgtatggcttatgaattacattttaatgtctactttcaaaagattggaatgtactgtatcactctccttattttcttgccatttgacctatgcttatcacttatgtgctttttcttatattttagtaaataatttataggaaaaaaatccactttttactaaaatcaacttcaaaccattaatctcgtttacagaaagccaatttctatgttgacttttatgtgtcagtgtgggtgagctttccattgagaaaacaacaacaatattattcagaataaggaacactctttaatcttaccctctaaaaacaaagataaatgagatagcagataatttagacagtctgaaaaaatttttgtctctaatttaaagttaagattgaccacagcttttatgtgaaatttgatttataaaatattgtggatttgatactcctaataatgctttttacatttgtaaaggacatgcttttatctttttttttttttttttttttttttgaggcgaagtttcgctcttgttgcccaggctggagtgcaatggcgcgatcttggctcactgcaacctccgcatcccgggttcaagcaattctcctgcctcagccttcagagtagctgggataacaggcatgctccaacacgcctggctaatttttgtatttttagtagagatggggtttctccatgttggtctcgaactcccgacctcaggcgatccacctgcctcagcctcccaaagtgctgggattatgggcgtgacccaccatctccagctggacatgctttatattttaataactgattataacactcaatgtagcaaattaatgatttttttctggaaaaaagtataatctatgccacagtctaggcatattttaaagttgactgtatatagctgaacattccaagtaatgagttatacaatgtaacttttcatggtagtaatgttaagattatgtcgtaatgttaagattatgacttgtaatgttaagactagtaatgttaagattatgacttaaaaaatttacattttgagtcaatcagggagttattcacaaaatcaaaattttcaaaaagtttatattttccctttgtagtctccatttttcttattagtcactgaagaacaagagtatttgtcttcttgtgtagttttattatgggcaatatattttccttttttaaaattaaaagaataaagactataataaataacactgagggctggatgtggtggctcatgcttgtaatcctggctctttgggaggccaaaattggcagatcacttgagcccaagagtttgagaccagtctgggcaacatggagaaaaatcatctctacaaaaaaaaaaaaaaaaaaaaaaaaaaggcaaaaacaatttagcctgccatggtggcactcaccagttaataccagctacttcacaggctgaggtgggactttgcttagcctagcaaagtcgagactgtagtgagccgtgatctacttcagcctgggtggcagaataagaccccatttccaaaaaataaaaaaaattaaaattcacactgagtatgtaattccaaatgatttctctcaaagaaatatttctggataaataaatattacagacaaattagctgttcagtataaaaaacagatttttatttagaaataatatgtccccatataagaagtcccataaggtatgttcttctacaaacattatgtcaaaggctacctgtgatctcaaagcatcagcttgaccacctgtcatttatttctcaggttaaatgctgttttatgaagaaatgatgatataagagcaatatgataacatcgtagatcctttcaatgttgttgaaaaatgtgacagaaaaaatattttagattgaattactttacttataataaagaattgagcttctacaaatgcatattaatcagtttttgctaatttaagtgattttgttacttttaagttttaaaaggcagatttatcaacagctctcaaatacttgcttttttctgttatgactactttcttttggtcatcttcatgcatgcttgaagttttaggattcataacatttggaaatgtatcactttaaagaatgagggaagtcacacagtgtaccataattctttttggtgcttcagtgactaatatggtgagtgtttcccagacctccaaggtgcttatttccttgactgggagaagtattgcttgctgctggctttcagccaccagctctgagcaagagtactatccagccaagcttatgccctctctgacatctaatgactgggtcacagggtgagtggtattttatgccatatttactgtacacatttatccacttccttagtgcatatctggctcactgctctgtatttacacctcaatgtgactttatttccagatttaaaacatatttcgagaaagcatacaaaattcaccaactcaggtgaatacacagtttgatagagtttattttagagataaagtttattctaatagctttgaaaatgacttcactcatgtattgtagaatcattaagagtcaaagggattgcttactttttttggttacactttgccgtgttttaggaagcaaattatttgctgtactggtattaagggatttgcaaaaatctcaggatgtagactaataataaaagctgacatttattgagctttacatttattgcatttaatattcataatcatgtaattaggtagacattattatttttaccattttaacagatgggtaaacccgagtttgctaatatttacttgggacttagatctggagcacaaacttaggatattctggtagcaaagactcttctctcaaccactgcttcttaaataatagtgatctgcagaacttaatacacatatgcccataacctcccacatacccacacatggagacagactttcacagtgtgtgtacaagaggggtgtggttatagcaatttggttggaaaattgggcaagctttggaagctttttacagaaagttaagaaacatcaacattctatttaaaagtagagaatataatttggatatgacacagactatggaaagactctggcattattctttgtgtgtgtgtgtgtctgtgtgcgtgcgcgcgcgcattgtgtactcacacacattcaagaatgcccaagtattatggcagagattccaagttacatgggttttagataccactgaactgtaacatcactatatttttcttatgaagtcctctatggccttcatttgctatattttccccaaatttctggtttttccctctctctaatttctagagtttttagtttcctttttaccatgttctcttggtaacatcacaattctcttattacccagattctggtctttaacctaagaattactgagctataatttatataaagtgaaatccccctttaaagtgtccagtttgatggattttggcaatgtgtacaattatataaccatcaccgcaatcaagagacagagttttatgcccctttgcagtacatcttcctgaaaccttggccctttttgtcatcagagtttgaccttcactagaatttcatttaaacagaatcatatagtgtgaagttgtatgtgctagacttcattttaatcataatatttaaatttattcctgttgttgcatgcctcaatatttcattcctttttattgcttagtagcattccatagtatggatatactgtaatttgttcatccattagacaagttatggtcatttgaactgtttctagtatctgactattgtgaataatgattttatgaacattcttggacaattttatgtggacatctgttgtctgttcacagttgtactctgggttaacacacagaagtgggattcccgggtcatactatgttatgttttacttaataagaaactgacttaccattttctaacggaggtgtaccaagtttcactactgttggcaatgtgtgagaattccagttgctccacatcctgaccaaaacagaattgccagtccattaaattttacccattcctgtgaatggatatgttattttactatggatttaattttcatttctttaataattaatgatgttgaacatgttttatgggcttatttgccacttatatgtcttttgtgcccattaaaacttctttgtatatcttcttcttattgacttttatgaattttttatgtactctggaaacaagcaattagtcatgcattttctgcaaatattttctatcagtttgtggcttgtctttttacttccttgtgtctttcaaagagcaaaaggttttaatatgtcacaaaattttctcttatatttcattctagagattttagggttttagctcttcatgtaagcctgtgatccattttaattggctatttaacttttgtgtatggtgtggataagtgttgaggttcctttatttccatgcaaataggcagtatgatttgttgcaaagtctatttctccccattgaattatctttgtaagtttgtcaaaaattgattcataaaagaactatgagtctatttctgaattatattttatgttatgtaaatccaaatgttgattcctatgccagcataacattttgtcatgattacaatggcttttattaagctttaaaatcagggagtgtgagttatcccatcttaccttcttttcaaaattgttttgccttttctaagtcccctctgtctatgtaagtattagaatcctcttgatgattagtacacaacaagcctgctgaggttttgattgggattatgtaaaactgggattaatttttggagaattgacattctaacaaagctaatccattagcatattatctttctccacttatttagatattatttaattttgtgttttataactttaaaagtatgagtttcttaaaaaaagtaattttgacatttattttagattcagggagcacatgttcaggtttgttacatgggcatattgtatgatgctgagtgatatggtttgggtgtgtcctcacccaaatctcatcttgaattctcacatgttatgagagggaccccatggggaggtaattgtatcatgggggcaggcttttcctgtgctgttctcatgatagtgaataagtctcacaagatctgatggttttaaaaaggggagtttccctgcacaatctctcttctcttgtctgctgccatgtcagacatgcctttcaccttctgccatgattgaggccgtgtggaactttaagtccattaaacctctttcttttgtaaattgcccagtctcagatatgtctttatcagcagcatgatgcagtaaattggtaccagtagagtggggcactgctgaaaatatacccaaaaaagtgaaagcaactttggaactgggtaacaggcagaggttgaaacagtttggagggctcagaagaagacagaaaaatgtgagaaagtttggaacttcctaaagacttgtagaatggcttttcccaaaatgctgatagtgatatggacaataaagtccagactaaggtggtcttagacagaaaggaggaactttttgggaactagagcaaagacaactcttgttatgttttagcaaagagactggtgatattttgtacctgctctagagatctgtggaactttgaactcaagagagatgattttgggtatctggcagaagaaatttctaagcagcaaagcattcaagaggtgaattgggtgctgttaaaagcattcagttttataagggaagaagagtataaaagtttgaaaaatttgcagcctgacaatttgatagaaaagaaaatcccattttctgaggagaaattcaagccaattgcagaaatgtgcctagtaatgagaggtttagcatttgttcatcaccaaaacaatggagagaatgtctccagggcatgtcagagacttttgtgtcagcctctcccatcacaggctcagaggactaggagaaaaaaacggtttcatgggctgggcccagggtccctctgctgtgttcagtttagggacttggcaccctgcatcccagcctctccagccatgactaaaagtggcaaacatagagcttgggctgtggcttcagagggtaaaagccccaggccttggcagcttccacatgatattgagtctgtgagtgcacagaagtcaagacccaaggtttggaaacctccacctatatttcacaggatgtgtagaaacacctagatacccaggcagaagtttgccacaggggtggggcccttatggagaatctctcttagggcagaggaagggaaatgtggggttggagccccaacacagagtccctactggggcgcaatctagtggagctgtgagaagagggccatcatcctgcagaccccagaaaggtagatccaccaacatcttgcactgtgtgtctggaaaagctgcagacactcaatgccagcctgtgaaagcagccaagagggggcttataccctgcaaagccatagggacagagctgctcaaggctgtgggagcccacctcttgcatcagtgtgacctgtatgtgagacatggagtcaaaggagatcattttaaagctttaggatttgactgccccactggactttggacttgcatgaggcctgcagcacctttgttttggccaatttctcccatttggaatgggtatatttacccaaggcccatacccccattgtatctaggaagtaactaactagattttgattttacaggctcataggcagaagggacttcccttgtctcaagtgagactttagactgtgaacttttgagttaatggtgaaatgagttaagactttgggggactgttgggaaggcatgattggctttgaaattggtgaggacatgagatttgggaggggtcggggtggaatgacatggtttggctgtgtccccatccaaatctcatcttgaattcccacatgttgtgggagggatccagtgggaggtaattgaatcatgggggcaggtctttcgtgtgctttacttgtgatagtgaataagtctcataagatctgatagttttaaaaaggagattttcccttcccaagctgtcttctcttgtctgctgccaagtgagacatgcctttcaccttctgccatgattatgaggcctccccagccatgtggaactttaagtccattaaacctttcttttgtaaactgcccggtcttgggtatgtctttgtcagcagtgtgaaagcaggctaatacattaaggtttgggttattgatctcattacccaggtagtgagcatattacccactagccagtttttcaacccatggtgccttcccttcctcctgcctagtagctgatagttgtttccatctttacatccatgtatactcaatgtgtagtttccatttataagtgagaaacatgcaatattttattttctgttcttgcatcaattcacttaggattatgggctcaagctgcatccatgttgctacaaatgacatggttttattatttctttatggatgcatagtattccatgatgtgggtgtgtactacatttcctttaaccagtacaccattgaataacactgcaatgaacatgtaagtgcatgtgtctttttggtagaataatttgttttctttgggtatatactcagaaatgggtttgctagattgaatggtagctctcctttaagttctttgagatatctccaaactacattcaacagtgagtgaactaacttgcattcccaccaacaatggttaagccttcccctttttccacagcctcaccagtacctgttattttggtacttttataatagctattatgactggtgtaatatatcacctcattgtttttttgttattgttgcttgttttttcctgagatgggagtcttgctatgttgcccaggctggagtgctgtggtgcaatatcggctcaccgcaacctctacctcctgagttcaagcaattctcctgcctcagcctcccaagtacctgagattacagtgcacaccatcacgtccatctaattttcctatttttagtagagatagggtttcaccatgttggctagcctggtctcgaactcctgacttcgtgatctgcctgcctcagcctcccaaagtgctgcgattacaggcatgatccaccatgcccagccctcactgtggttttgatttgtatttctctgacaattagtgatgatgagcagttttatatgtttattggccatttgtatgtcttcttttaagaagtatctgttcatgttctctgcccatttttctaatggggtttttcttttttgcttgttgaattgtttaaattccttatagattctggatattagaactttgatggatgcatagttcacaaatatttttttcccattctgtaggttctgtttactcttttagtagtttcttacgctgtgcagaagctctttaatttaattaggttccagttgacaatttttgtttttgttgtaattgcttttggggacttattcaaaaactctttgccaaagctagcattgaaaaggatatttcctaaattttctggtaggatttttatagtttgaggtattacatttaaatctttaatccatcttgagtttatttttgtatatgatgattggtaggggtccaactttgttcttctgcttatggatagcgagttattccagcaccatatgttgaacaggatgttcttacctattgcttatttttgtccactctgttgaagatcacctggttgtagatgtacagctatttctgagttctctattctgttccattggttgatgtgtctgtttttgtgtagtaccatgctgttttggttgctttagccttatagtatagtttgaagttgggtagtaggatacctccagctttgttcttcttgcttaggattgctttggctattccacttcatttttggttgcatataaattctagaatagtgtttttctatttctatgaaaaaatgacataggtagtttgacaggaatagcattgaatctgtaaattattttgggtagtgtggccattttaataacattgatttttctaatccatgaacatggaatgtttttccatttatttgtctcatctctgatttctttcatcagtgtttaattctccttgtagagatcttttacatccttggttagctgcattcctaggtatttcattttctttgtggtaactataaatgaggttgtgtttcttattttgactctcagcttgaaccttattggacatagaaatgctactaatttttgtagactgattttgtatcctgagactactgaagttgtttatcagttctaggggccttttggcagtctttagcattttgtaggtatagaatcataatgtcaataaagagagacagttgggcttcctttcctgtttaggtgcatattatttctttctcttgtccaattgctttggctaggacttccagtactatgttgaataggagtggtgagagtgggcttccttgtcttgttccagttctcaagagaaatggtttcagtttttgccaattctgtatgatgttggctgtgggtttgtcatagatggctcttattattttgaagtgtgtgccttcaattcctcgtctgttgggagtttgtatcataatggagaattggattttatccaaagcttttctgtgtctattgagaataattttttcttttaattctgtttatgttgtgaatcacatttattgatttgtgtatgttaaaccagcattgtatcccagaaataaagcctacttacttgatcatggtgtattaactttctcatttactgctggatttggtttgctagtattttgttcagaacttttgtgtctatgttcatcagagatattgacctgaagtttccatttgtgttgtcagtcttcccgattttggtatcaggctgacgctagcttaatataatgagcaggaaggaaactctccttcattttttgtaacagtctcaggaggattggtaccatttcttctttgtacatatggtagaatttggctgtgaatcaatctggtccagggcatttttggttgataggttttttttttttttttttattactgattcaattttgaaattcactattggtctatttaggttttcactttcttcctgattcaatttccagaggttgtatgtttccaggaacttatctatttccactaggttttctaatttgcgtgcattcagttggtcataatagtctctgaggatcttttgtgttttttgggatcagttataatgtcacttttgtcatttctattaaaaattatttttattttttgtgggtacatggtgtatatatttatggagtacatgagatattttaatataggcacaaaatacataataatcatatcagaggtatccatcaggtggggtatgcatcacctcaagtatttattctttctctgtgttacaaaccatccaatccaattatactgttttaattattttaaaatgtacaataaattattgttgactgtggccaccctgttgtgctatgaaagactagattttattcattctatctaactatattttcgtatcctttaaccatcccacatccccccctttcccagcctatgatattcattattctcttctctacctccattgatgcaattgtcttaatttttagcttccacaaataagtgagaacatgtgaagtttgtttttctgtgcctggcttatttcacttaatataatgacttccagttccatccaagttgaaaacgacaggatctcatccttttttatggctgaatagtactccattgtgtccaggtatcacattttctttatccatttttttgttgatggataattagattgcttcaaaatcttgactgttgtgaatagtgctgcaaaaaacatgagatcacagggaatgatggctcatacctgtaaccccagcactttgggaggctaaggtggttaggattgtttgaactttggagtttgagacaagcacaggcaacatagtgagattgtgactctactaaacattaaaaaaatcagccaggcatggtgacgtgtgcctgtagtgccaactactcaggaagctgaggtgagaggatcatttgagcctgggagatcaaagctgcagtgatctcagatcaaggctgcagtgagctgcgatcatgccactgcagcccagcctgggagacaaagcaagacagcatctcaaaacaaataaatacatacatacatacatacatacatacatacataggtatgcagatatctctttgatatgctgacttcctttcttttgggtatatacctaggtgtgggactgctagaaatagaatggtagtttctagttttagtttttattttattttattttttaatttttttcagatggagtctcgctctgttgcccaggctagagtgcagtggcacgatcctggctcactgcaacctctgcctcccaggttcaagtgattctcctgtctcagcctcccaagtagctgggattacaggcacatgccaccatgcccagctaattttttgtattttagtagagatggggtttcaccatgttgcccaggctggtctctaactcctgagctcaggcaatccacccacctcggcctcccaaagtgttaggattacaggcatgagccaccatgcctggctagttttagtttttatactgttctttatagtgcttgtactaatttacaattcccatcaacagtgtacgagggttcccttttctccacatccttgccagcattcagcatttattattgcctctcctttgaataaaagccattttaactgggaaggtaggacagcccattgtagttttgatttgcatttttctgatgaccaatcatgttgagcattttttcatacacctatttgccatgtgtgtatcttcttatgataaatgtctaatccgatcttttgccagttttaaaatcagattattagattctttgctatagaattgttcaagtttcttatatattttggttattaatcccatgtcagatgggtagtttgcaaatattttattccattctgtgggttgtcttttcactttgctgattgtttcctttgctgtgcagaagctttataacttgacattatttcatttgtccattttgcttcggttgtctgtgtttgtggaatattacttgagatctttgcctagaccagcgtcctagatagtttctccaatgctttcctgtagtagttccatggtttatgttcttagatttaaatctttaattcattttgattggtttttgtttatagtgagaagagttcagtttcatttttctgcatatggacatacagttttcccaataccttttattgaagagattgtcctttcccaatgtatgtttttggcatctttataaaaaatgagttcagtgtaggtgtgtgaatttgtttctgggttgtctattctgtttcattggtctatgtgtctgcttttatgccagtaccaggctgttttggttactatagctctgtagtataatttgaagtcaggtaatgtgattccttcaattttgttcttttcactcaggatatctttcactattctgggtcttttgttgtttcatataaattttctgattgctttttctatttttgtgaagaatttaatatgtgttttgatagaaatcacattgaatctatagattgctttaggtagtgtgacattttaacaataatgattcttcccatccatgaacatggaatatctttttcatttttggtgtcctcttaaatttctttcaacaatgttttatagttttcattttagaggtctttcactctttggtaaatttctatgtatttagttttatgtgtggctattgtacatgggattacttttttgatttctgtttcagattgtttactgtcattatatagaaatactacaaaattttgttcattttgcatcctgaaactttactgaatttatcagttctgataatttgggtggtggtagtctttaggtgtttccaaatataagattatatcatctgcaaacaatgataatttgacttcttcctttggaaattggatgccctttatttctttatcttatgtgattgctctgtctacgattcctagtattatgttgaatgacagtggtgaaagtgggcatcctttcatattccagatcttaaaggaaaggatttcagtttttcctcatttaatgtgataccagctgtgtgtctgtcatatatggtttttatttttgtcatttatgattgtacttattcagatattctctctctgacacacactctctctgtctctctctctctctctcttttgttaatctagttagtgctctgccaatcttattcattctgttgaagaaccacccttggtttcattgatatttgtgtggaattttgtgtctcaatattgttcagttcttttccagttttagttatttcttttcttctgctagctttggaattggtctactattttccccctccagttcttctaggtgcattaagttagattgttactttgcaatctttctaacttcttgatgaaggtgtttagttctgtaaacttctcttaacattacttgagctgtgtcccaaagatttggtaagttgtgccctactttcattaatttcaatgaattttttgatttctgccttaattttgttgttcagccagaagttattcaggagcaaatgttcaagttccatgtatttgtgtagttttgagagatcttcttgatattgattctatttttattgcactgttgtaaagagtgtgcttagtatgagttcaattttcttgaatttattgagacttgctttatgactgagcatgtagttgatcttagaatgtgttctgtgtgcagatgagaagaatgtatattatgtgattgttgctgaattattctgtagatatccattttgtccagttgactgagtgtaaattttgagtctagatgttctttcttagttttctgcctcagtgttctgtgtaacactcaggggagtgttgaagtctcccactattattgtgtagctgtctaagtcttttcataggtcaaggataacttgttttattactctgggtgttccaatgttgggtgcatatatgtttagtatagttaagtctttttttttaaaattatacgccttatcgttaggtaatgcccttttttgttctttttaatttttgttggttttaaatctcttttatctgatataataataccaactcctgctatttttgttttagcctgtgagtatcattaaatataacatgggccttttgaagatagcagacagttgggtcttatctttttattcaggttgccactctatgtcttaaatgaagcatttagaccattttcattcagagttagtattgatatacgaaattttgatcctatcatcatgttgttagttggttgttttgtaaatttgattgtgtagtttttttttaagtgtctgtggcctgcgcttaagtgtgtccttgtggtagcaagtgtcattcttctgaatccatgcttaacattcccttaagagcctctcatgaggctgatctagttgttaggaattctcttagactctacttgtctgagaaggattatctctccttcacttatgaaacttactttggcaggatatgaaattcctatttggaatttcttttctttaaggatgctgaaaatagggtcacaatttctggcttgtaaggtctgctgctagtctgattgggtccccttcgtatgtgccttgacccttctctctagatgcctttaagatttttattttcacatttactttggcgaaatctgaaaggcactatatgccttggtgatagtcatcttatatagtacctaccagaggttctctgtatttcttgaatttgcatgtcaacctctttattgaaattatggaaattttcatggaccatgtcttcaaatatattttccaagttgcttactctctctccttctctcttaggaatgccaatgtgttgtaggtttggtctctttatataatccaatatttcttggagattttattcattttttaaaattgttttttctttatttttgtctgagtgcactgacttgaagaaccagtcttcaagctctcagatttttttttttcagcttggtctatttttctgttaatactgctgaatacattatgaacatttttattgaatttttttcaattccagaagagcaatgttgttcttccttaaaatggctttctttcatctcttttatctcatggattgttttactagagtcctgggattgggtttcaactttctcttgaatctcaatgggcttccttttcttcctgattctgaattctatttttgtcatttcagtcatttcagtctggttaagaacaatcgctgggcagctagtgggctcatttggaggtaaggggacattgtagctttttaaattgctagagtttttgtgctgcttatagctcatctgagaaggctggtgttctttactgtggtgtaatttgagtagactcaattgcttcatttctggatgctttcagagggacaaggctctgtatgggatctttatttgtggctggattctagcctttggtatcacaggggtgtgtattaaaagaatatttttggtgttgcagcttgggctgtgatccagtagatgctgttttagagtagtgaccagcagataggctgttattcagccacatggctcttttatatttccttgcattaacagccatgctctttggtggaggaagagagagatgacctcatcactatgtctgctcctgggccttgagggatccctctctgatcactggtgctgtacctgtgcacttcctttgttagatgttctggactacagggctctattgggtagaggtcgtggcagggaggtaggccacaccttttccagcccagcccagtacagggaggcccatcctgctcctgcaccagtcaatgatcctgcatgtttcatccctctcagtactctgacagtggaggctcctccccaactctggtgccatccacaaatctttgctcagcattcccaagatgcctgtcacagccctggggcaatgggatcaggccatagctccatccttcagacccttggagttgagctgcaactgtgctgaggaatctgaagtgatactaggtcactgggaaactactcggggagcaaatcacccaggctggacagcaaagtctgtgatgtgcacaaaaggccctggtagggactggtgggcaggagggcctatagaacagatgtgccacagtccttgggtaagccagccccactgtctcctggccaggtggacagctggggctagagctaattggagagagatgtggaatcctgggggatagggtgcctatgggcacaaaggcctctggctccatctgtctctgcctactctctgggaagattagcctgctatttcaaatgtccatgagggacactggttcccttgtagctagcatccccatggtccacagcaagagtgggttctttctctgtcccttgacccactcttttcccagaatccattcagggctggaaactagctctaacatttgagtaccccagcagggtccccagcttcctttctcttcagcctcaatgtgtgtgtcgcttctccgtcaactctcggtgttttctgtctgaagatctgctcaaagtaggttggttttgttgatattttggtcactctcagtgggagtggcacttcctgccttttgttaagtgccatgaataaaataagccacatgctttgataaagaataataataggagtggaggatataggttgtgtgctacgtatgggtcaaggaagaggcctttttggggctgtgataattaagctggaatctgaagggggacaaagagccctcttcatgaatagcaaaatgaaggaacaacttgtatgaggatctttagatgagaatgcttttagaggcatcaaataactgagaggaggcttataaagcttggtggggatgcaggtggaacaaaataagtttgaagaactaggcaggatttaggtcaagtagggatttgtggacaattgtaggaaacacaatttctggcttaatggatgaggagataagaatacataaatatttatgaaacagaatgggaagttctacagtggaggcagaaaccatgaaccaggggcaggcatgcttttaatttaaacgttaagatagtaaatgtctgttgcaactactcgattctgcattatactgcagaaacagacatggtaaatcaacaagtgagagtggctgtgttcccaacaaactagttacaaaaacagtgagtggctggatatggcccataggccatagattcctgacccctgacataaaccaagagttcttgcctctaattctgactcaggataaaaatcacagagttggaaattcaggtagagttttgaagggtaagaagtgttttagtaaaaagaaaaataaggggattatataccagatagagcaaagcacaaggacattaaagggaatatactattattgctggggtagcaaaactggggcatatttggacagcagtgtgtgtatgggtggtgtgtgtgtgtgtgtgtgtgtgagagagagagagagacagagagtcaaaaacacaatggaatgataaaaatgaaactggtcaggctggcgttctgaaaaacatacaaagacattggacttaactgaaaggcagattcctaaaatatttcattaccatgcttacatttaaatgttgagtgacattcatgtgaaagatgaattggaattggacaacagtagaagtatttttcttgtcaaaaatccccaatggctttctgtttcttgccaaataagtctaaatccctatcgatattaagacctgccatgatttccacttatacccccagtctaattttatttgctctcattttcccaagagagaaagcccctccctaagactgatttccacctggtaatttggcttctgttatctaaaggatcagcttctcctgtttattattttattttttttaataaattcagaaagcatttctagatgtttcctaaggctattttctcccaccctggatctcttccgttgactgtgattcatgttttgggcacctagctatgcaaggtcttatttgtgcttctgttgtatgtttcatatgtctcaccaggattgtaaacttcttgagcagagaaatcattgcttcctataaaaagggcttgttttaatgctgaggatgctgagaattctcaataaacattaattgatgtaaacatcaataacattgaaaattctatctgagcacaaactaatgcaaaactagtttataaacctgatcaatgttttcattaggatttctaaaacattcctcacattgctgtttaatatttatacatcaattatttgtaccttacaatattatagtagcaggctgaatattaagttttacactttctgtttccagtttttaaaatcgacatattttttacctttgggcagaaagaagtgttctgtcttaaatagtgatgaagttatagtgggagaggatattaagcagaatagcaagtgtcacaaagttggtacaatgaaagcacaatgagttcagagtttaaacaactatgtatttactactttagcccatttgggctgctataacaaagtactatagactgggttgcagataaacaatgacaatgtatttattactacagttctggaagctgggaagtccaagactaaagcactggcagatttggtgtctggtgaggaccagctttataattcatagatggtacctttttggttgtgtccttacatgatagaaaaggcaagacatttcttctgtaaggacattaatcccatttataaagattttgccctctgacctaatcatctctagaaagccctaccttctaatcccatcatcttgaagattaggttttagattatttatttggaggggatcacaaacattcagaccatagcaaaatttacagctgaaatacttgttctaggaccctaagttacttgctacctttagaatggagtacatactgtgtaattaacagacatgaacagtgttgtttctttttacctttgtggggattgcagtgccatatttagagaagacagatttaagcagaaaattatgaagactccttttggaacacttaaaaaatttccaaaaatacaagttgaacctcttgagcatcattgctgttttcatcttgctcttcagtcctctagggtgtacactaggaggaagttgtcttctatcattgccttggaaaggtaattagacatgataaatttgtcagtattcacaatcctttgatttggtatttcagacttttagtcctccttgaaaaagattaagccattaatcgccaatggttcctcatttatctgagaaatagtgttcagagaaatatcacctctgaggctgtttacctactggacatgaaatagggcctgtaaaagtggggcacattcactgacttgattacctttcccatggcccaatgtagcagggcttgtaaaaaccacaggagacagcagatgtcttctgatatgacctttattgcagtagccttcaggttcctaaggagttaccactgggaggattaacagtattttccctgcttatttgacttcctgagtcacaaatttccttcagacccagcgggtggctgttcttttagtagggcctaatttttcttggtggaaaggttatgctttccttatagtatgaattctcccctataagaagctcccactatgtgcagctcagagtaaactgggacaatttagtttaacgttccttgttaaacacatttctgtcctttaagtgctgagagtgagcccataatgtactcgggattcctttcttacatgcccatgttatagcacaaaggcaaatacatttcataaaatactggtttgttgcagttgattcttgttacttgcaaccattctggtctacaaagtcattggtgatactaaccattgcccttaaggaaaattcagggttaggtcccttgcagtcacaatgttctcataactacataacctagttttgtgtgtgtttctgttttttttttttaatatatattgctgatttattaacattgaactcacagctggcaacaccataattcatgcctgaattaagtttatgtaatgcatgtactttctccataaggcacatcacggtcttcttgtgctgaggaacactaggtaggacttcagcactatgctagggccatttttacacggtgaaatcaccagcaaaaagcacaaaaaatgcaaaaaaactggcagcaaatagatcttgaaaaggacacttgtttatgagagctgaagaagaaggcacaatgttgtttttttcagcttcagctggggtcctgtgcattgggcaattcaaggtctttcccttctacctatatccacaaatcactgtgaaaacaccttgtgtattgattatggggctacaaataaattttagaaagtaggtgaattcatgaatacagaatctgaaaataatgaggacaactgtatatcactggccccatgtttgattttaaatttatagcactctacatcttttgaatgatttggaaatacatgtttttcgaattgctcaaccctgaaacagatcaaccagatcaaccagtgggtgtgtcccatctagtttttatgcccttccatccacattttacaggtagatttatgtctacaaatgagtcttgccttatgctggaccctcaaagcatcccacaatccacctctgtgtaactgtgttttattggaatgtgattcaatgaactcattataaaatggaaaacgaattcctcatcccatttttgacctttttgcccactatctatgtggactttggtcaattgtaatcacaagagctatctgctatcaatatttaaatgtccatgccattgatatcatcaactttctgaacattctgagttaatgtcagctttcggaagagtgaccgaagggcagggaaggttgacattcacggcttctttttgctttgattttctagctcttttgcctcttctctctcacccaatagctaaggttcttcccctcttggggtccagaaggagagtggattaagagaaaaggcagccttgggctggtaggatctagtgacctggacttgtcctctggttatggtgacttcctatgttacttgttttcttctagggcttctgtgggtttctcagatatttccctactgggaacctccatgcacagttacaataatgtgagcaatgcatctactagctgcagttgttgcttttaaacttcagtcagattttcctaccttgcccatccattccagatagttctcttggctcctggctgattttttcctgaaagaacacccactctgtggtatttaaaaaaaaaaaaaaagtcttttatttcaaagggcagtacttcccaaagtagtttaatctctttccttctgcccttcccccggttgagatcccaccattttgcctttagatttcttaagcacatagcagacactaatcccttatttcctcaaacttcagaggatacatataaaactctaaagtttatcttttgaattccttttcacttggcttgagataaaattggatatttctttcctttttctgcagtggggagaaagctgaaaatagttcagtgatgctcttcaaagcatcagtgttattcctttattaattatagatggacattggcccatggggcagaaccaggggcacagttgcttagcgtgttgcgcccacatattctgcaacattgcaaagcattattttgctggccttagactgaattttatcaatattattttttattttttttcctaggaaaaggtcatgggttctgtatttatcagatattctttaagttcttaatttttggttttccataagtaaagtaataaggcattgatatggttcggctctgtgtccccatccaaatcttgtcttgaattgtaatcctaataatcaccatatgctgagagagggacccaggttggaggtgattggatcatgggggcatttttccccatgatgttctcatgatagtgagttcttaggagatctgatggttttttaaggcaattttccctgttcttgtacactctctgtaggctgtcaccatgtaagatgtgcctcttccccttctgccatgattatgttacttgaggcctccccagccatgtgggactgtgaattaattaaacctattttctttataaattacctagtcttggatgttactttatagcagtgtgagaacagactctaatacaagtatggtctctggaaccagatagcctacatgcaaatgagacttagagcaaattatataatctcattttaccttagttttctcatatgtagttaagtgaataacagaaccttgcttatattattgttgtgaagataacactaaaaaaagcacttagaacaggtttggcccatgataacattaaatgttagatattatgcctgggaatatattctggttgtttgcataattgaatagcatcttagctagatctaagttaattattggatctcactttcattcttttagaactttttaatgttgttccatcatcttatggcatttattgttacattacagatttgatgtcaccctagctatttctctcctttgtaggtaatttgcttttgctacctatatatttgaagaatttttttctttgaagtttatccatataagtagactaggtctcaatattgagcattataaatcaaattttcctgctacctgctgttttttatctattgttttcaatcttcataattaacccttcactttagaaacatttttctacattttatctttgaatatttttcctcttccatttattgaattctcccattgtgaacaaacaattatcattatattggacagtccttgctttctattattctctatcttatgtcttcattctttttttcttaagcctttcatgtgtcattattcattttttacttatgtctgttctgttattgcttttattttatttacatagagatgctgattaggtgattaatttgttttcttaggtctgcagtgtctccatctcattctcttttttatggaatctggtgtcttaggttgtattatagtgtaagttaataagtaggactcttctccagttttttgtgttatattttcttcctggttgaattattcatatttatttaagttttgctttattttttggaagaggatatgtgcctctacactctctagataagttactgtttcttttccttttgaccatgtatgtgcatatcagataaagtagtgtatttgtgctctaatggagcctatgtgactttttggtctttttacgctgtatttgaggccagctgttctttctaatgagctaaagttgaatgagctaaacttcagctaatgagctaaagttgaatatgtgtttatttaattaattcaatcattcatttctgtaatcactcattttttcactttttcaatagcctgggatcatgcataattaaggatgaactcagcagagggaatgctcagtttttttctttgaatatttcaaagtgttttaccttctgagattctttattaatgtctttaactggggttcatttcaattcagttgggaagatatttcccattgtgacatatcacagattttttccctctctgtgtgtttcaatctaatgagtatcaatgaagtgttcactactttaggaagtcacctttgtctttcacttctctgtttaaacttattgttctcagtagtgttttcaaaatgttctttctttcattttttcatttgttgataccactcttggaggctgaagtcagaggtaggaacctcctaaatgtgccattgtacttttctatagaaatgttatttactttaatggaaattcacatacaaatggtttaggctccaagtccttgcctcttttctctcataccttatatctaatctaataggaatcccagctgggaagaccttcaaaacagtgtgtccagaatctaatccaatcacttctttttacctccactgacaaaaatttgggcagggtcaccagcatctctctcatacttcattttcataggcttctaattggtcctggcttttatcctttatcccctatagattgttcttcgcatagtggccagggtggttttttacaacaattaatcagattatatctgtcttctgttccaaagcctaggagagtaaaagccagagtcctttcgatatcccacagtgtggtacatgtttttccctcccacatgacttcacacgtaatactctggcaataacccagcccttcattctattccaggcatgtggtcttcttgctgtttctcaaaaatgcaaaatgtaccatctcctttgcacttactcttactcatgctgaaacctttttttttttttcaaatatcccatgctaagttctcattcaaggttttaatcaaacatcatatgttcagtaaggcctattcttgtcagttgacttaaactttcaacctgttctcccaactctgccttcttcatccctcttacccttatttttttctttttccttatcacttattactaacatacttatgtaatttatttgattatgtttcttgtttatctgtctcctctttctaaaatgtaaattctgtgagctcaagtctctatgtctttcttgttgactgtggtattccaggtgactagaaaagtttctggcatgtattatgtttgtaaaaaaatatttattgactattttaggtaattagtcatttcttccctagaaaagatgataagaaaattatactcgaacaccttttcccttgaagcaatgaccaccagttcatgtccatgaaacttggcagagggcacagttctctttctcttattttcattttggaagaagtccagatctgttggaatgcttgaaaataaaaggaatacttttacagcagagatctgaaaaacaatattaaaaatctcattggttaatattatcttttgtagatatgaagggatatatttaaaacattttgtgattgttccatgttgtatggttcttggtattttaaaatatttgtctcacaggttttaaaaatgaatgataataaattgattaaaaggacagaatgattcctgattttgcaatatcctaaaatacctagattattagaatatgtgattacttgttatttcatcatgatgataataaaagggaggcaggggagcatggaaggaacagtttaagacttgggtaggtcttagcaaaaaatgtcatctgctacttaatcactatatgtgttacccttggcatgttacttaaatattgtgaattttgtcagtccttctttgtcaagtaggagataacaaaactttatcagtcaaatagaaaagcagaaaccactttatcaagaaaagataaatccctttattttattttattttttttaaagagggcgtttaacctagggcattgagaacacaggtactagaggatatgagaagccaaataacaaaaagttagccaacccaaaaattacaacaagaaggacaaagggagaaggaggaaatagcagtctgtgaactagggtcacctgctggctgtggtaacagtgggctggatcacatgggacaaatgtcaactgggagactaaccactgcaggagattgtacctaaggaaaagtgtgggcagaaatactctggattctcctttctcttgtactctagtctcctaccaggacctttgaaaatccagtcctcaccagaagtctgctgacagcaagaaccatagggaaagaacaaggaatgaatctagtaacacacaggtcaagaatcagcaaaaaaaccttcagaattaaacgtgacataccgtatatatatatgaagtgtattactgtgcttttcacatagtgaatatcaatgaactattggtgcaatgatttataaattgctggagaccgcataatttataaacaaaagaggtttaattggctcatagttctgcacagaaaacagagtgccagcatctgctcagcttctggggaggcctcaggaagctttcattcatgggagaaggtgaagtgggagcaggcacttctcatggtgaaggcaggagtaagatgcactcaaagttatagtttgttgatcccctactatatgaaaaccacagtaatgtgcattgtcttttcctttgtgtttgcatggatcaattttaaacacaattttaacctttaaaaacgtgtaacttatttgtaaaatttctcatatgtgtaaatataaacattttatattactcattattgcactcacacccttactttgtcctagtcaattctatttttgcaaattagtatttatctaaaaaaaaaaaaccctgtaattttactctgaaatcacagagcacaaaaatctaagtgcttattttaccaaatataattaaagacaatactgagaatcaatccatatactctaccaacacaagcacaggatagatacgctatctaggagttgtttctggcagaaaaatatcatatgctacaggaaggggtaagaaggaacctaaaactaggttttaggttttaattcgaacaatataatgaattgtcttacatgttatttaagcaagggtgctctttgtaattcataccactctcaagactgagccttttgaaattcaaaccattcattgttgaactttgatactttaaaataccactgaagttaaaaaaatgggtggtgataaaataaaaatctgtttcatttgggcaggcatcacaaaaattgtcttggataattcaaacccaagacacattccaaaatgcaatagtttgctgcatgatttaattcatgtaatataagatacttgaagatttttttttttttaatcgttaagtcttaaatattgaaaaagaaagtctcagcagggcacggtggctcacgcttgtaatcccagcactttgggaggccgaggcgggtggatcatgaggtcaggagatcgagaccatggtgaaacccggtctctactaaaaatataaaaattagccgggcacggtggcgggcgcctgtagtcccagctactctggaggctgaggcaggagaatggcgtgaacccaggaggcagagcttgcggtgagctgagatcacgccactgcactccagcctgggcaacagagcgagactccgtctcaaaaaaaaaaaagtctcaggtcaccaaatctatattttgtgataaggagaagcaaaatttgaaataatttaacttaatatttctcctagttaaaacacagtagaagtcatggttgatagtgtattgactgctgtcactcacatcagaaatgaaacattaattccataattcgtatccatgtttttgcacttctgcttgcctatttattaagaaatatatatatttcttttgacctaggaattcagtaggattatcatgtgaaaaattgtgccagacatgttaaacaggcaaggaagactttattaaagattattgcaacaaaggaaagaaattgaactcaagtctattgaaacaaaaagtaggagagtttttaagttctgaggtgagctactggaaaaggactaaaggtcattagggatgagggcctgtgtgattacgctatctgtgtttgctaattggtgcttatggaagagcctgggagatggggtgctctatctttcctgatgaatgtaattcaaagggatcactcccaggtgtttgaaaaatacatttctgggttgtaaaactgaaagaggctgggagaagatttgtatctcagggggcagagaaaggatttatggttgcaagttttctagagtaaatgctctaagaaaagggaggaaacatgtctaaaattcagtcatgctgaggaacattgaggccatcttggtcaacagattctacaggcaccattttggagttgagatgtacattaaaggaaagatggagcaagcatctcttttccctaaattctgctggtttctgattgaccatttttactttttcactctaaatcgggggaaaaaagtgtcctcctctcctaaggtctctctcttctctgtcccttcagcccttactttagttctaggtgacctttatggaaggtgataatatttccaaaacagaaggcatcacttgccccaatttcctataattataacaagtataaaataaattaaccaagaaaaggatgtattaggccatttttgcattactataaagaagtacctgagactgggtaatttataaagaaaagaggtttaattggcttatagttctgcaggctatacaggaaacatagtgccagcatctgctcagcttttggggaggcctcatgaagcttttatttatgaaggaaggtgaagtgggagtaggcactcctcatggtcaaagcaggagtgagagagtagggggtaagagaggtaggtgccacacactttaaagaccagatctcacaagaactcaccaggtatcatgaagcagcaccataccaggcctcacttccggcattagagattacaattcaacatgagatctgggcagggacagatactcaaaccatatcagatgacaactcctcctctttaatctcctcctcttcctgccttgaatgtttctctccataatgtaagttaatatttatctaaggtaagataaagctatttaaacattatgactttcttatgttagtacgtaattgaacattgtacaataaaacttcttattggccgggtgccgcggctcacgcctgtaatcccaggactttgggaggccaagataggtggatcacctgaggtcaggatttcaagaccagcctggccaacatggcaaaactctgtctctactaaaaatacaaaaattagccaggcgtggtggtgggcgcctgtaatcctagctacttgggaggctgaggcaggagaatctcttgaacccaggaggcggaggttgcagtgaaccaagatcacgccattgcattccagcctgggtgacaagagtgaaactccatctcagaaaaaaaaaaaaaaaatttaaaacttattactgattttcctaaatgtattttccccatttattttcaccttttcatactgtagagaatgccaaaatattaatctcattggagatttgatcctcaacaaactataagatatttacagtacttaaaaaatccataagctcttatttttattttttttaacttgtgcatacctttgtattatgtgatccattttccattggtttatattttatctttcagatgtaaaaagtatattttgagccctcagtgctatgttttagcagctgaagtatgaactttgccctttttgaactggtaattctattttttttcccactaagataagttttctttgtttctttcctatgttactgatggtatttcatcacctgaataaatgcttcccatcttgattttaattttctttcagcagatgaaattaagtcacttactatacttcagtggaattagaacacttttattacagacaaatgtattttagataacattcttaaagttttccttaaaaatttacaaaagaatgtttagatttctgttgagatgtttgtcatacattaatatttgtttttactaaatttactatgtatttattaaattttcaaacatctagataagaagttgagcagattgatttactgttttttgtcctttataggacattgctcacaagatcattaaatgactccaaaaacgtaattcatgtatgggtaattataagtgatacttgaggtgagggataaaaaaagaactagtcctaacaaattaatatttttgtctgcatgctcatattgttttcatacggattttaaaattactctggtttgacattttacattgaagttttggaattttatctatactgactacttctatgaaattgagatatttctcttaccaaatactggtttgcaatgtatatcattaatttattgttttttccagtgccaattcagggctaatataatgggtggctattaagtcctacatgtgttctgaggttctctcagttgtttttaacgtaatctttatctgaatctatttacattagtttctaagcatatgctttagtgttctgtaagttttatgggttctttgttacatgcttaatttagttttagaagcactaaatatgggaatctggaagtgaatatcacagtactgattttctcagatgttttacacagtaattactcttcttaactataacctttgcattttttggccggggtgggtcttagaagtcctttctgcagaatttatccagtaaaagttagtttttggatagcctggggtttacttttaatgcatgtctgaatgctcagttttgataagtcaaatatatccttgcatctaagtccctgctgagtgaaaggttttgctacagctaaaagtctgagaagaaaagcagaaatcatcagggagttagcttgatgcatgaaagacccacaggaaacaaaactgagttgatgttaccaataggagcaattaagaaagaatggttttgtgccagaatgttcctgtaagcttatttgaggaatcactatttctttcttttaccaaacaacctttgttcatcttccttataaataaaacattctattcatattgctaaaaaaagtagtttgcttgggtacaaaaaaggagttttttgctcacattttgaataaacttagatactttcttattcagtctgataatctttgtcttttcattgtgacatttattcagtttattatttaatataattataatttgggttgaaatttttcatataactattggttttttatttgaactaccattattgttcttttttactttaccattttcttggtttctttcctgatcattttctggcgagctacatatttttttatttccccagaaattactaaatatctctttaatttactagagtctatgataaattagtgcctttatacttctagaaaattataataagcttaaaatagtttaatgcctttcaattctctttgccttctgctctttttctgccatttaatttaattctacatatattttcacactcccaaaccattattttttattttattttatttttatttttttgagacagaatctcactctgtcgcccaggctggagtgcagtggagtgatctcagctcactgcaacctctgccttctgggttcaagggattcttctgcctcagcctcccgagtaactgagactacaggcacgtgccacaacacccggctaattttttttatttttagtagagatggggtttcaccatgttagccaggatggtctcaatctcctgacctcatgatctgcccacctcagcctctcaaagtgtgctgggtttacaggcatgagccaccacacctggccccccaaaacattattactattgttttatacagttactattcatttaaattcacccatacatttaccctttcttgtactcttcatttcctcctgcatttctatgacttaatatgaggtcagttttcttctgccggaagaacttttagtatttctttatagctcacatcttctggtgacaaattctcttggcttttgtttatcttaagcatcttcattttatctttatttctagaggatataagagaattctaagatgcaataattttgttaagttctttaaagatgtcagcctaccatcttcaggtggcctttgctgctgcttctctttcttctcttcctcctgttcctcatccttcttttgtcttctttttttgaaatgtcacctaatagttttatttggctgtttgaagggaatatcctctcctacctctgtggctacttttaggtttttctccttatctttaatttttggaattatttttttcccaaaatttgttgtttcttgatccttcaagttaataaaattcaatgaagttacagcttgtggtctttcattagttttggggaagaaaaccagacataggcttctcaaatattcttcctacctttttccccccacttcccttggtacttcaaatgcatgtgttagatgtatagacaatggttcatgtgttcctgacacgatttttttttcttattctttcatctctccaagcttcagtctgacattggtctgtcttccaattttctaatgctttgttttatatctaatatgtggttaaatccatctactaggttctttttttctgtgcttgtatttttatttctagattttatattttactctttaaaaaaatgaactccatgccaggcatggtggctcatgcctgtaatgccagcactttgggattccaggcgggtggatcacctgaggtcaggagttcaagactagacttgccaacatggtgaaaccctatctctactaaaaatacaaaaatccaggcctgatggtacatgcctgtaatcccagctagttaggaggctgaggcaggagaattgcttgaacctgggaggcagaggttacagtgagccgtgatcacgccactacactgcagcctgggcaacagagcgaaactctgtctcaaaaatggaaaacaaaaaactcccattctgtgataaaattctccatgttttcacttgttttcttgaacactgaaaacatttttttttaaattgatatctgaaacttccaatgtctgatttccttgtaggtgtgtttctagtccagatttttttctttatatttgatgacttgttttcttctcctactagtatttattagtaaattggacattgagtgtgaaatgttatagagattctggatgatggtatcttcctttggagaggatttaattcttttctggcagagagaatggaaacatgttatcttgttgcaatcatagttggagaatctatggctcattgagcctttctagggtcttgctctgtttattttgtccctaaagtgtacttttgtagggttttcagtttaaaaaaatggatgtttattagagtttggtttttttttttttttcagtccctaaatcccaatatttactctcacagcactgtgcaactaaagaattctctgcttagattgtatcctcttaggtttattttctgcttgactctttggcctccaccctcgtgtagcttattaatcatcaaatgccttgaggggaaaagtggcaaagaccatttgggttgcctctgttagtttccacttggcagcattttgacccattgtctatcttggttgtgtttgatacattcaaaatattgtcttttgtttatttgttcttgttgaaaaatcataaaagttggataattttattttttcttgttttggaggtaggggtgtggggctgttatctgagacaagccactttatcataagcaggaacataagtacttattaaaatcttcatctaaaaatgttgtaaaaaaatctttataaatgaattaaatctttattttattctcatttgaataataaaaagcattttaatttaagaaaaacattatatagaaagaacacattttcttcttttctactttaggagttttaagattagatattgtcagtttgttacagtacactaatttaaaaaacaaacatgaggctcatattgtttttatggaagactaattgaaactctggagaagataaacaaaaatattagaagaatagctccgataattgatactaagaataattttacatggaataatttgtgcttgaagggggaaaacagattaattggagtttaagagctaaagaacatctgggaactttgttttgtataaatacaaaacaatttacatttttatacaaaacacagaaaatcctactataaataaaatgatgaaggtgaaattctctaggggacatgtagctctgttgtaggacaagttcattgtggtttgaatttataagttagaaagaactagaaagtcactaagtgaacactgaaaaatggcttctttaagagccgataaatgagtaggaaatttttgtccatttgatagtagaggtcattaggtcattggttgcagaaatgttggcaattttgttggttgtacttgtggttgttgattattgtgggagcagggttgaagactaagctctgattttttatcttacccaaattcctgcctaagaggtctagggagtcatgccccacaaaccacaaattctcatcagatgggttttatttaaccctatatattttgacttacttttgaacctaactctagcataatattatgagacaaggaaaaaaatatttaacccaaaatatatttccttaccataccttaacattgccctgcaaagtctctggtgggaagaatccacattctatagagaaacccctaccccttttgttttccggccttccttcccagatccaggaaataatcaactaagagccagtcacccttttaagtcctataaaaaacaatttacaacctgctgtctctaaagtctgctatctaagagcttcctctgaacaataaaacttggtctccacagtcctttacctttaacctgaacattcctttctatcaataccaggtcttcagacaacttcaaccaattgtcaaccagaaaatgttcaaatttacctatagcctggaagcccccactttgagttgtcctgcctttccaaaccaaaccagtgtatttcttaaatgtatttgattgataactcatgcatcctaaaatacataaaaccaagctgtaccccaatcaccctgggcacatgttctcaggacctcctgagggctatgtcataggccatggtcactcatatttggctcagaataaattccttcaaatattttacagagtttgactctttttgtcaacaatataaagagaggctggcgcctaatgtgcggcctcagagaagactcaagaccccaaaggagttgactgaaagtggagctaaggtacaagcaggggcccattgaagccccactgaattcaagctcctcctccagtagaactggtaagtccttctgaccccaggacctcccttaggttaaacgtccttgatttattctaagctggttttccctaggaagttgttgttaaaggatcctaatgcaagtttggaggtgcatttctaaagggtcttctcaattgcttttctctcagaattaactaagaataaggagaaaacaagtagaatgacccccttttgagcacttctcaaaaggggttctcaaaagaggtttatggcacctccacttgaagtaatatggtctttgtgcacagtttactttcagaaaaaaagtcctagggttgacctgcaaactgtagagtttctattctaagttatctttctctattttcttttctgcttgctttaaatctgctgttacttttctactgagattaaaaaaaataataataaccgctgtttggatctaacagtttttttttctttgttttgttttgttttttgttttttgttttttttttgcaagccagaaaatttatattcatctcatggctaaagtactaaagtaaagctataggatctttgtgtttgtatgtgtatgtatgtatatatgcatgtgtatatttaaaggcctttataaattctataatgttatgtttaattggcagttaaatgttttaatttccctctggcacaccgaactttttctccttataccttatcatgtaaattttgctatctaatcttcacctgagttatttcctttaatatgcaaatttggggctatttagctaactactgcctagggtgatgcaacatattatcaaaaatataaaagtctaaaataaaaaaaaaaggaaaacaaaagtcttttctaaatctataaaatacttgtatcagaatgcctaattacatctacatgtttatgtgtgtgtatacaatattttcactactaaaaatatatgaagagctctaatcaactggctttaaaaaagcactcaaatcaaatacagaaaacaaaaaaaaaccagaagagtagtcaaatgttttttcaagttcatgtgacttaagtaaaatctttactaaataaaccagcattaaaattatcagtaaataatatcagcaatgtctttagaattgttagcagttttttttttttgcatctgttgatcaagtagtttaatgtttattcctgtagaatactataagatttgccataagagttataaacgataaaacccagcccaagacagaatgatctttgcttgtatatgcttataaaatattgttggcttaaatgaaaacaactgcatactgagttattggtataaatacccttaaaactaaccataagctttattactaaagtaaatatctgaaattcacagctataaaaagggtttatagaaaaatatattaaatatttgctatcacagttttttgtaaataatctaggtaaactacaagattaattgggtaagtgtaatgaaataaaatcttgtaaacaaacttgtcataatttaggatctaaggttattatttgatataagtatctgggtaatttgtaatttaaaaattataggaatacttttttaacattcttattagaggtaaaatatctttgtctaatccaaaccttatttaagtgttaggtttaaaacaaggtaaaaaaaaaaaatcaggaaataatagatgcaaagaaagttaaagatgtagaaagatatttttggtaaagaatgtaaaaagaaaaattattttatacaaaaaagaatcttgtatggtgaatttttgccctaaaataaaataactgcgttgttcaaggaagaaagatatttggggtaaaacaaaaagtctaaccattgtgaatgatctatgtaagtcataataaggttagtaaaatgaatttataaggggcttgtgtaattcagttggctataattaaaaagaaatcataatctttctagaaattgatatttaatactaaaaaacgtacatgaatacaaaactaaataattggttaaaacaagattttattacaaatattgactttttgtgggggagggggcgaacggagtcttgctgtgttgcccaggctggaggctggagtgcagtggcacgatcttggctcactgcaagctccacctcccaggttcatgccattctcttgcatcagcctcccgagtagctggtactacaggcacctgctaccatgcccagctaacttttttttgtatttttagtagagacagggtttcatcgtgttagtcaggatggtctccgtctcctgaccttgtgatctgcctgcctcagcctcccaaagtgctggaattacaggcgtgatccatcatgcccagcgaaatactggcttatttttaatgcaaaaagtttttaagtttttaaattctataatctgtttaacatttttcagattgagatctttaaagcactactctcttttaaaaaagtcttaaatgatgactttctccttcaccttttgttggctcctgtaacttttactaatctaagggaaaaaaattgtttttgaaaacaggcaaatatagcatattttagacatgccttttggctcacgcctgtaatcccagcactttgggaggccgaggcgggtggatcacttcaggtcaggagtttgagacacagactaaccaacatggtgaaaccccatctctactaacagtacaaaaattagactggtgtggtggtgggtacctgtaatctcagctacttggaaggctgaggtaggagaattgcttgaacccaggaggcagaggttgcagcaagctgagattgtaacactgcacttagcctgggaaatagtgagaatccgtctcaaaaaaaaaaaaaaaaaaaaaaaaagccttttattctgcatagctgttatacctctatctttatatgtatcacgtggaagtaatatttcactttcaaactaaataaaatagctctaatcaaataacttaaaaatgtaagtgcttatcagattggcaaaagctagctcagatgcctcttaatttatataaccttagtaatctttattaaaaattaatttggtacatttaatctcaaaactctccagtaatttaaaattcttaaagtcatgtttaaaccttcaggatttttcgcaccactggaaatttgggttactaaaaagttaaaataataaaagcataaaataagcttttgttaaaattttattaaaattttataaaatacaaggatgtcaattttcaataaatgtaaggtttttggttaagaaactgtttaaaacttgctttaaaataaaggaaattatacagataaaattaaatgaaaaaaaaaaaaaactatctagggcaacaacaccctaagccctatggttatcaagaaaatagttgatatagggaaagggcaaaaccatgtaactatttaaaaaccaaagggtgtaatgttaaggaattgtttcattttgtagattagtatcattcagcttctttaaaaaaaactttagtggattgtagaaataactactttaaaaacaaaattcttaatttcaaatgcttcaaaatgtaagcccttgtttgaattaatgcaggacccacagctcattagtgaacaatcactgatgcacaggaagctattcctaaaaaagcaatcagcctagtaggccagataatgcccattataaggtctgtttgccctgagaaggggattgcccaacgctccctataaaataccaagtaaagtaccccagatgaagcagttgacatgtttcatatgcaagacatgttggactagctttatgataactgggatatcctcccacctaatacgtctgttacccacgtcatggtaaatgtgggggttaaaggggccccttttacatgggtacccctcccacagaatcataggtttatttaagaagccttatcaaatctgctatcccccataggtcatacagatgcaaccccctgctgggaaccccgacccttttcaccagaaaaggtaaaattggtctgggggtaaaacggctttctggaaccagagcacaaaaacatacaggttaatagaattataaaatgtaagatgtttaaacaagatttatgtaagttagtcataaccacttttacttaaatgccttataaaaataggtactatatctaactgggaatgttttcccctttctaatactataaaaccaaagacatgtaaatctgctcatgtaaattctccgctgcatagccttttgtgtggagcatttattggggctaatggcaaaaaccgtaagtatttttcggtaacaatgactgagctagagaatttctacttgatggggcatttactgctttgctatggaatattaactaaagctatccctatattaatggaagtaatgtttcccaaaaagttccataataaaataaaaatggtttacatgaaatcttgctacctgataagcaaaaagcctcttttctaaaactaattgtaaggagttgctaaactccagtgcctaatagctctcgtgagctgtttggtctgtaaatggcatttccaaggtaaacaaacatctcgtttcaaaagctgctgctctggttaaagaaggattaaaatatatgtatatatattttcttttatttggggaaagtatgtttttataggcaaatttccctttctaagtcctccagaattcagattgtagttttatggcaatatagttgtctgcataagttcaataataattttttaaaaaacaaaggcactcgttattttataaagactgaaactaaaataacctatttttaggtaaagtttcagtaaaaccaactttaaaaaaattctggccgggaacagtggctcacgcctataatcccagcactttgggaggctgaggcaggcagatcacctgaggtcaggagttcaagaccagcctgaccaacatggagaaaccccatctctactgaaaatgcaaaattagccaggcatggtggcgcatgcctgtaatcccagctactcgggaggctgaggcagaagaatcgcttgaacctgggaagcagaggttgtggtgagccaagattgtgccattgcactccagcctgggcaacgagagcaaaactgtgtctcaaaaacaaaacaaaaaacaaaacaaaaaaattgttgcaaatcaatttcttactacattttatacaaataatcaggcaaacataataagcctaaaacttaccttgcacacaaattgaccttgctataatattctctttaataaaaaaggtggctaaaaaaaattgtttcaaaggcaaagcataacacttaatactggatttcagccttaactttttttaagtacaaattaaatcattatttcttggcataataatcctctaaaaagtactacattataatttttcttcatatttttagttggtaccctaaaggagtaggttccttttcctggtctaacatacaaattactattatagctgtcaaactataaatgttatttatctctttttgttttacttccaaaaaaaccaagatcatggtattctaaagaccagagatacaaatctccctcatttggcatcctactgggcccagatctgttccactgctaatgctctgttgctaaaactatacaagccgcctccctctaggcccagggactattgcagaagaggtaggcacgtaagattgtaagggccagttttaagggataaaattaaaacaaaatcaaaccctccaaatcaaaaagggggtactaaaaatgcctaaaccgctggtaaaacaatttggttgccttttaaactgttatgtgtcacttttgcatccaccccaaccataaaaattttctgcttactataaaattaaaggaaaatatttactaacaggataaaataccttgtaacaaagtctcctgggtataatactcccaattatgagttgtaaaaataaatctatctatatatatttaatttttcagaacagtgcttatgtttgtatggctaattgctgtaagtctgtaacaaaaaccaagctcacacacaacagctcaacacataaaagttaaaacaagtcagtcttacagcttttccttttggtttttctatctgcctttttacttaaaacaatagtttaaaaaagtcacaaatgcctgtccacatccatttttatctggcctaaaacaattaattggctataagtcttttaactcttaaggccctcagctataggaagtcctgccaagaaaaaaatgacactgtagatttatataactttccctgtaacaaaaccttttctctcccaaataccagtatatggtgcaatacaaaagtggggagaaaaatagatttgtctattgttaacaagtctataacaatttaaacaccaagaaccaggcatttcttgcatttaatttataccctcctcaggatgctatatctataaagataaattagccagaggaaaagattaaatttggctgggtgcggtggctcacacttgtcatcccagcactttgggaggccgaggtgggcggatcacctaacgtcgggagttcgagaccagcctggccagcatagtgaaaccctgtctctactaaaaatacaaaaattagccggatgtggtggcaggcacctgtaatcccagctactcgggaagctgaggcaggagaatcgcttgaacccaggaggcagaggttgcagtgagccgagattgcgccactgtcacttcagtctgggcaacagagtgagactccatctcaaaaaaagaaaagattacatttattaaattctaatttaatgttggtcctacaattctcaagtaagatttatcaaaagatccaaataacccttaataaggaagggaaacacattgtaagtctaatcaaaaatataataatgcatatgggttttttctggctcattagtttgtttattgccctctatttctacctgtaaccttggatgcccaaaccttcactatctttatcatattactatattaacattaaacattttcttgtaaatgttatgccaaatgcagcagaagaaaaggcacgattaaagactcgaatcataatagctcaaaaaatctgatctaggattttttttttaaacaaaccctaggcctgactccatctcaccccttaaacaattggctattacatcacatcagaccatgtcctcccccattattcaaatcactaatatttaaaactattaccaccaatcagactacatgggaataagcattcctagtgccatgaaacctcaccaaatgaccaaatcaaacacccctaggaataagcctcctagtgctgtgggaaccgatgctgtttagttggcctgcaggtgcattctgtggaaagctttttggccaagagtggggactaaggactaagctcttattttttttatcttacccaaattcctacctaaggggtctatggagtcatgtcctacaaaccataaattctcatcagatgggttttatttaaccctatatattgtgacttacttttcaatctaactctggcataacattatgagacagggaaaaaaaatgtttaaccccaaaatatatttccttgccataccttaaaattgccctgcaaagtcacttgtggaaagaatccacattctatagagaatccccttgcccctttgttttatttccttccttctcagatccaggagataatcaactaagagctagacatgatttaagtccaatgaaaaaccatttacaacctgttatctctaaagtctgctatccaaaaagcttcctctgcacaataaaacttggcctccacaatcctttatctttaacctgaacattcctctctatccatcccagatcttcagacaacctcaaccaattgtcaaccagaaaatgttcaaatttccctatagcctggaagcccctgcttttgagttgtcccgcctttctaaaccaaaccagtgtatttcttaaatgtatttgattaatgtctcatgcatcctaaaatacataaaccaagctgtaacccaatcaccttgggcacgtgttctcaagacctcctgacggctatgtcatgggccatggtcactcatatttggttcagaataaatctcttcaaatattttagagtttcactcttttcatcaataatgttaaatattttttttttattctgaccaagtacttgtataaatgtttgttcagtaaattttctcattgtctgggaatacttttgtagcaattctattatcctattatatttcagtgcattgttcataccatatagatacaagaaatgtgtatgaataataagatgctatttgggagcaatctttcttccaaatttgaactaatttgaactactgacatacattttagttttttagtattctgttggctacatttgcttatcaaaggttaaaatttggattcattgatttataccagtagttctcagctatggactaagtgcctccaaggcacatttcacaatacctggagacactttttcttgtttgcacaaaggagaagttcccattgacacttgtagggtagaggccagatgctgttttatacttcaaagtgcacaggggagcccattacaacaaagctttatcctgcccaaaatgtcagttatgtcagggttgaggaactctgatctaaagataaaaataatatgaataaaaatgtaaagaaaatacacataaatgcagttactcaaattagtaggcattatgagtgtctagtatttaccagatttgtgcttattcaaaggtgaatgtagatctatgtgagagataaaacacacaaatatacatttttaatagataagtatttttatgaaaaataatttatttatatcagaaatgacagtaacagataggcgaggaatttgtgcatgtaaatagcatacccatgtttgaacttacagattaagcataaaatgcatctcatggaatgtcttgggtggagatgaatagaggcctgcatcacgggtagtaaaagaatttactgaaacagcagtgagttaaataaagcaagtttattagagagaaagtactttgcaaggaagcaacgggcaacacagcggagaagggaatgtctgcaaagaggcaggggctggaggaaagttttacagggtcatggtgctaggactacttgcatggagtgaggcatttgggaacaggatattgtgccactgggttttttgtggttagctgtctccaaacaattgttctcccctccctggggcccctctttgttgttaagttatcaggactccacatgaaatatttagcagtcatctgtaatacaatttactgtggagaactgtgaaatgggaaggttatatttttctgttggtgaaaagagaaataggagattgcttcaaaatggggtagcctaccataaagaaatgaaaatactggaagctttatgctttcaagtgtgtgcttgacacttcagatgaccttgattacattttgtttactctgcccttaaatttattaaatctacaaatttccaattgcgtacacatttatactttagcttttctgtaaccactattactgaaaccatggtaatgaaatcatctttgttagaattctgtagattgtcaaataaacttcagaaaaagtgagtctaattgcaagttgattctcaaatatcaactgataatggttgctggaagcattttaatattttattagatggagacagtttgaaatttaaagacaacttgaacttgcttgcttgaagtcacaaaatttgcattccaaatttgaaagaatggaggtaagaaaggaggcagtttaggaagagaacactatcatgaacccaggtgctttcaactatcatagtatttaaaccttactgtaactattttaagtggatattattatcatcattatataaaaggaaatgagactaattgttctcagtgtccagctcctaactagggaggtagcttgaattcagttcctttgaaatgaaagttactggtctttcctcatatgctccttctttttgacagaatttatactaatgttcatgacttcattgaatctattttgcatgagtgattttgctgaaggtaacagatgaaaaatacacacacattgctgatgaggggctcctaaagcagacttgatgaatccataagatggaacacagttaacaagttaagaataaacatagaatattccattaaaatatacctttaaatttgaaatatgtaaaataataatctagtgtaattagataatttaaaacctctatttttattttatttacctcggtgaggcttttggaatctgaaaaatgtatcacatccaaatagtattttacattttgactttttgcattatttccttatctgtagagaccacatccaaatagtattttacattttgactttttgcattatttccttatctgtagagacccttaatactactaatttttccaaatgtataattatgtcatatatttctttaagtcaaattttaattcaagtatcaaattatcattttaaccagctcttccttgtgttcctggatacccatcaggcttaatcacactgagttagaatccctaaccactatcttaatgagtgaacctgctttgttagtgtggctggatgtcttggcttgccagaaaaccttggctttatcattttaaaagtttgttctgacttcttagaaagtgttatttgagttacatggtttgattgtttattaaaacagtattataaatgcagtttagcttcaaattatacattttatttgtgttaaagactagaatacctctgactcatttcgtattgaaagagacctagccggccaggcgtggtggctcatgcctgtaatcccagaactttgggaggccgaggcgggtggatcacgaggtctggagatcaagaccatcctggctaacacggtgaaaccccgtctctactaaaaattaaaaaaaaattagcctgacctggtggcaggcacctgtaatctcagatacttgggaggctgaggcaggagaatggtgtgaacccaggaggcagtgcttgcagtgagccgagatcacaccactgcactccagcctgggtgacagagcgagactccatctcaaaaaaaaagaaaaaaaaaaaaaaaagctatccaggaatcattagagtttacaaaatatagggatttttaaaatttattttattttatttatttttataatttattttatttatcttttgagagggagtctcactgtgtctcccaggctggagtgcagtggcatgatcttggctcactgcaacctttgcctcccaggttgaagccaattctcatgcctcagcctcccaagtagctgggattacagatgtgtgccaccatgcctggctaattttttatatttttggtagagactgggtttcaccatattggccaggctggtctcaaactcctgacctcaaatgatccacccacctcggcctcccaaactgctgggattataggcatgagccaccacacccagccaggaataactttttagagtaaaaaaaagtaattgattatttttggtttttgtagaagtaataagacattttgatactttcaacttcatttattttctgtgttgttttaaagacttcttctcctagataacgagataattttgtaactttgctgattctgcatcagttgccatggtttttgattggtgctttactacctaagactgtacaaataacaataatcccaagaaactgttttttgagaataaaattttattaattaaatgctcaagttaaagcatttaaaaataactttcctgagtgcatagaaactgactaagaatcagacaaagaggctaacatctttctgtgtatattaggccaaattgttgggtgagatgaatgaaattcagaataaggaggattgagaggtgaagccagctgggcgtctgggtagggtggggacttggagaacttttgtgtctagctaaaggattgtaaatgcaccaatcagcgctctgtgtctaaaggattgtaaacgcaccaatcagcactccgtaaaatggaccaatcagcactctgtaaaatggaccaatcagcgctctgtaaaatggaccaatccccaggatgtgggtggggccaaataagggaataaaagctggccaccccagccagctggggcaacctgggtccccttccactctgtggaagggttgttcttttgcttttcacaataaatcttgctgctgctcactctttgggtccacacaacctttgtgagctataacactctctgcgaaggtctgtggctttactcctgaagtcaggaagacaacaaacccagtgagtggaacaaacaactccggacaggtaacctttaagagctgtaacactcactgtgaagatctgcagctttactcttgaaatcagcgagaccgcgaacccaccaggtggaacaaacaagtctggatatgccacctgtaagagctgtaacactcactgtgaaggtctgtggctttactcctgaagtcagcaagacaacgaacccagtgggtggaacagacaactccggacaggcaacctttaagagctgtaacactcactgtgaagaagatctgcggcttcactcctgaggtcggtgagaccacgaacccaccggaaggaagaaactccggacacaccatctttaagaactgtaatactcaccacgactgtctgcggcttcattcttgaagtcagcgagaccaagaacccaccggaaggaaccaattcaggacacaggatgaattgatgaggatggaggaaagggaaatagttcaactctgtgagctcatgttataactgatatgttttcttctacaggaaacattttctaaattctctaagaggaatgccattatgttttaaaataggtttatgggatgttaacttttttcttccaaatcaccttctatttaaggtcaaatgttttgcttattttttgaattagaagaaataaatgccacagaagcattctttttaaaaggttcttttcaatagcatacaaatcaaagagatctacctatactgtattaatgggaggaccaaattctgtctttatactgatagctaccttataatcagtagagctaaaatggttgtgactgaagagtttttcttttcttttctctccgtttctccccttttcctccctgctcctttcttccttcccttcttgcttccttcccttctccctccctccctctctccctccctcccttcttccctttctttcctattgctaagaatacaaagaacccctgcttattaaaagttactttgagggaaaaatgtgatatttctattcttaaaaaaagtaggtaagcaaaatctattctaaattctgcctaatcttcagattattggtttatatttcaaaataaaatatgggaatattttatgattttctcttctctttttaaaaaataactagtcattttatattagaacaaaaattcaccaaacaagatcctttctctaaaaaaattttcttttctttataaccttccttatcaaaaatacatctttgttttcataacttccttcaaatctctttcccgtacttactagttccttactaccttgtttcataaataaccttttcaagctgataatttgaattatacgtaggtatttttcccaataactcaggaagttcagcaaacaacattaaattagtctcatttgtcagagaagacacacaaaccaagatcatttcattttggctgggtttctatgccaaaccttgacacctcaaaatatccagcaaagacaaacataacacccggacaaaaatgtatgctgacagttctgaagaagtttctatttttattgtatcaataattttaaagccaccttgtttgttaaaaatttccttaagtcatgtgaacttgaaaaatactttgggcttaacttatgagtgctttttttttaataagccaatttggtaaacgcaatatataacataataaatgtacgtacataaatacttctgatagtaatacaaactcaccagtttagaggctacttttgtttgctcaataggtaatgcaatgaagactgtgaaccaacattttgggtaaaacagctcccatggcagttttatttttatttttatttatttatttattttgagatggaatcttgctctgttgccaggctggagtgcagtggcgtgatctcggctcactgcaaccaccgtctcctgggttcaagtgattttcctgcctcagcctcctgagtagctggaactacaggcctgcaccaccatgcccagctaatttttatatttttagtagagatggggtttcaccatgttgaccaggatggtcttgatctattgacctcgtgagctgtccgcctcggcctcccaaagtgctgggattataggcatgagccaccgtgcctggcctggcagtttgatttttaaaggccaaacctcttcagactccaaagaccactgggtccaaaaagtaccacagaagaacatcacctggaatctattaaacaggaggcccaaccctttttagtatagcaacataaaagcctaaatacacgggactccgtcccactttctcattcaacagcaatctccagattccaaagaatattggggccaaacagtatcacaaagaacatcagtttaccaaattctaatttcccattactgtatcaaacataaagtcatcaaaacacaatccaactgctgcagcaacaaacaagctccaagtgtgtccaaacggaaacagtcggtatgcttcctctctctctcagttgggcctgatcagctgcaaacaaaaattccttacgaatttctcaattgagaggagcccatcccagtgtctggtacccacaaaagacattcacttccctggacacacacacacacacaacacacaacacacaattacaagcatgtccccaagtgtatccatactgaaacagccagggtgcattcctctctcagtcagttaggcttgttcaacttgcaaatggaaattcctttaaaaatttgagaaattgagagcagatcctgctacctgggcccacaaaggacacacacacctatccagatgcaggtgccaattttcaaaggcagctcttctgaggcaatcaggaatgtggttggggccagatgcaatggggccggagagagacagaaacttgcttccagccaaaattgggcaagcagctatttaggagatcttctaagactcccagtccttggcagctgaaccatgagcaatgcttttcaagtcagggaatgaaaatctattaccagaacaccaggagttcaatctaggtcctgctgctcactgcacagaaggccaatcactgagacaataagtattgccaaggaggaaggctttaatcaggtgatgcagctgagaagaaaggagaacagtctcaaatccatctccctgactgattaaaactaggggtttatatagcaggtaagaaatgtaacaatgtgtaagaaaacaggaactaaggaggggtaagaaagcaattatgataaatgcagggggcctgatgtctcattgtctggatgtggtgatctgatgattttcaattatttggtaccttttttgagaagcctaagtgttgtttcctaaggaaggaactcagataaaacaaatgtaagtttcaagctttaagaccagcagggtcaatttctgttcatctacaaaaactgtttatatacaaaaaccattgacttggtttcaccaatttattttctctgcaacaaggtgtacaaggcttcccttttctctacatcctttctaacacttgttacattttgactttgatattagccatcctaacaagtgtgaggtgatatctctttgctttggattgacacatttaaaaagaatgcttttagcattatttaaacttatatttattctaacttactacattagcaaaacatttagtcttcaatagaaggtgatttgggagaaaaaaggaattatttgtccctaaattgtttccatgataatgtgtttctactccaattcctcaatctccctcatttttactctccatttgaaatctgtgtgtgttccaattaaaagtattctttcagaccaatatacgtgaaaagtggagcatagtgcagtattatgtaggagaagccaaacaagcaaacaagtaaacaacaaaggaatcacagtcatggtaattttcagcacttagttgtaagtaatattttcaaaggcttactaatttaaatactgaatatagagtcaaccaaacttattccaatttttgggtggttatcattttgtgtagttatgtcacatagacacattgggaaatggggaggtaaagcagtgtagagaagacaaaatccctcatgtgctctcatagaaaggtaataaaatctaaaattgataaattgcaagataataaattatgtatataatttagaaatctggtaatgccagaaaccaaagcagataaagcagtaaaaagtgattgccttttatgagagacgagaggaggagtgagaaagggcctcacactattttgttaaaagtcttaaataatatttgaggaaaaaaaatggatcactgggagaaaagatatttatggaaaataattatgttattattttacatctttatttgttaattagatttttggtgtgattgtcaatatttataagcttctgaggttttgcttttaatatgtatttttattttgagggtacatttcctaaaatgcaaaggcacatataggtgcctatgacaggcacatatacgtgtgttcagcattttatatagtaatgaagtcacaaatatagtcaattgaaagtaaaaatgaaataaatttagatatgctttttaaaagtgaattctgtactctgttcattgaatttaacacatctgctcagttttcaaaattattgtaatcacacaacagaaatgattagtaaagataaacatttcaaaaatgttattttaaaatgcttgatggcactaacttttttttaaagcagcttggtaacttttatggctgctagatttaataggagtcaccatggaaactgtctcacaatgctttgcagttgaatgagatataaaatacccatttaaaaacataaacactttgacagctgtaagaatatttacattttctcaaattatgatgtaatggtattgctaagggaatggagaaataagcattaaaacagaagatactcttggaattcttatgaactactcaggaactttggtttatctttatagatttttcctactttttgaaagatagtgaaagattagaaaaaatcataaaattcaagacattctgtccaagtatttagaaatcacttgctccttttcactcctttatctccatgctacatatccttttgctctttttttaatcttctcttcctaatctgcctgacactttatatcttctaaaatttttttaaattaaaaatagacagtgtattttaatgatcttcaggatttattcagggatgcactgtatcattactgttcttagtaaaaattgacatgtttgcttcattatctgaagcaggatgtgcagtgattcagctagaactcaggataagatggagggacacacagctccagccataacatctgtgttcaaggcagaaagggaaagggtgatgacagccatgtctcctcctccccttctcccccctcccctctcctccctctcctccctctcctcccctctcctccttcccctcccctctcctccccacctcctcctccccccctcctcctgccccccttccccctcctccccctcttcctctccccccttctttctccttctttctttctcctttttttgtaatctggaaaaaaaattcttccagaagccctcttcaccaagcagatttctgattatgtttcacagttgggttttatagatgctcccagattaaagaagttaaaaaaattaaacacgacttttcagcatcgatatataattaaaaatggcaagggaatagggggttagaaatggcatttctatagtcagtctgaagtgtctttctcagtgaattaaggatggaaaaatggtgaaggcagtgtgtcttaaacacaagtaacatttttgcaaaaagcacttaattattgccttggagtacaccacatcatggaaatgttgcacataactcgtgtgtgcaacattgctttcatagtaaggcaagtaaagcatcaaactgaggttcagagagatcagtggagttgttgctacacttcagcctgtttatcatgcctccttatcagtagggctcattttgattagtggctagaattgagagaagcctatgcaagcattttccactattttttcagaattataatttaggagctactcatactccaggatgatctcatccattcccattgctttaaatttagcatctgtattctgcaattaaatctgttccttttctggggttatctgtctcagtgaatgacaatattcctgttcgttggccccagacagaaaagttaatacactcttaaatctcattcctccattagtattgacatccaattagtcactaaacccttcctttacgttcttatcatttatttatttttgagatggagtctcgctctatcacccaggctggagttcagtggtgccatcttggttcaccataaactccaccccccaggttcaagccattctctagcctcagcctcctgagtagctgggattacaggcatgcaccaccacacccagctaatttttgtatttttggtagagacagggtttcatcatgttggccaggctggtcttgaacttctgaagtcaggtgatcctcccccctcagcctcccaaactgctgggaattacaggcatgagccacagtgcccagcctaacccttcctttatatatctctaaacaaaattttgtttcaactttgtttgaagacaacatctttctctttgaaagaaggttcttaatggctgcatacatttaatggtatggatcttgcctaatctagtcagttttttaaaattttattggaatccaaaattatatgcaattcacccttgaacaatgtggggggtaggggcgttgaccacctgtgcagttgaaaatctgcatagaacttttgactcccctcaaacttaattactaagagcctattgttgatcggaagccttactaattatataaacagtcaacaaacatatttttatgttacatgtgttatattctatattcttacactaaagtaagctagagaaaagaaaacgctattaagaagatcataggaaagaaaaaatatatttactattaagtggaagtgaatcatcataaaagtcttcattcttactgttttcccactgaatgggctgaggagcaggagaaagaggaggagttacttttgctgtctcaggggtggcacaggcagaaaaggtggaggatgtggaaggggaggcagaagagacagggatactctgtaacttcacagaaatacattgtaatttttgtcttccttttttctccaaaaatgtttctatatgttaccaatcattcttccaccatttgctttagtttcattgcccatattgtagaaagatcaatgtcataaaagagtaaaaatcagtcttgagtaaatcagactccttctgccagattgtctgatgttaatttgttttctggcactgcttcttttacatcttcctcattgtcactgatttggaagcacttatcctcccatcttctgttaattcttctggtgtggtgtctactagctcttgattttcgtcaagattcatatcttgaaacccttcatcccactccctctttgctgtatcgacaatctctttcacagtttccttgattgactctatcataaaccctgtgaagtcatacacaacatctgtacacatgtttttccagcaggaatttattgtttcaggcttgatgacctttacagctttttaaataacaatgatggcatcttcagtagtgtaattttcccagactttccaacattctttatatcagggttttcttccacagtattgacaatttcttacgcagagtaccatgtgtaataagccttaaacgtcctgatgagccccttgatctaaaggttgaattagagacattgtgtttgggggcaagtagaccacttcagtgcctttggtgtagaactcatgaagttctgggtcaccaaggtcattgttcaataacaatagagctttaaaaggcaatttcttactgacaaggtaattcttgacttcggggacaaggtattgatgaaatcagtccagaaaaagtgttcttgttgtccaggccttctttttgtacaaccaggactggtagctgatgtttatcttttcccctcagggatcagagattagcagctttatagataaaggcagtactgattataaacccaaatgaattgcacaaaactgtagagttagcctgccccttcctgtcttaaatcgtggtgctcatttatcttccttactaataaatatactttctgacattttcttccagcatagggcacttttgtcttaaaacctttttcaggtacatatatcatttctcctcaatgcttttcttaatggcttctggaatttgtctgttgtctcttggtcaacagaagctgcttctcctgttaacttgacgttttttaagccaaacctctttctaaaatatcaaaccatcctttgctggcattatatttattagtttttttctttcacctttcttttgctttaggttgtcacataatgacttagctttttcttgaatcatattagagcttataggtatgcttttcttatggctgtcctgcatccacaaaaaaaagctgtgtttttaatatgatataaaaaggtatttcataaaaagagcaaggttttcatgttgctagtgtggctgcagtgagagcttcagtaattttcttttttccatttatttacaatgatccttatgctgtattcatttatcttgaaatgtcaggcaactgcagctacagacctcattttatgattacatattgagcaactcaacttttaattgtaataatttgacttttctctgcttcttgggagtgctcccaaggtatcataatatcattcaaggtttatggtattgcactaaacatgaaaaatgtgcaagaactatgacagaccactttttactgtgataaagcagcctactggagagaactgctcatgaggcaatggttagaatcacctggtgttttaagctaatactggcaactcttgagctcatctcaacagcaacaggaggcagctacacaattattacagtagcatggtatgtactacagttaattttatacagttaaaatttaatactgaatctttgtatttatttacatgtctattaactgtgatggtgccatgtaggtatgatctgttcatgtgtgtaagttttggtaaattttaacattttataatttgtgtatattttgtggtagtaaatgataacatagactcgtatataatatctacatatattatttgcatgcatgacatacttaaactttcttaaatttttttatgttcctaggctacatagttcatctgctttttgatttatcacaaatctccagacaaatttagtatatttgttttttaaaactcatgtacaagtggacctgtacagttcaaattcatgttgttcaaggatcaactatatacatatatatagatttggatgcgaccttgtaattcagatatgtacaatttaagttcttagatggtcaatgtacatctctggataattttttttctggaatttatgcggattttttagtttttttgacattttttgctgtatgtttacatttgaacaacttgactggaataggatttggaaggggagttgtcataatttttaaccaaatgttccttttttataaatattattttattgtcttttggcaagatatgtttgaaaccagactagttttttcaaagtttatgccatctttatttccttaattaaatgaattattttatgtttttattttaaatgcagggggtgcacatgcatgtttgttacatgtgtatattgtgtaataatggggattgggcttctagtataactgtaacccaaatattgaatattggatacagtgttcagttggatagtcttacatttcctttctcattggatacaatgttcaacattagattggatatttttggagtccccagtgatgttagcctcatgaaataaattaggaagattttaatcattgcaatgctttagaatagtttaaataacaaactttcttaaactttattacatatacttcaatttttattaaagtatacatgtgcatagcttaaaatgtaaaacggtagtacaaggttcaaagcagatacaatcttttgaccttattcacaagggcaatttctcagatgccaactctattaatgctgtcttctttttattctgtgtttctaaataaaatacttgaatgtgtttgtggcagttatgatgaggtttggctttaatacagatcacaaatggcagtggcttatataaaacagaactttgcttctctgtcatataaatgtctggagggtggatagtccaggcaatgtatggcagcccggctccatggagttctccatggatgtttctatcttgtggctcagtagaacatgtcctgtattgctaatgttaccttatagaccaagtggctgcttcagctccagatgttacattccagctagcagaaagaagaatgagatgaagaattccctggctgccttttaaggaagatgctgggaaactaatacctgacatatctacaggccagaactcagtcatgtgactgtaaacacctaggagcaagagaagtagggaaacgcagccttgcacctccatagcccattgctgtggagaaggggagatagagattagaggatagggagtgattttccatttttatttcttgattttgcaattctagacattttctattaacatgttatgaaaatgtaggattgggatctcttacatccattaaattccaagtcttgatccttctcctcaccatttatgtttcttcctcgtattttaaaaaattaaatctctatttattgttcactattatttttacagagtaaagattggtcacggccaggcacggtggctcacgcctgtaatcccagcactttgggaggccgaggcgggcggatcacgaggtcaggagatcgagaccatcctggctgacatggtgaaaccccatctctactgaaaatacaaaaaattagccaggcgtggtggtgggcgcctgtagtcccagctgcttgggaagctgaggcaggagaatggcttgaacccaggaggcggagcttgcagtgagcagagattgtgccactgcactccagcctgggcgacagagcgagactgcatctctaaaaaaaaaaaaaaaaaaaaaaaaagattggtcacaggtgttccgtatagttttacatttcctttctcatacaatttttgtttttcctggagataataagtacttttcatttattcacttgtttctatatctgtcattgatttgtctttcaattgttcaaataaaagtaaaactctaataataaagtccaatatatcagataacatatcatttttttccctagaagccacctggaggcctctgccctcttgctttattctacactagatgttctctaggcctgttacacagctgtcatcctaagattttctttgccttcatcctgtgaagtcccttccaattttacttgtgaagacaaacctttttggcaaatgatgtctcttcttctcgcttcatttacttcttaatactgaaggcaggatttctctgtaaacttctaggaatttgtaaattttttgcgacctcgaatataaaaatatgtattttacctctcacatttaattattagcttggctggtcatagaattctagagttcaaaataattttatcttggaattttgtttccttactttttaggttccaggttgcttttctggagtttgatgccattgtaattcacaattctttaaaagtgcctattttttaaaaaacggtatttattctggaagcttttaggattttttttctagagttctgaagctttgcagtgatatacttctatataaactttttccattcattttcctgaacatttgattgtcttcatcagtgtctaagtcatatccatgggtataaaaaaattattatttcagtgataatcatcttgctttccatttttcagaaactcattaagcattagcattcttcttctggaattcataataaacattggctctcctaaattgattatatgattttttcttatattttccagtttatccttttttggttctcctttttaagatgaaaattttttcagctttgtcttccaactcttctactgaatttatacttctaccaaaattttaagttccaacaattttttgttatcaaagtatttattagtgtccttttattattttaagaatttaatattttggtttttttgggctactgataattaaaacttttgtatcctaaccctttatgtaacatttctgattcttcaaaaactttgttttgatgtttgtgtttttgttgctgtctttcacagtggaaacttttccaaactatatgatgtcttcatatttaagagtgagacaataaaatgttcattcaaaattgtgctttcaggcctcatataggatgaaatagctggttactgaggaatttcagtgtctatgttattttctaaagcttagtataaactttcagtctcccatctggtggtggaatgggtcaaagtctcacaccaagttttcatggggcctgatgatagagaggtgaatgaggatctcacagtttgacttgcacttaaatctctgtcttcagtaacatgcctcactttgtcttctgctgtccagagcctccacaaattgtaaatatcttggtgtcatctacaattgaaaaggaggtagccatgttgatatgtgggtttggagggggactttagagaactaatatttaggctcaagttaatcaatatcttttttattcagcaggctataacctcctgatggcttcttcctgcccagcacagacaaagccaagtcactgagtttaattgacgcgagactggctacaccatgtaggagacagagttattacacaaatcaatttttccaaaaattcagaggctagggtttttcaaggatactttggtgagcaaagggatgatgatgtggaaaaatggtcctcttctggatggggccacaggataactggtgggtctgggtgaagccatctctccagacatgcaaaaacctgcaaaagacagctcaagaggccaatcttaggttctacaatagtgatgttatctgcaggagtaattatgggagttacaaatcttgcaacctccagaatagtggctggtaattgtattcaggctcctcacatcttcctaatgtattggccattcattacctttacaaaggtagtttagttttgaggaagggctattattatttaaattataaactaaatgtcttccaaagttagcttggcccaagccctctagtaattaagaagaatttggaggttaaaggcaagatgggagttggttagatcagatctctttcagtatcataattttctcactgttgtaatttttgcaaaggtggtttctaggtcactccactttccaccattgccttcagtgatacccattgctgcctctgattcttaagcttctgtggccctttgagttgcaaatcttttactcttgcaggcttccttcccactataggctgttagcagaactcagaaagctgaagcattcaattattattatccatcatcttttcattttccaaaactgtaatgacctcttttttctgctattaatgtctcttctattatctctgtgtgtttggcttaatatatctttttaaattctttgccttttattttagtatatttcaggaggagtgaacataacacatttcttcaacctatgtttaattggaggttgattatacattaaatatgctaactttaatattctatggtttttatgggtataaaacattttagaatttataagtatattttctaccctttcctatatttgccttcctaatttactcagtggatcatatatttattcagtatgtttgtactcaaaagttttgatcttttccttagctatcattatagcccttttgtcattactgtttctgatgatatattatttccccatggttttttgggggggttggatttactagaggtttatctattttattgtccctttctaagaaactgctttttggttttatttctcacttccagtttcttttgttaaaaaaaatgtatgtgtagccacccaacaggttcaccttgccagctgcctagatagagccaatttattgagataggggaattgcaatagagaatgagttattcatgcagggctggctgtgctggagaccagagttttgtaattactcaaattagtctcctcgagaatttggggattgacatttttaaggacaatttgttggataggggccagtgaactggagtgctgactggttgggttggaaatgactccctatggagatggagtctccatagggttggagatgactggttgggttggagataactccctatggatatcaatccctatgatttcatagggagtcaatgctgtcttctgcactgagtcagttcttgggtggggagccacaagaccagatgagtcagtttactgatctgggtggtgacagctgatccatcaaatacagggtctgcaaaatatctcaaacactgatctttggttccaaaatagtgatgttatctccaggagcaatttggggaaggtcaaaatcttgtagcctccaactgtatgactcctaaaccataatctctaatcttgtgggtaatttgtttgttctacaaagacagtctagttcccaggaggaaggggggttttttgagacagattgttactgtctttgtttcaaactgtaaactaagttcttcccatagttaatttgggctatgcccaggaatggacaaggacagcttggagattaaaagcaagatggagttggttaggtcagatttctttgactgtaattttttcagttacaattttgcaatggtgaattcatgtgtatttacaaatgcatttactttgtgctttgttgtaatgaattctttttcttttttttttttttttttgagacagagtcttgctttgtcgcccagtctggagtgcagtggtgcgatcttggctcactacaagctccgccttccaggttaatgccattctcctgcctcagcctcccatgtagctgggactacaggtgcctgccaccacgcctggataatttttttgtatttttagtagagatggggtttcatggtgttagccaggatggtctccatctcctgacctcgtgatccaccctccttggcctcccaaagtgctgggatgacaggcgtgagccactgcgtctggcctgtaatgaattcttaacatgaaattttcttaggtttattttgtgtgttttttaaaattattgagttgaatatttaatttatttttaatatttattattcaataataaatataataaagcttttaaattttctactaggatatgataaaataagtgtttcattaggaagcattcctcccattattaatttatatgttgtatgtcattacactttctagttaaaataatttattgcctcagattacaaaagtaattgcaaacttgtttttaaaatacttaaatatagaaaaatgattatattagtctggtgcagtagtaattgcagtttttgccatttaaaagtaatagcaaaaactgcaattacttttcaccagcctaatatatttttagtgaggttccaagcaataaaaggtatgtaaatagaaaatagtatagcctgaagctgtaagaactactatgaagccagataaagaaagataaacggttagggaatgacaggaggggtaggggagacatgtttagctatggtgttcagaaaaggcctaggaatgtgacatttgaaaagataacttatggatatccctgagcaatgtgagcatttgggtgtagggggttgtggtgcagaactaagggaatagccagtgtaaaagtctcaggcagaaactaggttatttgcacaaaagcaaccacgtcggtgtgaaataagtatggtgagggaggagaaaaatgttcttagatgagagataaaaggtgattgggggcagattatttgacaatccatagaaagctggacttgaaaaccatctatggtcacacctgtaatcccagcactttgggaagccaaggcaggcggatcatgaggtcaggagatcgagaccatcctggctaacacggtgaaaccccgtctctactaaaaaatacaaaaaattagccgggcatggtggtgggtgcctgtagtcccagctacttgggaggctgaggcaggagaatggcgtgaacctgggaggcggagcttgcagtgagccaagatcatgccactgcactccagcccgagcgacagagcaagactccgtctcaaaaaaaataagaaaaccatctatgggtattgagcaggagagggaatgctctgacctaagtatggttagtgttgtgtttgttactgggtggactagatatcatgctgcaggaataaagaaagcagggacaccaggtagaagaatattctagtaatctaggagagtgatgacgaaggtgactttattaagtttgaacctacactagagatggtgagaagtagtcaggtttaccatctgatttgtgggtggagaggatttgctaataaattgaatttggggcctatgcaaaagagagttaaagttactgctcaacttttcggcctgtgctctttggtgcttttgtttactaagaggaagatgggttggccaaaggcagagtttttggtgtcagataaatcaataaatctgtcttagatactaactttgaatttgtctattaaatatatcccagtggagaaattgctttgaccatggaatataagcatctggagctcaggtgagggcctgaggcaaagatacaaatgagccatcagcccagggatagtgttaaaaccacggtcttgaaaagaactgcctgcaggtattctgtagtggtgtctgcctttctgtagataaagaaaggcagaacggggctaagtaataaactatatacaatgatgctgtgagtatgaattgattgccatttgggggttgataattatatttggaaagatgaggtagttggtgatttcaacaaaagttaaatgatggggaagaaatattgaccagaatagattaaagagcgactggacaatcaggagccagcaagaccccttttggagagttttctgtgaaataatacttaaaaatattttatggtcaacagagtgtgttatattcatctgttttcagagcaaaaagttggaagtagataattggttatatgttttcactaacaattatgtgttataaataattatacaataaacatgtaaatatataaatataatatgtaaaatatggtagattgtattataaatatgcttgttatatttttataaattcctctaaattgtatagatataattttaatcttagaaattatatctatatacagatttataatgcacataaatacacttatgtacatatgtgcatatgtgtgctgtgtgtgttgttgtgggtggaactagctggggctgatgttatgggcaataaaggaatttgccaagacagctgtaggtaaggaaaggcagatttattagagaaagtatgaagatatgttgcaatgctgcaacaggcagcacagcagagaaggggctgtctgcagaggcaggggccagtgggaaatgttacagggtcatgctggagggggttatgtgtggaacaggttgttgtgccaatggaatgaggtggttgtacctgtaggttgtttgcaattagccttctctcagagcaattgttcatttttctccccaatctaggaccctccctgacctgggcttccctcctcatagttgcttactcatcaggactccatgtgtgtataatacacatatctataaagtctgatataatgagagagattaatgacaattattcacaataattttggttgtattaatttctccttatattttgctatgtatatagaattcttgattcaacacattttgtctgtaaaccatatatatgttccactaatgtttctgaatttttgatatttagttctgatatcaaatgtcagtctcactccctttactcagtggcctttgggctctgatactaggtcagtcccctggaactctggttccctcagctgcgtgggaaacagctctgctatatgctcatcacataggagctgtagctaaccagcagtatccagaatcagaagactcatcactgtctctgcccaatcattccttaatcacccagataacccagttgtttgcattcttccttactctctgccagtccccggttaatgttctcaggctccctcttacctctcgatgtttctaaaaactcattatttctttagcgtagcaacagcaagaaatctggtatttcatttctttgctatttcatccctgccctggtcatacttcctccccatcccactgtcagaaagaagttggtttcaggctttccccttcctctctgtgatattttacttctaccttggactttattgctttaatgtctttggtagaaagagccacacatggtgaaataatctctatgatctgagtcattatttgtgtcctttatatgttaatgcaagatagatggctttagaaaggactttagttttattttcaagacttaatatttcttcaaaattttattttggttttctacagaagcatatttacattgaagctaatgaaaattgagcttcacagtctgttcacatgatcatatgtttttgtgggttttttttttgtttttttgcaaaagtgcattatttttgtattatttttattaaagagagataatgttatataagtgtcagattccacaaaatctggatatatccttggataagttaaatggttgttttttccttccctcccttccttccttttgaaatagtttagggtcattggtcatgttttctggggtgttatctgagcttgtggtctcatgaccgagaatattaaggagcatagacacggacgccagagtgaggttagagcaaaagtttaataagcaaaagaagacagctctccatagcagagggatcctggacaagttgacattttacagtggaatgccaacttttataagaaactcctctcatctctgtagctgtttgagtaacttttcttatgtgaaaagctgtctgtacaactctccccatctttacagctgtgggatgtctctaggtaagcacaagcatagcttttcttgtttatataattgtgggtttgttttaggtcagttcccctccccttcctgtgcaagctactatgaagcctgccatagtcatgtctgaaaaagggaggaacattttgcctgggagcccactaatcacaaaaagaacaaaaggcttctatgcgggaccttggctgcctggcctacttatctgtacagctgcagcctgagttttcttcaggctgctgtatttttgcctgtagctgtgatttttcagagctgcttctccaactagccatagttgtctgcctaactgatttttccttttcttctccctcattaccccccacttcaggataagagaccctaactgctgttaggaaggtcaggcaatggtatttctagatacttcctgatggagaggggtgttgtgtcgagaacaccagctagggtttcttctgggcctggttcaaaggtccttggaagaatggcatgtccatgtggggttccatttgcagcactacttggagtttaatagcctctaggtgagaggaaacaattccggttatagcattgagtatacagggtccaaacttaacacaagacatacaagaaaaagaggtcccagtaaaggagagctaactaggtctaaaaagaagactggaatctttcaagaagggattgtagctacctgggactgaagcctgctctttctcttaatgtgtcaatgattctaatttgattcttaagcacctgtaagttttattccaattggctagaggtgttgatccaaaaggaacatgcttcatttaagagtacacaggtctttgggaggcggaggcgggcggatcacgaggtcaggagatcaagaccatcctggctaacatggtaaaaccccgtctctactaaaaatacaaaaaattagccgggcgtggtggcaggtgcctggagtcccagttactcgggaggctgaggcaggagaatggcgtgaacccggtaggcggagcttgcagtgagctaagattgcgccactgcactccagcctgggcgacagagcaagactccgtctcaaaaaaaaaaaaaaaaaaaacagtacacatgtgccggccaggcatggtggctcacgcctataatcccagcactttaggagtccgacgtgggcagatcacgaggtcaggacattgagaccatcctggcgaacatcgtgaaaccccgtctctactgaaaatacaaaaaattagccagccatggtggcgcacgcctgtagtcccagctattcaggaagctgaggcaggggaatcgcttgaatctggggggcggaggttgcagtgagccaaggtcgtgccactgcactccagcctgggagacagaacaagacttcctctcataaaaaaaaaaaaaaaaaaaaaaaagagtgcacaggtgcccccctactttggctgtaaaaacatctagggctcatctattttgcattaccactgcggctagagagtttatggattgttgttgtgcctctttggctcctactgatgtcttccacccttgttgcatcataatagagatattaagtactgatctctcaaaaagagaaataccagcaaatcaaaataggcctctggctatagcatgtcccattcctggtttttccagtataggattgttgtgtgcatgtcctccccagtcctctctctcagttagatctccataccatgttatggaagtaatagacctctgtgtttagtgtacctgagatagggtactttctagaaaggagcacagattatgaattccatcagatgatgttgccatgtcagtggagtttaaaaataataggtcggggaccactgccactatagtgcatgttcccctccaatgcctagggagaattaggtgtaaccaggaaccacagagaaaataaagccctgtcccttgaagggaggattctaggttgtgatgtgtaagagatgcagctagtctttgcatccgcttcataaagaggttccccttatatctaatgggagcatctttgatatagggataaaaatacaaagtatagtcatttatggtgccatttgggactctacacactaggtgggaaggatcctgctgacagatggagctttggaagataatatgtcctgaccagtatctcagttgattcttaatgcaggcgctctcagtccagacatctccttttcgcccactagtgtgtaggttattactagtatcaaatatcttacaggggtctgggattccctgaggtggcatatttggaaaggaccgtgtgttatttgctattctgatgtaatactggtaagaggagttacgcaggggctgccgctcaaatttagaatcacagttaggaggcgtggatgggttttttaagtttttcaacattttatctcacgtgttagattagctttctcctttttttaccctccagacctcctcacttttagagattgtaagtgtaatgttgcagtatttgagatttcccgggtatggcacttttcctctgctttcaaagcagagggaggcatctgctatcattctatcaacttcacctagtctaaggatgtgtcttatccccaggggatgtgtgttcctgggtagaattaaaagtgctcccatatcaagttccatttatacctgacaagttcttgatggttaagggcaaagctatcaaagggaaccccaggactatgagttaaggatcatcaagaagcctcccagtttcagtgttattaaactgagcaaattgttcagggaaaacccagcaattagtcttgctgtatagatgagcaatggctggtactgttcgggtcaaagactaaaaagcattcctgcctctaacagtgaatgctactaagcttgacagaaacaaatttgcctcttatctgttactgccatccctgcaatgaagataataactaagcaaaatattacagaagtgagactgtctgtctgcttttccactcaggaggtgccacagggtgtaaccctactgcaaaagcaaagtaagcaaaataattcctgcaagtatggtgtagttaatgatttccatctgagtttctatttgtcaaaatattggattttcctctgggggggtctatggagttatgaatttggtcccatggataatcaaagtccccctataaatttgcatcaaaaagaagctgcaatacctgacagcagatctcaaaaggaaaagtggaaataactgaaagaatctggtagggtaaaggtgggattgagttagatgggtagtcctcactcatttacttatcttttctaattttcagtgtaaggtgcctgacttcttcacattggtacctgggatgctcttctgggatgtcaggggctgctttctctgctttccaggctttgacttgagtgtgataaatccaagagttgatacctgcaaccttaacctttgagagagtagagaggaggacagtgtaaggtctttgcaaatcggggtctagagaaggggaaagagagggaagagtcttcactaacaccaagtcttctgggttaaataagggcagtcctatttcttgggggttcagcttccaatggttgttttcattcctattggaagtgggcaaggaggttatatatttagctaattcagaagtttccttgtcaaatagaaaatcattggtaagaaaaggccaaccacacattatttcaaaagggcttaaatccaatttggaggcagtgcttctcacctgtagtaaagccacgggacgaagagtaacccaagggaggtgagtttcttgagagagcttcctcaggtacctcttaatgacatcatttgttttttctatttttcataaagactgtggtctcgaggcacaatgtagatggtattatatgcccagtgcttttgggtaacagacatcttaaatgaggggtccaatgtcactttggaggtacttcaggagtccaaaacaagaagttatctcattaattagtactcttaccacctcagaggacttttctatttgacatggaaatgcctccacccagttaatcaagatgtctatctatactaaaagatatggaatgccccttacttttggcacatgggtgaagtctatcctccagtcttctgccagataacttcctatcctttgaatttggtggggaaggagctgcctgttgaggggattatttttaaggcaagtttcacaagcattaacaagctgaccatttttagtaggttttccccccaaaacaatctttgggtgcattgataagtcttatccccacctaggtgaaaggtttggtgaaggagtttaagaacttttcactgactagaggctggcaagtggactttactgtgctctgagtgtaaccatcccgagggctgaaaagtgtatccttgagatgtggcttattctatttctgcagaagaatactgaggtcttacttctcttatggagccctcccagattacaggggtctcaaatgtgtcagatctcctgggtctttttgctgctgatttggctgcttgatctgctagtctatttccctcagttatgtcatccacacccttctcatgtactctgcaatgcattactgccacttcctacagaaggaaaattgaggatgaagtctgcctatttcctgatgaatttaatggaagatccattaacagtgaggaggtgtctttccttccagatatcagcatggacatggagaaccaggaaagcatagttagaatcagtataaatgttaactgcctttcctttgctttatttgagcatccttctgagagcaactagctcagctagttgagcactgatgcccagtgagagatgtgcactctcaataatgacattcagggtgactactgaataccctgccttatgggtttcttgttctgtgaaggaacttccatctgtgaagacagtccaatctggattttctaggggagtttctctgagatcctccctggcttcataggtttgtactactatctgttcacaatcatgttcaggttctctggtttcctctgagaggaaagtgcagggtttaggcaagggcacatttttaactgaactgcagatcctctagcagcaaggtttgatatttgaggaggtgattgtttgttagccagagactccctttagaggatagcagtcctgctgtattatgtggagtataaagagttaaattattctccatggttaacttggtggcctctggcaccagaagagccactgtggcacctttagccaccaaatcaagccccttacttaggtaactgacagactgctgggatggaccttgggcctgagttaaaactcccaaggctatttctttccttctgagacataaggattgaatgcctttcctatgggaagactaagggccagtgctttaagtaaggcttgctttagctagttaaaggatttttgggcctcagattcccaggttaagagagtgagttttagcacctgagtgtcttttatagggtgatacaaagggtgagcaatttcaccatacctgggtatccacaatctgcaaaggcctgtagtacccaaaaatattcttagctgtttgaggatttgggaaaggggaaaggaggtaatgggcttaatcttctctttgcccaatgttctagttccctctgacaggagtaaacctaggtacttcactgaggtttgacaaagctgagccttaaattttgaaaccttatatcctctcttagctaggaaattaagaagagcttcagtgccttcctgagaagccttctcagatgaggtacagtggagaatatcatcagcattgtaaaattttaatgtgaggatgagacaactaagagagatctctcaaaattgcctgcccaaacaagtgagggctgtctcagaatccttgaggcagcactgtccaggttagttgggcagtctggccagagggatctttgaaggcaaacaggtattgagagtcagggtgcaactaaatgtagaagaaggtattctttaggtctaaaaccatgaaacatttagatccctcagatacttgggttagcagagtatagagattaataatcacccaattaattcgaaccacagcctcattaatgagatgtaggtcctgaactagcttacattccccactgggtttctgcactcctaatattggatgttgcaggggctgttgcagggcctaaggaggccttgtgcttttaagttatccatgatgatatctagtcctttttcagcttctggctgtagggggtattgtttctgcttaggaaaagaagtggaatccttaaggtgaatctggactggtatagcgattgttcagccaatctttccctgaattacccatacctgtaagttaatattggtttccactaagaggagataaagagtttgttctgaagccattaggatggcagctcacatatgggctagaatatccctgcctagcaaaggagtgagactttcaggcataattaaaaaggcatggataaaagcaggttcctccaactacagctgagggtctgagaaaaatttcaagttaagggcttccctgagatgtccatcacagtcatgctaggggaggagggaatgcctggattggagaggagaaccaaaagactggctccagtgtccagaaggaagtctactttcttgccttccacctccagaatcacccagggctcctggatagtgagggcagtttgagcttctggagtcaaggatctttgccaagaccagctcggctggggagaccctaacccagcagcactagaggaattaaagacacacacacagaaatatagaggtgtggagtgggaaatcaggggtctcacagcctttagagctgagagccttgaacagagatttacccacgtatttattaacagcaagccagtgataagcattgtttctatagattatagattaactaaaaatattccttatgggaaacaaagggatgggctgaaataaagggatgagtttggctagtaatctgcagcaggagcatgtccttaaggcacagatcgctcatgctattgtttgtggtttaagaacgcctttaagtggttttccaccctgggtggaccaggtgttctttgccttcattctggtaaacccacaaccttccagcatgggcatcatggccatcacgaacatgtcacagtgctgcagagatttttgtttatggccagttttgtggccaatttatggccagattttgggggacctgttcccaacagatctaagtcccaggatccatcagtcctgctggaccatctgtgagactggccttggacttggtgatttatgcctccagggacagtccaacctccagtggtccccaccacaagctagatagggtcaaggtggcttctttttgttgcctgggcactcccttttgaaatgtcctggcttaccacactggtaacaatttgcaggcgtaccctggggatcctggagtttataggcctgtaaagcaagcactagtgcctgtgtctctctcttgtacttcctctctttttcctgggcctcttcctggtccctgttgtaaaagaccaaggtggccatgctcaggagatttttctgaggtgctactcagtcctatagcctgcttccatagcttccttctgatatcaggggttgtctgattagtaaacttgttttttaatattaactgcccctcaattgaatcaggagatagagagatctgtttcagtaaagcttccctcagactttccataaaggccaaggaattttcatctggtttttgatctatcatagatagcttagagtagttaagcgatttggccctgatcctttataagcattccagtatgcacattagaaagtgttttctttcccactcatgtataggatcactggggttccaattagtattcttaaggggtactgcctcactccctgttggaaatggagtttcttgttcctgttattgttctctaatcccccttccagtttcttccaagttctttagttccccttcttggatgaggaggttttctttggctataggagacatgttgtttatcccaacttttctgctgcctgtaaggttacctgtttctccacagcagtcagggtttggattagaagaacataacatctctccatgtatgatcaaatacttgggttacttttggaaagcctctatatatcagggtcatcagagaaccttcccaggtctccctttatttgcctaagttcttgtagtaaaaagggaacttgaaccatagtggcatcatatccactgggcatttcttgcaggcataatagtgaagtcaagggagttggaggctttggagtggatggtgctggaatggccgatgatatagctggagggggcccaagataaggggtggggggtttgaggggctgaggcactcagaagttttctttgatggttttccaggaattagtttctctgattttggggaatcatccactatgtgcctgcctgatatgactgcttaaagagctggatcaattgtgcaatgcttacaaagatttgggttgtgtcgcaggacaaagaaagccagtacatagggaactttgaatcatttgccctcctgtctgcagacaaaatctaattgttggatagtattaaaattaacacttccctcaagaggccaggcctgtctgccctgcagttggtaataaggccacgctcttgtacaaaagaatatgagccactttttcttcagggtctgatgataaaagcaatcccagtgtctctggctgtacttgagaggagtgcaggctgaggatggttttttacccatctagaaagagaaaagagaaggcattccttagtctctttcctttcttttggagtgacccagcatggagaaaaagacagaaggggtgtcccccctctccccttctctctttggttgtctgggtcctggtaacctttgtagatgctgcccatgaatgcaagtgtgacctttttttcatggatcccgaggagctagttagcaggaatagtcaggcttatctgctgaagtccctagctctctgctggtgcttcccctttaactcccttgcgtgactggtatggatcccaggtctcccaggtatatggatcctgggaaaaaactgtataatagttgtacttgggcaaagccccctaatggagggaatgttctagctctaaatacctatattcaggtattttggcccagactaaagtactcattcctaaacaatgggtccgattggcttccaaacataaaacccctctttcttttagatgccattgcaattggatgcagaatggatgccttaaaagaatgtaggaattgaatggctgtcttccttcagatggagacagcgtggaggctaaaatctgcctttcaagggcaatttccaccacactgtcaaagacatagtttctccattcacagataagacatggagccagatgtctgatagaaaggtgcagatgagagaagagttgggaaattatagattttggacaaaggactaataagtctccccagggaaaaatcccatctgactagttggtatgacagagattggaacactaaaaagtagctctgactccaattactctccagacaaaggttagaaagggaagtttggggctgtccccacaacatgcctccccacaagaaaaaaataatccatctcatagagagactgtctagttatgctgcacagtgctggcttctcacatggaaaaagagacagcttaattaatattccccccatccaaccccattgagggctatcattgagagataaataggtctttagatccaagtcttggaatctccctgtttcaagaaaatcacagagacagcaattccttgaaatacattcttgattactaaggccccagctgactttacccaacaggattatatgcccaggttgtaaaaacacttgcaatattgcattcaaagaaggaataggagacatgatagccgcaaaacgaaaggaagaaaatgcaacagaaaactctggaagtcctggtgccaatacccagcaggctgtcagggactggagttagtccaagggcctccaggttacaccgaagtgtagccttggccaaaaacctttggttgcctgaggacctccttccagccccatgcaatggctaggtcctccacaaaagggaacttgattggaacacagccaacattcccaacaaccaagggtgagcagggttgataaagtcctctcaagaaagcctgtcccctgagtcttgtaagactggaagttaccctattggcttttaactgactgatgggccagtgtgtttttttcactcttgagagaacaaaactgagaacgagaagcctcagaaataaaagtcaagagttaagagtttgctcctactcactctttcgatggatcccaggcaagcccacactaataaaacagtatagggtcactgattacgttgtctgggatgttattcaagcttgtggtctcatgactaagaaaattaagaagtgtagacatgaacacaagggtgaggttagaacaaaagtttaataagcaaaagaagaaagctctccacagcagagaggggtcctggacgggttgccattttacagttgaatgctaaagcttttatgagaaacttctctcatctctgttgctgtttgagtaacttctcttatctgaaaagctgtctgtacaactccccctatctatgcaactgtgggacattcctaggtaggcacaaagcatagcttctcttgtttatataattgtgggtttgctttaggtaagtcccccccttccctccctgtgcaagctcccatgaaacccaccatgttaatgtctgaaaaggggagggaatgttttcctgggagcccactaattacacaaagaacaaaaggcttctatgctggaccttgcctgcctggcctgcttatctgtacatctgcagtctgagttttcctcaggctgctctatttttgcctgtagctgtgatttttcaggcaggctgcttctctgaggactagccttagttgtctaccgaactggttttttcttctacctcacttccttccttccttcttttttctttcttttcttccttccttttctccttccttctaccccacctttctctttcactctctgcttccctttcttttcatccatcccttccttccttccctccctctctctttccttccttcctccctccctccctccttccctccctgcttgacctttccttccttccttccttccttccttccttccttccttccttccttccttccttccttccttccaaaaacttcaggatactaaaacaataatgataatgagaacaactataggtaatatttgtggagcacttactatgagccaggaactgctagtttgcaaaaatcaacaatcaatgtagtaagtcctactattatccccactttacagataaagagtcctagatacagagagatctaacagcttgcccaatatgtcatagaataggtagatgtaacagaagcattgttagcctatacagagcctttgggcagtttatataaaagcatctctacctctaactgcaggaatgacaaaaggcactcctttccatggtcatgtggccccatatcagggcacactgctgggctgggagatgaggaatggctgccaggctcctactgcacttttgccctggttccatgggggcaacacacaactgtacagccttacagtccctagacttaaatacaaggaatattaaatgaaaatgttaatagcattgacactcatattaaaaatattatcttagaaattcattagtttactaaagctgttagaataaaacatttcaggaaggtgtatatcatcaatataaatacgggttataaaccaacagtattttaatatatgagcaataaataatcacaagatttaataaatacaaatctatttttactagccattatcatccagaaatattcttgaccaaaaaagtccctcaactagaatatatgtgaactatgtgaaggtaattataatattttaaagagataaaattagaatttaattatattgactgattatataatacttctaattagaaagattatatattttagaggtagaatttttttttaccaaattaaaatatataaaatttgaacagattcacatcacaactagaagacttaatttataaaatagcaaaacaagtttgcacaaatatttaaaaatattaagacaactatttggtaggtggaattctaagaaagccctcatgatctgtcctttgtgttacatctgtataacttcctccctttgtgtgtggatggaacctgtgatttgcttccaaccaaaagagtgtggcaaagttgatacaatgttacttctattattatatttcataagacttaatcttacctgactggggaggaagaccatccaccttgaagtagcaacctgccatgttgtgactacttatggaaagggccatgtattcgttcgtcctcatgcttctgtgaagaaatacctgagactgggtaatttacaaaggaaagaggtttaattgactcacttccacagggcgggggaggcctcaggaaacttacagtcatggtggaaaaggaagcaaacacgttcttcttcacatggcagcaggaaaaaggaatgcagaatgaaggtgggaaaggccccttactttaataaaaccatcagatcttgtaagaactccatcagtatcatgagaacagcatgggagtcatcaccaccatgattcaattacttcccactgggcccctgccatgatatatggaattataggaactacaattcaagatatttcagtggggacacagccaaaccataccattctgcccctggccccttccacatgtcatgtcctcacatttcaaaacacaatcatggttgggcgcagtggcccatccctgtaatcccaacactttgggagggcaaggtgggtggatcacttgaagtcagaagtttgagaccagcatggccaacatggtgaaaccctgtccctactaataatacaaaaattagctgggcatggtggtacatacctgtaatcccagctactcaggaggctgaggcaggagaatcacttgaacctgggagacagaggttgcagtgagccaagatcatgtcacttcactccagcctgggcaacagcacaagactccatctaaaaaacagataaacaaagacacacacacacacacaatcgtgccttcccaaaagtacccctaatgtcttaactcattcaagcattaactcaaaagtccaagttcaaagtgtcatttaagacaaagcaagtcccttttgcttatgagcctgtaaaaccaaaagcaaattaattacttactagatacaatggggatacaggcattgaggaaatacacccattccaaatgagagaaattgaccaaaacaaaaagactagaggccccatgcaagtccagaatccaaatagcagagtcattaaacaataaagttccaaaatgatctcctttgactccacgtgtcacagccaggtcatgctgaggcaagaggtgggctcccaaagcctcgggcagctccacccctgttgctttgcgtacaatcctcagtcccagctgctttcacagctggtgttgagtgtctttagcttttccaggcatgtggtgcaagctgtcagtggatctacccttctgcgatctggaggacagtggccctcttctcacagctccactaggcagtgttccagttgggactctgtgtggggattccaaccccacatttcctttctgcactgccccagcagaggttttccatgagggctccacctctgcagcataattctgcctggacatccaggcatttccatacatcctctgaaatctaggtggaggttcccaaacctcaattcttgtcttctgcacaactgcaggaccaacaccacatgaattcttctaaggctgggggcttgccttctctgaagcaatatcctcagctgtaccttggtccctttaaccatggctggagtggctgatatgcagtcccaaggctgcacgcagtaggaaggccctggacccagtccatgtaaccatctttccttcctgggtctgtgatgggaaggacttccctgtgatgggaaggtctctgacatgccctgcaaacattttccctattgttttggagattaacatttggcttattgttacttatgcaaatttatgcagcaggcttgaatttctccccagaaaatggggttttcttttctattgcatcatcagtctgcaaatttttgataattttatgctctgtcacctcttaaacactttactagttagaaatttcttccaccagataccccaaatcatctctctcaagctcaatgtttcacagatctctagggcaggggcaaaaagctgccagtctctttgctaagcacagcaagagtcacctttgctctagctcccaacaagtttctcatctccatctgagaccaccaaagccttgactttattgtccatatcactgttagcagtttgggcaaagtcattcagtaagtctctaggacattccaaacttccccacagcttcctgtcttctgagctttcaaagtctctaggaacttccaaacattccaacattttcctgttttcttctgagccctctaaactatttcaacctctgcctattacctatttccaaagtttcttccacattttcaagctccttatagcagcaccctacttctggtacaaatttactgtattagtttcttctcatgctgttatgaagaaatacctgagactgggtaatttataaaggaaagaggataacttgactcacagttctgcagagctggggaggcctcaggaaacttaaaatcatgatggaaggggaagcaaacacatccttcttcacatggtggcagcaaggagaagtgcagagtgaaggaggttggggaagccccttataaaaccatcagatcttgtgagaactcactcactatcacaagaatagcatggagatagccactcccatgattcaattacctcccactgggttcctcccataatatgtggcaatcatgggaactataattcaaaattagattttggcgtgggcacagccagaccatatcaggccacatggcagtgcactgttggtgacctctaggttctgaggacagcctttacttgagatccagtgggaaactggctcagtcaagggaaggtaccccttgtcctgatctctgtggcctcattagtttggcagcctgtgctaacaaagctgaaagctgctaagaggtcaggacaactcccaggccttagaagcctgccctagggggacacagcatctggaccctctgccctggggtgactcctcccaagaatagttcctgggaagttgcccagcccttcactggccacacagatgcaagaaaacaagttttgctgacaacttgaatgaatctggaagtgtagttctccctagttaagcctccagatgagaatctagcccaactgacaccttgatgttagccttgtgaaaccatgagcagaggatccagttaaaccgtgcctgaactcttgatctataggaactggggcacaataaatacgttattttaagctgctaagtttgtggcaattcattatgcagcaatagaaaaagaatacagaaattatagaaacattaaagtcctatattacagcaactcttactgaaaatacaagtattggtgcatggacaggtagatcaatggaagagataatttcaactttaattttattataggagataacctagtatattacaaaacatcacaaattacatttaagtatccactcatgcctggtgtactatttactccttttctccatttgggaatcacggatacatcactgaaataaataacaggcagattaggcccattgtattgtgaaagttcaaatcacaggaaagctaaaataaagcatttttcaaatcttagtccattctaagcttgagagtgataaaaataggtcagagagaaaaagcctacatgaatatttaaaaaccgatcatcacaattttacaactaaaataaaatttttaaaattaaaagaatgttttcattaaatatgaaaaagtttaatatatatattatatagggagcaaatccaatctgtaaattaaagtgggtgcagagcataacttacaaatgataaaatgcaactagtaattgttatattgtagcatttttgcttatggaggaagaagctggtcaccaataaatattccttactttggtcaaagcctgaggagcatgagtagtgggcaactcaggactgaccctcagaaagttagtgacctggctcatcatgacagcccagatttcaatggtagtgaaagtcaaattattcttttaatataaaattccttttcaaaatgccaagtgcatgattgtcaagctggtaatcaaactttctgtggctgtttgcaatgagcaatgtccttgcttctcttgtaccattggaaaaaattcttctgctcaacactcaccaatcggtgctggcttgcttgaactttgtgtcatgcaagtgacaagcaggattctgtgagataagaagtaactaaataagattagtgtccttaatcaggactaatcaatcatttcaagtggaaaatttatttggatttgagtgacctgaagtgcattaacagcagattccataataatacagcaaatggtcatatttttacaatgctctacgatccccataaggagctaatttacttttttccttctgaatttttctaatcataaagattcaatcctctgtccccactgacttcccagaatggctttcatatgcatttacattcatgttaaatgtgtgaattgttttaatggcacttctttcacaacttgaaataattattttggttgagttcaccatgcttcaatatgttgtgtttgccccattctgagatttgtttaagagtgtagggtaagctgatgacatttcaaatagcctaatttgtctttgtatactgtatgttccaatcaaggacatttcaaagaatatgaaaattgtgtcagaaaatatgttatcaatatacaatcaatgtgtaaagtgtagaggcacgtttttccccaatattaatagttattttaaaaaaggagctctggcagagggtcacatgattctcctaatagctttctctgcaggcgtctccataattattctaccctgtggtatgccctgtcagtacagctaagtatgacagagccaatgaagtgatcaatgcttttcaggatctcttttcaactgagcaatgaatgattgctgagtgcagatagttgtccattggtgagtactctcattagtgacattaagcctgtgacaccagtgaatgaaaagtgaactgaggttgttgatggtcagcaagtcagctcccggcaagtgaaatattcattcaaaattattagccaactactgaggtctgcaatgacaactagggttactttcaatttctatgtaggtttatattttattagttattcaaggtaaagttaatttcaatgaataattcttgacagtggcagcttttttcagtactgtcattttaggcttgaaaaaacaaaaggacaaatcactgcctgagtgtgtatgtgagtttgttgtatgtttgcatgtaagtgagctttgtcatcttcctaggaggtacttacattattaagaaaaaatggacattttttaacagctaatattttgattgcttactataaaccatgtactctattaaaatgctttgtacagccagatgcagtggctcacacctgtaatcccggcactttgtgaggccaaggtgggtgaatcacctgaggtcaggagttcgagaccagcctgaccaacatggagaaaccctgtctctactgaaaatacaaaatcagctgggcatggtggcacatttctgtaatcccagctacttaggaaggctgaggcaggagaatcccttgaactcgggaggcagcgattgcggtgagccaagatcaccgttgcactccagcctgagccacaagagcgaaactccatctgaaaaaaaaaaaatgctttgtacattatactttattttctccttaaatttaataggatttaatgtgagccatggggctttggttaaaagtatattgaaattccgcaattcaaaatggagaagataggtcttaatagtaatgcatattaaaaaaaaagttaggattttagctaaatataatcatagtacaagccgtctactggtgtggttgtcaagaaaattaacatatagctgcgttattagtataacaactgaaaaataagaactatagtgcagatcagacccctgcaaagcaagtattcacttttggttgtgtatttttaatgggagactggtaaattggccaactactgaggtctgcaatgacaactactattgtagcccacttggatgaaagtaaccatatggtgggtactcaagcaaccctatcatatgatgaacagttcaagtaactttggaacttagctacagaaaatacatataaatcccatgaaaggtatcttcaagcacatttacacctgttcaacacagggactgtgttcctggaaagaggagtgtggatttcatcagcattataagaattggaacaatatggtccatatagatatctatggatatccaattgccccagcaccatttattgaaaagaccatgaatttttcaatgctctgaagtaccaactttgctctagataaaacagtgatgtattcaagtgtttagttctgggctctattttcttgcctgatctagttgtgtagttttatgctgacattgtatcacctcagttacttaactttttaattaggcttgatatctgataatattgtgaaaccttgttctttgactcttgagagtcatagctgttctggaccctcgaatcactatataaaggttagaataagatgattttgaggggaatatttgggattttaatcagggttctattatctatatatttatttgaggaaaattgacatattttcagtattgagtcttccaatccaagtttattcatccatttatttaaaacttcaaaaacttctctcaatagagtttataattttctgaaaggaggatttacatatatcttttgttgaattatttctagcagttttatattttgatgctattataaatgatatatttaaaaatttttattttttatttacttattgctactttatagaaatgcaattgatttttgtatactgaccttatttctaacactttgctaaactcacttgttaaatcaaaaatttatctgtcattttgtaggtttctcttatatacaatcatattatctgtgaaatgttgaaagctgtattccttctttctaatctttataccctttttcccctagcattgttactacactggcttctaccttcagtaaaatgttactcttggcaatcagcatagagttgtggttctctccataacctaaaaacaacctttattacagacgttagtctactgacatttgccaatattcctaacatatctgatttaaataaataatctcgctttctttttatcttttgtatattagatttttcttccatcttgttatcttttgtatatttttattatatggttatccaattttcagcttaaaaatatagattattttactatcattttgtttctgtagaattcttctcaatttatcaaagtataatgcgaattgatacttttattttctttctgagtaaggaaggggcttagaacacattaaatccactgtcttctttgttgaattacatgttacttttctgtcttttaatttttttatattttaaaatttaaaggatgttattgttttataaagtcaatattacatttttttgacctttgtttctagtcatctctccaattttatttgtctgaaggagcacctttttaatatttctcttagctcagatattctagtaacccaccttcctagtttttgtttgtctgaaaatgttattatttacttttacttttaaaggatactttctctggctgtagaattctagattgtgtcctagtgtaggtgccatattatttatcttattttgaatttaattggcttttaaaatctgtaatttatcatctttcatcactttagtacaacagacattaatttaaaatttgcttctgttccattcactctcttttcttcttctagaacaaaattacatgtatgttagaccttctcaacttatcccctgtgtctcttatcctctagatgtttcatcaattgtctctccatattgcaatatggcaataattttaaaaataagttttggctcagaaattctccatctatgtttattctgttgttgcttcaatctgtttggttcttaatttggtggtgtctttcagtcttgtaatttcatctcttccatatgtttcttatagattttctagttctttgaagaagctctaattttgtcttttatatccttgaaacatggtaagtatagtttattttacagcatatgtctgtttaatatttagaattcttaagaatttgtttctattgtctgtttttctgttgttttgtttataatgtctttcttctcttgggcctgattatttatttatgtgacaagtcactgtatttgaaaaattctggaaatattttgatggcagtgatgttatctttctccagagaggatttacattgcttctgatggacttcaaatagcaccagaaatttggatttcttaatacagtttaaggaattgatattatctaatgttggatgtagtccctctgtggcattatttctagtttgcccttattatgagaatgcagttctttgaggaaccaaaccaatttgtgggaatatttactaggcacactcttagcaggcatgatttccaatctttgttctcccttttccatttaaaaacatcagaaactgacagatttataaggggaaggcaactccgaatagtgggtttacttttcttcatggcattattagccctctaatgcctttatgtaaatatttttatgttttgtccaagtcttgaagttgtcctcccaattttctaccagccttaggagaaaactgggacttgctcaaagacacacacctataaataggagagttggcgctcaaacccagttcactgtagctctaaagtccatcttcttaacctatatgtgatactttcccactacatggttgttgataagtttcaaagaacaatgcacaatgattcctagatgtcaccagagaagtacggatgattagagactatgaacaccaatatagtcttgtagcaacatttgacagttaatagtagccagagttagacttcattcttttaggtttagtgacccagtgttgtcagcatgacagtgatttaaattctcagacatagtcacaatactaggttcatgaaaggtaatgtgcaagtcagaatgccagtgtatcaatgtataatttaaaaaattaagctatcctgaacattggaaggtttatgtgagacaactagtgatttctatgactgttgataaatgattgaaacaaagatgaactggaatcagaaggttctatgtaatcagaattatgaaatcagaataagaattattcagatgttacatagttacactaccccagtctccagtcatgagttcttaaatccatggaccaggacatcctctcctctacatgagtgagtgctgccaccttattaattttgaagtttcccttttcagtgtgctaagatagccaacccctttttaaatcagtcttgcctctatgaagaaatatccagaacactttggagatttggatattctaaaacttttcaattaaataatgaattacactcttattttagttttggaatagtcaaatatattgattgtgtaggaagactttttttaaacaataattcagtgtgcatctttatacaattccagataggtgttatacacattgttcttgtctgatatatactgagaaaatcaagtatttagaattttataaattctgtaaaaattgcttcaattagaatataatttaatattttgaaaactaatagtttcaaaaattgtgattaaagtcatatggatgtatatccttgtgtaagttaaaattatcattaaatatttattttaattttacttcctataattattacaatcaccgatgtaattacttctttatatattcaagttagacatttggcttttcaggattttgtttgtaaagaaaaagctttggagtagatgatattgaagatatgttcctgatctaaaatttcacaactacttcattaatacagattaggaagaaagtcattctactggctgcattttaaatttaggtacaatgcacatgtgtgctgccatcattagttagggctgggtgtagaagcatcgcctcttccatataatgatgcacttgagagctgagctcaattgtttagagatagaatgttaaatatgtctacgtctggtgcttatagattaacaaagtttaaatattgacaatttgaccatatttttttccagcaaataaacttggaaaaaagttggagaaagaatacaaagataaagaacacacatttttctcatgccttaaaaatgcagttccacccttataattgtgcagttattattatggaattacttattctcatggcagccttttgactttgctattgaaattttaaatcccctgttgctaccgggaagcatttattatacgcaagtataacatttttcctttgatttttgaagatgttgtttataaaaatttcatgagatacagtgtttctatacacattttaatatttgaaaactttttaatgaaccaaatacggaaggtttcagggcaaaagcaagttatcttggtcataaatatttcaatcttttttcaccattttccagtgtaagtataagcatttcttttagagattttagaacattctttgcatttttcagtcttcacaaattaaaatgactgaacaatggccatctgctttaactcagtacttaacttataatcttgtatttttaaaacttgtctctttaaagtgcgattgatctccattaacgtattatttctctgtgtatttttttcatgtttcacaatatacttagtgtttccacctgagaagaccaaagactatcctttgattttcatgctcctctacaatagctgaaactagtttgacctaagagtagttagcacttgagtttttcttgaaaataattatctaaaaaataatagccaaataacttatattctaaaaacaggcacacttaatctcctttacaactctagcaaatcagattttgaacatacgttaagcattctgaggtgtgggcaagtaatcatctgttctttcagtatttaattgcttttttaattgcaactgtgattttgacctccaatataaagcaagcatgacttactgggttactcagacagcagcagaagtgcttgtagatgaatgttatcttactcatcaaattctgacaaagtgtttagttaatttacaaaccacttgcacacagagagacacttaaaaatgtgttttcaatgaatggatctaataaaattttaggtaatatataattacaatggtaaaaatactgttttgttttttcatttcggaagtattaaggggtaatgaaaggaaatatcaattgcttttccactttaacccaatttaatctttacaacaaatcttttaattgggttttatgtaaagaaacaataccaaggctccaggtgattaaatacgtcaccagtatgtcaatgtttctcagtgtgtatgtgtttaggccaaggtttgagcctggacgtgtcttgttaataatcttgcttgtgttttggtaagctaattttaagtattttctaaaagcaagggatatatagtaaataagtacatccataaaattaacaaatcagaggaaagataatttgtcagaatctgtttaggatgtaacctgtttaggtagagcattattaaagtacatttgaggaatctacagatagaattgctattttctctttcctttctcaaccaagtcacctgccctccatcattcctttctcctcctaaagcctctctcagccaagagggaagtgctctggaactttgttgtacccttggaggaggtaaagcctcagagctcttaagctaatccaagacactctcatacagaaagaaaaatagtaagcaccttttggtacttcagtgcctatgaatagagcaagttcagaaactatcttgaacaaaactgcatgctgcatgtgacgtaggaactaatagagatatggttgaggtgaggaaaagggacaagtctttgtttctataaactacacctgctaatttggtgctaagatgaagccatttttaggatgaataaacacatctctgctttgtaaacgtacccgtttatacatttttttgtattacttgatagctttggtattatttcatcatttatctgttattgttaccctggctgcctctgctgttgttactgttttgaaaagtaacttgaataattatgaccaggaaattttggcaatgcctatgtcaagcagtggcagatatagtcatggctacataattaacattttgatcaatgacaggctgcatatatgatagttgtcccataaggttttaacactgtatttttactgtaaccttttctatgtttagatatgtttagctacacaaatacttaccattacattacatttgcctacagtgtttagtacagtaacatgatatacaggtttatagtccaggagcaataggctataccatatagcctaggtgtatagtaggatataccatctaggtttgcgtaaggatattctatgatgttcacacaaagacaaaattgcctaacaaggaatttctcagaagctatttccatcattaagcaatgcatgactgtatagtgaaccgtgaaaacttggaatataaaaatgttaggaatctactggagttgccattcttgctccaccttgtctttttcttgtaaatttttagtgcttctgtaatttagcattttagttatggataaatttcatatgggcatataatacatttacctttttacaatttaatttttgatttgtttgtacactgtgctcaaatgttccaaatacctttgttcatgaatccagttactcattcataatagtgtgatacatacacagctacccaaatcctaccccaaatcctaggagaattcccatgtggttctgttcagttttattttggttgaaggctgaggttttcatctggtgtctaaacaaatgaataatcctccactctcatgtcagagagtgtcagatagctggatactcaaaggtttaataaattagtgggtatccacatttctggacatttgagcacagtatctcctttacttagtcctggtgaggaaagatccttcttccattgtcacttcatggatcctgctccgttcacttgttcctgtctggctgaattgtcattctgtcaccacctcttccttttataactctagtcctaccccgcatatatctataatattctctcttgactagcattagtgttttttgggtcttatttttgtgtgggatggggaagaggagaaaccacctttggaattgttgaaggaaaaggtggaagtaagagaaataaacataaaatacacggattgttaattacagataagatcctacacatacttgttcaacaaatatttatcaaatgcctgttactactcaaaaatatatttaaatgctgagaatggcacacttttaaaaaagacaagttctctgctctctcaaaaatactatgtatgactttgagggaaattgtgagaaaaagagatttttttttcctaagtgtaatgggacattattatagatttttgagctgtggaattatatggcttatagtatgtttttggaggattagtttaggctataaggagcagaagtgatagctggattagattgggaggggtgattaagggaaatacaatcaaaggtaattaccttgcttttggcatttattaacccaagcagtaaatatttgttaagtagctactatgtacccctaggcaccagcagtaaatattttagtgctgacctcattacccagagccttgatgttttcaccatattaataaggaagagcacatccctagtttttattatgattccaaggtattaaagaatattatattaaatatgtgaaatgggataggataatgtttactgttctcatttgaatatttattctcttcaattgttgattagttaattattctttggaagagaaatttcgactgatgattaaaaaaacagttttttaaaaaaggcaaagaacttctgtggaatgactcttttctgtggtggtttttgaaccaaaatacagtagtccaaatgttttagtgaatgtttaatctattttatgtatttttgcatattttcatggttattcaatatataaatttctcaaggtttataaaatgaaaatgcaatttttcaccactttctaaaattttcaaatatttatagtatttttaattcacacactactgcatactatagttctacatgtggcaatggagcctcaactttgctcattgctgcaattcagacatttctgagaatccttaacaaaactcttgaaaaggctccattcattagcaggctttgtgtgagacactgagaggttttctggtaaaagtcaaacatacccacacaaaaactaattctaaaagtagggagaattaggcaagacagtcttaatattgatttctggtaatggcaaaatgcatattattcatttatgttttctcattcagaccattaaaaactcatgtaacagatttcaatggaggtgatttgaggtagggtggtggtagtggaatgaatatattaatcttgacttctaatttgattgcactgtggtttgagagactgttgttatttcagttcttttgcagttgctgaggaatattttactcctgattatgtgatcagttttagagtaagtgtcatgtggcgataagaagaatgtatattctgttgttttggggtggagagttatgtagatatctatcaagtccacttgatctagagctgagttcaggtcctgaatatctttgttaattttctgtctcaatgatctgtctaatattgtcagtggggtattaaaatctcccactatacttgtgtgggagtctatgtctctttataggtctctaagaacttgctttatgaatctgggtgctcctgtgttgggggcatatatatttaggacacttagttcttattgttgaattgaaccttttaccattatgtaatgcccttctttgtctttcttgacatttattggtttgaaatctgttttgtcagaaattaggattgcaaccccggcttttttgtttcctctttgcttgttaaattttcctccattcctttattttgaacctatgtgtgtctttgcgtgtaagatgtgtcccttgaagacagcatactgatgtgtcttggctcttcatccagcttgccattatgtgtcttttaaccagttgtcctatttacatataaagtaagtattattatgtgtgaatttgatcctgtcatcatgatgctagctgtttattttgcagacttgtttatgtggttgcttcatagtgtcactggtttgtctattttgtttattgttttttgtagtgactgataacagtttttcctttccacttttagtgcttcctttaggagctcttgcaaggcaggcctggtggtgaagaatttccttagcatttgcttgactgaaaagtatcttatttctctttcacttatgaagcttagtttggccagatatgaacttctggattggaaattctttcatttaagaatgttgaatattggctcccaatctcttctggctagtagggtttctgctgagaggtcttccgttagtctgatggggttctatttgtaggtgacctggccttttttttttggttgcccttgatatttttttttccatttgaccttggggaacctgatgattatgtgtcttggggttgattttctcgtgtaggatcttactgggattatctgcatttcctgaatttaaatgttgacctgtctttctaggttgaggaagttctcctggatgatatcttgtagtatgttttccaacttggttccactctccctgtctctttcaggcaccccaatctgtcataggtttggtgtctttacataattccatatttctcagaggttttgttcttttctttccattctgtatttttttttctattcttgtctgtgtgtcctattccagaaagatagtcttcaagttctgcgattccttcctctgcttgttgtattctgctactgatacttgtgattgaattgtgaagttctcaggtccatcaggtcagttatcttcttctctaaactgggtattctggcagtcagctcctgtatttttttaatcatgattcttagctcctttgcattgggttacaacatgccactttagctcagtaaagtttgttattactcaccttgtgaagcctacttctgtcaattcagccattttagcctcagcccacttctgtgcccttgccggagaggtattgtagtcatctggagaagaggcattctggctttttgagtttttacatttttacattgattcgttcttatctttgtgagcttatccacttttgatctttgaggttgctgacctttgaataaggttttcatgaggtctttgttatggatgttgtgttgttgttgttttctgtttgtttttcttttaacagtcaggccattgttccatagggctgctgctgtttgctgctgtttccactccagaccatagttgccttagtttttctcatacccggatgtatcactagtgaaggctgcaaagtggcaaagatggcagcctgctccttcctctggaagctctgtcccagtggagtactgatgtgttgccagcctgaacatccctgtaggaggtgtctggaggcccccaatgagagggctcacctagtcaagaggaacaggatcagggaccttcctaaagaagcagtctgggccgggtgcagtggctcatacctgtaatcccagcactttgggaggctgaggtgggcagatcacgaggtcaggagattgagaccatcctggttaacatgatgaaaccccgtctctactaaaaacacaaaaaaattagccaggcgtggtggtgggcgccgtagtcccagctactcgggaggctgaggcaggagaatggtgtgaacctgggaggcagagcttgcagtgagccgagatcgcgccactgcactccagcctgggtgacagagcgagactccatctcaaaaaaaaaaaaaaaaggcagcagtctggctgctttttggtagagcaggtgtgctgcactgggggttgttgggaggggagccatttgttgttacatttggactctccaaagctggcaggctggaatgactgagttgaccaaaccacagagatggtggccacaccctccccctgggaacatggtcccatctcaggcagactccagcctgttgccattggctggctggaattccaagccagtgggtcttaacttgtgaggtgctgtgaaatttgggcctgcagaatgatgctgcttggctctctggattcttccccattcctagggatatgtacagacagatctcccacctttttggggatcctggggctggagtatgtaaaactccaggatctctgtgtgtgcctaagcaactgctctgctgagactccacacagcaatatgtatcgaatccaaggccctggtgccatgggctcacaaggggatctcctgatatatgggttgcaaagatcggtgagagaagtgtggtttcctgggtgaggtcacacaatcacctgctgcttcccttggctgggagtcagggctcttttggctgtgtaccactcctgggtggactatcaccccaccctgcttttcttcattctccgtgggtcagcttgtttgcctaatcagtcccaaggtgagaacctggatatttcagttgaaggcactgaattcacttgcctctttcattcctctccatgagtgccacagactgaagctgcttctaatcagccatcttgcagaaaccactagtttcatttctttagcattaggaattgaatttcagtataatttagtggttagaagcagagatcttggctctttcaattatttaatctgtctttttggaaaaagtacatagcttctgtctgttttagtttgctcatccatatatggggttagtagtactacttatctcttaggcatattatgaatattaaataagttatttgtaaaactcctggagcactatggcacatagtgagcatatatgaagttaatcactcatttaaaaatattttttctatgagaagaaaagtctcttttatttgtatatcctcaattactagtgaggtaaatcatataggatgcccatatgtttactagtgaggtaaaacatataggatgcccatgcagttctttattgaactgcttgtatgaaaccaacccaatagtcccatagatagatagtttttttctaaacaaagaaatcgatcccactggtcttaaagctcaaaacttgcatttgttttatctgagttccttccttaggaaacaaacttcaggtctctcaccaaaaaaagtataaaaaattgaaactctcctgattaccacatccagacagtgagatgctggagtcctcattcatcatgattgcttctttttccctccctagttcctgtttttgttgtttttttcagacattgttaaatttcttccctactatataaactcctagctttagtgagtcagggaagtcaatttgaagttgagcttctatctctttggccatagcacctgattaaagccttcttccttggcaataatcattgtgtccctgattggctttccatgagatgagcagcaggacctaggctgaacccctagtgtcttggtaaaatgtacatgggtgtttggcgaatgttttaatctttttatttttgtttttaatagctctctcagctttctgtgaggtgagcaatggtgcctagactgaacccctggggttttggtaaaatgtacatgggagtttgggaaatattattatctttttatttttgtctttaatagctctctgagtgagagagactcctttagcccttgcatctaacttctgtttttcaaatttccattggcatactaaagaaaaatattatacatacactagtggtgtaaatcaggatacattacatatgaagcaatttcaattatgtttctgaaatagtgcagatgggataagagtgaggaaggcagagatttaccacctatataagaaaagctctaatatatccagcatgaagtgggtgagaactacagaggaggttgagtgacaaggcaggaagtagattttattaaacttcagaggaatgccctgatttctagagtctgcacagagtgttgataccataatggtaatcacaacctatatctggatgatatggtaatagggcctgatataatgtagtcctagcatatggtcactctacaaataggacttttgactggtgctattggtggcctatattttttattacttaaattatttaggtctcctaattgcaataaaatattaaatagtgtaatggaacttttttttttttgagacagagtctcacactgttgcccaggcttgagtgcagtatcatgatcttggctcactgcaacctccacctcctgggttcaagcgattctcctgcctcagcctcctgggtagctgggactacaggcatgccccaccatgtctggataattttttgtatttttagtagagatggggtttcatcgtgttagccaggatagtctcgatctcctgaccttgtgatctgcttgccttggcctcccaaagtgctgggattacaggcgtgagccaccacacccggctgaactattaattacattagctaaccactcacctatttaaacacaataaagctctctgtgtcatatgtcaggaaaatgtaactgagagatttatttgagaaattcaaaggacaagcattcatgataaataatacagaaattatatgaattgacttatccaagactgtcttgcatcattgcacatgatataaatgaggaattgaacattctgaaaattttgactttgttgacattaaaaagctatttaatatttgcttgttgaaaatatcaccaaaataatttgttgacaaagcaaatcagagtttattgcttaccatggaaagggaaacatttactttgatagagttttagtagtgtctcagaagagggagggcaaaggaaggatatttttgaggccttgagggacctggcttaaaaaggatcttttcaatgttggaactcgccttaatcagtttgggctgctataacaaattaccatagatggagcgacttaaacaacaaacttgtatttctcactgttctggagatttaaagtcctaggtcgggctgtcagcagggtgggattcttagtgagggttctcttcccggtttatgaatggctatcttcttgctgtggcctcacatggcagaaagacggctaactagctcttaggcctcttcttcttcttcttcttttttttttttttttttattatactttaagttcaatgtgcacaatgtgcaggtttgttacatatgtatacatgtaccatgttggtttgctgcacccattaactcgtcatttacattaggtatttctcctaatgctatccctcccccctcccccatccctctaccgcatgacaggccctggtttatgatgttccccaccctgtgtccaagtgttcttgttgttcaattcccacctatgagtgagaacatgtggcgtttggttttctgtcatagcgagagtttgctgagaatgatggtttccagcttcatccatgtccctacaaaggacatgaactcatccttttttatggctgcatagtattccatgatgtatatatgccagattttcttaatccagtctatcattgatggacatttgggttggttccaagtctttgctattgtgaatagtgctgcaataaacacacgtgtgcatgtgtctttatagtatcatgatttataatcctttgggtatatacccactaatgggatcactgggtcaaatggtatttctaaaaggacactaatcccattcataggggcttcaacttcatgacttaataacctcccaaaggtctcacttccaaatgtcatcacattaaaattagaccttcaatgtgtacattttgggagaacacaaaccttcagtctattgtaggagttcattagaattgggcaagcttcaggatataatattttaaaagtgatagacccagagaagcaaggattttgaggcaagagttcctaaatgagccttggccagtcaataagactaggtgggctgtccactatttttagatgagtactttcaaaaggttcctgaaagaacaattgaatatttctgcaattttactttcctgggaacagattgctaaaataataaaataatgttaatgtcagtgtaaagctgtgtgaatgttgctagttttatttctcaaagcagtacatttgtagataaaatatctatttcaagcaatgtaacaaggaacaaatgccacgagaataatttaacagacctaggagccaatgcagagaccagactctggttttaatgtctcctctacaaaaataaacattatttgtttgaggggaatcattgcatttgatccattacttccttatcaaagatactcatatgcttgattttctccatttacgaggagtttgctgcagttggaaacagaggactgaaagggactaatagagtcttgatggctttggctcttttgtttgtgtttaagagcatcacaggaaaagaaaattagggagattttagtattaaaaagagctgtaacttttcaaaagctattcaggcatgatttagagttgatccagaatataaataaagtgatatccaatgacagcagtcaaataatatggtctataggtatatatagtgtttgctctcagtagtttattaagaatcatttttaatatcaactttatgcataatttatttacaattatttcatccaattaaagtaaataaattgatacaccaccaatattagacaaaactgtgttactcccaaaaagtttcattatgcccataggcagtctatccccccctttttttctagacccaggaaactaccaatttttttttttggtcagtatgattagtttccaattttaagacattctgtataaattgagtcttacaaaataatttcacagtgtctagtttttttcactcagcatgcagattttaatgtcatccaagttttgtggtaatctgttactttttaataatgaatagttttttattgttatgataatacaattttttttcattcattgtgcatttgggttgatttcaattttggatagtgaataaaggtgttatgaagatttatgtaaatgttttcatagagccgtagggctagaatggctagattgtatagaaggagtaatttttataaatattttaagaaataatcaaattgttttctaatgtggcagtaccattttacatttccattatcagtatatgagagtctcagttaccttcatattttcaccaacacttagtattgtcagtctttttaatatagctattctaataaatgtgtagtagcatcacattaaaaatttaatttgcagttctctcataatccttgatattgagaatcttttcgtggacatattgacatttgtatattttttcgcttattgatttatcttttgtgtatctgtacaaaactttggcccactttttatatagttgtttctttttttattgagttagaaggacttcttattgaacacacatattttgtctcacaaatgtattgcaaatatttttccaattctgtggcttgcattttaattttttaaaaaagatcttttaaatagcgggatacttttattgtaataaagtttaatttttcagggttttctgttatgctttgtgatatttgtgttgtaattaagaaatacttggctaacaatagatgcaaagatttttctcatttttttcttccagttttaagttttaaatttagatttctgttccattttgggttaatttttggatacaatgtgaagtaaatgtcagtgttcattgtttccatattgatattcattagttccaaaaatatttgttgaaaactattttcctttccctattaacatttctcgtcatccttgtcaaaaatcaattgagcctacatttctgggtctacttcatttatgtgtgtatctgtcctttcatgaataccacattgtctcgattggtgtagttttataataagcctggcaatcagatatggtaagtcttccacctttgttctttttcaaaattactttggattttctaggtcagtgtaatacttaaaaattgatttttaggtctgggtatggtggctcacacctgtaatcccagcactttgggaggccgaggcaggtggatgacaaggtcaggagtttgagaccagcttggctaacatggtgaaaccccgtctctactaataacgcaaaaattagctgggcgtggtggcacacacctgtaatcccagctgagggatagcgaatcacttgaacccgggaggtggaggttgcagtgagccaagattgtgccattgcactccagcctgggtgaaagagtgaagctccatctcaaaaaaaaaaaaaatagatttttgatttcccttttactttctgcaaatgattatttaggatttgaatcattttttagttaaatatgttgtagactttgccagtgttgtgaacttgttctgtagtcttctttatggaaagattttaaattataatttatttatcttaatagatattggactatatacttctctgagctaaggtagtttgagtctttcattaagtttgtccatttcactaaatcttcaaaatgttttttggtcaatgttaataatattcacttaatattatttttaatatctgtaggatctgtagtgactattttttctctcattcttgatatcagtagtttgcttcttttttccccttgtcattgtgtctaaaagtttgccaatttttaaatctttcacccatttttttttgctttcatatattttctcttttcaattacatttattttcttctttcctcttgttttgtgtttaatttgctcttcattatcttatttcttaaggtggaggtttacattattgatttggaacttttattgttttttaaaataagcatttagtcttctaaatgtttctctaaatacttatttagcttcatcctattgtttttgatatgttgtgttatcattttcattttttccataatattttctaatctttccttattgattcttcttgacaaatgggttatttagaagtgtttaatttttacttatttgagaattttctagctatctttctggtgtgtatttctagttgaattcccttgagataagagaacatacttcacatgatgtgttttttcagaattttgtttaggcttgtttcatgcctacaatatcaattatcttagtgaatgtaccatgtgcatttgaaaaaacagtgcattctgctgttattgggtggactattttttgttttttttgtttttgtttttttttttttgagatggagtcttgctctgcctccaggctggagtgcagtggcgcgacctcggctcactgcaagcttcgcctccctggttcaagcgattctcctgccgcagcctcctgagtagctgggataacaggcgcgccaccacacccagctaattttttttcatatttttagtagaaacggggtttcactatgttggccaggatggtctcgatctcttgacctcgtgatctgcctgcctcggcctcccaaagtgctgggattacatgcatgagccaccacgcctggcctggatggactgttttataaatgaaaattaattcaaataggctgataatgttgttcaggtgtcaatttagtctctaatttttctgtctatgcattacttagattattgatagaggattaattgtagtttgtttattcctccttgcagttctatcagtttttgcttcgtgcattttaaaactctgctgttagatgaatacacacttaacatagcagcgtcttcttggtgaattgattgtcaggcctctgagcccaagctaagccatcatcacccctgtgacttgcacgtatacatccagatgacctggagcaactgaagaaccacaaagatgacatttcaccattgtgatttgttcctgccccaccccaattaatcaatcgaccttgtgacattccccccggacaatgagtcacatgatctccccaccctgcaccttgtgacccacacccctgcccgcaagagataaccacctttaactgtaattttccactacctacccaaatcctataaaactgccccacccctatctccctttgctgactatttttttggactcagcccacttgcacccaagtgaaataaacagccttgttgctcacacaaagcctgttggtggactctcttcacagggatgtgcatgacactgatcactttatagtcatgtaatgtccttctttatcttgacaatattccttgttttgttgtctgcttcacctgcattaacatctgcccgagcttgctttttattaatgtttgaatggtatagtttttttcttttcattttatttttaaactatttatgtctttatatttaagtgggtttcttatacactgcatacaactgaaccctgtgtgtgtgtgtgtgtgtgttttaattcaatcagataatctctgtactttaatttaggtgtttagaccatatacatttaatgtatcactgtggttgaatttaaatctaccatctctttggttgttttcaaaatgttccatctgtttattctttggttttctttttctcaatttaggtctccttttggattgattttaaaatgattccattttaaatgattctattgcctcattggtttattaaatctttacaaaaactttttagtggctacttagaattgacaatatgcaactttaatttattacactctaccttcaaataatatcacctcacatgttgtgtttgaaaactaagctctgattttttcttatcttgcccaaattcctatctaaggggtctggggagtcatgccctacaaaccataaattctcatcagatgggttttatttaacactatatatcatgacttactttccagtctcaccctggcataacactatgtgacaaagaagaaaatcaaaatattttattcccaaacatgtttctttgcgatattttaaaatggcgctactaagccgtcctttgtgggaacaaatttgcacctgtatataatctctattaacatagctagatctttttcttccaggccctcctaatcctgaagagattaactaagagtctagcaccttttaaaggtctgaacaggaaacatttgtcatctattacctctatgggcagccactataagacttcaaaagaaccttggtctccacaatcttttatcttaacctgaatatttcctttctattgatcccaggtcttcagacaaactcaaccaactgtcaaccaaaaattctttcaatttacctatagcctggactccccaccctcttcccctgcttttgacttctggaccaaaccaatgtatttctttttttttttttttttttttgagacggagtctgactctgtgtcccaggctggagtgcggtggctggatctcggctaagtgcaagctccgcctcccgggttcactccattctcctgcctcagcctcccaagtagctgggactacagtcgcctaccaccacacccggctaattttttgtgtttttagtagagacagggttttaccatgttagccaggatggtcttgatctcatgacctcgtgatccgcctgcctcggcctcccaaagtgctgggattacaggcttgagccaccgcgcctggccaaaccaatgtatttcttaagtgtatttgattggtgtctcatgctgccctaaaatgtataaaaacaacctgcatcctgaccaccttgggcacatgttctcaggacctcctgagggctatgtcatggcccatggtcactcatatttggctcagaataaatctcttcaaatgttttacagaatttgattcttttcattgacatgttaaaggattacaacagtatatttccacttatctataatttataccactgttttcatgtttcattgtatatatgttgtaaaacccaaaatactttaatattatttttgctttaaacagtagtgtcttataaagacatttttaaaaagttttaaaatctgtatctttattattttatcattcccagaactcttcatttctttatttagattcagtttctgtctggtattataatccttctactggaaaaaattgagttaatatttcttgtagcacaggcatgctgacaatggattctctcagcctttatctgaaattatgtttaacctttgtttcttctttgctttgagagatgttcccactaataaagaagtctggatgaacaggtttttttttcttctgcacttgaaatatgtcatcccattgtgttttgatttgcataatttttgatgaaaagttactgtattgtatgtaaaatattcctgtattgtatgaaatgggtcatttttttctgtctgctttcaagattttcacttttaaaaccttttctttagtcttcgtatgatgtatttagttttctttctttttttcttttctttttttttttgagatggagtttcactcttgttgcccaggctggagtgcaatggcacaatctcagctcactgcaacctctgcctcccaggttcaagggattctcctgcctcagtctcctgaatagctgggattcaggcatgtgccaccatgcccagctaattttgtatttttagttgagacggggtttttccatgttggtcaggctggtctcgaactcccaacctcaggtgatccacctgcctcagtctcccaaagtgctggattacaggcgtgagccactacgcccagccgtatttagttttctttttaaacaatacttatgttgtgtttttttctaagccttttaaatgtgtactttgattcctttagttatttttgaagaattcccagtcattatcttttcaagtatttcttctgccccattctctttctcttccccttttgagatttcaattacatgtgtatttgatggtttgcaattcatccacagatcctgcatgctgttgatcccatcaaaggcattcttcttatctgttaccatgctttttatttctataatcactgcattaatcatatggatcatatgtgggcctgattcttcctattgccttgtcttctagtagtgtgctgtttttccttgctttgttgtgtttctcaaattttgtacttgataagctgatggtatgtataagatacatacacatgtatatgtatatgtatacatataaataaaatttattgagtcttttttttatttgtgtctagaagtggggctaatttctctctttgttcagtttttatcatgagggattgagctaatatagtcagaagttgagctagttttatttatttatttttattcttatggttatcctcagtgcactgctgatttcaaattcctctagtgttgtcttttacttagagtggcagctgagtagcaagttttcctcaatattcctcttacaacctcagctttagggttcccctgtgagtctgtgcctgtgagaggttcttttcttttcccatgttcttgtacttttctcagcaggagacttctgttacttgcttcctgttgcttgctagccttgtgttggtgggtgtagggccattctctgctacctgggttcagcctcagtcttaggcaggtccctgggcttcagagatggtactttctcagtgattctggccctaatccagctaggattagggtttatttgtctccttaccttagtttgcagttgtaatgggtccccacctacatgcttttacccttgggcttaagcttttgtttcataatagggatagggcaaagggatcatgctttccctcagtgtctgttccttccctttttcaggtcttttagtgagggagcttttgtaatttcagcaatgggtctctcatctaagttcctggtgagatccctggagaagagtttgtgaatgggtttgaattcttgaatctgaggctctgaagggttttataatctcattctagctcacactcatccccttttagaaattcaataatactttttagctgggtttttcttactgggttataaagcacccagtgcctcttcctcgcatgctctgtctgcctcagcttatgctcctctgtccttggagacacctgacttttcttaggtatcagacaagatttttgctgagtaaccccagccctctgatttatgcaagaaaagttatgcttttgaagattagctttttctgattgttagaaggtgggagaggcattctttccagctttttacttgctaagccaaatgcaaatacaattttgagaagtagaaaaagaaagtatattggcaaaagtctacaggctcagaaaagacattatgttgtaataagtatatgaagatattgctgaaacaatgataactgtgttaagattttcagatgttttccctagagcaatgtgaatattataaacctgcttttaaaggccaaaatactatttattttcaaaatgatgattttgtgaaaaatgaaaaaaaatttaaattatgtgattatttactgaaaatacaaatgataaaattgattttaatctataaaacaaaacaaaatattataatgctatatttcttatagtaggtatttagtttttgagtaatccttaagggatggctaggtagatcctttacgagttcattaattattgccttcatttgaaagcttcagttgcatgtaacagaaaatccaacttaaactaccttaaatagaaaagtgaatgtgctttctcataaagacaagaaactaaagacagtaagattttatgcaaagattgaaccagaggtttataatgtttaacaggactccagtgatattcctctgaaccagtcattgtccccaagaggatgcagtgtacttcttggattgatttaaattacaggactctttcctggaagtggcagttaattcaacttcctgagaatgaaacatattgtaaatgaatatcaggaatatgtatgaggcaaaaaaaaaaaaaaaatgttagtgaggcactccccagtatctattctacacacacacacatatatatatacgtatatatatatatacatatatatatacgtatatatatatatatattttttattgcccaatacatataaaacaccaaactagacatattgggtgtttggaggggatgaagagaaatcactgtttacttttaaaaactagagcaaaatatgagaaagcattttgttgaagaacgttgtaagaaaaatgattcagagattcctctattgaagtacattcttttttttttttttttttgagttggagtctcactctgtcgcccaggctggagtgcagtggcgcgatctcggctcactgcaaactccgcctcccgggttcacgccattctcctgcctcagcctcccgagtagctgggactacaggcgccagccaccacgcccggctattttttttttgtatttttagtagagacggggtttcaccgtgttatccaggatggtctcgatcccctgacctcgtgatccgcccgcctcggcctcccaaagtgctgggattacaggcgtgagccactgtgcccagccatgaagtacattcttgagaatctcaggattttagagcttggaattacctgagagatcactgagtttacctttctcattttacagatgaggtaatggagaccacagatgctaaatgacttgcaaaggtcatgcggtcagcaggtggtgaatcctaggcaagaacatatttttggctttgagactgcagctctttccattactccatatttattttgaaacagagaaaaaaattctgattagcttatatgcacataaagtcatttgtcaccatagaatagccttactgcagtaatacattgatggcaaaagttccatcctccttttcaaaggcctagtttgtatgtgtgtctgcttatgaatgtaactttagattaaagtgcttattagtttttttcccctttgtttcaaagacatttttcaaatgttttacctttgacactgccacctgcccacacttatgaatattaaataatgttagaggttaatgcactactaatgataggttgttgtaactcaattggaccctcttggcaagaaatgctcaataaaatgctctttctacagcaaaactaagtggtcctggttatatcctgtgtgattgaggaaaataggattttattttggtatatctgtgtgacatatatgtctttcaggataatataaaaagagtatgtatgacttttataaatcatttatgagtttaccacttttcatagatattactcttttagtagtgcttgtttttaaaatatcatgccaagtaatttaacttttaatattgttaaattgaaaaattttaaaatcacaatgaaattgttttacatgttaattatagtaatagtagctatattatgataaagattattaggaagaatctaaattttgacattggttttactagttttctattactaaaaggtttcattaattctacttctctttataataaaggtaaaagtgtattttaaaaagaatggcctgtaaactaagtctttttgaaaatatatcaaaatacagaatgtgatataacagcagaaattgagcactgttattgctcttggaattttggtgtgtaaaagtaaaactgaaagagaatctctatctttaaaaaactgacaatctgttagaagaaatatggcatgaacatataaataactatacacagacaaatgtgatatgaactgtatgagtaatacccagtaacttcagaatacaaaggagaagagatgactttgactaagaagatttacgggaagcttcataaagaataaactagttgggctaggctttacaaatgcttagttgataaaaaagagaaacaaaagatgtaaaggcaagaaagatcacagcatttcagggaaaggcagaaaatatcatttggtgggagagatggatctatgaagtgaagtcaatggaattagagattgaaaaaagggtaatttgactaggaatagtggaccacagacatgattctgtagctaatgctggttattaaaagtatgagcttgagagctcatagtcatataatctaaatatactttaagaataatttttttgtaactagatataggatggacttgaatatgtgtgttagtttagaaaggcatagaaaaaaatctaatgatgttatcacgtattccaagcaagagataataaattcagttctggcaccagaaaatggaaaagaggttaaatataattagcattatagaaattgacttggcaagacattgtgactaactaatggtttgtctggatttgttggggattaagagacatatttgagaaaaggtgtccgttactttaaggaaggttggaagacggaagactaaacaagatattgagttagtgatttgaagatgcttctttcaataaagaaattttctcaattgtatagagtcataggggtgagactatattataaagaattgaggggtaactgaaaggtgagaaaatggctttggaattatactttacttttttttctcaaagaatttaactttttatttccttctgtttaagtttttatactattggattattagtgttgaaatgctacttgttcatacaaaatgtctttcattagtaacatgtaggtatttgataatacagctaataaattcctgaaaaattagatattcagatacccagccttagcttacatatatgaatagggaattcaggttggacaatatttctatttctcctattttattgtatttccatgaatacaaatgtaaaaagagtacacctttataccatttctatttttaattacttagttcttctggcacaccctttcaaagaatgtaatgtttctatttcacttaattgctgtttaattaatatgcagttcataagtgaggaggataaatgtaataattcacaaaagataagtaagccaaacactgtttgttcattccttctgggctatgatttgagaatatgcaggacaatacacgttttataaagattcaaatgagattatttcctttggtgattctctaatatattgtctcttaagaatgctaacttattttgaatgactgtcttgtgtggcaaaaataaccttctaagttaagagtatataatgatagatgacttaatagtacagtgttcaccaatatcctatgatgatgaggaagtgattggaaagacagtaatccatctggatatagtcattttcaatatcctactgaattaacgactatgcatttttagtggaacacatttatatttggatgtagtggatgtaagtgtctacaacagcattcttaactttctgatcttcaaaattaattttagtagaagacttggtttttccaaaagctatcttcatttgtctgtaaaatctacactgaatgaactcgtgtaataaatttactgattgaatttgattaatttatttaatttttctctttagaaattttcttctaaatcaggtaatttaaacaattagattgagtttgttacatatttttaaaaatagttaaatggaaacattgtaatattatcacaattaatttgttatttaaatgatagcttatgacacattaaactttttctagtgctgggattctttttagaaagttaggctgtgcacggtggctcacacctgtaatcccagcactttgggaggccaagacaggtggatcacctgaggtcaagagttcgagacaagcctggccaacatgtgaaaccctgtctctatgaaaaatataaaaattagccgggcatggtgctgggcacctgtaatcccagctactcgggaggctgaggcaggagaatcacttgaactcaggaggtagaggttgcagtgaggtgaggtagtgctactacactccagcctgggtgacagagtgagactctgtctcaaaaaaaaaaaaaaaaaaaaagttaatctagcctcatagagtcttttggaacctatctggcttgtagttacttggcagatatattttctttaagccaatatgcccagtcctgtatttagacatacagtttatggcctaattcttacataggttacaacaaattcctttccttaggacaattctataaagtcttctaccagtttcatctcccttttaagatgacataactgcacacatgtagcattgctatggaggaatatactcagtatggtgagaatcagtcatctggttacttccatctctaacatcaactccagaatatatgctaaactcttcttgtgaatccttgtcatctaatagccctgtgctcattttgtctcagggaactaggctttttaagtcatcttgactcttgagtctttttctataatccatgttcaatagctcagcaaacaaattctcagaattccatggatcttaaatgtcaaccaagataaaaaataaagggagttccattttcttcagggactgggtgactaaatgtaaatgatcaggaaatacagtcttgagagttgttttactgtttactagcagaatagttatgactccagatcctgtatccttcatgtgtaaaggaggtagagcaattttacataaatttttttttgcattaaaggtggcattttatgtaaaagcacacacacacacgttcagcaattatgaaatatataggacatgtgtgtctataagtatacctataaatatgcgtaggaaaaagtcctccaaaaatgataatacttgtagaggatttatagttcatgaagtgcttttctaaatactatattgttattatgcgttatattaatttaatttttacatataacaaatgcagatggttatatttatttcatattaatctgaagaaaaaactatgacaaagaaaatttaaatatggaggagcaaagacatagcaagagaaatagtcaggatagaaatttagatctacttatttcacctctaactctagtctgccttctatctgggaagaacaacttggctttatctatttccagtaatagggaagttcttgcttgtcccatgtctttagttcagttttagtatttatttctgtgatcaatttatggctgcagattccatttacaataggactttgatgaacccagggattccataatactggctcagtgtgtgtgtgtgtgtgtgtgtgtatgtatgtgtgtgtgtgtatatatatgtgtgtgtgtgtatatgtgtgtgtatgtatgtatgtatgtgtgtgtgtatatatatacacatatgtgtgtgtgtgtatatatatacacatatgtgtgtgtgtatatatatgtgtgtgtgtgtatgtgtgtgtatgtatgtatgtgtgtgtatatatatatatacacatatgtgtgtgtgtgtatatatatatgtatttcccctctcctatctattttgctgttcatttttatcttctctgttggctcctcttcctgtatctgactgctaaatattggtacttttcagagctaattattttactttttaaaaaaaattctcttcagtttttgctaggtcaccaatgatttagataagaatctatatgtcatcacctcacagatttgtaacgccagctggtacctctcttctgagctccagatccatttatcaattctgaaatttgatgtctcacaacctcccacattcaaaatctccaaaacttagctcatgaactctccaaaacccctttgaattcgaaattgctcctcccacagttgcaaaagccagaaacctgggcgttaccactatttcttctcctttcatatctactccttccaattcatcactaagtctttggctttttcctcctgattgtatcagggactaaggatttttaatgtatgaataaacacaatcttttcttctccctctgacttctagaatagatgtatgcttatttcttttgtgaactcttggcaacttatttactgtatagaacttaggaaaatggctaattcttgcaggaaatgcaataaaggatccctgagtctttccattcgtgggaaacttgggttgttgagagctaatttttcggccacctttgtgcggcaacggacagatgagaatggaaatgctgatgaacattacctgctaggaggagatgaataagtagcatggcgttgtgtggtggttagggagtgggccctgtgactgtgagagagctgtgtgttgagaggaaaatctggctgccaatgttgaaacttgagttgtaaggcagtttactggcagaattcgttcctacccagagtacctcaatctttcttttcacttgaggccttcaactgattggatgaggcctactgacattatgagtatgacctacttttctcaaagtctactgatataaaagttaataatatctaagaaataccttcacagtaacgccgagattgctgtttgaccaaatgacgggttactattgcctagtcaagttgacatatacaatcaaccatgacagagaggatctattctattttcacctgattcagttccagtaattatttttttgtatcttatatcctagagatctctcagggtttcttccctcagccccagatcttctcccatacttatatataagaaacgtcttccatttcctatgtctcagtttgaatgtagctttatcagaggagtctctacttttctaaggattaggtcaattcctctgttagatgcttccatagaaccctctgctaatcatttgtttaaaatctctgttcctttctaggaacagagaacacaataggcatgcagtaactattaaagtaatggctggatctaccttagaacacacttaacctgcactgttggttccatagctttctgctttgctgagagtgacatctatggcaattttctctatcctcctcaccccttaattacaagttgagaagctatgtttgtgggtggggcaggtccactgaatgactatgttggatattgagataagcaaacagactaaaggcttaggttgcgcacaacgctcactttatcactttttagctttttcttctctctttcccgtagcagctggtacaattagagggaacagaggctattggcatagcttgggccccaggtaggaggggcccaagcttggcataaatattagaataagctcttctgtgaagctcttctcaggctttagagcacatggtttttaaaatttttttatttttgtattattatttttttaactcttactttccttgattttttttctttaatgcttttttttttttccctgtccaggttcatgttagcatatgaactaaaaaatatcaaaaaggaagaaggactgctgtattgtcatgttggcagatttattcatttcatattgacaatgctaatttattatactttcaaacccatcttgccctcagggatgttagatgatctggttccactgctattaaatgcttgctcctgtaaactttgtggacatagaggctgagggaacccaataatttaatccagaagtcaaattatcaggcgcctttgcccagtggtgtttctgttaaattcacaaaaataatttatgggccaggtgcagtggctcacgcctgtaatcctagcactttgggaggccgaggcaggtggatcacctgaggtcaggagttcaagaccagcctggccaacatggtgaaaccctgtctctactaaaaatacaaaaaattagctgggcatggtgaaagtcacctgtaatcccagctattttggaggctgaggcaggagaatcgcttgaacctgggaggcagaggttgcaatgagccgagatcacgccgtggcacaccagcctgagcaacaagagcgaagctccttctcaaaaaaaacaaagtaataatttatgcattgtgaggagatgcctataacctactaaacatcatattcacaatagcatggcctcttcacctaaagtgtgaaaccttcagattaaagcaaggttaattacgttttctacagtgtcatatttctacaaagtacaaaatgcaaagcaaaataacccagaagctaggaatgagaatttttattctttttttaggactaagacgttggttagttttgatttgaattcctggaaaacctagtgctttcttaagataatacacttgacagcctttattaaacatactaaatagattagaagataagtttgtgcataagtctgtgcttgttttggatagtttcctatttgagtgttgtcttttttctaatattccttcactctgactagattagatgtctctcttctctcctattataacaatcaataaatagctgttattttttactcatgattttgcatcatatttactagagtatgtgtctacgtcctcttttaactgcctgttggcaattgcctgttgcatcttattcactgagcaactaggcctatggcaaacaatcaattattagcatctgaatgaccatatatatatatctgttctcgtctttttttttgagacggagtctcgctctgtcgcccaggctggagagccgtggcacgatctcggctcactgaaagctctgcctcctgggtttgtgccattctcctgccttagcctcccgagtagctgggactacaggtgcccgccaccacacctggctatttttttgtatttttagtagagacgggggtctcactgtgttagccaggatggtctcgatctcctgacctcgtgatctgcccgccttggcctcccaaaatgttgggattacaggcatgagccacaacgcccggccctgttattgtctttaaaataccctgtgcttcctttcttaactgaatgtaacctcagaggaagttaggtaacagatgttaggtaattgggcattctctgcccctggaatcatccttacactctgaggcattcaggcctttccatgtacagggactattttgtaggaaatgaaacacagtggctgtattagcttgggctgccacaacaaataccatagactgggcaacttaaacaatagaaatttatgttttcacaattctggagactgggaagtttaagttcaatgtgccatctgactagatgaagtccctatttgtggcttatagccggccttctccctatgtcatcacatagtggagacagaaagaagaatagctctctggtgtctttttttttttttttttttttaataagaacactaattttatcagattagcaccacccccaaccttatgacctaatttaaccttaattaccaccctactccaaatacagtcacgttggttgttaaaagtttcaacctgaattttagggtaaacaattagatccatagtggggaattgaagaatttttaatataatttcaatttttaatgctggaaagcatgattacatatgaagcaaactcagcaaaatggccaatgcacaccaggccactttccttccacacatgcctgccttttagctgagaagaggataaggaaagcaaaatgcgtgttccatccagttctagaagttagatgttgactttcagaatacaaaccagaaaacaggttcagggtgggagaaaagctcacagaacagagatgagaggctttgctgcttctgactctgctcatttttcttccctttttttttttttaccttttcctctccacacctttagcctgcaaagctctacatggtaatattagcagattaaaaggaaatttgagagaagacaagtttaaatgccagaaagcagtgaagcactggataaagtgttaatcaaagcaagcaagaagcagcagctcaggatatacttggaagcagacacagcttccttaactacatagctttctcttcgtttgacatttttatttccagagtactacttgagcctcaaaagcttgctttttagtgaggaaaaaaattaaaaggtttattcaaccttttagggtgaaggaaaatgttgagttctctgagcatttccttgtgcaatgagtcttgtatatctaaaccactttggtttcctgttttaatcttggctttgatatcacatggtcctttttaaaatatatatttatattgtttaaaactaatttttgaattttcatttggtttcaaaaatgaatctaaggactggaaaattttctacaatttacaaaagaagaaactgaggttcgtagtttatgtagtgtgcatgagatcacgtgtctccaagtggttaaggccatgattcatatccaagagtgactgactccaaagactgtgttgtcttttcatataaaatacttcgatgtgtaccaagaaaaacatttatgtttcttcacttgacaagcacaagtcctgtctttataaaccattagaaataattatagccttcacagtggggcagaaagcagttttctactttgatgtatgtcttgtagggaagaataacattttaactatgattttgactttgttcttcattagtttacctcatgttgagcattttgtcatgctgattccctctgaagatttttaatgcaatgcgtggtgccacaaatttgattagagtaactggcatttgattgtgccttggctcaaactttcctccttagtgccccaggtgctagtttttcagattcctgcagtaatcaggaactaaggagatttgcactcttgacaccctaacaggtaaattaacttcgtgatctgtcagattccactggagtcatcataattctgactgttgtgacatacaatccttgtaatgttttctaagtggtttgaagatggatggcacataaatatgtatgtctaaagatgagtataacattgttatgcttccctttgcatatttgctataggaaaaaaacactcattttgtcaaaaattctcaagaatgatcaacaacttttactgcaaaatagtgtaatatgctatataattgttacttaagaatttctaaaacaaagttacataactcatgaatattttacgtggaaggcatatgatgctggaaagacttgggggcaaatattggcttttcaacatactggctgtctaggcacaagtaagtctgagtttactcacttttagaaagtttaagataaagttttaggctttatttttaacaaatattactagactactaactacacaaggcactgtgccaaatattttaaataaaatagtgaacaaaatagagaggtagccccactctgatatggcttacagttgtaaattttagttgaataaacaaataaatgttacacaatgtgacaagttctatgatgtgtagtatgaggtgtcctgggagcaagtgaaattaatcccagctggggttaagacttaaaacatgagcataaattagctaagtagtgagagagagtgtattaccaaagacatgaagctctttagaggtaggcagaagcaagattatgtggaaatcagaatacatattaggagtttggactatatccaaagatcaaacagaagccacatagagtttgatttattcatttgttaattcaacaactgttcatcaacaaatgtattagacactacttttggttctaggaacatagtaataaaaaaaaaaaaaaaactcctgggccaggcgcagtggctcatgcgtgtaatctcagcactttgggaggccgaggcgggtggatcatgaggtcaggagtttgagaccagcctggcaacatggtgaaatcctgtctctactaaaaatacaaaaaaattagccaggcgtggtggcacacgcctgtaatcccagctactcgggaggctaaggcaggagaatagtttgaatctgggaggcaggggttgcagtgagctaagatcatgccattgcactccagcctgggacagagcaagactgtgtctcaaaaaaaaaaaaaaaaaaaaaaaaaacaaaactccaaattttgacccttatgcttatatgccactgtgaaaagacaacctcaatataaaaaatacatgattatatttgaaggaagaatatcagcgctattgtagaaaatgttgttgttgttttaaaaatggagaaaggctaggggtttgtcagtttagaaaaaaataatctagaatggctgcagcacagtgagcaggtaggagagtgatagcaaaagagcctgagatgtcaccagaggcctctgtgggacagatcactgtaaagacttaaacttttactgtaagtgaaatggaaagcctttgaacattttttggcgggtaaataatattatctgatttatacttcaaaggaatcacttggctattgatttaggaacaatagtagggtggcaatggtagatgtcgaaaatcaattagagggccgtcgtcaatgctaagatgagtgatgatgaccaggatgaatttgactggcttcaaaggcaagtagtggaaatattcttggatatatttttaggttagatcatttaattatttcctaacatgttgaatgtgagtgacaaaatagaacattcaaggaagacactcccaatttttgtttatctgaacaattggaagtttgaaattcccaataataagataagaaagaaaacagtttaaacatgtttgtatgatataaggttaagagttcagattttgacataatcatctttgagatgtctaacagactcttaagtggagaatttaaataggcagttgggtaaagtatttggaattcagagaaagtagctataaatttggaaatttttaaagcaactagattagatggcattgccaaggatcattctgtgtccgtatgcttgtgggtagagaatagaagtggcaaaccctatttgtggcaaactcttaatgttaagaagtctggaggaagaggaagagtcagaaaaacagcctaaaaagaagtgtccagttaggtaagagaataccaggagaggatattttcttggaaggcaagtgtgaacagtgatcttaagaggaatgaatgtcaaattcttctgaaagtctgggtaacttgaagactgaaaattaaccatagcatcgagcaatttggggccgttggtgatgctaacaaaagaagtttcagtggtgttagggagatggcttctggttctagagccttgttgtcatgctagctaatctgtggataacaagaataatatctagataaaatattttaaatattttaaaagaaaatatttgacgaaactgaataatgaccagaaacaggcaaaaactaaagagcaattaacccttgaaaaatgaaactatttcaaatgaggtgtgtgtgtttgcttgtgtgtgtattgtctcatagtacttctcaatctgaatggggataacagaaagccaaggttttgtttgtttgtttgtttttggagacagagtcacactccattgccggggctggagtgcagtggtgcagtcttggctaactgcagcctccacctcccaagttcaagcaattctgtctcagccttctgagtagctggggttacaggcacctactaccatgcctggctaatttctgtattttcaatagagatggggtttcaccatctcttgatgctggtcttgaattcttgtcttcaagtgatcctcctgccttggcctcccaacgtgctgggattacaggtgtgagccaccatgcctggccagaaagccaaattttaaagccttattttgttagaggactaagttcagagctgacagagtggctggaaaatttaaatgggaagtttacagagggaacggtctctaaaatctgtataaaaactaccaaaatccttgtcttcctattgaaccacccatgtagggaagattccaattttagtaaaaccagcatccagaaagagaaataaatgaaacaaaacaaaacgaaaaacttcagttcctggccactgggggagaaagattttagtttgaatctaactgcctgctaggcaaaatctcaacacctttcagataaaagttactaaatccagagaatctacaatatttctaacacaatttcaaggataaaataaaatttattaggtgtaaagtagctgggaaaagttacttaataaaaatatcagtcagcagaaactctaagatgatcaagatgttgtaagtagtagacaaggcctttttatcaggtattgttaacatcttcaaaaaccaaaggaaaaacataattatagtgaatgaacaggtgggaaatcttacttgagaaagtgtgggaaagaaccaaatggaaattctagaattaaaaacaaatatagagaaaaagcaggcatttcacaaatataaaagagccaatatctgaggaggatacaactataaatatatatatatatgtctaataattatatacctaataacacaacttgaaaatacatgaagaaaaactgacagaactaaaagggagaaatagacaaaaccgtaattggagactttacacatttctcagtaaattatggaacaacttgacaaaatgtcaataataatgttgaagacatgaatggttttatctaccacatttatcatattaacatttatagaacatgacaactgcagaattgacagtcttttaaagcatatatggaattttatagagatagaatgtatgctagaatattaagaaatctcaataaaaattcatgttccttgtccataatgaaattaaataagaaatcaaggtaatcatagaagaagtataaggcagtgctttgaggggacaatttgctgttatgatgcagctggaggtgaagtgggatcagtagatttaattttttttttttttttttgagacagagtcttgctctgtcacccaggctggagtgcagtggtgcgatcttggctcactgcaacctccacctcccgggttcaagtgattctcctgcctcagcctcttgagtagctgggattataggcgcccgccaccatgtctggctaatttttatatttttagtagagatggggtttcactatgttaaccaggatggtctcgatctcctgacttcgtgatctgcccgcctcggcctcccaaagtgctgggattacaggtgtgaaccacttcgtccggcccagaattttttatgttgatggacataactgattggtgagagtaaacttggtgtaagaaagaggagacttggaggtctctgagtgggcatgggtacaggagcagacatagtttacttacagtaacatgagaaggaaggcagtttacatgtgtaaagatactggaagatagatagcatggcgagaattcgtatgaattcacattttatgtctgccagataagtgatccaaccagatttgtggttttagaaggccattgtaattatagtttggagcaattattttgtgggcaagattgcaggtagccatactattaggagatggctataagccaagtaagacatgatgatggcaagaaatagttaatagtgtgtaaacaactctgacatttgaaagacatttggaatgtggaggcagcaggacttttttttgttgtttgtttgtttttgagacagagtctcactctgttgcccaggctggagtgcagtggcgcgatttcggctcactgcaagctctgcctcccgggttcacgccgttctcttgcctcggtgtcctgagcagctgggactacaggcacctgccaaaacgcccggctaatttttttgtatttttagtagagacggggtttcactgtattagccaggatggtctcaatctcctgacttcgtgatccgcccgcctcagcttcccaaagtgctggggttacaggtgtgagccacagcgctcggccacaggacttgttaaatgataaaagagacaatatagggagagagggattcagaggaactgaagaaaattcccaggagtttgattcaggcaatttgttttaaggtggtagcgtttactaagatagaatgcttaagaaagagcaaagttgaaaagaagatgatgagtttagtcttagaaatgattggtaaatagatttaaagtttcaccaaaggatctgtgctgaaggtagcatttgccaaatatcagcatacagatggtaactgccaccagctatgtggttgttgagatctccaagaagaggtatggtgagtaggatgggaaagaaatggaaaaaagaagggaatggaaggtctacaaaaagccttgatttattaaataattattctgggccatgcactctttaataagttgtttttacatcttaatatatttcatcctcacaaaaatgctatgagacatgtatgcttattccattttacaagtcactaaatagagaaagatgattgtattagtcttttctcatggtgctaataaagacatacctaggacttggtaatttataaggaaagaggtttaattgactcacagttctgcagggctagagaggcctcagaaaacttacagtcacggcagaaggggaagcaaatatgtccttcttcacatggcagcagcaaggaaaagtgcagcgtgaagttggggaaaagccccttacaaaaccagcagatcttgtgagaactcactcactatcatgagaatagcatggaggtaaccatcccatgattcagttacttcccactgggtcccacccacgacacatggggattatgggaattacagttcaaaatgagttttgggtggggacacagccaaaccatagcaatgatctttaaaaatgtagacaaaatggatctgaaagtaaaaggaacattacaagagtatgatgaccctgaagtcacagacagtttgaagaaggagaccaggtcctctgctgagagtaagaggaaattgctgtgatacaagagtcaagggaaatgagaatttaaatgtgcagtttaattgctgtgggtgctagaagatgagacagattgatgagacatactataggccctgtttattatagagaccatgatggtcatggtcagccatgattgatgttttgctaagcatgtaaccaaatgaaaaagacacagtgggaatatggactttggcaaagaatcggatgaggtaataaactatgttgaaaggtaaaaacagaaaaagctaataagaatataaaaatgttgtcatggactggaggtcctagcaagtttaaaaggcaagtttaatggcagttgctgaacaaaagagtcaagatatttggaagttgctatctgaagcagggtctttgcatttaatattttaaaactggagcacttctgaatgatggcaaattccaagaatggctgtgagaataaatagaagtaaaagcaacaggaaatgaggatgtcaaagacatgcatagatagtctactgaattacttgcttccagggatcagaaatgccagattctggcaggacttggtatggagacaaaactgggaggaggagacaaatattcagtgattgaggtggaggcagaataagttggttgatgagaccaatgaggtggaataaagatctgtgccccatttccaaagaaaagaggcttttatgggagagtaaaggactgatggtctaaaagagctagtgtggagagtactaagcccacctcctcaccttggtatctggtccatagtaagaactgaagaaaacagaactattgtttcagtcttgccttttctttgtatatatttatatgacttttcatttatctttttataaatataaacactattatgtgccatagagtgaagcagaattttctcccaagggaactaatatgtgcttgatttacaaaatagaaatcattatgaattgtatgccttactaaataattctgtaattatatgttatgaaacaacttaaaggtgtgatgcaaaggaaagaattgtcatccaataaatggagtttaataatttttatttcacggtatgaaattttatatagttttttatgttagaggtacagcaggtgaaagtaggttttatttgattttaaggatctaaacggttttaattatacaacagaatgtctcagaaaacatgaccattttcaaatacttttgatgaggagatgggttttttttaatttaaaggcaaatacacagggttttggctatatcaaaattgtgaaataccagttagcttaggataactttatcatctttgaaaatgatgaaagtaattaatacacttctttttaaaaccacatgtaatttttgagaatagatgactatttcaaatagtcatgtgaaacttctcttaaaattaaaatagatattagtgaaagagtcataaatgcaggctttcactttattggacacaaaatatagaagacatggaaatgtgttgggataatggtatgatcttagggtaggtaggaatgctataaatatgaaattatcccatatctttgtccaagctttgtggcactttcttccatatcctggatgtcatactttttcaccagggtcttcacagctttttcagcccttgataaacccttctgtttgaaagcaggtggttgcccctctgtcacctggaaaagacgtgggctttctcagtctgaagatggtattcactgggaaaaaagcatggcctcccacctgacaaagagtatagctgctgtgccttcattctacagattatatatttaggctaagccttttttttttggattggatcttggacattatagattaagtttcttggacttattttagttgtcagttctaactctaatgatgctcaggcccagtttgcttcccttttttcctgatcctgagaggaggtctcggtatcttcacagctgagcagtcattgtcagtgcacattttgtgatttttgtcatttggggattttctttgccacatagttacagaatttgatttagcaattgggaccacaggcaaaccatatctttgataacgctgacccttgacaagtcatcatcctacaaaataaattacagggaaaacagttcttattccagtgttcccttatcaaactctacatcagagttagctgtgagtgatttctacttttagtattggagatgaatattagatattttctttttctttctttcctttcttttcttcttttttcttcctttccattcctttccattcctttcctttccttttctttttcttttcttttcttttctttcttttctttctttggcagagtcttactctgttgcccaggcaggagcacattggcatcatctcatctcactgaaacctctccctcctgggttcaagcaattctcatgtctcagccaccggaatagctggttacaggcacctgccaccatgcccagctaatttttgtatttttgtagagctggggtttcaccaagcaggacaggctggtctagaactcctgacttcaagtgatccacctgcctcagcctcctcaagtgtgggaattacaggcatgagccactgcactcagacaatattcgatgtttctatagataattcagttactttataatcaaataatgattattaatttttctgatattctagagccatcttgaacttttcactattttaattaaacttctgtatccatgtgcttctctacccttttttggttccctccttcctatctttgagcttccatgataagaatacaaaccacacttaactatgttttccccaacctcactggatgttctcctggttttcattgttggcttttatcctaaacacatacttttaatgtagatgttctccactactccatcctgggctgcttctgtttatttatttatttattttttattttgagaccaggtttctctctgtcacccaggctggagtgcagtggtgtgatctcggcttactgcaacctccacctcccaagttcaagcagttctctgcctcaacctcccgagtagctgggattacaggcacccaccaccgtgcccggctaattttttgtatttttagtagagatggggcttcaccatcttggccaggttgatcttgaactcctgaccttgtgatccacctgcctcggcctcccaaagtgccgggattacagacgtgagccaccgcacccggcctgtttttatgtttttatatacttttcactgatgtcttaaaagtagcatgtccagaactaaactcttggttttattcccaaaatctagattgtgcttgtgcttagagagtaaatctcttaacacctgcctacaagaaggcatataatgtctctgctgccacctctcctgtttccttccaactttccacttgctccgtaggttctagtaacgttaacctttgttcatttcttgaacattaggaagcacattaatacttcaggacactgtccatcctgaactctttgctcaccatgctctttctttaggtctcatcttaaataagacgtcctcagagagcctattccagctactcatctacatttatcaactcacacacccattagtctctatttcaacatcctttgtttcttaacagtactaatgactctagtttgcaattattttgttttatctatgagaatatgtttcagaaaggtagaatcacattgctctagtatatccttgtatccctattacctaatttagtgcctggtgaatatacaataaatatttgagtgactgcatcttaagaatttcttttgttaaaatcactcccttttagttgtctatgtatgctgtggcattagcttcagtgaagtatctgaccaatggcactagtctagacttagaactgatctcctgggaaggcccaaaactctgcctggcaacagcatatttcaacctatacccagcagcatacccatagggcctgatcagtttgaattcccttaaagtctacctgttatcaattcattttaaactgcatgtgtatctatctcttcaaatagtatgcttacctatccctctatttgtttgtttcatttagaaatgaaatacaatcataatctttatagtattatatagtactcataaataattagtttcctaattggcagagggattctccttctctccattaatgacatgatagttttgaaaatagatagttcctgacagctgtatatcaagagtttatttgtgggtagagtgacattacactcatatttcccataaaagttatataatatatgtggttattaggcttctcatctagtcctcaagctagttcttaaagcctattgaatattcttaaagtgaaatcgtaatactacaatttcaaacaatatattatttataatgttataatgtttggtattctataaaaaatagggatctgaagtcaaatttggatgtacaatatattacattcattccagcagtcagtagttctcaggcaggtatataacagaatcattcatggagcttttaaagtatacaagttactaggtccaatgtgggagattataaattagtgaatctgcattgtgacatgatatttatgcattgtttaaaagcttcacaggtgactctaatacacatctcttaagaaccaacattcagggaatttgctcttgaaattttccaaatccatgaattaaaagaaggtgtgttggaggaaggggttttaaggcttttcactatgtgaatgtcaaggaagtcctaatttgggaaatgcgataattttattttcctatcttactttacatatctggaattttcaggttacttaccttttctttacctggaatctagacctatagtcatgataataatggctttcttgtttgtaggggaatgctttataactcacctcggtttataatgaaatattcttcttgtatttcagttcctttaatctcttggtctatattatggccaaacaactctcatggcctctactagaacaaaatgtagtccttcgtgaataacaaaaatagcatttggtaaaagttatttatacagctgataaaatgttattctaatttgcccttgactttgttctgcttatatactattatttttaactgactgagaaagttaatatattcagtttatccaaatacataatcagaactagatttaattgcaggaaaatttggaatataggaaaatatcaaagaggttaagatgaattttatgacatctcaccaccgggaaataattttatattgtttcttattgagggaaaaaaataaaggctgagattaaaccctaagtgtatccagccggtagggggcagttcttctaattcataggactattttgtctttaaatttagcactcggagggtccctttccttgacctttgacatcagtatttatgcaccagatggataatatttttgtgtgaggcagctttggcaccctttggctaagatacggaaataatatatatttattaatacctgatggcataaaaatagttaccataattcaactcatctaactattatcattatatagacctctgttagtaacctgaactacttggaaaatttaaaagtcagggtttgtttctttctttctttctttcttttttttttttttttgaggcagagtctcactctgtcgcccaggctggagtaaaatggcttgatcttggctcactgcaagctccgcctcctgggttcacgccattctcctgcctcagcctcccgagtagctgggactacaggcgcccgccaccacacccggctaattttttgtatttttagtagagacagggtctcaccgtgttagccaggatggtcttgatctcctgaccttgtgatctgcctgcctcagcctcccaaagtgctgggattacaagtgtgagccaccgtgcccagccaagtcagagttttttgtacacagaatcctgagctacataggcttgaagataattcgtactggaaatgaacaaaaatatcactgtcctgcaatttgtttatagtttgcctcttccccaggccttctttttcctgatattccaattttgcttctttcagacatctgagaaaacagctaaaccatttgccactgccagtgagtctgtgcatattcttatcttggctacttttcttcccacacacagtgaatgaatgacctgatggactgaagctcagcccatcgggaggattatccctcacagttgtcctcaggggcaccctgagtgaggctatgatgcagaaacagtgctttcaaaaggtgtatcatttctgctacaaatggcatgcacttgctttataatgctagggttcctccctttaagtgtcctattggggcctgcaaagattccacactgaattatacataagtgacctctacacattgaatctgctgctgtgtggcctaagcatattggcagcctgggcctgctaccataccctttcttgctctggaccccacccaaaaatgaccttctgcatcacctaatgaatgggtcagagcaataatacacgctgcctccaacatccgaagaggcctacaagatgttgagattctttctttgtgatgggtggcacgggtgtaatagcttgtcgtttacattggaggagttgtctcagcaagccccaggccagtgaacctctgaaaactttatgcatatagcaaatatcccctgccctccggagcatgttgctgaccaagggcatcccgagtacatgccacttctgttcatcaagcataatttacaaaatatcatcaacataatggacttatttgatgttctttggagtattcagttccttttagactatcttgtgatagaaggttaaactaagccctggggcaaatcaacaaatgtatttattatccaccacatgtgaatgtaaactgtttttaattccccttcctaatggatatggaaaaggatgcatttgtcagatcaatagcttcatgtaacataccagagattatgggaatgcattctagtaaagataccacatctggtatgtcatctgcattacagctaccatgttttcagtggcccattttcacttgccatgacctatctgtattttatatatttttttgcaggtgacagactggtaaaataaattgagatataatgagagctatcacttctgcacctcagaggctaaaactaatctctgcaattaaccctaggatgttatattttttgatttactaacgtggtctgtttcagggacttgcacttggcttttcctgtaacaataacctttataccactggacaaagaatcagtgtgagggttctgacagctgttaagtatgtccatcccatctgtacattcagggactggggaaatgacaaccaagtaggcccatgtacccagcagaaaattttaaaaaacttagaactgagaaaaacctaatggaaaaccgtggccagcactctggttattatctgatctcataatgtcgttatctgctcaaatcctgtatcctatccacaacctttaaaatatgtaggtattccccttttctcagtgtgtacttaccttgttgcacagcctctttggagatggacttggggagtcacttctgtatgtacctgccagggaattgcagttattcctcaaatagatctgacctctctcagttgatgcagccttggtttgagaactggctcagggttgagaactgggaaagggattgactttccattgaggaagctggtcagccttttgtttatttattcgtgatctctttgggttatatagtaagtagtactctcgttcagtgctcatgtatcctttctctaggaacaccatagtctatgagcatttccatggatccctgtgggttaggacacccccctcccgccccctgcatcctgccattaagactttgcacttgttacagtaattactcccaccttgctgctgacaattaagtactgttacatgtctctgatatttggggaagccattatctccattactaccagggagctcagttctgcaactttatctcctacctacagagcacgtacaactacagagttttcaaaaatgttggtacctccgtcaccaagacctcccttattgtttccgtaaacagattgtaaacagattgtctcctggacacttctgcagaactgagtcaggtggagggtctttcagtctcctataatgggttgactctagcatgtccacttctctgtgcttttgattcttccatcatctgcctgctcactcttgaatctctcccatatttaatgtgggccattgtcttctctgagcttcttatggagcattgtttttagtgcatctctaagcatcattgccagggcgttcaattttgagtcatgggatagtgccctgtttttgccaacctttcatctatccagttcccctatctaataaggccttgattttgtcatgtgagcattgtctaagctgtgaatcctgccttctctaatgttctgtaactttcacaattaagtcctagtcttggtgttcagcttgattagcccttcaagtgtggtagatgagggtttctctaaaccctgacagagaagccctcagatttccacactttgcttcatatggttgattagtgattggagcctgttgtttctctctctaaagcaaaagttgctctcaggaatagtcactcaattgcacactaattttgcagttcctattttttccccttatctttcaaacaccaatgataacacatacactggtgcatctgtaacctatatcttgtatcatccatcacaggtgaacatttcagcaattgtcctgcttcatcatgccagggactatcagatgacactttgtccagtggtggggactttattgcatctggctactgagaaattcagttttagaatcccatccttaaagagtctacttcctaaggtactcctggcactagctgtcttatgtcaggtttcctagcaggggggcttgatgaagggattcctttgtgaggcagggttctcagaaaacaacctgtaaagaagtaagggaagatcaggatgggggaagaagctaggacatgatatggtctcaagagaagtacagttcaacctgatcccatagggagctctgaagtataaattgcatcatagagactgtcctctccagaagcaaaagatctgggcatcggtcagtcatcagccaagggcagcccacaggcagagggtggatgcaggatcacctgggcatccctgggcaagaggctaatgccagtcaagggcaattcttcagagaagagttccagtgtgagccatgggcagtaggtaggggatgcataagcagccattaagagggattggatggggacacctatagcatctgctacacgtcacctcatgttagaatactgaaaaataaattactattagtaggtcagcttttggagttttacagacctgcattcatttgggcaagataattaacctttctgactgtttcctctacagtaaaacaggaataataactcagcttaaatttgaaagggtttaagcgaggatgaatttgtgaagtctccagtagagtacttgctttataatgggtgctaaattaatgttattatgttgacaaagaaagtagaacttggctatttaccaagaaaataatatgtatgtttatctaattctatttaacacagaaagctaattgatatcttttacttacctcaaaaagaaatgatgggccgggcacggtgactcacgcctgtaatcccagcactttgggaggcccaggcgggcggatcatgaggtcaggagatctagaccatcctggctaacacggtgagaccccgtctctactaaaaatacaaaaaattagccaggtgtggtggcaggcgcctgtagtcccagctactcgggaggctgaggcaggagaatggcgtgaacctgggaggtggagcttgcagtgagccgagatcgcgccactgtacttcaacatgggagacagtgagactctgtctcaaaaaaaaaaagaaaagaaagaaatagaaatgatggcactatgcctcttagttcatttgcaaaataaattaatgtcataataatgctgtattaatctcacatgtaagaataaaagtataatatttaaaatgaggtattatatatgcattaatcaatatgattaatattcagagaaagtgagctactattagaatttcctttcaacatactactcagtaatttttgaaaaggttattgatgaaatgatacatgtgcattaaatgaaattgctcacacacaaataaatatctctatacattcagatatatattggcacaattggcccagcatttgctgaacataagtgattcagtaaattacattagagtatacaatgattgcttcttgactatttttctcttcttttgttgtcatttcatctcctgaagattgactaatttttttgtttttttgagatggagtctcactctgttgcccaggctagagtgcagtggcttgatcttgtctcactacaacctccgcctcccaggttccagtgattctcctgcctcagctttccaggtagctgggtttacaggcacatgccaccacactcggctaatttttgtatttttagtagagatggggtttcaccatgttggcctggctggtcttgaactcctgacctcaggtgaccgcccagtgtggcctcccaaattgctgggattacaggcatgacccattgctcccagctgccaatgattgacatttgtctgttgattcttatttatctaattccttttggtagatgaacctttgcaagtaccgtgtctgctgttcttgggtttcttcatttaattctgagggcgtttgcatttagggaatgacactgatttacttaattgctttggtataccctttataactactacttgtgtctctttgacacaagaacacacatgttcacgttcatcaggggcatgattcctattgttaactacttccctttaggaggttgtcttctaggtaagcatatttcttttatgcttatcaaatatgaaataaatatacaaccaactcaatagaatgtcataggctaatatggtaccacagaatgaagcaattataaagttaagctgcataatgaggttacttttggagaatattggaccttaatggcaatttaatcaacttaacctgctttaccagagatgatatgcaacagctaatatattgagccatcaatagatggagatagaaactgaatctgtaaacatttgctttgcaaaaccacattcatctcaggcaaataaccttttttcacttaaacaattactttagacaatagcaacaatttaaaaactgagatacatgcagtacttatcacaataaaatcagtatctctatttttaaaaccatttcgaacagtaatgtgaattttttgggaatatatgtctaagcttgtctccatttgttgtgtagattaaggtatttaccatattttatgttaatattaatcattttacaatcattttcattatgtttgtcctataattacataaataagaatgaaaatgggcagattttcaagttgctcactatttctatttttcatccaaaagaatagtgcaatgaggagtccatacctgatagacatgtggaaatatagctggacacatttatggagtggcagtcaatgacaaggcacaaatacatagtgttatgacatgggaaatagttcttaaggttgaagttcccactagagagcttgtggtgtagacacttagaattgagagcctaaaaaagatggtatgataagagcaggtttcacctactgagtactatcttttctcatgttttctgtacctcgtatctctcgtatctctaaaaggtcaaagatactgcataagccctctggaagctacctcttcccaagtctccatattcacactgcttttgattaatcgatccgtttaccttctcactgtgcatcgggccttctgtcattgtttccctttatatccagctcatcattacaaataccttcaatgccagtacaatccttagatcatcctaacctatgaaactcaaactctgagtgaatccactatctcttcccttggaacactctcttcacttgcttctgtgcattttcctaactcactggccatttttaaaattttagcctcttttgatgactttgttttttctctattaaacctacaaattttgtcctggtctccttctcttctttgtctgtctgtctatattcctttgctattttattctattctcatgtcttttttttttttttttttttttttgagacagagtcttgcttcgtcacctaggctggagtacaagggcataaacatgactcactacagcctcaagatcctgggctcaagtgatcctctcagctcatgctcttgactagctgggactacaggcatgcaccaccacacctggctaatttttgtggtttttaaagtctttttggtagagatggagtctcactgtgttgcccaggctggtcttgaactcctgggctcaagtgattctcctgcctcagcctcccatagtgttgggattacaggcataagccactgcacctggtgctcatgtcttatataatctttttttaagttaccagagttatgtatttaattgctttttattgtcacgttgatttggatatctcacatatttcagaattaacaggttcaatttcatcctctgtcagtcaaatctgtgttcctcatctcctccccacctagtcctccaatttcagtaaatgacattaatctgaaggcttgaaatataaaacagaggatgatatttgagatttacttttcttcatgtctaagctggttaggcctgaggtcaactgcaatgtgccaggagagttctatattaacactactcaaaataacaacctttcaacatctcccacctcagaacaatacacacacactcccctttacctcttcagggcccctattttcttaacagttcttattaagtctattattatatttcttatttacttactctttctgtttttcttaccagaacttttgagggcagacaatctgtcttttggctatttgtcttcatcccctaccacggtgtatggcacataaacatcacgaaataaatagctttgaatggcgaattaaccatcttatatctacttgaacatcatttataagaaccactggggccaggtgtggtggctcacgcctgtaatctcagcactttgggaggccaaggcgggtggatcacgaagtcaggagttcgagaccagcctggccaacatggtgaaacctcatctctactaaaaaaatgcaaaaattagctggatgtggtagcaggtgcctataatcccagctactcaggaggctgagggacgagaattgcttaaacccaggaggcagaggttgcagtgagccgagaccgtgccactgcactccagcctgagcaacagagcaagattccgtctcaaaaaaaaaaaaaaaaagaactgagaacacatcagatatggataatgaacctaggatagttggacatgatgagagacacttactagttattgactacaaaagagtagccaagagaaactgagagcagcctcactctagggacatcttatttccaaaaagacaagcatgactgatcagtttcctctttttatttactgctggtctttcattatatgcttcacaaagtacagggaagaacaatgttttactggcagagttagaaatcaagataaggagtgagaactaagataaattgcaaagactcaactattagtgtagaccttggacagctagctaaaagaatacagcctggtgaattggagacaaaaggtactccaaatatttggctaaaattttgcaaatatatttgggttacttaattcatttgaagtgtttaagtcaaattataaatcacattctatttatttaaaaatatttattgaggacctaccatgtaataagaacttaggatatatcatcaatgaacaaaacaaacttttctgccctagtggtatttatattctggggtaaagacaataataaaccataaaatatgttagaatatgttaagcataatttaaaaaatagagcagtatggctgggcacggtgcctcacacctgtaatctcagcactttgggaggccgaggcgggcggatcatgaggtcaggagattgagaccagcctggccaacatggtgaaaccccatctctactaaaaatacaaaaaattagccaggcgtggtggcatgcacctgtagacccagttactcaggaggctgaggcaggagaattgcttgaactcaggaggcggaggttgcagtgagccaagattgcacaactgccctccagcctgggcgacagagcgagactctgtctcaaaaaaaaaaaaaaaaaaaaaaaatagagcggtacaacggtatatgagaataccgctggtattgtaggtggaggtgcatggttcatgtatgtaaataggagggtcagggtgaatttcactgagaaaatattatttgagaaaatttgaaggagtgaactgtgctgataactgagaaattaatccacctggcagaaggcacaatcagtagagaaattcaaaggcaagagcaggtttagtcagtttctagcgagagcaaagaggttagtaggtagctggaatacagtgaacaggacatgggatcatagagataaggtataagtaccttgtttttttgtgctgagtgaaggtaccttggcatgatttgggatcaaatgaacgttcgttatatattctcctcttagtggttccactggctaatattggaaagatctcttgtcacttttgccttcacatttacactttataatttaacacacctgggaaaggcacaattatatgcttcattagtttcctgacctaatatttggcagaaggccctacatatttttctttatactttattttcatcgaaattctttgaaactttattcagagaagtaggtaaaagcctcaggcataggcttacacagtttcatttttatcttttacatctaaactcacacaattatccataagctctatcatttatgcactttcatttaacaaacatgtattcagcacctactgtatgccaagtactgtcaaatgtatatgtgagaacacaggccttttttggttccatatgaattttaagatttttttttctaattttatgaaaaatgacagcggtattttgatagagattgaatcaaatctgtagatttctttgagaaatatggtcatattaattctgatccatgaccatcggatgtttttctgtttctttgtgtcaccttcaatttctttcatcacttttctgtagtttttcttgtagataccttttacttcttgggttaaattaattcttagggttttttttttggtagttattgtaagtgggatagcttgcttgattttttcttgtctagataattattggtgtgtagaaatggtactgatttttgtacattgattttgtatactgcaactttactcacttcacttatcaaacctaggagtctttttggtggagtctttggatttttgtagatataaggtcatatcatcagcaaagtgggacaatttgatgtcctcttctccaaattgcatgccttttatttttttctcttgcctgattgctcttgctaggactcccagaattacgtcgaataggagtggtgaaggtggacattgttgtcttgttccagtccttagaggaaataatttcagtccttttccattaaatatgatgttagctatagatttgtcatatatgacctttattatttcaaggtatgttccttctatgtctagtttgttgagagtttttatagtgaagggatgttgaaatttttcaaatgctttttctttatctattgagatcatcatatggtttttgtccattttgttgatgtgatatatcatatttatttatttgcatatgttgaactatccttgcatccctggcataaataccacctgattatggtgtgttatctttttgatgtactgttagtggtttgctggtattttgttgagaatctttgtgtttaagttcatcaggaatattggcccatagttttcttttttgttgttgtgttctcatctgaatttggtatcaggataatgctggcctcataaaatgagttagggaaaattacctcctttttgataattttaaaatagtttcaggagaattagtattagttctttgtatatttgttagaatttgtctgtgattccatctggttctgggcttttcttttttgagagactgttactgattcaatcttgctactcgttattggtctgttcaggttttctattacttcctgattcaatcgtggtaggctgtgtgtttcaaggaatctatccatttcctcaaggttttccattttgtcagtgtatagttgttcatgacagtctctgatgatcttttgtatttctgtggtatcagttgaaatgcctcctttttcctttctgatattgtttatttgcatcttctctcttctctcttggttagtctagctagtgttaatgtacatcttgttgaagaaataactttttattttcttgagtattgatttgtagtctattttgttcagttttgctctgatttctgttatttctttccttctgctaattttgggtttggtttgttcttgcttttctagttccttgtggtacagtgttagattgttcgtttgccccaatctttttgcttttttgatacaggtatttattgctataaacttccctgttagcactgtttttgctgtatctcacaggttttgttatgctgttttcattttcatttgtttaaagtaatttcttatgttgaataacatttaatggttattttattaggaatttatctgtctatgttaatgagagctattagtctctatttttgtttttgttttgtagatattttgtcaggttttagcatcagatttgtgctgggcacatacatcagttggcaagtgtttcctctaattttctgaaagcacttgttataagatttgtgttaattgtttcccttaaatgttgataatattttactatctgggcatgtactttcattgtggggaggtttttatattaaattcagtttgattaatacatacagagttattcagattttttatttaatctagtttcaagttttattttctttcagatattatagtaatttaaccagttgtaaaaggccctacagttaaaagaccaaacttgaaaggctaaatattaaaaacacaaactacaagttatttccatgaaatcagtcaaatcatgaaataaattttgtgcaaatactaaggaaatatatacatctatataaatattagaaaaaataaaattagactacaaaattgtattaggaaataagagtgtatttagcactcttaaataaaaatgtatttattaaaattatttttattgacaggtcataattttatacatttatgaggtacaatgtgatgttttgatatatatatgcaatgtaggataattaattcaagccaattgacatattagtcaacttgcaaacctatcattttttatggggaaattaaacttgtaatttactcttctagttattttgaaatatacattattattgactattgtcaccctgctatgcagtatatcacaaaccccccattcatctaaagctttgtaccctttgatcagcaattacccatttgttccctccctgtactcccaatcagctcttggtaactaccattctattctctacttctatgagttcaactttcttagatttcacatataagtaagacaatgtggtatctgtctttctgtgcctgtcatatttcatttataataatgtcttccagattaattcaaatgttgtcacaaataacaggggacccccaccctttttaaggctgtatagtattgtgtgtgtgtatatatatatacacacacatatgacatataatttattgtcatatatatatatatgacagatactttatcctttcatctgctgatgaacacttaggttgttcctatatcttggctgttgtgaatcattttgcagtgaacatgggaatgctggtatctctttaatgtattgattttggttcctttgggtgtatactcagaagtagaattactgggtcatatggtagttctatttttagttttttgaggaacctccataccatttttcataacatttcttttaatttacattcccaccaacagtgttcaagagttcccttttctctgtattctcaccaaaccttatctttcatctttttgataaaagccattctaaaggcgtgagataatatctcgtttttaatttgcatttttctatagtgatgctgaacattttttcatgcatctggtggaaatttgtatgtcttctttgagaaatttctgctcaggaactttgcccattttaaaattggctttattggtattgagttgagtttattacatactttggatattaacttaccaggtgtatggtttataaatattttctctaattctgtggattgcctcttcagtctgttaattatttttattttgtgcagatctttttagtttgatgccatcactttcgtctatttgtgctttcattgcctgtgttttaggagtcgtagccaaaaaaactgttgcccagaccaatgtcatttagcattccaggccaatgtcatttagcattccccctattttattcgagtagttttacaatttcaggacctatatttaagtcattaatccattttgagttgacttttatataaggggtgagataaaggtccaatttcattcctttgcatgtggatattcagctttcccaagagcataatctgaagacagtgtttttccccattttgtactctcagcacctttgttgaaaatcagttaaccatagatgtatgggcttgtttctaggctcactgtcctatttgactgatgatgtagctgtgttatgctgttttgattactatagctttgtaatttgttttcaaatctagtaatgtgatgcttccagctttgttcttttgggtcaagattgctttgacttcaggaccttttgtgattccatacaaactttaggattgtattttctatttctttgaagaaatgcattggaattttgacagagaatgcattgaatttataaatcactttgggcagtatgaacttgaattacactttagaccaaatatacctaacacacataaagaatattccactcaacagtagcataatataccataatgtactttcttctcaagtgcacacagaacattctccaggcatatatatgttaggtcagaagacaaattttaacaaatttaaaagtatttaaattatatcaagtgtggcaatggtatgaaactagaaatcagtaacaagaaaaatcttggaaaaatacacaaatatgtggaaattaaacacgatgctcctaaacaacctgtaggtcacagaagtaatcaaaaaggaaataaatatcttgagacaaatggaaacataaacataaacataacacatccccaaattatggaatgcagcaaaagcagtcctaataaggacatttatagcatttaatgcttatatcaaaaaagaaagatctcaaataaataatctaatgttaagcctcaggaaactagaaaaagatgaaaaaaccaagtccataattagcaaaaacaagaaaatagtaaaaaccagagcagatctaaatgaaatagagactaggaaacaatagaaaaatcaacaaaatgaagagttggttttttgaaaaggtaaacaatatggacaaattgttagattaagtagggaagaaagatgactcaactaaataaaattagaaatataagagcacacattataactgatattacaggaacaattgtgaacaattaataactaattggataatctagaagaaattgataaatttctagacacatggaccctaccaagactgaaacctgaagaaatagaaaatctgagaacaatgtaaaataagaatgaatcagtaataagaattcttcaattaaaagaaaacatccttgattggatggcttcactgctaaattcactcacacattcaaagaagatctgatgccaattattgaaaatttccaaaaaaatgaaatggagggaatacttctaaattctttttatgaggctggaattacactgacaaaaaagacaaggacactacaagaaaaatatttataggcaattatttctgatgaaataatgcaacttattctcaccttgagttcagtttgagaattgaactcaaacacattacttcaaagactcattttcaagtgcacacagcacattctccagacatatgttaggttgcaagacaaatcttaataaatttaagaagattcaaattatatcaggtgtctctgtgtgtggcaatggtatgaaactagaaatcaataacaagaaaaatcttggaaaatacataaatatgtggaaattaataattaccacaataaagtggtatttgtcattggaatacaaagatggctcaacatatgcagatcagtaaatgtgatacacaacattaataaaatgaaagatgaaaattatatgaccatttaatggacatagaaaaatcatttgacaaaattcaacacccttttatggaaaaagttttcaacagcttagatatagagggagtgtacctcaacccaataaaggccatatatgacaaacttgtaggtagcatcattctcaatggtgagaagttaaaagcttttccttcaatgtcagaaataagataaggatgcccactctcaccacctgtattcattatagtactggaagtcctagccagagcaattaggcaagagaaagaaatacaagcatccgagtagggaagaaagaagtaaaattgtctgtatttgttgatgacatgatcttatatagagaaaaccctaaagatacccctaaagaatttgttacaattaaaattgaattaagtaaagttacaggatacaatattattacacaaaattaatagtgtttgtatatactaataacaaattatctgaaaaggaagttaggcaaacagttccatttacaatagcaacaaaaattaaatacttagttctaaattcagcaaaggaagtaaaagtcctgtacaacaaaaacactgacgaaaaagttaaagaagacacaaataaattgaaagatatcctgtgttcatgatatataaaaattaatattgtgaaaatgtctgtactacccaaagtgatttataaatttgatgcaatctctatcaaaatgccaatatcatttttcacagtaataaaaaaatcaatattaaatttgtatggaaacaccacaaatacccaaaacaatcttgagcaaaaagaacaaagtggaggcatcacacttcctgatttcaaaccatattataaagaacttataatcaaaatagcatggcgcctgcatacaaacaggcatatcggccaataaaacagtatccaaaacccataaatatgcccatgcatttatagtcaaaatatttttgtgtcagttttgatggctacatttttcattaatttgaccattccatctgaatagtcaaattcactacaaaaatgttattcacaaatttcttattttttaaattactgaagttcctctttcctgattattaaaaatttgtgttgtctctcattctttccttttaaaatagcttgttgaggtataataaccaaacaataggctgttcatattaaaagtatatagtttaataagtgttgagatatatgataaatgaacactacaattcaggtaatgaacattcccatcacttcctcatttcctcatatctctttttaatccctccgtcctaactgtcccaataccactcctttttctagacaaagcctaatctcatttctattgctatatagatcagtttccatttcctaaaatttatataaaggaatcatatattattcttttgtttgatttcttttactcagcaaaattattatgagatttatatatgttgctgcatgtatcatttgttccttcctttttatttctgagtaatattctattgtatgaatacatcaccatttgtctatccaacatattgtgggtgggcatttcaattgtttatagtttctggctattacacataaagtgttctgaacattcatgaacaagtctatttaaagacatgtgctttcatttctctggagtaaatacctaggagtggaatagtttctcctatggcaagtgtatgtttaactatttaagaatttgccaaagagctttccaaagtggttgtaccactttacattccagaaggcagtatataaaaactctggtctctccacatccttagtctttttaaatatagccattcttgtgatatccctttgtggtttgaatttgcattttcctagtgataactggtgttgagcatctttcagtgtattcatttcccatctgaaccttttacttgtacaaatctttgtcggttcaaatcttatgtccatttgttttttaaactgttttttaaattactgagttctgataaatttttatatattatggctatatctcctttatcaaatatgtaatttgcaaatattttctcccagtatgacctatatgttcattctctaaatacaatcatttttgaagagtagaagttttaaattttgatgaagtttaacagttttttttatggattgcacatttgcattttatcatagcaatttttgcctaactcaaagacacaaggaatttctccaatgtattattctagaagttttatagttttaggcattccagttaggtttatgatctattttgagttaatttttatatggtgtgagctgtgggttgaagtttattattttgtatatagatatccagtggttccagaactatttattgaaaaactattattttctctactgaattgcctttgcatctttgtagaaaatttgttcataaatgattgagtcaattttgggggtcttgttgtgaagacagggtaatagatgagtgaaacaaatagtgacgcaaactcatctattcccctgtctttacaacaagactacactggcttgcttaccatagctttataataaataagtaatgtttgtcctccaaaattgctcttatttttcaaaatcattttggatattctaggtcctttgaatttccatatgtatgttagaattaggttgtcaactgctagaaatcctgctggtattttgattggaggtgcattcaatttgtagatcaattttgggagaattgaaatattaatactgtggagatttccaacatacgaacacaatatagctctccatttattttaggtcctctctaatttctgtcagcaatgtttttagtttttaatgtttaagtcttgtacatcttttgtcagatttatccctaagtattttataaattttatgctactttaaattgtattaaaaattttcactatctggacgttcattgttacagtatggaaataaaattgatttatgtgtattaatcttgaattctacaaccttaccaaaatcacatattaattccagtggattttttcataggtttctttggattttctccatggacaattatgttgtctgcgaataaagacaattttatttcttctttactgtctctatatcactttttcttgactttatgtcttagctagaacctccacttcaatgtttaacaagagtgatgagaacagacatttgtttcctatatcctgatattaatggaaaagcatacaatcttttatcattaagtatttcagctgtaggtgatacggacaggaggcagataaatactgggtagaagaggatggttccccagcaaaggccccaccttaaatcctggaaacccacagccctaaatgggaacaggcatttatcttttcatgtcccaaagttgccttttggtctgccatgcccgcctatcctgtacccatataaaccccaaacccccggctccacgaggagacaaacagaagagcagaagaatagcagaatggcacgataaagagaagagaaggagtgtctgaatgtcgagaggagtttggctggggatagtcaggggaagataatcttcccactccattacatttccagctccctatccatccctctgagagccacctccaccactcaataaaacccctgcattcatccttcaagtatgtgtgtgacctgattcttcctggaagccgaacaagtacctgggtaccaagaaggcactgagctggttaacacttaagccatcccggatggcaaggctaaaagaggatactgtaagacaggcccacttgggctttgggagttgcagacactcaaccctggatgctgccatagggctggagctcaggggcacacaccttagctccggcacctgccctcctgcatgctccctctcgtgaagggggtttgagcagggcatggtggctgaacagatgagccacacccctgttgcaagttctgtgagggacgtcagggaactcgcctatttcacaggtttttcacagatcccctttatcaagttaaggtagaattcttttcttttgctagtttgttgaaagttttgaactgtgatggataatggatttgacaaataccttttctgtttctatgaagataatcgtatagtctctattctttagtttgttaatttggtgaattacactgattgattttcaaatattaaaccactttgtatccttgggaaaaaccccacctggtcacagtatattgtctttttatatattgttggatttgctttcctaatatggtgttaagaattttgctatgttcagccgggtgcagtggctcatgcctttaatcctagcactttgggaggctgaggtgggtggatcatgaggtcaggaaatccagaccatcctggccaacatggtgaaaccccgtctccacttaaaaaaaaaaaaaaaaattagccgggattggtggcatgcacctgtagtcccagctactcaggaggcttgagcccgggagactgaggttgcagtgagccgagatcgccccactgtactccagcctgagccacagagcaagactctgcctcaaaaaaaaaaaaaaaaaaaaaagaattttgctatcttcagaaggatatgaatctgtaattttcttttttggtaatatctttgtggatggtatcagaatcattctagtttcacagagtgtgttgaaaatattccctccttttcaatgtcctgaaataattttagtaaaattaatactacttcttcctaaaatgttggtagggtttaccagaaagccatctgggccaaaagtcgtctttgtgggaagatctttagctacaagttacatttcatctatatatctatgtgtatctatctacctatttatctctctgttatcaatcattatgcaggttattgatttttttctggattgaattttggtactttgtgtcttttaagaaatcgtcatttttactcagttgtctcatttgttcttgatcaatctgctgagaggtttatttgttggtcttttctaagactcaacttttggttttcttaattttctctttaggttatctgttttctattttattagtttttcctctgatcatttttttcctttttgtttttcaagatgtagctttaggtcattggatttagactttacttttttaatgtaagcatttaaagatatctatttctttctaagcaatgttttagctctatccataatttaggttatgttgttatttttattcagtctcacatatttaaacatttctctctctcttttttgtttttttgacccatggatattttgtgaaagtgttattgtattagtccattctcacactgctgataaagacatacccaagactggggaaatttagaaaagaaagaggtttaattgacctacagattcacgtggctggggaagcctcacaatcatggtggaaggcaaggaggagcaagtcatgtcttaaatggatggcagcaggcagagagagaacttgtgcaggggagctcccccttatataatcatcagatctcatgagagctattcactatcatgagagcagcacagtaaaggcctgcccccatgattcaattacctcccaccagttccctcccacaacacatgggaattcaagatgagatttggtggggacacagccaaaccatatcagtgatttttaaaaattgttaaatatttgatttttatcttagctacattattattcttgatttctcaataatcccattatggttagagcacatattttgtgcaattccagtatttcaaaatatactgagacttattttatggttcaacatacagtgcatcttgatgaattttccatctgctcttgaaaagaatgtgtactctgaaggctttgagtatagtgttgtataattttcagccaagtcatagtggataataatgttattcggcccttctttgtcctttctcattttttctggttgtcttttaaaaattcctgagaggctgggtgtggtggttcacacctctaattctagcactttgggaggccaagataggtgaattaattgagcccaggaggtcaagaccagcttgggcaacatggtgagacaccgtctttacaaaaaatacaacaaaatggctgggtatggtggtaggcacctgtttcccagctactcgggaggctgaggtgggaggattgcttgagcctgggaggcagaggttgcaatgagctgagatcaccttactgcactgtagctcaggccacagaacaagatcctgtctcaaaaaaaaaaaaaaaaattcctgagaaaggataattcaactatccaaatatgattgtaaatttgtctagctctctttttattaattttgtccatttttttgtttatgtattttggggctctgttagatatgtgcatatctatgattttatgtcttgtgaaatcactattttatcattatgaaatgttcttcctttgccttaagttgctatatattattaatataacaactccagccttcttacccggtttacataatatgtatctgtccattcttttccttttaatctatctgcattttaaaatttaaactgtacctcttgcagaatagttatgtcttgcttttccaaatattaaaaaaaatctgcattcctaattggaatccttagttcatttgcattcaatgaaattttcgtgtgcttggatttttgtctaccacttcactacttgttttatatttttactactttttatttctctggtatttgttttctgacttttttgagttaattgcatttttacaaaaatattttactctaatttatctatttgctttaaaattatactactttggaacatttaaaatggttgctccaaggcataaaatacacatttttaacttttcacaccccactgggaaatgtaaaaaccttgcaatcatataggtcattttttctcactccattttggctatcattgtcatatatagtacatctatacatgatatacttgtatatgtcagatttacatgtttttacttttctcattaagcatttaaagctatttccttataaacattgctgtagttgtatctcattatttataatatgctattttttataattcaatataaaacattttgcatctctcttgagagtttctttgattcgtacatctttttgatccatagatttttttgtttttgttttaaaacattggaacacacatacacacaataatttttgttgtaaatagtgatgtgttatcaaattatgaaaaaaaataattgtgtttaaccacctcaactcaacttctgatgctcttattttctctataagacctgagatttcatttggtatcacctctcttcattgaaaaagactttcttcatgatttcttatagtgttagtctgctgaggatgaatattctttgtgctagtttgtttcaagactgactttgtttcccttcattcttgtaggatattttcactggatttataattcttagttctcagttttatgttgtagcactttaaacattgctacagtttcttctggcctctattttttgtttgccttatttttatatgtatgtaatgtgtcttggggcactgcttttaagatttttatgccattttttcaacacctaaaattaattactacataattaatatttgtttccatattataccttgcttcatatgttaaaaaaactaacaatatataatacatataattaatggcactaataacttttaaaatagccataacaacattttagtaagtttgatatctcttgggacattactaattgtgttaacattattactaattgtgataatacctaatgtgtgtctagaaagccttgttaattcatttgactttgagttaataaagtgaatatttctttgtgaaaaagattaaatttataagacagagaaaagaaaaagatttttatgccattttggaagttcagtggtttgactctgacatgcttggacataattttttttatttaccctgtatggggcttgctgagattcttaaaactgtgaattatgtcttccacaaaattttggaagtttctcaccactatttcttatatatcaagatatatatttatgtataatatataatgtaatatatgatatatgtaagatatatatctaatatatatgatatatcttatatatatcatatatagtttcatttatatatatttgcatatatatggaattatatataggttcatttgcatatatatggaaatatatatatcattcaatttgcatatatatatgtgtatatatatacatatatatatacacacacatatatatatatagttccatttcctctctcctctcattttgggactcaaattacatgaaacacatggttttgataaagtcctacaagtcactcaggttctatgaaatcattctcaatcttttttctgctttctctaaattgaacaatatttattgagctctcttcaagcccactgtttttttcttctgtaaatctaattgacttctaatccctaaaggatgtatattttaaaaaatgatcttatactttttagttctataatttttatttgattgatttttatatcttccacttttctgctaagattccttttttttcattaattataagcatgtttttaaatagtttttgacaatggtcatacttgctactttaaaaattcctttctgccagttccagcatctgtgacatcttagtttcaatgtatgttgtcttttctcttgtgtatgagtcattttttctgttcctcacatatctaataactttgacttgtatcctcaacattgtgaagtcactggagtcatttgcctgtgtttctaaaatattaacctttgactcacactctaaactccatctttcctgtagtagcagaaactgaaagctctgattggtgttttagccttagctatgtgtatcagtcagtttgagctgctacaataaattaccataaggtaggtataattatcccccatcatggaaaagtcaaagcatgggccactctcctgggttgttcccttcactcaagttttctcttcccttcgggcccttctgtgggttcatgttcattttctactaggtggggtgcttgcactgattaatagcctgaaatatttgccttcttattgattgttatacaacctcttttaaagtaaaaaaaaaaaaagcatattgcacagagaagtggatttaaaattttttttatgaatgagctatataattatgttgattcaggcaatcaaaactcattggacttcaattctgataattaggaaatgtttgatcttgtatattgagagaatggggaagctatttgttgcgtgtaatttaaccttttgactcatattttccctggaggctctaatggtagagcactcagaagtatttggtttagttcctatctcaaaattgctgtctaataaaacacttcagtttctgctttatacttccattgattggtgttaaaattggcttaggaataccaaacattacagtgtttgaattcgaaacatataatcttgttattggaaaaagcatatttacttttaaatgtgttcataaaacatattggaaaagggctactaactgtgcaatttagtgtgaactgtgtgactaatttgtttaaaatgtaaatgcaaagtatttgaatgtaattattgactgtcaaattgatgattactgattaatattattcatcaatgcacaatagttaacatggataccaaattagttataaaatcaggaagctgtgactttggaaaagggaggagatcagtacagattgatgttttaggaaaaaaacttccagtttcgtaaaatgtcgttagcaacaaaaaagagtatatagtgtacaccaatatatgttctttcagttgctttgtttcttaatataacttttattgttaagttctgcgtttctaatttgacagtattcttcagggaaagaatcaaaaggaaattctaaaagaatttcagaaaacttttttaattgttcagaacttattgtaattgccttttaaaattcagattcacctttgttaattagattaccttttttttttttttttttttttttttgagatggagtctcgctgtgtcacccaggctggagtgcagtggctctgtcttggctaactgcaagctccgcctcctgggttcacaccattttcctgcctcagcctcccgagtagctgggactacaggcgccagtcaccatgccaggctaatatttttgaattttttttttttagtagagatgggtttcactgtgttagccaggatgatctccatctcctgacttcgtgatctgcccgcctcagcctcccaaagtgctgggattacaggcgtgagccaccacgcccagccagattccaattttaatcttgaaaacaaacttaaaaaattctgcgctattgttaacaggaaattttgaggcttatagtgtttattaatgttcacacttagagttaggtcattaaaaatacttactttatactttcctaaaaatgtattttgatgtttattccagtacgtaaattttccatttataatgagaaacacaaaattgagtctgatttctagatcattttggttgttaaaactactcttataccacatgtgaatggaagttacagtaaaaggtacatagtgaatagggcaatcacaaatatagtactgtctattagaacatttgataaagatggtaatgaatatatatatatgagatatataaaatcaaatatactaagagatggaaaagcaaatgtatttaacaaatcaaatatataccactgatgttctataaaatgactacctactgaaaatcttcaaaaataaacctcaaagtaatcttttccttgctttaacaaatttcatgtagatattgctttagcaaatgtcatggtagattaccaaataagtattaaacatgtgttgctagtgtatattttgatgatgctcatctttgcctaataaagcaatacatttaaggggaaaaatgtttgtcatcctagatcaaaggcatctaatatgtataatatatatgctatataaacacatatattctatatataatatctatgcaatatatattacatattatatatcctatatataatataatgcatataatatatatgcaatttaaaatgattagcatcctaaaactatttatgatccagatctgatccaacatatatataatatagtggatataatatatatgcaatttaaaatgattagcatcctaaaactatttatgatccagatctgatccaacctttcagttaaaagttatataatcttacacctcctatttagtactaatgcattgtgtagctccatgttagtgggttaagacaaggaatacatagcaaagcaattaactaacaatcaatcaattaaagtcagtggtatgtatggataaagtttggaagtgcctgtgtggttagttgttcaaaaacctataatagagtataggctgttagcttccaacgtcttgatggcataggttttatccttcacttaaaatccaactttttttgcttggagaagatagaatagttgagaaggtaacaattaatacccaaaaataaaatctgaagaagcaactcaaaagcaatggaagtattcataagggaatacttgattcttactgagctattggttctctgctttccatgtctgtctaggccagtacttattttcatggttaatttacatctcagtgactccatatttttagaagtaatcataatttaattccaaaggcaaaatactaatatgaaatgtggtatgattccttgaataacacatgtaattacttttaacatctcaattaatgtggaagatacaggtagatttttatgggaaatttataggcttagaaagctataattcattttattaatagaatatgtgagcaagaagcatacattttgcttatttattgatttttttacttccttatttttatattatatataaattatatattatatttatattatatataaattatatattatatttatattatatataaattatatattatatttatattatatataaattatatattatatttatattatatataaattatatattatatttatattatatataaattatatattatatttataatatatataaattatatattatatttataatatatataaattatatattatatttataatatatataaattatatattatatttatattatatataaattatatattatatttatattatatataaattatatattatatttatattatatataaattatatattatatttatattatatataaattatatattatatttatattatatataaattatatattatatttatattctatgtaaattatatattatatttatattctatgtaaattatatatatttatattctatgtaaattatatatatttatattctatgtaaattatatatattatatttatattctatgtaaattatatatattatatttatattctatgtaaattatatatatttatattatatgtaaattatatatattatatttttattatatataaattatatatatatttttattctatataaattatatatattatatttttattctatataaattatatatatattatatttatattctatataaattacatattatactgctggagttcagtggctctatcttggctaactgcaagctccgcctcctgggttcacactattctcctgcctcagcctcccgagtagctgggactacaggcgccagccaccatgccaggctaatatttttgaatttttttttttagtagagatgggtttcactgtgttagccaggatgatctccatctcctgacttcgtgatccgcccgcctcagcctcccaaagtgctgggattacaggcgtgagccaccgcggccggccagattccaattttaatcttgaaaacaaacttataacacgttataaacacgttatgttagtgtttccatgggaacacctgagaggagcacctggccaaaaccaaggagtcagggaagatttcctgaaagacgtgccaccttgtctcgttaaatgttaaaggaggagcagtggttattgatttattgatttttttacttccttatttaataagaaatatcaaattaaagcattatagtgaattggaatgggaaagcatatgaacgggaaaagtttgattcaaaacagttataaggatgggatgtagaaggatctctgctccagagagaagctatgaaataataagagggaaaactacttaggacctgtgtgtcttccatgaggtagtggaatgaagaacttttcagagtttctgccataattatggttatgattcttcattttgttcttgaagcccttggggggaaaaaaggagaagcataatctttattatatttcaaatttaacctcattacataaaaccccaaaatatctaattcggattatttcttaaaatgtcaattcttttccctgatagttaccagataggttagttgacccagagaatgaggaaaggcacaaaagtcctgtttttcttggtctctcatcaatccaagaacacagagggataatttttgtcttcctatttgttcagtttttgaatcaacaactttcatttagaactggagttcctactattacactgaatatagtgaaggaggttaccaactgagtgcagtacaatttgagaactttgatgcacaagaattcaggaatgtgggaatccagttgtaatctaagctctctacccagatgcctcattcagtgggcagtggtgaccatttgctgtccttctgctgaattcctgtcaaagatccttgtcagcaaccgaaaagaaacaaggcaaattcatttatgggtaacttctctgtttgcaagcatcacttcttaccatccctgtgttacagataaacttactgcacaaacgcagtggtctttatctgctcctgctgtttagtggaaatagtgttttctcaatctcttctgggttaaccactgctcctcctttaacatttagtgagacaaggtggcacgtctttcaggaaatcttccctgactccttggttttggccaggtgctcctctcgggtgttcccatggaaacactaacataacgtgtttataactatctgtcttggggactgttgtccactgaactataaattgcataaggtcagggaatatgtcttcacttttggatttccatcgtccaggattgatcctgggcaataaaggattcacgataaagccctggtgaatgaatcaacaaatgaatttcaataaatgatgtacttaaaaggcaaattaactatgatatattttaggaggctttattgagtaaaagtgattgagctttcccatgaatgcatcatttgaataacaatttttaaattaacaggttagagaagaggagataatttagcagctattggttggcatagtggcctcttttgtcgtaatttttcattcaaattcttgttcttgttgtgaaaggatgatattgtgaaggtgtacaccctttatttttataatccctgcaattcctttgtttatttcttagttctttattttcaaactaggccttggctttaaagccctgccatggaaaggaaggtgatagcagaaattcaaagtaaaacagaaaaagtcataggttttattactcttattacatcacaaaaatagataataaactctcataggactggttgaagaaaggataacacctaactagagtaggtattgtgaaacaattgtgtctcaggaaggaacctgtttctatttctattacattgagttctaaccacacaaacaaatcttcagacttatttagggatctgagggcagaaagagaacccaggaagccagtgcagtcctcgtttcatatttccctgtgccatgtgatcaaggtttgatagcagaggaatacactgactaattggcatgtatgggcagagagaacttgggaacagccaccttgactgctgctgcctagagtggtgtcagggagcaggtgaggtttttagttgagttggagggcttggcttgaaggtgtctcatggtagatggaagaggcagccataaatgatagcacaaccaagccgaaggaccggaagaaatgggtggaaaaattgatgccagcaaagactaggggtcaaaggcctcctccacaagttgttgatgttgtaagacagcctctcctctgtagacactgaatgtcaaagcttcccctgagaaaagatcaaggaaactgtgcagctttaacttgtacctcaactgactatgatgaacatattgacttgatgctatctacctttatttggaatggaggcttgaattacagaataattttcagagagatcaaaagttacatttgcagttctgacttcttagtgtgacattatcttactcattatattagtttcaccaagatccagttctctaaaatgaaaaggaaaaaaaaattgtaataacttcaagatggggatccatcttctgtgtcccacacagaatagtccattaatgctgacaaacatattttcccatttattgccaacaacatgttatttcaggactttatattgtgtatgttaaatttctgtctctgtctctcttctctctctctctctctctgtctctcatacacacacaccttgtacaatatagctcaccttactgaaataacaaataatgtgaaaatgttatgtattcgatcaaagccacaaaataaattgcagagataggttatagattgaggtctatctcccttcagagattttgtacttctcatttattattgtgacctgaaagaattgatacttcctcaaacataaccttgttacttttttcttactaattgctggcaaatgataaaaccttcagcttgcagatgacttctaaaaaacagtgaatggaaaagagccttgatggcttaagtaatctgttaatagtaaaaagattgatttattataatattgttatttattgaagtcatgagatggcaggagagagtacaatggggtattgaatttttatctagagaaagaaggcattgtgttataaattttttaagttcaattttttaaattacagtactatatcaagattcagttagaagtattaaaaattcaaagattcagccatttcagttgtcaagcatgtagaatcgcaaactttaataagaaaaaaagtttatcaaaagatgaaatggcaagaagccctagagtaggcataactggtgacagtatgtgtggtgtcattaccacattcctctgcaggatgccacacattccagtcccttgtctttccatcattaaataatacatagtgacttttttgggtctcctaaatcttttgttttctttagcgaatattaagttgtaaaaaaagaccataaaaggaacatgtttcctaaagtttttacttctgaacattaataaaatattctgtcaacgttgttaattatttttatttttaaacatgtaaaggttgtgcagttcacacatggtatttactattggattttgtagaatcaatttacttagtagaaatacccttagtttgtaaacaagtcatctaattttcatttagctatataagtaccacataaaaattgattattctcttataaaatcctacggtgacttatttcagcattctatatttccagtgatatgatgtagaaatcaatgctgttgttactaacttaatggaagtataagagttgcatttgatgttgatttctatgttccatgaagaggaagagactgtgtaaacatatatgttcttacactgtcaatatatatgttgacagaatattataaaaggttagttcaattactgtgcagacctatattctaaattatcagcaaatcacagcacacagccaattctcctaactataggcaatgtccgtttaagacagctgtttttccaaccatttttaatattttctgggtttaggaattttccaagtcctcttaagtacagcttatttcagtggttgatttttttttggtctctatgtgtaatattttcaaataacaataactccaaagggtgaagatataaaagatttgtaataatattaagcaaatgaagagcagcagacgtattattaacatgacatataaaatggacaggataaattagaaaaggtcctataggagcactcataaaagttttcatctagccttttgcccaattatattttatattctgaaagaatggaaacaatctctcttaaaattttatagcactcagggcctatactaaatctttcatatgttttcaaattattcatttgcaaaaattaaatttatactgtaattatttctttaaaattgggtagactcaaccagtggcagtggttttaaaaagactccttaactgtgaaacagaattcattgcataaaatacattggaacattcacattcagttattacgacactagtctttcacttgaatgtgtctgtttatgaatttatttgtcaagaaatttttgaaatctatttggtgaaagtagagaagagagaaaaaggataacagatgaggttaccagggaacgttatgaaaagaaggttgtgtttgggagaggtgtgaaaatttggaagagtgattatggcaaataagaaagactgctatttggagatgagtaaaattctgtgaagaaaagtgaggttgggaataatcagtaatgaagtcctttgccacaattttatgtatttttccaaaagcttcaagtaagagcagataaaatgaactgcaggtttttccacagataacctgtgaagggtaggattggggaccgtttggttgaaatatttagttacgagatttaaggtggatatagaattacatgaagacaggcttgttttaacattacaatatataactaaactgtagtgtaattaggctaaatacatttaactcttcataaggttatgagaatgtttagaaataaaacataaaacataaaaattacattaaattggtactaaatcttacatagtgccatatttatctacatatgcaaaagtgtacattgtgtctctctcctacattcataattatacagaattaatcagtttgtgatatcttactttttgcttcaaatcaatcattaattttgaagaactttagattaaaaatgaataggcttctgtagatacactaaaatgtcggattctggtgaacattttcacaatcttggctgtttggccagtttttaacaaacctggagtttttttgttgtgctcgttgttcgtgagattttcgtgtgtctgtgtatgcattcattcaacaaatgttgagtttctgttaggtagcagacataattctagacatcctgaatatagttgtgaacaaaacaaacctagtgtctgttctcaatcttaggatctgattctaaattaggggctctgtaaataattaatcacttacaagtcaaaccgtttaattacttgggtaccttgtttattatagttaatagcttttacttggcctttgcacctggggtcatcctagctccactagaaacaggcaactcaattgaattacagcaggttcacctgcttttgtagctatggtatagctaacctttaattcctaacatcaagtcttcatattcttttctctacagtatgccaagggatgtctgaaaccttaattctttgaagtgggcatgacattggttctaagtttgggctaactaacccaccataccattatgaatgtagtgagcttttcaagccggcagattgtctgctaagggcacctacatcaacacatttagttcactcaagtcccctcaaactcaatatgtacaaatatgctgtagtgtttgttattaaacatgcacagatttccatttatatcagtctgatcaaaataatttacttccatatgtggttattttagacattatttaaagaatgtaaagtaatcctgaaaatgtcaaatgagtattacaataacttcacaaggctattgattctttctgatgaatatacttatttgtcttataaaatttatacttattattaaggaatcagagcatttaaaaaatagatttttaattattgtacaaagcaattaaatatccaaacctgtgttgaatcaggactgtgagtgatcttagtatgtgaaatagtaatgttttctgatggccagaactacatcatctctattgggagttcactgtcttgtttgttacatggagaataaaatcttttatatgtaatttttaaaaaacattattttaagacaaaaccttagttttactttttgcagtgctgcagaataaattctgataaaacaactgttaaagggtccctatgataaaataacactgcgtcctgggtaaattatgacaaatacaaagtttactgcacttcaagaattgctaaaataagttaaatcttaaaggtgcctaaaataaaatgaaatgataaaataaagcagtttgttctgaaggaaagtgcatatttcagtggtgtgatggaaagataaatccatgggagtccagcaatatagagaagctgaatttgaaattcctacgttaagcttggaaccttgaagggacaaaagtgttctccggttgataaaaccttctaaaaccagaaagggcaaatgcaaattcaaattcaagagaaaacatctttcatttggttccaaaccaatctcacagattatattttaaaatgagtttactttaggaaacacaattactaagcatggcagagaataagtcaccatggttgatatatagggaaacaacaatagacttatttcccccaatgacttcagatattggaatgatcaaatttaagatataaattactttgaaacatataaagggataaaaataaaatggaactgatataattacaggaaacaatcaataatgtcttggtaggtttaaaaactatcccaatagaaattttagatgcaaaaaaatgtaattgtagaatcccagcacttcgggaggccgaggcaggtggatcacctgaggtcaggagttcaagaccagtgtgaccaacatggagaaacaccatctctactaaaaatacaaaattagacaggcatgatggcatgcacctgtaatcccagctacttgggaggctgaggaaggagaatggcttgaatccaggaggcagagcttgcagtgagccaaattgcgccattgcactccagcctgggcaaggagagcgaaactatgcctcaaaaaaaaaaaaaaaaaaatacttgagtgaaaaagatagataaagtttagtagagagataggaaaatggatgatagagttttgggagctaaccagaatgtaatacaaaacataaaaggaagtagaatataaaagagtggttaagaaatatgtatgctaaaaggaacagtaacaaatatctaactggagttctagaggacagaataaagaaaatggcagaatgacaatatttgcaaatataatgggtgatgatattccagaagtaacaaaaaatttatagcatatgctattaaggtgtcaaaagaaatttttatttaggtgctttttagtaagtttgaagaacaaagacagaatgaaaattgtcaaagcagccagtgagaaaatacacatcaattacaacagaatgacaaatagattgggagtggatagcttaagagtaaaatgaaaactaaagaacaatagattaataatctttcaaatatgaagaaaaattaatgtcaactttagaatttgtacctgtcaaaaatatctttcatggatgaaggcaaaataaatatctttttagatatgcaacatttaacacatgttaaccaaagaaacttttaaaatacgtattttggaaagaaatgaaataaccccagatcccaggtttgagatacaaaataaaaatcataggcaaataatctagataacataatgtaaataaaatactgtttgtataaagtaataatgataagtatgagaacaattatttttaattaaatacaaaaggaaagagaataatgaaaaaccatagcatataagatgggattgattagatttcaagtgttggaaaatccttttactatttgtgagagggtttataatccttcttgactttaaatgtgttaaaccaaaatattaacatatctgcaacaagaaagaacagaacactatagagaagggttgaggatttctgggttgtcgacctttggggatccttttatccctatttcagttcatggtgtaccagactttcccatttaacagtcccaatttatacttaactggtgtgttcaacagaagttaacagtctgcaggatcatattttactttctacttttggctacctcagctatattatcattattatagaaaaatattggttgtattttatatctcaggataaaaatttagagattaggacttattttcattccttctttgactctgcattggaaggtgaagtcctgtctccaaatattttcgaattctttttcaatataaatggtgtttagattctacgttgctaaaacttaatagtgcccagtgtcctctgttcattttagaattacataagttttacaattataattatagacttttctttcttccaagtgagataaaatgtcttgctagtgcttactctcctaaaattataatatatttgcatacaaataaaattgttatgactgttggaattattttaaaaatgttaatcaaattatctatactagaactggtaacccagttacatatttgtgtctacacctttactttttcaactgcataatatgtgttatgacacttgccttgaggacaccaatgaaatggatatttctaagtcgtttctccaaagtctttagtcctaagtgtcaaattgtgctctcaacttaatttattttgtttagtaattcattgagccctatggctttaaatatcatctttatgctggtaaacataaaaggcataaacttgaattcccctcccctacccatcctgtagtactgacctctccatttggtgagcagtgctgagccattatcctacttattccagccacagcataggaattttccatggttcctctttttctcttactcctgtccacattagcaagtcctattaagtatgcattcaaacaaacaatgtcttgaatcttttaatttttccatcttattatgactaccttagtgcaaaacactatcatctgtcacctagctcactgtaataacctcctactgatttctctgcttctactcaggctttcctcaatcatttattttttaaccaaggtatgtgtatatatatgtatctatgatttaaaaatacattaaagacacaaatcaaattatgttcattatctgctttaaatctgccagtggctttctatgatacttaaaataaaattggaatcagttgcttgtctgcaaaatcctcccttccataccatttcctccatcaccaccatgccatcagtgctagctgttccttctttcaattctctccctcatctttttaagactgaccctcttgtcattaagatctcagactaatgtaatttcttagaggcttttctgactactagagttacctagtcactctgtactaaatgccttattttttctctatgtgatatgttattatttatttttatctctgtatatctctctatcatctatgtaataccccctaatttccagaatataacatccatgagagcagcagcaacctcatcactatttttcacacaagccattagaatactacctgggcttttgatggtgctcattaaatatctcttgtatacatgaaggacatacttttctgctgttttgaattaatactttattttttttttacttatgtagcaaattttgttaatgtgattgcttattgataatggctagtggtcttatcatccaagaatttaaaatatatatatttctgactacatttgtaaatgtcttattcaatatttaaattaacttaaaccttcttgaaataatgctcagagtaatttctactaaattggttgaactttgagagcttctaaaacctgcacatgaatagtaatttatttctgtctagtccaaagttgtttgaatatgacatgatttagcctatttttttagtacatgggatgcttcataacttcaagaataataaattttaattttgagcaccctagcccaaaaaaaggaaactgtcagcactgatctagtttttagtgaattcccctgcaatgaaggactgattgggttgtggttttaaagctacattaattctgtttctaactcttttactttctattttttaggagtatttgttacaggttttcatatctttagtataaattatctttctttatgcaggatacctttctgaaaagggtccgtttaaaatttctaggcaatgtatttttcttttagcatgttaaattagagttttttaaaaagtgtatgtattgaagaaaatacactgtcaaataggagatattcatatatgcattccaatagcaatcagttgaacttttgaataagtactgtagaaaaatatttttctgaatggtgcttttacaaattaaattcatataaatgattcagattttttaccttcaaccttgtcaggatttaaagtattctctttttctgtttccttttggtttcatcttaggtagtagtctttataaaggcatttacatttttcaaaaactttcttgccttagagatggcgtgatttgtcattaaattaattggaactactatatgttgaacttgatcgtaaacatgtgtacaaaattatacttttaaatttggtgatttaccatggcaaatcctatgaagtaggtttattaatattgttgtcattatttattttacagaacagagattcaaatgggttaatgacttttctggcaagatataactatgaagaggcagaattagatttgcattcaggctgttctgtggcagagaaggggaatactaatctagaaacaggcatagactaacgtgctgtgatgtttaatttaactatggaacacagagctcctggggagagcactgacaggcaacccaccaagcttttgtaagtcatgtgctgccaaaattcccctgccctgatgaagagggatctggatccaactcaaaataatatggtaggagccttagtcacatattcagacctgagtataaaggataaaaacaaataaatttgagcctatattttcagaagtctctgtaagctaggtgataagttatgactgttatgatactacagctgctactactcataggggattagttgccaagaaaagaacaaacaaacaaacaaacaaaaaactcaggcaatctccctatctgatgaaacaattcatttcactgcaaaaggaatgaggtcccagttttctcaccattcccaccacagtcatgagaattcatatcacaaaggtggtggtctacagattctcttacatgctttgaatcaatggggcacacaacttgaatacctaggctcagaaatctagaggttgaaatgtcttttatttctttctgtacgtaggtaggatatgttatttctttgttattactgctaaatatatagtgtgtattgatggtgatcacatttaacattgagtgtactgatttcataaaggaaaaaaagaatacctgggtggtttgtcactgtactagaggagagatgggcctcccctggattgaggattatagtcagactattggcaagaattttttgaaatggcattatgacatttttttcgagatgaagggttgcataattttgtgttgtcacgtgattggaagtggtgaagatgcatttatagtgaatccaaataggaaggtgatgttaaataagaggcatccttggcactctgtgcacaggaagaaatgtatgtgtgttggaaatccaagggtagaatatccatcatagtgtctgccattttcacatgctgccccctatcctgattcagttggtggctacagataaacatgtttaaatttcaggtatcttgactctcttgagcatatataattggacttggggatgagaccctgatctaaggtagggagttcatagactgacctacagagcatgacgtggactcttgtaaagggatatgatgtgtctttctcttagcaagtcaaactagaaaaaaaatagtttaaatcaggctgtaatgagaatagaaggtgaaatgatggagcagatttacggaataaggatcaatggccattggtcatcccaaatcatgagaaaatagaagataattaataaggaaaaataataaggtagaggctgggtgcggtggctcacgcctgtaatcccagcactttgggaggtggaggagggcggatcatgaggtcaggagatcgagaccatcctggctaatacggtaaaaccacgtctttaccaaaaaaatataaaaacttagcctggcgtggtggcgggcacctgtagtcccagctactggggagtctgaggcaggagaatggcgtgaacccgggaggcggagcttgcagtgagccgagatggcaccactgcacgccagcctgggtgacagagcaagactctgtcaaaaaacaaaaacaaaaacaaaaacaaaaatcaggtagaaaacagctttgtaggatggaaaagaacaaggcaggtatttgatttagaaagcccatatcattaggaatagagaaacatttggttacaaaaaatgaccgtacaatagagtgaaggtctatatggcttttcactgctgttgaagtctgtagagttcattgaatcctaaatagtgtttcagtaccagttcctgtgaagctaaaccatattagattaatattctttgtttctttttgaatgagctaatattcctttcctctcaagaaagagaactaaatctgaattgcttaatttaaacccacaatttatttaaagattttgtcaaagaaaaagtgcattggatagaatgaaacaggcaaggaacgttttattcaattgtaatagaggtcaaaattattgcagtaatggagattgaactcaactcctttgaaacaaaaggcaggtcgatttttaagctctggggtgagctaatggaaaagtactacagaatgttgtggggaggttgtcaatgtgattagcccatttgtgtttgctaattgatactttttgaagttaggcccctactcccaaacagagactagcagataggggctgtgtctttcttgatgattatatttcaaagagatagctcttgggtgcttgagaaggacatttctgggttgtaaaataacaaagaggctggggaaaaaattacatctcaagaagcagagaaagaatttacagttgtaagtgttctaaaataaatgctttaggaaaaagaaggtcggggcctatcttcaggaagaagcctatctaaagtttggctaagctgaggtaactttaaggttaatgctgtcttcttcaattaccagaggaattcacagatctaaaaggtgttgccaaccaaacttcagaatggcaggaagcagaaagactgcaggtaccttggtggccagaagtctgtatgttttccccaatacaccatcattaagatgtcatcgttttctgtcctttgaaaattaccaggagcatcctttgacccaatttagatggggtgcgtacatattcattcattcatctgacaaataccaagtatctacaatctaccagatactgttctaagcactagggatatgtttatcagtgaacaaaatgttcaaaattctccatactaatgaaactcacattctagtgggaaagcaacatatagtaaccaaaataagtaatacaagtatatagcatgtagatggtgttgttttgtaagcaatacaagtatatagtatgtagatggtgttaagttttgcaaagaaaattaaagcaaggaaggggaatataccacatctacaatgttatagtccaatgtatggacccctagccactctggggctattccatgcatattctctgggcaattgctaggtatgagacaacacttatgacatggggaaataaccaaattggtgtatgttacacccttttgacttctatttctatgctatacaggctcattatttaccattaatttgcaaattaactgtcttaatttaagataattaaatgcatattaaaaatattttgaaaggctgtattataacatactagtattggtttactaatttagttgattggaaggttatgggtcatattttggtctatacttcttcatattttgtacattttcatcaatgggcatatttttaccttgataattagaaaatttttgatactttaaaagtttagcttcttatataacttaatcatcatcattataataatcacttttagtactaagcactttcttttttatcatcttatttaaaacctcaaaaatgagtctagggaagttgaggctagaatataaaagacctagtatgcacattaaagttttgacaataagagaaaattgaaagtgtttaatgtgaagactggcattataatatttattttgaaaaaaattaaaaaaacctgtaagttacacccagagtggaatgatttggggaggaactggagttgactatggtattgatggagggagacatgagtatagttacagagggaaggaaatagtagggctttgctaaagagaaaggctaaggagacattttggaacgaatgataaccaatatttcatttaactcacacttctgtaacaggggtgtccaatcttttggcttttatgggccacattggaagaagaattgtctttggccacacagaaaatacattaacaataatgatagctgatgagctaaaaaaaaaaaaaaaaatctcaaaaaaatctcataacgttttaagaaagtttacaaatttgtgttgggccatagttaaagtcatcctgggctgcatgtggcccacaggctgtgggctggacaaggctggtatcgaaccaaccttatattcctgagtgagagggctctagactgaaaactcccaagccctcttgatactgagctgtccatcatccccaaattccaaatgcctatatggatgaactccatcctcacatgtgtttcacatttttacagtgggatttctattatttttatatatttattttgcaaattatagtaaaaatttatcagttttaaaaacaaaaggaaatagttgaaaaacaaaggtctgcaagttgattgaaatactatacttttgctgtaggggagccattgtagttttaggaagttgtgttatattagtttcacctccattaaggcttttaacccagaaattcctctttttaaataatatcaaaacaatttccagtaaataaacactaggtgcaaggaaaataattatattagtatgatttccttcaaatttgttgagaaaggaggctccatagccttcgttctacagatgatcaactttgaaaaacagtggtaatgtggctgtatgctcgcatatgtcttttaattgactagttagctatttacttttctgcttgttgatgactttcctaattgaatagaaaagctatagttacccaccacaatataaaatattgaaaggtgatggagaaaaagcactttactagtctcttgggaaagaaaattgcatattgtgtctgtaattattttgctctctgaagaaatatatcagactgccatttctacatcaattttctggatatcgtgggacccattattttaatgtcaacagaaacaagctcttgtagagtttctctgccttttctatgctccagttaacctgagggacctttaagctataatttatagagaaagacaacagcataacacaaatgagttagagattgatttgtaagtcatgtaaggcatgcagagtaacaaatcgtggaccaaggcaatgcagatcagaaaagaaaagaaaaatctgcactcatcacactacctaaaagtggacatgtaatgggacgttgatttaataaatgtcacgaaatttcaaatagaccaatacttaaagcctgtatgagaaatataactaattgtttatccattcaatggctacttatagctcaactataatggggtcagacactgtgctgtgcaatggagatacatgagtgagcagagtagatgtggcttctgcacttacataggattgaaaatgaaataatcaatggtgataacatttgtagactatactttgagagctgtacaagaacatctcatttctttttgggagaccgtagaacaaaagtgcatgaaaaataagtaaggtggttaagtaagcagaaggtttagggagcattggaaagaggtaaaattatatgggaaggccagagagacaagtagtggcacggaactgaaggaagttcaggatggctagaatatggcaagtgttgagacgagtggagagccaggcaggcggcaggcagcaggctttgtatgacctgttaaattacaactgacacccaaataagtccaagtgcattcgtctttctaggattatttatcaaattcctacattttttcaagctgtttaagatacaaagattaaaaaagaacgattttttaacctatcgcatctccaatttggtgtaatagaaagtgaaataaaaggatgacagtaatacagagtaaaaagtgatatgaatgtaaaagccagaagctgctaaagaaacagaagaaggaaagtcaggaggaaggtctagagcctgagaaagacttaagaggtgattcttgggttgagtcttaaaggccatcggaagctggtgaagcagaggagggaagaacagttgaggcagtagtaccgacgtgtccagtggcttagaagcacaaggaacaagatttgttcagaactgcaaggggaatgcttttattacagtagcatttgtcaaagtgtgcctcagtaaacaatctgcaagaggatctggagacactctgtgtacttcttggaaagttacaatgcctattagtgcagtaagggatctgaaaatatccacagtggggagtgctgtttaactttatttcatatggtgtttttcagaacaatttgaccacagaatttcctctactgtcttcttttagtttaaaacctattaacattcattaaatacaccttgaagttgatattagaacctagactgggtggtggaggaggtcagaggatggggctacagaaggtcagatcatgaagaccttggtctgccaggcagatcgttagtgtagaacgcacccatttccttccaggtgaaaggtactccattgatgtggcacatccaactttactcactccacgctaatggggttgtggggagtgattcatatgaaaggtaaatttaggaggagttaaatgagagtatcatagctgtaccattcctcctcttggagtgtgctgccagctgggagcacctgctccaggtgggaagatttgctctagttcagcaccacctgggtctgggagggcaattttcctcttttgggattcaatattaagaggtgcatttgactgtaagaataaacaatatttccaacatagtttcattggcaataagggagatgtcttagttagccattcctcattcattgttttatttctcaatctcttcaacattttttataggcaaggaggtgatatgtgttgaccttcatgagatccagatattgaggattttgtctttatcctgtagataattgggaaccactaaagtattttaacagaggagtgacattgccagatttgcatttgacggcttagatagcagtgtagaagatatattaaaggaggaataaatagagtctgagaaaccaatctaaaaggacagcagtaatccagacaagaattaatcagatcttgaactacatcaatggtagcaattcattggagaaggggatgaatatggaatacacataggaggttgaatgaacagaattaggagactgattagatgtatgatatttgagagagacaatctagcacaactctcagatttctgaatagagctggtttgcattaattttggtggaaatgaaaaactagttctagcagactgagtgggcatgccttaggaatccaactggagatgtctaggtgtttgttgtatatacctgtctgcattccagagacatttatagtctagaaatacagacatggcagttgttgattaattcgtggtactcaatgtcatgacatcaatcaggttctttaggagggtgtgtggaacaagaatactacccagtatcaatactgaatacttattacatgcccactatgtaccagcattacattaaacactttacacacatgctctcatttaattctcatgaaaactttttaaggtgagcactattacactattatcatcactttccaaatgaaacttgggaaaacagacggactagaaatggcatcctaggaacactaacatttacggggcagttgaagggaagaaataaacagtaagaaaagaaaaagtggttgaagagaaaataacttttaacacgaagcatggtgctgaaataaaagaagaactggtcaacaatttcaaatacttcatagatgtgaaatagaagctgaagagtttccacttgatttggcaactaggaatcatatttattgtgttcataaaccttcccatgatatataatatatacacacacacatatgtcactctgtcacccaggctggagtgtgctgctatgatctctacttactgcaacctctgcctcctgagttcaaacgattctcgtgcctcagccttccatgtagctggaattacaggcacgtaccatcatacccggctacatttttttatttttaatagaagcggattttgtcatgttggccaggctggtctcaacccctgacctcaagtgattagcccaccttggcctcccaaaatgatggatttgcagccgtgagccaccgcacctggcctcccatgatactttaaaaatacttgataaaatacacttgtattcagtaacatacacagatggtctttgtggtttgctattttaattattttttacaggggacgtatattcagagagttttgctatgcaatgctctttgacaaatttaactttattcagggttgggggttaagcctgctatgggattaaagaacagaaaaccacagggctctcattctcttattgtttcttctattaagggtcaaattcaggagcatagtgtacaatagcaattattcgtcagaaactcagttccctgttagaattctactcagaaagtaaatagaaaaaaaggagaattctatatgcatttgggggaagagacatggtcgatgacctagaatttgatgaaaatcacctacctgagagtcagattgattattaaataaattagcaccaatcaaaacttctaaggcacagagctaaatgagcttatgaccctgtacattgagggagttattaggatgctaaatcttagaacaagtctctgcatgcatgagttttaatgaagcagatgtacaagcagatgaacattattttaagaagcaatcctctccaaaaaacaagataatattgtagttttatcagcaattgtttacataccacttgatttctagatttaacgctgattaacaatgcactttcttttataatctacttttttatcattggtctggctaatttataagattttgtgtctgtgtgttccttctgaaaacagtagaaaaatgatattgtaacaataaatatggagcttacacaatgggaaacaaggaagagaaatcttaacatcaatggcagagttaatgtagaattgcagaatgcaggcccaaagtaataaggataaggtgacaatcttgatctggttaagagatatatagtacctcacgcattatgactgtcctgttacttggagtcgttgacaactgactaaacatagggacacatttggtattcttttgcattcagcagaatgcagcagaataagcttggcagatataaaaaaacatttatgttcctccttctgcccttctccatccccttttgaagtgcctatacacaggggctttgcctggggatttcccagggctcctcctgccaaacaagctcaggcagggcagaggggtctcaaaatcctgaggacttggttgtgaatttggagtctgaattatttatctgttttcattcctagcacatttgcctatttttttcttttattcaaaacagtctatttaatttctgaaatgcaaaagaatgtttggcatggataaatagctgtgatttctctctctgataaatcttgcaatgttagagtttaccaaagagaacccacatattcttgtcagtagcatgggctttggagtcaggcgactaattctagatttactgcttattgctcatatgagtatgagcaagttactatactactgattctttttttaatgtctaaaattgagttaataatgtttagtatatattcatgaaaaatataaggagttattgtgtacaaagtgcataagacagtgtctaatcctcagaagacactcaataaagggagtctaccttagagttgagctgtcttgagtccaactacctgggataaagtctggactccatacctagcagctatgacttttgctaagttatataacatttctctgcctccatttccttgtttgctaagagggattcataatagggtctactgtgtaagttcatgagaagattaagtgagttactacataaagctcttagaacagtgctagacatagtaaaatcttaataaatgtttttgatgaaattgattatataaaaattactatcagcatgcagtgctgtcaaaggtataatggaaaactataatgaaaacttgatttctatccaaggagcttgtgctaaacagcaaatgtgttcatttttaagggttcactttcctttcctcattacttttgaactctgttcattacatttgaactttgtctagtgctttgaaatgtgaagatcaacataattttaatgatctcatcaactttatgcagtagatacccctctgagcctgggggagatgggagtttaaatccagagacagacatgtctgtggtcttacagcaaagtaatggatgctctggtactgtgtttatggactttttacactgagtccactgcttagtctgattagttcacagtccttcataaagaatgtgagcatgctatccatccaagggtttatataaactacaaagacagcaagcaagaactaaaacagaaccatttttaatgcacactttttattgttaatgcaagcgacatcatgcagaaaataacatatctcattttccaagcaatttaatggtcttccagttatcatttgacaggatcaagctataaatctgtttttatacaatttgaggaaggcttatggaatccattatttatttcatttttttgtaagatctaagtaatattttttgtagttaatgagctgccaaacatttagttttcttagtaaaatctgagtatatcattttacttgttgaattttgatggatacttatttgcattagattataaaaggttaatactgaatttcaaatcagtgcagagtcagtttctattagtacctgccatcatccttgctagtgcataatccttcaggctatataaacaccagtggcctttcttgatttaaatgaagcagagaaacattgttttagttcagccctaaaactgaacccctcatataatttctaggagttttcatgggatataaaaagagaatggggctgattcagatattcttctagctcttatggaaggtaaaattaaaacaataaagttataattaatgaaatacaacattgtgcaatggagagtagagctcttgcgatagctcctttgtcttggagggctctctgtgcctggggtgggataggatgggaggggaagcttttgcacttagatgactttcttcacttttggggcatgataaatctgtgtcccaccttttaaggtagtgatgctggatgaccagtatcacatctgctatagttggactgctggtgtggaaattgctcttttggactcagtttctgatgttatctgagtagcacctctgcagccaacctaaggcaagaggtctacccctggaaagcatcctggctgtgtcagggctgccagttcttgggtctgcatttctgcttccaaaattgcttgtgcacttattcctggctgttgggagctgcttctcatcagaccactgcacaaggtgtcatttcaactaatgatatagtagcatttatatttaaagggggtggatatatttttaatattttaacagatacatagctttttttttttccagaaacaaccatacacaccaaccaatacagacaatgacaacaaggctctccattaggatgaagcctcatatctgatgtttaagtccagaaaatgtcattcctagatatatatacacagatgtgtttttgtatgagtaaattatcaagtaaactataatttttaatatttggaagatgattatcatatcatttgaagtgcttttcactgtaagttacttttatggaaatagtattgtgaaaaaacttatttcttaatgcaacttataagaacaaattcttatgtattttaattttatttttaaaaactatatttttctgaaatatgttataaaatatgttaaaatatgtctgtcacaggtatagattattaaaaaataataaagcttttatctgctttttacaatacatttttctttggctgtagtctataatatcattttatcataaaacaaagcccatcaacactatctaaaactagtactgaaaaagaaaaactggtatatagaaattctctatgacttcgtttgtttcagagtagcatttgacataaaggtcaacattgactaagcccttgcattatcaatatattcttccagaaaaattttggcaacaacataaaacaataggatgttttaaaattattaataatttcataatctgctttaaagatagtctttgaggaagactttctctaaggaaatacctttaaaagtcaaaataaaaatctgtaatcctatctgcatggtagaatcaaaaggcactgagtcttgaactaataagggatagggggaggattcttgaagtacatgaaacttcatttatactatttttaaaaaaaacagaaaataccataaccagacacagtgccccatgccagttacaaactccaggatgtattatcgtggagaacactctttgatgattggctatgtaaaggtgaaagtggattacacattttggaactacaacagggtgtattttctatgacacaaacatctcgtgttaaggaattggcttaactgttctaacaaaaaggtcttaaaatgaagtggcatcatcaatgttgtcttcattgttatcatcatcatcatcatctagattttatttttctcttgtgtgacagattagagaaaagaggtttgggctggagggagccaattcttcatgaggatattcaaggactaaatttgcttccattatgttgctctgtcatttcctgggatatggtcctggagtcaagggagaatgacaggttaccttcacatatgttttctagcctgcaagcaaaaaagaaagagtggaagtgaaaggaaaacagtttaccctttatgcatataatatggaagttacccacatcaccttcatttagtggaatggcaagaacttacaatcgtagatgcaaccagctggaagggaagcagctatggcacagctaacgcttgcagatagttctaccacaaaaattatgaaaggaagactgatacttcacaatctgttctacacttcttaataacaaagcaaggttgaagaatatcaaaaaggactaataaaattataaaatatggatgacctgtttaataaaataaatagagaaggtggacagcaaaattattaaacagaacaattaagtacacataaaatcagtctaaagttttaaaaataggaaagatagagatcttgaattgttagaaataataaatttgatgagttttaggttgactgaagaattctctgaagattttaaaccaatttctacagtactcagtataacttattcagacaatgtattttgtcagatatgccttacaaaagtaattcaacttatgtaagcacatatccacatctaagtactgaagaaaataatgtcatattgttaaaacagagtacacatttcactagtttattcaacatggtaaagctcttgaacaaaaaaggtctttctaaaacacaatcttagattcttattttttgcctacttcttttgcatgaattagaaatgtaaaatcgagagtaaaactaaagacaaaaatatgatgataatacgatttcattagattatgaaacaatttcaaacttacgtcttggtgtgggagaattactctgaacagggactcttcatggagtccagagatactgggagtcttcaaacacatgcaaagtctttctaaaacataatcttagattaatattttttgcctgcttctccttttgcatgaattagaaatttaaaatcaagaaaaaactaaatagagcatagaagaatttttctaaatttggataataatgcttagatataattaatactcagaatatgttgaaacagaaaatgataaatgattgtacattgcagctaatagtatttcaccatttaattattcaatttattaaagctttgtgatggtaaaattgtatttaatcactaaggtttattttcttgctgctctcaccattttaaatatttgaaaatgtctgctttaagtatctgcataagttggagaaatattaactagcataaagtttattttttaattttaaaatgatgctgatgataattttgtggtagttgttttccctgttgatcataaattgataaaaacatagaggttttggatttaataagagacagatgctgtctgaatccatttgtgctgctataacaaaatatcttaactggataatttgtaaaaaacataaattaatttttccacagctatgtaagctggaaagcccagattaaggtgctgcctggtgaaggcctgatctctctgctcccaaaattgtgtgtcttgatgctgcttcctctggacaaaaggaatgctgtcttcatgtgacagaaggcagaagggcaaaagggagggaagtgctatggtttgaatgtgttgcctccagaattcaggtgttgccaacgtgatggtagtaagaagagagacctttaagaggtaattaggtcacaaggactccttccctcctgaattggattaggtccccttataaaaagacttgatagaaagagtttgtctcatttttcctttctgctttctgcaccatgtggggcccagcattcctgtcctccaaaagatgtagctttcaaagcaccattttgggggcagagagagcagccttcaccacataccaaagtacacagtcttaggtattaatattttgttatagcagcacaaatgaactaagacagatgttttcttgattagaaagatgaaaaagtagattgaactaacaaatgtacaatattttggtattaataacatctcatttctgagataagctttgtaacataatttgaaatcaggaagtgtgatgtccccagctttgtttttcttgctcaagattgctttgcctattcaggatattttctgcttccatatgaattttagaattgttttttccatttctgtaaaaaaaaaaattagaattttgatagagattgcattgaatctgcagatcacttcaggtcatatgaataatttaatattaatttcttcaacccatgaatacaaggtatctttccatttatttgtgtcttcttcaatttcctattcaatgtgtacagttttcttacctccttggttaaatttattcctaagtatttaaaatattaaatatttttttgttgctgttgtaattgacattttttaaaatttctttttttcagatattttgttagtgtatgaaaatgcaactgatatttgtaggttgattttgtttcctgcaaatttattgaatttgcttattagttctaacagtttttttgttggcgtctttagggttttttttaaatataagattatgtcatctgcaaaaagataattttactttcttatttggatgtctttaatttctttttcttgtataattgctctcattaaaacttttactattatgttgaagacaggtgagcatccttgtattgtttttgatcttagagaaaaagttttccacattttactgctgagtctaaagttagaggtggtcctgtgatatatggtctttattgtattgagatactttcctcctgtacctaatttgttgagaatttctatttttgaaagaatgcctagttttgtaaaacgctttttcagcatttattgaattgatcatattatttttatcctttattctgttactgtggtatattacattgttgatttgcatatattgaatcatctttgcacctcagggataaatcccacttaattatgttttgtgatctttttaatatgctattgaatatggtttgctgatatttcattgagtttttttgcatccatgtttattagtggtaatggcctgtaattttatttttttgtaaagtctttgtctttgctatcagggtaatgctggcctcctcaaataagtttggaagtgttgtctcttcaattgtttgaaagcagttgagaaagattggtattaattttttttaatggttggtaaaattcaccattgaagtcatttgaccctagatgttttttcctttttgttgggaggtgtttaattactgagtcaatttctttactcattgattaatctcctcagattttctatttctccatgaatcagttctggtaggttctatttttctagaaatgtatccattcttgtagcttatacaatttgttggcatataattgtttacagtagtttttttatgatcttttgtatttctgtggtatcagtcgtaatgtctcctctttaatttataattttatttgaatcttctttttctttagtccatctaaagtttcataaattttgtttatcttgttaaaaaatctcctactttcattgcttttttctgttgttttgctagtctctgtgtcatttacatatgctctaatatttattactctcttccttctgctaactttgggctcagttttttcctttccacattccttgaggtatgaaggtagtttatttatttgagatcttttgttttacttaatgtatgcattgatagctactattttttttcttagaactacttttgctgcatcttataagtttgatattttgtgtttccattttcataagtcacaagattttttttttacttctcttttgatattttcttttacccattggttgttcaggagtgtgctgtttatttccacatattgtgaattttccattttttcctattttcatcctatcatgatctgaaaagatacttgattaaattcagtctccttaaatttgttcataattatttgtggcctaacgtatgatttattctgaacaatgctctgtgtgcacttaagaaaaacatgtattctgctgctattaaatggaatgttctgtgtatgtctgtaactccatttggtctgtaatgttcaaatctgctgtttctttattgattttctgcctgaaagatctatctaatagtgaaaatggggtattatagtcccctactgttattatattgctgtccaattcttctttcagttgttaatatttgctttatatacttaggtgttctgatgttgggtgaatatatatttacaattatgtcctctcaatggatcgacacttttgttattataaaatgaccttgtttgtctcttgtgacagtttctgacttaaaatctatcttgcttgttacaagcgcagccacccttgctttcttttggttaagatttgcattgagtaggtttttccatcccttcactttcagcctatgtgtccttaaagctaaagtgattttctagtaggcgcatatagttggatctcgtgttttatgatcagccactctgtgtaccaagactcattcataactccttctttaccctagcactcacaatgaataagtcactaaattctgtctaaacttttttatttttttgcattaccacttggtttttatttatggacgttcacctattgtttatttgccgtcatatataaagcattattataaacaaattttttgtctacatttttatgtcctaaatatatctctctagaagtaaaatttcaaagtcagaggatatgaacttgtggagcaaaatacagtttctaggcattgtgaaattataaaaatgaataaaccgtgactctgagatctacattcacgtattgaattgtcattttgaaggccttataagggcatcttctaccatatctgaaataaaactaactcttggtttcctctgctgatctgtcccactaataaaacctcttaaactgttctttttcccttcctctctctcaataaatgagactaggaattatccagatgagtaagtgacaaacctaagcatcatacttgatgctcatacattctgtcccttttacaccactgtatcagtaagtcttttcaggtccatctccaatatatatcttggatctgtctgcttggttccatttttactgatgtcgcttgtctccaggtcaccatagcttctcgctttgatacttcaatagcctccttggcaggtttgtatcttccactacttctgcatgccagcctagtatttacatagctgctgaaatgctcttttcaaaacacaaactgatttcatttgttgccccattaatctgtttattgacttagcattgctcttcaaatagaatctaaactccttaacaatgttacacatggcctgagggatctggcccagctcagtttctcaatgttcattatttccaaagtccagcccttctcacagttctctggctctttcactttcttgtcagttcctctttgttcctcaggttttctgatatttgcacatgtttgtttctatttggacagttctttcctaactaggcttgttacaaaattttatgacagcctccgttgcatattttgtttacccttgcatttctctgagagatgcctgctatgaacaccctatgtcaggcattctgcaaccccaccacaaactcataattgttctattttccagtatagtatgtaactatatatttaatttttttattacaaagggaattatatcctatgctcattctgtcattttgaacagttctcaaagttattgctgaagcttaaccaaaatgaatgtagatagcaatgtgaccatataaaatattttacatttttgattgtagaaataatatgtttattgcaaaagaaagtaaaaaatacatggaaatattaggataaagtaatatttaccttaaatcccacaactttgatattgtaaccattaacacctctgtgcctaccctttcaaatttttatttttatattcaatcaagcacatttatacttaaataattgaggttataacaaacattctttgtttctacggacatttctttgacacgtgtataatctgcagtgatcaaatcagggtacttagtatatcgaacacctcaaacattgatcatttttttgtgtcagaaacattcaaaatctgctttctagctatttgaaattatacagtaaattgttatgatcatccttcaattatacagtaaattgttgttatgatcattctatacatccttcagtgtatagaacactagaacattttttgttgttgttgttttgtttttagatggagtctcgctctgtcacccaggctcgagtgcaccaaatatcaaaattttaaatagacagaatttttatgacactgcattttttttcagtgggtttaacttcctagcatcccatgctttctgaaccacctggtggtctggttctcgcaaggtggatttataagagttgacaatggtatgtgaaccaactggataatgcagggctttatacatactcatgtttttttattatataatttttattaagaggttttattttccacttggatcaaaatatgggaggatatttggtaagtaaatatagtcatgtgtcacttaacaggagtaattctgagaaatgaattattaggtgcatttttattgtgccattttattggcattattattgtgccaatgtcatagggtatactttacacaaacctgataatacagcctaatacatacctaggctatataacatagctattgctcctagattgcaaatctctccagtatgttactataggttattgtaacacaatggtaagtatttatgtatctaaacatagaaaagatacagtaaaatatggtattataaactcatgggatcactgctatatgtgtatcccatcattgaccaaaatgttgttatgcagtgcatgtgcatgactgtatatgtatgcacagttttatttttgcttcagtttgccttctggatccacactggcattgctatggatccacatggcactgctagaagaataaatatatgaacacatttaaacatccataaagtatgattgcgtatctatttaaattagttttttatttttattttatgggttcatagtaaaagaatgtatttatgggttaaatgagatattttgacacaggcatgcaacacataataatcacatcagggtaaataatgtatccatcacctcaagcatttattctttgtgttatgaacaatccaatatactctttcagttatttttaaatgtaccattaaattatttttgactatagtcaccctattgtgctatcaaatactaggtcttatttatcctttccatttttgtatacccattaaccatccctacttccccacccccgactccctctgctacccttcccagcctttggtaaccatccttctattctctatctccatgagttcaattgttttgatttttagctcccacaaataagtgataacatgcagtttgtctttctgtgcctcccttatttcacttaacataatgacctccagttccatccatgttgttgaaaatgacaggatctcattcttcttttatggatgaacagtactccactgtgtatatgtgccacatttttaaaattcatctgttgatggacacttcagttgctccctaatcttggctattgtaaatagtactgcaataaacatgggcatacagatatctcttcaatatactaattttctttcttttaggtatacacccaggagtggggtcgctggattgtgtagtagcaccctttttagctttttgaaaaatctccaaaccactctccatagtggttgtactactttacattcccattaacagcataacagggttcccttttctccatgtcctcaccagcatttcttacagcttttggataaaagccattttaactggggtgaggtgatatgtcattgtagttttgatttgcatttctctgatgatcactgatgttgagggccttttcatacacattttccatttgtatgtcttcagatattgagaaatatctattcagatcttttgaccatttttaatcagattattaggtttttacttacagaattgtttgagcttatatattctggttattaatcccctgcagatattttctcccattctttgggttgatacttctttttgttcattgtttcctttgctgtgcaaaagctttttaacttgatgtgattccgtttgtccacttttgctttggttgactgtcctcgtggggtattactcaagaaatcttcgcccaccctaacctcctcgagattttcaccaatgttttcttgtagtagtttcatagcttgaggtcttagagttaagtcttcaacctattttgattttatttttgtatacagtgagatttaggagtctaatttcatttttctgcatatggatatccagttttcccaacaccatttattgaagagactgtcctttccctaatgtatgttcttgacacctttattgattatgaatttactgtagatgtgtggatttctttttgggttctctactgttacattggtctatgtgtttgattttatgccagtaccatgccattttggttactataattctgtagtataacttgaaatcaggtaatgtgattcttccagttttgttctttttgcttaggatagctttggctattgtaggtctttttgtggttccatataaatttaagaattgtttttcctgtttatgtgaataatgtcattagtattttgatagggaatgtattgagtttgtagatgtagattgctttgtgtatttatggacattttaacaattttgattcttctaatccaacatggaatatatttcaattttttggcctcttaaatttcttttatcaatgttttacagttttcattgtagagaactttcacttctttagttaattcctaggtatattttaactttatttgtagctattgtaaatatgattattttctggatttctttttcagactgttctctgttagcatatagaaatgctactgatttgtgtgtgttgattttataacctgcaactttactaaatttgtttatcagttctaatagttttttggcagagtctttatataagattatatatattccaaatataagattatatcatctgcaaacaaagataatttgacttcttccttttcaatttggatacccttaataaactttctcttatctgatcgctctagctagaacttccactactatgttgaaaaacagtggtgaaagtggggattcttgttatgttcccaatcttggaggaaaggcttgcagtttttcccaatcttggaggaaaggcttgcagtttttccccattcagtatgatactagctatgggtctgtcatacgtggctttcattatgttgaaggcatgttccttctacacctagttttttggtttttgttatgttgaggcatgttctttctatacccagtttccttgtatacccagctttttgagtatacctatcttgaagggatgttgaattttatcaaatgctttttcagcatcgattgaaatgatcacatgttttttcccatcattctgttgatatgatatattacattgatttattcttgcatatgtttaaccattcttgcatccctggataaatcccacttggtcatgatgaatgatcttcttacggtgttgttgaatttggtttgctagtatttacttgaggattttgcaccaatattcatcggagatattggtctgtaggtttttttgtgtatgtgatgtgtctttgtctggttttggtatctgggtgatactggcttcacagaatgagtttagaagtattccatcctcctctattttttgtaatagtttgagtaggattggtattagtgcttctttaattgtttagtattaatagaattcagcagtgaagatatcaggtctcaggcttttctttgctgggagacattttaatatggctttgatttcattactttttgttctgtacagcttttcgatttattcctggttcaatcttggtaggttgtgtgtctctaggaattttgtcatatcttctagattttgcaatatgttggtggcatatagttcctcagagtagccactactgatgctttgaatttctgtggtattggttgtaatatctcctttttatctttgattttatttgggtcttctctctttttttcttagtctggccaaaggtttgtccattttatctttaaaaaaaaaccaactttttgttttgttgatcttttatattgtttccttggttcaattttatttatctctgctccaatttttattatttctttttttctattaattttgggttttgtttgttcttgcttttctagttctttaagatacatcactaggttgtttatttgaagtttttctttttctttttctttctttttttttcttttttgaggcagagtctagctctgtctcccaggctggagtgcagtgacatgatctcagctcactgaaaccttcatctcctgggttcaagcaattctctgcctcagcctcccaagtagctgggattacaggtgcccaccaccacgcctggctaatttttcttttttttgctagaaatggggtttcaccatcttggccaggctgatcttgaactcctgacctcgtgatccacctgttttggcctcccaaagtgctgggattacaggcatgagccaccgcgcctgggctgaagattttcttcgcttttgacttacagctatacacttccttcttggtactactttcactgtatcccaaaggttttgtgtgttgtgtttccattatcatttgtttcatgaaattcttcaattttcttcttaatttcttcaatgattcaatggacattcaggagcatattgtttaatttccatgtgtttgtatagtttccaaaattcttcttgttattaacaagaagaattcttgttaataataataagaattcttcttgttattaactggctttctttcattgtggtcgaagaagatgcttgaaattatttcagtttttctgaatgttttaagactggttttgtgacctacatatggtcacatgtcaagaataatccatatcttgaggtaaagaatgtttattctacagctattggatgaaatgctctgtaaatatctactgggtctctttggtctatagtgcagactaaacccgatctttctttgttgattttctgtctggaagatctgttcaatgctgaaagtgggtgttgaagtctccaggtattgttgtttgaggtctctctctctctctctctttagctctaataatatttgctttatatatcttggtgctccaatgttacgtgtatatatatttacaattattatatattcttgctgaattgacctgtttatcattatataatgatcttctttgtctcttgtattttttgtcttaaaatttattttgtctgatataagtataactactcctgttctttttttcatttccattggcatagaatatctttttccattcctttattttcagtctgtgtgtatctttataattgaagtgtgtttcttgtaggcaacagattgggtttttctttttactgtccattcagacattctatgtatttttattagcgtatatagttcatttacattcaatgttattattgataactaaggatctaattccttccattttgttatttgttttccggttattttgtggcctttctcttccttctttcttttctcccttttagtgaaggggatttttctctggtcatatgatttaattttttgccttatatttttgtgtatttgttgtatattttttacttgaggttaccatcaggattgtaaatactaccttataaccattattttaaactggtaacaacttaacattgcttggataaacatacaaattaactatgaagcaaaaagaaaagtaaaaaacactacacttatctttgtcttcccactttttaactttttgttatttctatttatatctcattgtaatgtctatgtcttgagaagttgtagttgtttttgattggttcattatttggttttactacttaaaataagaggagtttacacaccacaattacggtgttataatattctgtgtttttctgtgtacttactattgccaatgagttttataccttcagatgatttcttattgctcattaactttcttttctttctgattgaagtactccctttagcatttcttgtagcataggtctggtgttgataaaatccctcagcttttgtttgcgtgagaaagtctttatttctctgtcatgtttgaaggatattttcactgaatatactattctagggtaaaaagttttttccttcggcattttcaatatgtcatacctgtaaggtttccactgaaatgtctgctgccagacctattggagctccattatatgttatttttttttttcgttgcttttagtatcctttctttacctttgggagtttgattattaaatgcctttaattaatcttctttcagtaaaatctgcttggtgttctataaccttcttgtacatggatattgataactttctctaggtttggaaagtttctgttattatttctttgagtaagctttctatcattatctctttctctgccttctcttcggggccaataactcttagatttgctcttttgattctatcttataaatcttgtaggcatgcttgtttctttttatttatttatttattattattattatttttgatggagtctcactctgtcaccaggctggagtgcagtggcacgatctcggctcactgcaacctccacctcctaggttcaagcaattctcctgcctcagcctcccgagtggctgggactataggcgcacaccaccaggcccagctaatttttgtattttttagtagagatggggtttcaccatgttggcctggatggtctcgatctcttgacctcgttatctgcccgcctcggcctcccaaagtgtcaggattacagacgtgagccaccacgcctggcctcttttttattcttttttcttttgtcttctctgtgtattttcaaataacctgtgttcaagctcacgaattctttctttggctgataaattctgttattaatagatttctgatgcattcttcagtatgccagttgtattgtttaactctaaaatttcttcttgattatctttaattatttcaatctctgttaaatgtatctgatagaattctgaattccttctctgtgttatctttaatttctttaagtttcctcaaatcagctattttgaattctttgtctgaaaggtcacatatctctgtatttctgagattggtccctggtgccttttttagttctgtcaggtcatcttatcctggatggtcttgatgcctgttgatatttgttggtgtctgggcattgaagagttgggtatttattgtagtctttgcaatctgggcttctttttttaacttgtccttatttggaagctttttcaggtattgaaaaggacttgggtgttgtgatctaagccatgccttcattaggggaaccccaagcccagtaatgctgtggttcttgcagactcatagaggtactgccttggtggtcatggataagttcaggaagaattctctggattcccaggcagactcttgttctcttccgtaatttctcccaaatcagtgaagtcttcctctctgtgctgagctgcctggtgtggagactagagtgacacaagcaaccctgtggccactaacactaggattgcactgggtcaggcctgaagccagcacagtactaggtctcactcaaggccctctgataacacaccctggctactgcctgtgtttgctcaaggccctatgtctctacagtctcaggtggtaaagccaactaggcttgtttccttcgcttcagggtgttgagtttccccaggctttgttgagccaaggccttgaactggggaccacaagtgcctccttggtgctctgtctcactgtggccaagctggtatctaaggtgcaagcaaagtctcctttactttatcttctgcttttcttaagcagaaggagtctctctccagagtcaccacagctgggaatatgctgggtcttatctgaagtcagcacatctcagagtctcacctaagacccatggtgtactgcctgggtattattgctgcagttattcaggacccaagctctcttcagtcagcaagtgatgaatcctgccaggactaggtcactcccttcgaggcaagaagttcccttctggcccagggtttgtctagaaatgtcatccaagagctaaggccttgaatgggagctttgtagctctgccccctgagtggccatcaagaagcaagacaatagtcttctttattcttccctttcctcttctcaggctgaaggaaggggtctcttttggagccatcagttgtattgcctggggttggccatagcagttgtgcatgcactcttttagctgccttctgggtgtctcagttattgcctgccccccaagctcgctggctccaagccaaggtcagtaattggaattttagtccttgtgtcctagactgtgtttcaagtttatttagagtcctagagcatttcagtctatggtggccaggcttactggaactcaagttctgagtgctgggatgggtgattctcctctggctagggcgggtctgaataccccctccattggtgggggtcagctgagttcagcccagttttgtcttctgctgtgatagggcagcactgagtttaatgcaaggtctcacaatcactgcactgtacctctcccaagtgcagtgatgccacgtgaccgctgcaggggcagggtgggtgatgggaggggttggcattgacaattcaagactgtcttttctaccctcttctgtggttctttgaacaatatgaagttaaaaccaggtactgtgagtgctcacctgattttggttctcatgaaggtgcttttttgtgtagatagttgttgagtttggtgctcctgcagtgaggatgattggtggggccatcttgctctcccccctctgtatatctttattatgttctttagtattgaattcaaataacaaacccagtaataggcttaattaaatcatatttgcattcaatatcatctgccaaggaatatgtcagttgttaactcagaatgaaactgatttttcataattcttactagggatatttcctcacttttcagttttaagttagtatttttttttttttttttgagatggagtttcactcttcttacccaggctggagtgcagtggcacaatctcggctcactgcaaccctctgcctcccgggttcaagcaattctgctgccccagcctcccgattagctgggattacaggcgtggcccaccacgcccggctaaatttttttttttttttttcattagagacgaggtttctccatgttggccaggctgctcaaactcccaaccacaggtgatctgcccgcctcagccttccaaagtgctgggattacaggcgtgagccaccgtgcctggctttgctagtatttttaatacaaaggatactttttgtttattcttattatttctggcttcatattttatgaaagtaaatcaagataactataaacaatagtcatttaaatagaatactttaaaaatacattatcttttataatcttccttagagagaatgacaggattaggaagaaaatgatatctagaaccaggtttaagccatgtctgacactgccagtatgatcttgaaatctgaggctcatgttctttaactaaataataagaaaataccaactatataaatgtacagagttgttactaaggttaaatgaggcaatgtaagtaaacctgcactgaaaaatttaaaggttattcaaatgttaattatttttattgttttatgtattcatttctttcccttggagcaaatagagaaaattaaagggatataaagtggaagaaaaatgtaaaaggcaacctttaggaagaaatcatcatgatccaattgcaattgtatagatagttttgccacttaccaagaatagactcttgctatatcagtggttttattcccaaggaatctcacagtgttgaaaactaatttataaaataattgttccaatatggaaaaaaattgggagatggagaatttcatcctctaagtgatggaagtattttttcttcaagaattttaatactgaagtttttttattagcacaattgcatagttctaaattctacacattactgaacaaatcgagcattgataatgcacatcagcatctgctcaaaaatgtcttttattttcctaaaaccactgacacagagattaacacagtgctgcttataaattctttttcacacatttttatgataaataaaacacaaagcactcaagataaattttatttttacccagaagttctaactttttgttttaattgcattttaactagtacttatgagatagatgcaattaagttcttattaattgataatgttacattaaataaatatctattttttaatgttttaatgtagaagaattgcatgaattgtaaaataatcatagttttctaacatattagaaagaagaaagctatgaggagaattttaacaaatagtaggtttggctttgcctggcatgagtgtgggtagttgtggaaaggtacataaagaagatatataatgtaatgttgtatgaacagacatcaaagtacaatttacttgctttgagcaaattgtcatgaagcttaaaagcaatgtggaggaacttactagcaagtggaactatcttaagaaaaaaggtgaaataataattccttcaataaaaatctattgagcacgttctaaatgccagacactcttcatagtacagaacttaatacagaccatcttcattctgtgtttattccagtgggaggtaactgacaatacaaagaggaaaatacgtaatgtattggaacatgattagtgttatgaatgagttcagggatgagtcctgacaagagtagaggtggataattcagttgtatttagaaatactctgagaaagcctcaatgagaagttgacatttgagcagaaacatgaaggaggagagggggcatgcaatgcagatatctggagaaagaatatttgaagcagacaaaattggaaatgcaaaaatcccaagtcgagagtttgcttggtatatgagagggatggaaagaaggccaacatgatgactaaatggaaatggaaaagtgggaaagctttagatgcagtcggagagatagtttggcccattgtaaaacctcagccatttttacttggagtctgatggaatctagcgacaaacctgacttccattgcctggcatagtacagtattgagcaaaggtgtaaacagagggaatatttaagagagtactacattaatccaggtaaacagtgaggattgaactaggcttgtaatagtagcaggatgaaaagtggtaatattcccttgatgctaccttcaaaatatgtccagaatacacagggctttcacagaacccaaaggtagagtttcaccttgatggcaatagatacctagaaccaagatcttgaacatttcttctacagaaaagtaactgaatccctgaatagcttttgcttgtttgtttgtttgtttgtttgagacggagtctcacccttgttgcccaggctggagtgcaatgacgtgatctcggctcaccgcaacctctgcctcctgggttcaagcgattctcctgcctcagcctcccaagtagcagctgagactacaggtgcgtgccaccatgcccagctaatttttgtatttttagtagagatggggtttcaccatgttggccaggatagtctcgatctcttgacctcgtgatccacccgccttggcctcccaaaatagtttttataaaacagaaggatttaaagacttcaattgaataattgagtaaaaatatgcaggaaacttcgaagaaacatttttatcatatttggagttaattggagataaaagatattcataaaataatgtatagaattcgctttaaaaactgcagttttaaaacattagatataagtaccatttaaatatgattatgactttaaagaattatcttgaaggtattattttaaatggctgtctaatttttgctctcttaaagaagagtctaaatgtagatcttctactcagtataaataaaaggaaaacatggttaaatgccctctaaaataaggaattcagagtatcaactgaaattaaggctgttgaagcagaaataacttgataaatgtttaatggaagccaaatgtaaggattgatccaggaaggcatagcaacaagtcttggcacgacccagagttggctacaagttggaagggttttattaaagtttaagagaagaaacaggactccttatattggagttgtccttttacactgaaggtgcaatatagagtttataatcattcactacagattgcaacatataggctaaaatgtctacatacaagataatcagtaaaatttcatgatgcaaaaaatcaaatcagcatcgtttttaatgtcaggatttcatacattaatcagtatgtcaaaaactggagtaactccgataagattatttactaacaaacaggatgtcaccatgaatcacaagacatttcccaggagggctaatttggaagcttgccagatatgatctgtaggttatcagtagttaatgtaaaggatttattttttgtatgaagagtgagacatgtaaatagaaaacggtataaaagagttcaaagaaggaagcacgaagtgaaaacttaaatttctgaattgcttgtctgcaaatagaagccaagatacacatgagactgcccaggaaatgcatatagaaaaaaaaatacccaagccatgattactatatttcctgcaaatattagaaaagttagtgtggagaaaaactgaaactattcattatattttaagcatgaattggttgtttgcagaaatcatgaataaatatattctataaacatattttccatgtattttggaaaatacatattatatatttttatcaccttttactcaattatgactttgtatcatttctgaaagtagtttcaccaaaataagcctaatacgttactgtgtgttgtcttgtattattttctcacctattattggcatactccagttttaactttagataaaacaatatatcatggcatttcatgctttcacctgtacaatgactaagataaatagttggatgtgtcaaaaagtaactccggaggtggtgtgagcctgaaatttacatatttttgttatatattaaagaatatataatttaaaacaatacctataatttaatcacatatttgataatgtaaagatgaatctgtaccaattaaaacttagaattttttagcaaagaaacctaccccttattccacctggactaaaaaagaaggaaggaatgggaatgagggaggagtgtgtgtttgactctcaggcagtccatattttatgtactagggaatggggaaggaagttaggatataattttgcagaatagtgcacttcaactaacaatattgtttgcagctccactcctattttttattgattttatttgctgtaaacaagtatcgagggtctttggggttccacaaagcagatgggccaccatctctgctgcagctgcctctcctaatcctgctctgggctttgaatttctccactctgcaatctgtctatgctcttctattcactttcttcccccagaaacgtgctgcacactcatcaactgataacgtcctcccttacctccttgatgtttttatcattatttttatatttctatcatcattttaaagagtcattttgagaggagagtgatgaacagatctatgtctgcaggttgaatcaaaagcatctattcctttttaaaaatatattttcttaagttatgaatacacaataactgcacatatatacagtatgcaacttaatacatttgacatgtgtacacatctgtgaaaccatagttacaattgagatagtatataatatacaaataacagctccatctcctcacaaagattccttgtgcatctctacaatttcaaattttatttctttattagaaatatggccctgcaaattatctgtcttcttgggtgagactcagaagtttgtcaataattctgtccatttcattgaatttattggcataaagttgttcaaaatattcactggttaatattttgatatccaaatagtctgtaaagctgtcacctccctcactcctagtgttagtaattgtgtttttactactgtatgtcttctcagtgtggctacaggtttttcaaaattattgatcttcaaaaaaccaacttatgctttcattaaaatctgttgatttctgaggttttttccttgatttctactctgatacttaacactctgtttattttgcttaatttagatttaatttttcttctttttctagggttacaggtgaaagctgaggtccttgattcttagaactttcttctttctaatataggcattttgtggtatatttttccttttcatgtgtaaattggtttacgtggtatttattttttctcaacttttatttcagattcaggggatacatgtgcaggttttttccatgagtacattgtgtgttactagcgtttgttgtacacatgattttgtcacccaggtagtgagcatagtatctgataggtagttttttgaccttcaccctgctcctaacatctcacttgaagtatgccccagtgtctacttttcccatctttgtgttcatgtgtactcaatatttagttcccatttataaatgagaactgtggtatttggatttctgatcctatgttagttcacttaggataatggccttcacctatatccatgttactgcaaaggacatgatctcattcttttttatggctgcatagtattccatggtgtatatataccatattttctttatccagtttaccattgatgggtatttaggttgattccatgtctttgctactgtaaacagcactgtgatagacatatgtgtgcatgtctttatggtagaattatttatattcctttgggtatatatctaataatggaattactgggttgaatgataattctgttttagtttctttcagatattaccaaaccattttacacaatagctgaaataattacattcccaccaacagggtgcaagaattcccttttctccacaacctttccagcatttgttattttttgactttttaatgatagccattctgactgatacgagatggtatctcatcgtggttttgatttgcatttctctaatagctggtgatgttgagcattttttcatatgtttgctgcctgaatgtatgtcttcttttgagaagtgtctgttcatgtcttctgcccatttttaaatggggttgtttgcttttgcttgttgaattgtttaagtacctaatagtttctggatattagaactttgtctgaagcatagtttgcaagtattttctcccatttagtaggttttctgcctattcagctgataatttctttctttctttgtcctgtgcagaacctctttggtttaattaggttacacttatgtatttttgttttgttacaattgcttttggagactttgacatgaaatttttgctaagtcctatgttcagaatgtcatttcctagttttttctagggttcttacaatttagggtcttacatttaagtctttaattgattttgagttgatttttgaatatggtgaaagggcagggtccagttttagtctaacttacatggctagacagttatcccagcaccatttattgaatagtgagtcttttccctactgcttatttttgttgactttgtcaaagaacagatggttgtaggtgcacagctttatgtctgggctttctagtctcttttgtaggtatatgtgtctgtttttatatcagtaccatgctgttttggttgctgtaggcttgtagtttgaaatcaggtagtgtgataccttcagctttgttttcttttgtttgtttgtttgtttgtttttgcgctgtttgttttttttttttttttttgctaatgatggctatattattttcccacatttgtattgttttaccactttctttggattgagtttcagactcctcttgtatctcgatgagttttcttgccatccagattctgaattctatgtctgttgttccagccatttcagtctggtttaggatcattgctggggagctaatgtggtcatctagaggtaagaagacactctggcttttagagttgccagaattcttgtactagttctttttcatctgtatgggctgatagtcctttaatctttgaagttgctgtcctttaggtagggctttttgcttttgtattctatgatactcttgaggatttgattgtggtacatgttgggtttagttgattggtttcatttctggatgctttcagggggacaaagctcagttcagcattgctgggctgtatgctctaaccctgggggcactaggaccaggcctatcactttgttctgtggcactttggggtcaaacacctgctacactagagagcctggggcattcccagttcactggcgacaacactccaataagggctgccagcaaagcactgcagtagaatggcagggagtgccatacacgtgtgcactgcagcagaggtaatgggtctgtgctcaccactggggtggcgggggccacagatgattgtggccaatggggtgacagaaggggctgcacgcatgtgctcacgggttggctgttgggggtagtgtgcaccagtgggagaatgctgcaggcaggtttgtgccagcagggattcatctgcaaaagtgctctgataggaatgtaataggcagtgagcaaaagagctagcaccatggctgacggcaaactttttagtggggcagctgaggctgggtggcaaatgggtttggccaggcaggaccttggaagacaccagcagacagaggaccattcagatcagactgaccgcatgggaaagacagccctgctctctgcaggcccagctgctaataaacgctaaagccacctagaggaggagtatggcaagccttagttgtggacacccatgacagtgctcctctccagcctttcccacgccaaaccctctgggcttcatgcagactggagttctatcttgtccatctctcctggcagttttccctgccaactctaatgtccatgggggtcatggggtctcctgcagctaggatcctggaggtctatggctagagtgggctgctccatgcttatttcactcaccctttccctagaagccactgggggccaggaaggagtctggtgcttggcaacctaacttcctcccctttcagcctccgggtctacatcctccctatatccactcccaacacctgctttctgaagatctattcagagtctgctggtgtacttgatggcatggtctctctcagtgggagaagctcttcctggctgtgtctgtcagccatcttggctatttccttgtatattttcttatagctactattttagttgcatctccaagttttaatatgttgcattttcattttaatttattttaaagtattttaaaattatcttttgagttttttatttgacttctggattttcataaatatgttattttccgaatatatttgggaaattttcagagaactttgttactgatttctaaattaattatattgtggtctaaggatatactttgtatgatttttacaaatatactgaggtttgtcttatggtatataatacagtattgataaatgttccacatacaatcaaaaagaatgtatattctgctcttttttgaggtgattgttttataaatatcaatgagattaaattcaagccttctataaccttactgtttttctatttttctatcaattcttgaaaaatgatgttgaaatttgactacacttgcatattttttccgtttctctctgcagttttattagtatttacttcttcgcgtagtaattttttattgggtgccagttattttaattttaccttggtggctgctgaacatgtttatatcatcatacatagtgtgaactttgttccaaaattagttaagtttattggaaacacactgatactttcaaatcttgcttttagatattgttaggcaggatcagcacagcatttagtctatggcacatttttttcctaatgcataggtaaaactcatatgtggtctatcctatttcctgtgaattataaggtttctactctgctttttagaaacaagaactattcccaggtctgtgtgagctccagatattgttccctctaatctttttaggtgcttcagtttccggtccatgatagtttcttcacatgtgagcaatgataaatactcattaataattcaacagattctttttgaaaatctctggtgctctctctccctctctgcatttttctcctctacaataattttctctgggaactctgacccacgtaagttcctttgactgtctcctcagttatgtctcctcaattaaggaaactgtctggattccctcgtcccattctttatcatagaaattttctctcttctgtatactagagaaatcatagtttttaactttatttgttcctcgtttccaaggtttactgtttgtctttgcctgatgttcaatatctgcaaaacaattattttgcatatgttgtctcttttttagatgtttccagcaggtatttaaatctatacttgttaatccatatttaacagaaacctacgccaaaatgtatttattctaattttaatttttttctatagtaatttggattgacatataattaaatacctatttgatattcttacttggcgtatctcattttccatatctaaagctgaactcttgttcattctactaaagtttttcttctgcagccttcctcatctcaataaattctgcataatatttataatttcataaaccagtaaactggcagtcttcaaagatttcttctctctttagccaatctaatcaagcaccaaaaatatttcttgaccatctcctgaatttacaaccatcattccagctccattctctaccctattcctagttattatccttttccatatctacttcaaacttctccaaagttaaaagaaacaataaacaaacaaacaacaaaaataaatgagagaattcttctaaagacagttgtatacactgctgggagaaactaaatataagcagctctttatatcttattttaatcaatgaaccacaatataatgtacctacttataatttattaaaaatttaattcctattttaaatttctttttgaattcttattttaacttatttatttaaataaaaattcccattttaaatttattattgaaatatatagtgtaagtaattttttaaaaatggtttgagggactactacaaacgcatgcatatggcaagattgttaaaatggaaacaaggaagcaaaagttatggacaaaaggaagggagatatactaaccaccttagctgacctagctgatctgtcgtagcattaaatttagcttagagatttttgggcatcccaaaagcaatagaagtggattaattatcattgatttgataaatcaattcttcaagtatcaatttttcctaccaagaagaaaatattgaagtacataattgacaatattatgcaacatatttgtttttctcttttactcagtatctaaggcattttccctatattgccattttaaaaatcaatctccaaaaaggcaacatttttatattgaaaaattaaaagatttatatagctatatctcaatatatatctgcacatatctatctatatgccaaatattaaaacatagctatataaatatttaaattatgtatatatttattcctatatctatctacctatctatccatctgatccatgtgatttttttgtctttgctatgcagatattttcccataaatgatggaagaataagagtttttgaagtttatgtttgtaaattaccatggttctaactttatatgaggatagagcatatcttaaaatatatgctaaagagggaataatatatttcatatatccttctctttttttttttttggctagcattttgacagtaactaaatattgtcaccagtttaagacaccaaacataacagattattttggactggaaaaatttcaaaccagcattatcagtcagcaatcctgacaaagaaagcccctcaagtcatcattgtttgtaatagcaatgacaccagtgttaactcctatggaaggacaaattgcttgcctaactttgaattgcactgcctttttcttgacccttaagttcactaaatatattccaaactaattttaataacctgatctggagttgctaattacataattcattataatatctctctaactgatttcagcacattggttttacaataccctaatccatcctcctctctgtagccagactgaactttcaaaatgtaaatctgcccagtaattcctcttaataaaatccttggatgactttatttttcctaatgacaatgtctaaaattcttaacaaggtttataatgccttctaggattttgccctgcctatcatcttagcttcaatatatgtccaatttcctcattgctctctctgctccaaccacactgaactttcattcccaagtgtttcttgaatacttgattctggatctttgtacaaggaattttttattcctgaaacactgatatatcctctctttccccactgccaacttattcttcagatgtcagttcatacaccacgatctctgggaaacatttgcgaatgtctctgctcccctagactagattacgtctctccactactttccatgacacatagtactctgccttttatatctctttcacatgcataagttgtgtttaatgtatgacttcccttttgaattttaaattgtgtgaggcaaggacaaggtctgtctctatctttgttatatgccagtgtttggattattacctgaaaattaaccattgcacaaaactatttgctgaataaataaatgaaggaggctcggtgcggtggttcacaccagcaatcccagcactttcagaggccaaggtgtgtggatcacctgaggtcacgagttcgagaccagcctggccaacatggcgaaaccccatctctactaaaaatacaaaaattaggtgtggtagcaggtgcctgtaatcccagctacttgggagaccgaggtaagagaatcacctgaactagggaggtggaggttgcagtgagccgagattatgccactacaagatcacgatgatcatgccactgcactccagcctgggcaacagagagactccatctcaaaaaaaaaaaaaaataaaaataaaaaataagtaaataaataaatgaaggaatgaacagacagtaaagcgtctttttttttttttttttggttgatttaaaacatctaacatgtaggtagaagctattgtttgacttctgaacctgacatgtagttattgtaaacttttgagcacaagaaaaagataaatagtgtgattatatgaagaataattaagatttccaacagaatggtgttcgtttttttttcacagagaaatgcagcttatcaacttttttgtgtgtagtagaagcagcttcttcaaatgtctaagtacaaaagatgtagaaaaccttcaataaaattagttcaaagcatctgtgtatttcagtaatctgtgattattgtgtttatggctgctgagtgtgttcaggaagtgagattacaggtgacttttgaagtgttttgagaacttacttatacccttttttgtgtggctattgttaaccactcagatcttatgaaccgagtttgtgatggatgctaaggaagtgctctttgatgaagtaccttgcctaaggattttcataattttcaagtttggcatcggaactataaacatgtagataaaataagcgtgttttatgacccaacccccctttaaaaactgtgcagttggcagacaagcctattattttcttcaattttcttctgctgaaatgaaaggaaatatgctactatagtattctggtgggtataccatgtcctttaattcctctctctctacaagaaaaaagcccagctatcctccccaaacaacaaaaggaagcatgtaaaaaaattagtaatctattttctaattataagaggttttttaagcttgaaaagaagagttaaatttgttggcattaacctttcaattttcaatggtgtataggaatagcagagagaaccaaaagcgtgctgtgcctctgatgtgtgcactccgcgaatgaccaaacccaatttctggaaaaactgataatgatcagcatttgtcatatgaatctggatgatcaaataaaatcaattgttattctgttcattcatccttgactgattagggaattcaaatggaaagtcagacagaaggtgatgtgcatattaatgattaattattcaagaaatacttcaagtacacactgtattccaggaaaagaattttacagtaggttgcttgaaaacatgcaggaaaaagggatacatagaaaaaaatgatatttgagaagaaagtcacatttttaacagttttaaataatttcataacagccacaatgctgcttctaaaactattaagaaggtccaagagcttgcctgtgtgcatcctttaattaaaatgaacttttcaggtggatttttctatcccattaatctgtggctcatagaacatttggtcaaatgtcacatacttgctaaggtccagggattttagctgtacaatttctgaatatgttcatgtacccccaaacatatgctatcaaatttcagcaagttttttggatccttgaggaactcacatggctgggtgtgcaggatacattttctagggacatatatatccaaacgtaggagactcccagttgttctgttcccagctgatgacctaaattttcatttctaccattatttttccaggttgtaaatctgagctgattcctccatgccatctgattcaagctcataattttaccattctctgtgtgccttattccatattcttttttgtccattactaccctctttcgctccgagttcaatgtcttatatatttttaatccagcttcattaatgggtctattttcttactgtttcttttgtgtaataacttgatcttaactcagaggtagacttaccctgaaggtaatgacgcttaagctttaggcttgccatttaatttgcatgtgtcactttgaaggcccttaaagaggctctagaaatatattcacatgcttgtaagtttctgtaatatttgtaagagtaagacattttcactatagtcatgtgtttttcctttgcctgctgtgttagtcaggattctccagaggtacagaaccaataggaggtacatatgtagatatagatacatgtacctatatctaaatagatatagatacatgtacgtatatctatttagatataggtacatgtatctatatctatttagatatagatatagatacatatatgtgtatctgtatgaaagatatatatatgtatctaatgaaagctaattctccttaataaactctgttatagtttattaaggagaattagctttcactattatacagcaaagccctaccatgtgccatctgtaagctggggaaagaaaaagccagtagtggctcagtccaaatctgaaaacctcaaaaccaggaaagccaacagtgtagacttcagtctatagcagaaggcccaagagtccccaggaagatgctggtgcaagtcccagagtccaaaggccaaagactgggaatctgaggttcaagggcaggagaagtggaaggaagcatcaggcatgcaaagacagagagaactaggggaatcagcaagcaaaattatccccattcttccaccagctttgttctagctgcactggcagcagataggatggtgcccacccaaattgagggtgggtcttcctctcccattccaccaactcaaatgtcagtcttctctggtaacaccttcagagacacccccagaaacaatacattgccagccatctaggcattgctcgatgcagtcaagttgacacctaatattaaccatcacacctgtcaactttttttcttatactcagttttcatggcacctggtgttggagttgggttgagcattttaaggatccagtttagggaaagttaaattagagatacatttcatttgagtctagtgggatataaattttagttcttagtcattgctgtatgtgcaattattgttagctgtgctagtgtagaaatgcctatcaagaaacaccccgactgcccactgtgtggacccagcagcatcttgacacgaagtaacagggcttatagctacctggcaccagaagcgtttgggcacagaagtggcatatacttttaaaagtggagagagaatcaaaatctgtggaaaacctttctaaatctcctagcgcatatatgaaagaaattcagatagagattttcctaaatttgacaagaattctaaaaatttatataacattaccaataattggttgtgaatctaaaggaaatatttctatgttattgagaataattttaaaaaatatatcaaccaagctagagggaagagtctgttctatcaaaatgataaaaaattgttgtcatacaaaggggtgaaaatatttttaagttcaatttaaaaagtaagaaaaataagtagaatggagtgacatagacaactaattcataaaattataatttttttctagatttgatgatgttttaaaattatccagcttttcaaactttgtgatttgttgtactttcttctttttctaaataattattcacatttgcaccaaatttgtaatttataaatttgtattctttttaatttattgtatgtcagatccaataaacctggaacatctcctgccctaactcaattagccccaataactcaaaataagtggaaatcactataataaaaatttgatttaatgtaggggctaaagtggatggaaatctacgctctggaatgagactccctgagataaaaattcttgctccacaacttattattctgtgaccttgggcaagttactcagcatatctaaacctcagctttctcatttaaaaaggagactggattagaaagcgtaattccttgatgctctttataactgtgtgatagtaacatgaaacatagtgagtaaccaactaattaaaattagtatgcatgttgaaaaccttggattccctgtaatttcacatcagccctatggattcctaattgttctttcaggtatgtgtagagtaagaagaagtctagtgtggcaactgacctacctgtccattcttttaactagcatagtcccgcttttattaacttcatttacactctaagctttagtttgaacaaggtgctctgtgtctgtatatgtgtgttcatatgtgtatttgaatacaactgcccttgcccaatccttctatcacaagaatcatgtgataacattagtgaaaatattacaaacagaaaataagtggtaatcgcttctctatttgacttcaatcttatatgtaggaaggatggaaggatatgtttttatttaaaataaaacaaaataaccacagaaaattcttccttctagatcagagattaagcattcaatgaaaatagaaaattaacaagaagtgattgagagaaacataagcttccccaaattctcagggatattaaaggattatcaagtttcccatagcatatgggactgagcctcatgttaatatttggttatttatatttgaccaatattaaaagaatgtgtaaactcaaacagcaggaggacttggataaagagctaacactggcattttatgtatagctccccaaagacttgctttattgatttagtatttttaattgtactttttaattagaaaaaaatcacattttaataattgctactcataattgccagacagaataatcttagtccgtctttaatttgacagcttttcaaatgaatgaatcagtttcatccccaaataaattcacttccaattaaaagttgattgttttatgacaggacatagagatattttctttgattcttacatgtcattgagaagtaacaataatcagcatctctgaaatttcctttcacttatagagacccaagccttctggcaattttccatgaatgaagtctttcttgtaatcaagatattcctgttttattaatttttttcttttatatttgtctgcgtaagaacagggaactgtcttaacagaatttctaatacctaggtggtcagatattccttcaaattaaacaaatttgatgtcttaaaactaagtgtaacaaataaataaataaataaagagaatgttcagctcctttgctaagctatacccagtaatttagaataagagtttaacggataaaataaaataagcaatagttactatttcatgtatatcctagtgcaggggtccctaaccctgggccatagactgatacagtgtctcctaaggaacagggccacacagcaggaggtgaataccagcaagggagggaagctgagctccgcctcctgtcaagtcggcaaattagattttcatgggagcatgagccttattgtgaactgcttacataagggatctaggctatgtgtgccttatgagaatctaatgattaatgcgcttgaatcatcacaaaaaatggtctccactaaaccagtccctagtaccaaaatggttggggaacaatggcctagtgtacagttctcttgttttgaaagaagaagaaaccaggcaatagaaataactggtgcgataaattgacacttgaaaagcaggtagttaaggggaacaatgtttaagaaggcagtgagttttgaatcattaagacttgtaaagctgagtgtctaaagtgaacattttaattatggcatgtttcagttgtaaaaatagatcattaagaatcacttataatcttggccctaggataggtattttggatatattcttaattatgtaaccaaatgcctaataatatgtcaccagtattgtagatttctgttgccacctaaaattctgcattatatgcctgattctacaataaactaaccaatatcccctttggaaaatataaggctttaaccatttctttattactgaatacttatttttaatttttaatattttgactaatgttaatatgtgtatctttctacatagaatattttaattccattttaaatgagtaaattgtatgtttcccctccttattctgtagttcactaatttatcctgagggactggagttatttgatttacattcaggttttgtgtatgtgtgttttgtgtgcatatgtatgtatgtgcatttgcaacatgatttgttcttcatgtagtgtctttttttgttgttttttgttttgtttgtttgtttgttttgttgagacagagtctcgccctgtcatccaggctggagtgcaatggctcaatctcgactcactgcaacctccgcctcctgggttcaagcaattctcttgcctcagcctcccgagtagctgggattacaggcgccttccaccacacccaactaattttttatatttttagtagagacagggtttcaccacgttggctgggctggtttcgaactcctgacctcatgatccacccacctcagcatcccaaagtcctgggattacaggcatgagccaccatgcccggcccgtttagtattttttagtgttttaatttctttgagaaaattgatttttttttttttttttttctgagatggagtctcactctgtcacacaggctggagggcagtggcacaatcttggctgtctgcaacctccacctcccaggttcgagtgattcttctgcctcagcctcccaaataactgggattacaggtgcatgccatcacacctggctaattttgtagttttagtagagacagggtttcaccatgttggccaggctggtcttgaactcctgacctcaagtgatccacccaccttggcctcccaaagtgctgggattacaggcgtaagtcaccatgcccagctgaatattgactttttgatcctcagtttaaatattgttttttttttttttttaatttttatttttgagacagagtcttgctctgttgcccaggctagagtgcaatggtgcaatctcggctcactgcgacctctgcctcttggattccagcaattctcctgccttagcctcctgagtagctgggactacaggtatgcaccaccacacctgctaatttttgtattgttagtggcgacagggtttcaccatgttggccacactggtctcgaactcctgacctcaagtgatctgcctgctttggcctcccaaagtgctgggattacaggcatgagctaccacgcccgacttaaatattgcttcttatagcatacttcttcactgatttcttcccttgcttgtacctgagagttctgatttactgttgtttttttggcacgcatcctacccaagttaatggctttttttatgtgttctgtaatataaattgattatgttacttcagaattttgagcatattcaaatcagttattcccctacccactgccacaggacataatcaatccttttgaacacttatactccctcacaggtagaaaaatttggggtggagtaactctggaagactaagcatctttactaagagcctaagcccttaagaaaggccatgtaaatcagctaggagggggaactaaactttgtgttagtctcaacatttaaattgaacagaaattgtttgtatcagaagatatgatatttttaagagacaagagcaaagattttttggttttgttttgggttactcttcaactgagcagattagagattgttagaaagattagataagttgcagaaaaatgcaaaagctccctttcctttgtacatctgagtaaatgtgagtaattagtattaggggtatagaaaccttaagagagtcctaagcaatttttcatggcctcacagatgttcactaaagtagtcaaagtctcttcttatcagcaagaagtgtgaagaattgcctgagagtgaaaagtcaacagatttgcaagagctttagaacaccaaggtcatgagtacctacaactgggaacactgagcaattcagtggatgtcagcacagatgccaaaggctatacatgataattacagctcagcagatgccaccccacatggatactaatgatcagaagccagataccacttggtatgactataagcccctaggtttgaggtgatcactgggagaggaaagagaagaaacgacaacctgaaattattttgtttcccactgaaatgcctgaaatctctggaatacactaaaattttgcttttggccgtcagctggaattgggtctagaaatagatagaaaggtgaattaatgaaaatataaagggaatagtattttttatacaccactgtatgtggtctgataactcataataaggataatttggccgtcagctggaattgggtctagaaatagatagaaaggtgaattaatgaaaatataaagggaatagtattttttatacaccactgtatgtggtctggataactcataataaggataattttaataatgacacaattgaagaaagagctactgttagtaataccttggggactgcagtttatgaaacacctctcaatgtatgactttttgctaatctagttttattcactgaagtatttcctacagtgagagtgtgccaggaagcactggtaagaaaggaatgggtacaatgtgtgtaaacggtgtgcctgacaatttagaagactagaggttaagagagatgtgaaagccaaatttagagaagtgaaagccaatttttcatacctgaatgtttttatttatcctcccaaggatgatacacacaggggtgtatgttagactcaagaggtttaatttcagagttgcagagttgctgctgatcatttaccagagtgtagcctgggaaagccttaagaccagggccaaataagttaatacaaacaagggagaaaggtggtaacaggaggtgaaatgggtgtttctagcacttctgtttctccatggcccaaatcaggcattctaaatacgttcttggatactcatgtagaaagtcagaaggaaggtgaaaaatagaaattgatcaggaatgatatttccagaaaaagattatagtagttatataaaataatattttttatttttgagttagaatatgtaaattacaagcccattcattcatcaaaatgataaagagctgtaacttttgagtgactttaatcttttctgttagtcaatagtgtttatcagatatttttattgtccctccctcaggtttcatgtgcacttccctaaccccttgtcattaggtgcttgagatacaggttgacctttatctgtgggagaaaattgtaggtattgctgtagatcggagagattcaagagtcaatgttgagtgcaggactttgagaatggtggagtgaaaacctctgtgaaactgttcctttatgaaagcaatgaaatgctagaaaaaattgtcaaaataaaatttttcaaaacctggaaattagtcaaatgtttgcaacaatatacatttattcaacaaaagtagcagagcctaggtaagaaaagcagaacatttttatattgacttgttttaatcttcctttttccaattatgtgatagccttgaatcatagcagctatgaaagccagcaggcttgcagccactggaggagacagctggtgaggaactcctcacaaagctccactctgagagcataccacaatgtgacttatctaccagctccatggaaaaaccccattcacagggcgttgttgttatttgaccctgggaaggagagaaaagcttatttccagagttcccctattatattattcgaaatgtttagttttcaacaaaaattatgatacatgcaaagaaatagcaaaggtatcccatatatggaaacaaaaaaaagcagttaacagcaaacaatatcccgaggacattcaaatgctgaacttagcagacaaagattttaaatcaactattatgattagaaacaagtaagtaaaggaaaccatgtccaaagagttcaagaaaagcatgacaacacacaacttttgccaatcagcagaagtttttatagaaatatttgaagcatttacagaaatatttgaacaattattagatgacaagtgagataaattagtggatatttctgtggctatacactgcagggaatatggactttacagaattagaggaaagtatgactgtattaggccagtcttgcattgccataaataaatacctgagactggataatttataaagaaaaggggtttaattggctcacagttctgcaggctttacaggaagcctggtgcgggcatctgctcagcttctagggaagcctcaggaaggttacaatcatcttgcaaggtgaaagggcaataggcatgtcacagggtgaaagcaggagcaagcgaaaatgtagagggggaggtgccccacactcttaaatgaccagatctcatgtgaactcagaaggaaagctcccttaccactgagagcatggcccaagccatttgtgaggaatccactcccaggatccaaacacctcgcggggatgacatttcaacatgagatttgggcagggacaaatatccaaactacatcaatggcaatggtgtctcaacacgtacagaatgagagaaagtgccacaaaattaaaaagcgacaaacagagattctggaattgaaaagtaagtaactaaaattaaaacaaaaaactactagtggagttcaacaacagatttgagttgccaaaaggaaggttcagtaagctcgaagatacatcagttaagattatctagtcagaagaatagaaagaaaaacaacacaaatttggaggtaagtatacactcttgcagccattaccaaaatctatgctatgtacatatccatcacctgcaatagtttcttcttatgttctttattattatttttttgtgataagaacacttcacataaaatctgccctcttagccaatgtttaaagtacacaatactgtattgttaactgtaggcactatgctgtacagtagattgctagaatttcttcatcttccgtaactgaaaatttgtaccttttgacaaataactttctgtttccttctcctcacaagattcccctcattttagagcaggggttttacacaccaaattgtcaacaatgagtatttcttggtgaagatttggtgggtgttcagtcagtaggtgtaccttccattttaactttacatatacctgtattgttttatttttaaaaataattaatgtaaataacacttataacaaaaatgaccaagatgaaaactagtggctctcagatgctgttaactttggagagacactctgatcatagattttggtaatggttgcacgagtgtatacttacctccaaattcatcaagttgtctaccttaaatatgtacagctttttgtatgtcagtcatatcccaataaaatggtttttaaaataaaaaaaataaaaacaatacaaaatgtgaatacagcctcagagacctgtgggctaccatccattgtaccagcacaaagataatgggaatcccagatgaataggagagaaaaaagagcagagaatatttaaagcaagaatggctcaaaacctcccaacctgagggaaactgttaatctactcacagaagaaatcagtgaactccgagtagtagaaacacaaaaagctccatacctaaaaacatcacagtcagtgttcaaattagaagaaacatagaatactgaaagcagcaagagaaaataactcatgctgtgaaatgaatgctcacaaaaatggaacgaattttcataacatacttgaagtgctaaaagaaataaatgaaatagagaataaaaaatgaataagaaaaaacaattagttctttaaaaagatcaacaaaatagaaaaatttacctaggctgactaagaaaaaagcaaagagaagactcaaatgactaaaatgagtaatgaaatggaggacatctctaattatcctgcagaaataaaaaagattatacaggaatcctgtaataaaccgtatgctaacaatgatgtaacctagaattaaaggaaacatttctagaaataaacaaattaccaaaattgactcaagaataaaaatgaactccaaagtaacctataacaaagattaaattgccaagtaaagaacacttctcacaaagcaaatgccagtcctagatggtttcactggtaatttctgccaaactcttaaggaactaaaaacaattcttcacaaaatctttcaaaaaatagaaaagggagaaacacatcccaactcgttctatgaagctagcctgataccaaaaccaaataaagggatcagaagaaaacaaaactacaagccaatgtcccttatgaatattgatgcaaatattctcaacaaaatagtagcaaactaaatccagaaacatataaaaaacattccatcaggaccaaatggaatttattccagtaatgcagggtcgctctaacatctaataatcaacaaatgtaatataccatattattagaataaaaaaaccacatgattttctttataaatatgaaaaaactgacaaaatccaacacccattcatgatgaaaaaaagtactcaacataataagaacagaagagaacttccttaatctaataaacagcatcagtggaaaactcacagctaacttgaagaaagactgaatgatttctgttgaatagcaggaaaatacaaagatatctactctggccacttatatgtaacattatagtgaatgttctagttaagacagtcattcatgagaaagaagtaaaagtcatcagaatggaaaaggaaactaaaactatctctgtttgcaaatgatatgattttgcatatagaaaatccaaaagaatctagtggattcaatttaaataataaacacattcagcagtgtttcaggatacaagatcaatatacaaatatcaaatctacacaccatcaatgaaaaatccaaaaatgaaatgcggaaaacaaaaccatttagaataccctcaaagacataaaatacttagaaatgaatttaagaaaaatgtacaagacttgtacactaataaaactgttgaaggtaaagacggtccaagtaaatgaaaagatatgttcagaggttgaaaaacttaatttttaaaaaaaattatttattttttgagatgcagtctcattctgtcgcccaggctggagtgcagtgacacaatcttggctcactgtctcccaggttcaagccattctcctgcctcagcctcctgagtaactgggtttacaggagcctgccaccacacctagctagtttttgtatttttaatagagaaaggggaaaaaacttaatattggtaacagacatccaacatagtttgtttgatagaagttcagcatttaaaatacaaaatagacatcattttgaaaatgtaataacaaatatatgtaggcaaatatataagccaagagaagctggaatacgcaaacccagtagctgacaagataaaattgaaggaaaattttcagaaggaatgaagatagactttatgtactggtaaaagcaacgattattttcatcagataacatcagtttaaaatatgttaacacagtaactgactgaattctggggagcaatagataagtccataatagcaatattaatccaaatacctcagaaatatatagaccaaattgatagaaaacatacaatacaaggaaagatacagaagattagaataataaccagtaataaattataatatggatcatggttaaaaacattgtcaggaacttagaagagctggagagagagaacgtggagcagcaagtatcagaatagctgataaaacaacaagcccaaatgcaagtaatagtcaagtctttaatcacttactgtgaaggaataagcaagaatctcaaactggaggtagcactgacctcatgttacatccacctgccccatgagcgtatgcaccaattacgggtcgggtagattagtactaacataatggctgtctgactgttgagggagctctgaggaaagacttttgcagttttatagacctgggggttggggtgaggtctggggcaaggctagaagtggaaaatgcctgagtactgaatgagtccgaatgcagaaagtgttttcaagatcctccaacaaggagaattccaaatagaaggcctcgactaggaatgcagatgagcatgagagcatggctggccaggaagctgagttcttgactgcaattcctgtcagagactgcagtgcactggctgtgtagccagtctggtgtggggagggcaactttcccccatgaggcctgccagctaaagccattataattgcttgtggttgtacctgaaaaatcacaaaaaatttttgaccatgggctgaaactctcaaacatacaattcaaggccaaactgaaccctgccacttagttctgtcactgactagacatgagatcttgagtaagttatttaacaattctgtgcatgagtttttctattcgttgaatgggaatacgcttggtaaaggaagtatactgatataatatattttatctacagaaagaatatcagacacatagtgttataaatttgttagcacttgtttatatgcatacataggcacaaacacacatgtatccatgcatatctatattatgaatatatctgatgtacatacatactattatacatttttattgtatatgtgtttatatatgtacacacttacacaaacaaatgatttttgtacctaacaaatgcacatacacattctttcagatttaaatgaaatatttacaaaatttggccatttgatatgctgcactttatctctgtgtcagttcacttcccattggctagaattcagtcacatggtgacaacagaatgattctgaaatgcattctagctgtgtaactagagatagaaggaacccatttttgaacagttagcatctcttctgtagtttgcctctttctagttaccaactactatgcataccctttttcaacacatatattaactctttcaccaaaagaaaaaacagaaagtttcactagttacgcatttcaaagtccagaattttagaggacataccctcctccccatcaagaatgaatatgtatatttctggtctgctaacataaaaaccagaaatatgattatttgttgctatccccttacacgatacacaatagcagagccaggaataggctattacaataaaaactcacactaagaaaaaaggaagaaatggaaacacattacagtcattgattcagagcaacattgctgttttgctgggctagtattgtaaaatcctccaccctaacagtactggaagttttaaaaattagaccttagatctgttttttgggaggaacacctggctccactacctgggaggttttgtcttatcttttgacctgttggacaaatgtaagaacactggagatcatgttccctttgaaggatgaggagtgtggcacaatttcttttggtttgcaagttcaatgagtcaaaactttttttggagcataatattaggtatttcagtggtacagatgcttcaaaaacataacagaatttgtatctatttgttttcagtatcttctatgaggcagcagccaaagccaaggttatgttgtagacattgtttttaagttgtttctaatttctgtgcttattccttgtgcccatctctctcttaatggaggctactttaaggccttctgaaaaggtaggcttggatgggaaggccaaactatttcatcagacctttgccatagggttaagcacctttatttaactgagaagactttcaagtcttttcttgctacatgggatgaggaagtactgggctttttataaccatgtcccacttttctagagcctctctattccctttcatttatacttgaaaactgatcaaacttgaatcagttaataatacattgctacaaacaagcagaactaagcaaacaaaacagaataactttctggctctttccagctactttctatgaagtagcaagttttctaggcacttgatctgccttacaaatgattgcaggcaactaataaatgtattaccactaaaataaacaaaaaaagaaaaacctctgtctttacagcctgtgatattatttccttgccacctcctgtttggctgctaagtcaatggcacatattttaggttttggttatgatatcatgccatttctaatacgaattatttcttattgcatctgaagaacaaatttgtaaatgacattaggtagggagcaagttttctcaaaactatttctcaggactgtatactaagctagtatttttaaacttttttttttttgctacaacccaaaacaaaaaacacaatttatatcattctataaacacacacagacataaacctgtatgcatacacatggataccagatgggccaacactatgtcatatctaaactgggactattactgtcaaacccatatgtgtggtatgggtatctgaaattccctttatgatgctaaattggtttttcacatgaaattttaaaaatttgcttgaaaactgctgagcattttgtatttttagtagagacagggtttcaccatgttggccaggatagtcttgatctcctgacctcgtgatccacccgcctcggcctcccaaagtgctaggattacaggcgtgagccaccacgcctggccaactgctgagtattttgaaatggtatttatgacagctaggttagtcctttgagacatcagattgataggaattttatatcctgatttagtgttacatttattgaagagttttaatgattaaaaataaataataaataccatgtattatatgataatcatgtttcatttaaaagtacatacgtatcttttcacttaacgatttatacccttaagtgttaaagtatatttccatttgatctaactttaatagtacttaaaagaattaagaataaacagtggaaacaacattaatctttttaatatctaaaagaggtctttattactattataataactactgataagagatgcaactttacaataggagtactgagttttctatttaaaaagaagttttctatttaaaaagaaattttctatttaaaaaggcattgtgtaatttcctaaagtttgaagtattgtgaaagcgcatcttaatgtcggaagggtaacaaatcctaaagttgattagtaagaaaaaatagaatagcatcacagttcttttttaaaaacccttaactaaacagaaaatacaaatttggaaacttaaaaattaaggatctgtttgtttctttgcatttatgccatggtctctgaatttgtatttttttttttttttgaggcccattcacaggacgccatatgaacacaaaactgtgtggaagttcctgaaaacaattccagatttaacctttcagctaaatgataagcatctgaaaacacttagtaagactgtcttttccgaaacctggttgaaaggcagcacaggtaatagactaatgtgggataaatttggcgagataaaatgcaggccactgtttcgagttctttatcattataatgcttataatttcacttaacaatttcagttgacatggtaaaaatgtactatttgggtgtgtttcatttgtaagtttataagtagtgaaatgaataacatctcacattttagtacttagagtttaagatatatacttgtgtttctctgcctggagcatgactcagaattacccagtgatcacattgagacccatattgtcgggtttaaacatcagaatttctggttcagtaggtataggatgaggcctcaatttcatttataatacctcaggtgatgccaccagtgcagggaccacacttgtggaaccaatatctgagatacacatttagtaacaatatagtgttgattttcataggtaaaacagcagatagtcaacatgattatttgactaagtcagatactaacccagatatagggaaaaaagcctctctagatagattttcatttcccaattttagcttttggtcccttcatgaaggatttagtggatatattaatagacttgttatattttaattacgggggctaggcatataatttaatacattctttatgtcagaagcatccctttttgttcctcagaaaaataaatgaaggaagatattgctattattattctccacagatgaggaccccgaggcacaaatatcacacagagcattcttgcttagaatcgagtttcaaacacacttcagcctaattctaacttgttctctgtgtattatgtcactgttagtacaaactggtttatcaagatcatgacatttaaaacttaactggaattttaaagaatatgtgtctattgaaaaaatttacatatttccagagttttccctccatggtcttctttcataattagttccatttaatctgtgatcaagcaatgaaaaataaatcaaaggaattttaaaggggataaaataattttgaaagggaataaaggacaaacattcaacattgctttgctattagattgaggatagtaattaaaacttaatttgttttataaatcactgaaaacatatttgtaacagtaaaaaatatgggaacaatctaaatgtccttgaatagaagattggctatacatattttgatatatctattatatagaattctagacagtgattaaaaagaatgaactagatttatatatattgatatggaaacattaaagagtaaatagaataattgcaaattatattaataacacatttatgaaaaaatctaaatttatgcacatagacacacacacacacacacacacataaacatatatctttttaaactatacaagtgggtccagaaggacatttcaaaaatacatatttttaaaaattgttgccttagtgtaggggagtgaaattgaggggtgataaagggctaaaattaactctttcttctacatatatttgagttggttttattctctcacaatgtgtttatttatttgttaatatttgtaattatacatttatttttttcaaacattttctaaaattaaaattagaaacaaacatttaatttgatggcaccttaactcacgtgattgacgattaaaatatgaattttcaatctttcacaagtgtcaggtattccaacttgcatttcaatagggtgtactttcaacacttaaaaattaggagactctgtgtttacacctacctgtgtcaaaatccctctcaagtttttaaagcatttagttccgacagctcagatctgtttcactaccaaagaagtcaactcattaaatatatgacctttgtagatttctttgttcatccagtttagtaaaaaggcccaactaggtgtctgtctctctcctttttctttattcatgtatgtgtttccctccctctgctattatttaaactattccttctagtagcccctcatcaccaggctgctgactttcaatctgctgctggggcttccatttctctggtgcaattccacacagctgtttgtaccttctggtctcttttctggccactagttcttaaagcctcattatttaataaagcttcctaaacttaccattattcactaagcctcttgatcattcaggttttataaataatcgaacagtaataggaaaacaatattatatttctaagtagtgaataaaacacattatgtgtgtctaagttaaaatgctacaaaaaatgattactatattattatattatttactgactatattaatattactatatatgagtacttatattaaaattactgtatgtaatgtattttacatatagtcatctctctatatacatgtgtacgtagatataatttactgaagtcaaatggaaggatttttcattagatcacatttttatggcctgaacaagggacatttttatgattgataacctaaagctcatgaaaactaaaagaattgccagtttagttactaacctgtaacaatatcccagatcaaacttttattatctagctttatgttaatattaaaacccatttctataaaataatgtttttctcttttatatctatgtcaccttgactgttttctttgtgtagtcctttgtcttacagtattatttctcttctatttctttcactttatttcattctgtaacccacttttatgagattgtatctcaaaaactccgtaattcctcattttcattaaattgtatatttacttttaatgctgaaaatatttttatattactaaggttctaacatttctttaacctgcatagattttattttctgttgtggtttatattttatttaacaactaaaaatatggtagctaaatctcatgaaatatgtagtgggcatcttttctagacatcaattaaccataattcaaataatttattcttataatagaagaaataaaatctttagctgagatttagtataaatccagtctttatgtagactcatcaagaaaaaaaggagatccaagagaaacccaggaaaggaaggcttcactgctgaattttaccaaatattttaaaaagaattaatatcaattattctgacactcttccaaaaattgaataggagggtatattcccagactaattttatgaggccagcattaccctgacactaaaggcagacaagttaaatgaattcagtaaaattgcaggatacaaaatcaacatacaaaaattagtagtgtttctctactaataaaatattcaaaaaggaaaataagcaaacaattccatttatgaataacaataaaaaattacttaggtgtaaatctaatcaaggaagtgaaagacctgtaaactgtaaactagaaaatattgataaaagaaattgagaaaaatagtaataaatagaaagctgtgctttctatgctcatgggttgaaaaaattaatattgttaaaatgctcatactagtcaaattgatctatagattcagtgcattccctatcaaaattccaggacatttttcacagaaatagaaaaacaattcttaaattcatatggaaccacaaaagaacccaaatggccaaaacaattctgagcaaaaagaacaaagctagaggcatcacactctctgatttcaaaatacactgaaaagtgattataataaaaacacaaggcaatggcataaaaacagatatgttgatatgataaggctttgtgtccccacccaaatcttatcttgaattgcattgcccataatcttcccaaatccccacgtgttcagggagaaaccaggtggaggtaactaaatcatgagggcagtcacccccatgcagttctcatgatactgagtgagttctcatgggatctgatggttttataaggtgctcttcccactttacttgagttttgacaaaggtgctaaaaacactcaacagagaaaggacagtctctttaatgaatggtgttggagataaatggtgtttgaatttatgagtgacgacttacagtatctgtagaagaaatttctaagcaacaaagtgatcaagatatggtctggctatttctaacatcctatgttcagataagggagcaaagaaatgacttaaagttggaagttctctttaaagggaaagcagagcatgagagttttgaaaatttgcagcctacccatataacagcaacaacaagaacaaaaaagctattatgggtggaagaatccaagaaggctgtggagcaaccacttgttagaaatatttgtgtgactaaaaaagagctaggtgctgatagccaagacagtgggaaaaaggcttcaaaggcatttcagagatctcctaggtagacactcctatgataggcccagaggctaaggatgaaacaatggttttgtgggcctggcacagaaccctgctgccctgcatagcctcaggatgctgctccttacatgccagccactccagctgcaactcaaaggggcccatatatagcttgggatgcccctctggagggtacaagccataagctttggtggtttccatgtagtgttaagcctgtgggcatgtagactgcaacagtgaagaaggcttggcagcctctgccaagatttcaatgggtgtatgagaaaacctagatgcccaggcagaagcctgctacaggagtagagccctcacagagaacctctactagggttatgcaaaagggaaatgtgggattgaaggtcctacacagagtcctcactaaggcactacctagttggacctgtgggaagggcactactgttctctagaccccagcatgttagatctactggcagcttgcactctgcacctggaaaagctgcagctactcaactcctacccctgagagcaacctcaggggccataccctgcagagacatgggggcagagctattcaaggccttgggagcccaccacttgtaccagtgtgctccagatttgggacacagagtcaaaggaagttaattttgagttttaagacttaagccttgctgggcttcagatttgcttgaggcctatagcctctttcttttggtcaatttatcccttttggaatgggaatgtttttccattgcctgtttccccattgtatcttggaagtaaatagtactttttgattttataggctcataggtgggaggaacatggattcaaactcagataagaccttggacttgggacttttgagttaatgatggagcaagttaagacttttggggactgttgagatgggataattttattttggaatgtgagaagaatatgagatttgggggccaggggcagaatgatataatttggacatcccctccaaatctcatgttgagatataatccctagtgttggagatgtggccttgtgcaaggtttctggttcttgggggtgggtcccttgtgacttggtactgtcctcatgatagtgagtgagttctcacaagatctggttgtttaaatgtgtatggcacctccccttattctctctcctgctccttctctctccatgtgatgcgtctgcttccattttaccttctactatgagtaaaatctccttgaggcttcctcagaagctgagcagataccagcacctgccatgctcatgcagcctgcagagccatgagccaattaaacctcttttctttataaatgacccagtctcatgtgtttctttatagcaatgcatgaatgacctaacacatgctatattatagaaactcatataacttagatataatgaacaagttcagatacaaactatcataattgactcaaaggaaggataacttgaagaaggataactaaaataaattaatgtattaaattggtaacttaatattctcacaaagaaaatccctgacccacatggattaataatgaagtctatctagtacttaaaggagaatttagagcacaagcaatgaacagttaagaataaaaattaatttataaaaatgaaattaagaaattcagttcaatttgccaataacatcaaaaatataacctgcttaggaataaattgtacaaatgaagtgcaagacttgtacattgaaaactataaaacattgttgaaagaaattaaatagaaagtaatccaatattcattgatctacataattaatattgataagatagcaatactatttatattgatctacagattcaacacaatccctaacagaaataccaattgtcttttttttgcagaagttaataaattgatcctaaaattcatatagaaatttaggagatgcaaaacagccacaatatattgaaaacaaatgataaagttgaaggactcacacttctctatttcaaaacttactacaaacctatagtaacataaaagtgtgatattggcataaatatatagagagatcaatggaacagattgagtccagaaataatgttttaacttgatggtctattggttttagacaaggttactaagacaattcagtggtggaaagaaaactcttttcaacaaattatgcttggagacctaaatatcaagatgctaaataatgaaggtagacccctaatttacaacatacacaaaaaattaccaaacatgaatcaaggatataaaggtaataattaaaactataaaacttttagaagaaaaacttaagaatcttcataatcacaggttaagccatgtgtttttacacataacactgacagtacaagagacaaagaaaaaattgaataatttggaccttataaaaattaaaatattttgagcttcaaagaatagaatcaataaggcaaaaatgcagcccttgaaatggaacacagtacttgcaaatcatatatctaataagggtctcatgtccagaatatgaataacttgtaaacctgagtaacaagaagacaattaacccaatttcgaaaatgagtatattagctgaatagatacattttcagagaagatataaaaatagccaataagcacataaaaatgtccaacattattgtcattaagcaattccaaataaaaattacaatggcatactactccatccccactaacatgattaaaatataaaagaaagtattaagcgttggtatggatgtagagaagttggaactcatacatttgtcttgggattgtaagatgaagccactttgtaaaacactttggcaattcctcaaatattaaccataatgttacatttgccccatgtattagtctgttctcacactcctaataaagacatacctgagactggataatttataaaggaaagaagtttaatggactcacagttccacatggttggggaagcctcaaaatcatggtggagagtgaaggggaagcaagacacatcttacatggtggcagacaagagagaatgagacccaagtgaaaggagaaacccgttatgaaaccatcagatctcatgagacttattcactaccatgacaacagtatgggagaaacaaccccatgattcaaatatctcacactgagtccctcccacaacacatgggaattatgggagctacaattcaagatacaatttaggtggggacacagtcaaaccataccatttcactcctggcccctcccaaatctcatgtcctcacttttcaaaaccaatcatgtcttcccaacaatctcccaaagtcttaactcatttcagcattaacgcaaaagtccacagtccaaagtctcatctgagacaaggcaagtcccgtccacctgtgagcctgtaaaatcaaaagcaaatttcttacttcctagatacaatcagggtacaggcattaggtaaatacagctgttccaaatgggagaaattggccaaaaccaaggggctaaaggccccatgcaagtccaaaatgcagctgggcagtcaaatcttaaagcttcagaatgatctcctttaactctatgtctcacatccaggtcacactgatacaagaggtgggttcccatatcttgggcagctccacccctgtggctttgcaggatcccagctactttcatgggctagtgttgagtgtctgcagttgttcttttctgtcacatcatcagaatgcaaattttttgaattgttatgctctgttttccttttaaaactgaatgcttttaacagcacccaagtcacctcttgaatgctttgctgataccctaaatcatcttcctcaagctcaaagttccacagtcctctagggcgggggcaaaatgctgccagtctctgctaaaacatagcaagagtcaccttttctccagttcccaacaagttatttatctccatctgagaccaccttagcctggattttattgtccatatcactctcagcattttggttccaaacttttccacattttcctgtcttcttctgagccctccaaactgttctaatctctacctgttacccagtttcaaaatcttttccacattttcgggtatctttacaacagcaccccactctaccagtatcaatttactttattagtctgttcttaagctgctaataaagacatgtctgagactgggtaatttataaaagaaagagatttaataaacttatggttccatgtgactagcgaggcctcacaatcatggcagagggcaaagttgaagcaagacacatcacacatggcagcaggcaacagagaatgagagccaagcgaaaatggaaaccccttctaaaaccgtcagctcttgtgagacttactgccatgagaacagtatgggggaaactgcccccatgattcagttatctcccacctggtccctcccacaacacttgggaattatgggagctacaattcaagatgagatttgggtgaggacacagttaaaccatatcaccccagaattccactcctaaatacacatctaagaaatgaaaatatacattaatgccaaacttatatacaaatgtttatagcagtattattcacagtagccattatgtggaaaaagaccaaatttacatcaatgagtgaagaaacttttaaaaaatatgtgcatatcattataatagaaaattttggggtgaaaaaagtgatgaactactaatacatgccaaaacttgtgtagaccttgaaaccattatgataaagaagccagtcacaaaaggccacgtgtttatgactgcttttatatgaaatctccagaataggccaattcatttggacatcaagtaacatagtggttgccacctttgggatatgaggtaagggacattattgctgatgcataaggtgggcggatcacgaggtcaggagatcgagatcatcctggctaacatggtgaaaccctgtccctactaaaaaaatacaaaaaattagctgggcatggtggcgggtgcctgtagtcccagctactccagaggctgaggcaggagaatggtgtgaacccgggaggcggagcttgcagtaagccgagatggcgccactgcactccagcctgggcgacagagtgagactccttctcaaaaaaaaaaaaaaaaagagtttcttttgggaatgataaaagtattctaacgttagattgtgacgagattcaatgtatctttacatatagtaaaattcaacggaattgtacattttaaaagggtgaatttcattgaattgtatctttaagccttttaaaaaattgggataatgttaatcttttagagtgtacaattcagtgacatttagcacattaaaaatattttggaaccatcacagcatccagttcccccaaaatttctatcatcctaaaatggaagcccatgcccattaagcaatcactcaccattcccctaaaccctggtagccactagcctgttctctatttctatggttttatttattctgaacattttgcatgaatggaatcatacaatatgtgaccttttgtgttgagttctttcgcttaacatagtgttttcgtggtttatctgcattgcattatgtacttcattgtacctcatgagctgttaattgtttctttaatagctgaataatatcctcttatgtaagctatttttaaaatgctttttaaaaatcaattggagaccaatggacaccaataatgcaagccagctcctagagagccctgtgattgaaatcaatttcttttaataaatttgtttaatatgaaaagagaaatacaaaagaaattttaaaaatccactagaaatgggttagctgagacaaactctttctgtgaaatgatttaaacaaagttaagtaaaatgaaaaattagcatatcagagacatcagtatgccaccatacattgaatatatcatacacgtacactacacaacttcagaaatataatttacctgtgttttcccactcccctcagaaagcacctttgcataacatactgtgtggaattctgtcatatgagaaagaaatttatttcttatagattttctataatctcttatattagagtaacagtattttatgatgtgtacattccttttactaccattaatcctttgatagacaatcctcttagctgtgcaggataaagctcactgtccctttcttatgtttgaggactctgagtttcaaaatcttactagttctacaccagtgaagggtagaagcaagccttttgagtctgggtcttctgaagccaacctttagctttgttttacccttttccatgaattacatttttccatgaataaaattaagctatagtatcaaggaaacttgtttgttaacatgtatcatcaaagagccttcactagaataatatgtggcattaattgatacaggttttgatgggtaatctaaaatatctttgctgaaatactggcttatagaaatcagtgccattgcttttacgatcttttctagtgtgagaacagtcttgcatggtgatgctaattctctccctgttatctgttatcaggagaatggctcttgatgtaatatgtcctttttatggcactggcctgaatttaatgttcaatgtaaattttaatcttttaaatgtctgcaaaataaactcttttttatgaaagtgacaccaataagagagtgaagatgatttttaatggcaaaggaaaataataaatatgtgtttattttaaaacttagagcattgaaaaatgtgattatatggcacattataaatagaccaaaagtcaaaagaagatgtaaaataaacttctaataagatgtattggctaaaaatcttgtgttttatgggaaaatgaatcaaatcgtcactcagttttgtacccataaggggatacagttttatccccaagtaattggagatttagtaaaattgacacatttaggattaaaatgtggtatgacttaatattagaatcagaatgaggatttcagaaaaatattgtgagtcattatgtacttcaatcaaaatctaatctagacaacaaacatggaaaaaataagattgcataacaattattggtgaattttaaggtagatattttttattaagctttttttttttttttaaatagccacagggactgttaaatgttaatgtctgaagttaaaataactttttcactggagagaaaaaagtttgactttaatagccaactattcatgatatttattatcagaaagaatgactgaagaaaccaattctaaagctcatattattgtttttgtagattattctcaagattgactggcttatactagaaatcttgaaaagccaattcatctggttatccagggatatattttaaaatccgtaaaaagtggagaaaccatctggactttatatttattgagaattggtatttaaacaaattttaaaagacctttctgagatttttgtttgttttagtagaagggcgtttcatagcaaattttaaaagcttgatggtatataacttggagtcagaaaaaacaccttcttttggtggtataggtgctttgatttatttttagaggtaaaaaattcttagctcttccacccgaatacctatgggtgtaagaaccataatactttcttcaggcatgtgggggcttcttcaatatcccaaagctatttgttcctccccactcctggcagggctgactctaacacacacatgctcttgatctgaaacataatttaatctgcagtggttagacataatagttactcaaaaaatagttgataggtgaatctatgcattaactagcattggaggtaatttccaacaatgtaaactttaatacgcagtactgatctaaagttcattcaggaacaaaatatttattgctagatgataatctgaaatagatgtagttcatgcattcttccagataaactaatgattatcattcaattataatgctgaattctatggccacatatcacggtgccattcttttgaccttcccatgtaaaagtgatttttaaattcttagaaatagtctattatgcctggtaaagggtattctattaattacttttgtgaaaatcttagttatgtttatactaaagtgtaaacttttgggagaaatatattcaatgttattgagaatttttatagttactaaatcctgtaactgatcatatttcctcttatatgttggctattagaaagcctttaaaaactatttgattttaaatagatatgatattgttttgatataaattttaaaagattgaaatgttttaaaagtaaggaaaatggagctaaaattgtccctgtatccagcattacctccttgaaaatatatagaatttcacagaatatgttttgtaatttaatattattcttgccttcatcagtttttcctatgtttatcttcactgtatttcattaactttttaaacaatattatctgtatttttgtatgctcacaagataaatccttttagataacaaatgaaatcctttactgaaaaaagtcaaaggctttgattttaatatgtgttgttatgcataataagaaactgttttccttctctggaaatttttaatgtaaacaaaatatttgaagaaattataaaaaataacaatctgtatatatttttaaatctgacttcaaattgatacatgaggcttagacatacgtgtgtcatttgataactgtcttaaatatctaaatataaatcaaaaagcattttcattacttcgactataaaaacacaaattcagtaagtacttcaaatcttggaagaataacttgaaaactacaataagtattataaaaggtaaggatgaatgtgactgaacttgaagaaaatgtgggacataaatgaaaacagactctcatcagcacataggtcctctacatgtggacgtgattacacagagatgtgtaaagtcttactgataacagtgtggtcttgaaatacttaaatacccttcaagacaaattataccttcagcttaaccacaaatcaatgaatacatcctaatgacaggatgtctaaagaccatatatatgtatatatagccagaatatatatgcatatatatagccagaatactcctatagtaactctaagtacacagtgatgatcagcaagtgataaaatactaaatacagacttggagcttagctgaacagttggatggacaagtcatgaacaactgaaattcgtaattaaataagaaacacagtttctaaactgttcaatatttattgttcatgcttactgtttggaatcaggcatatctacattagttttgaaccaaacaatgttaaaatagtcacatgcttatacaatcacttacgggaataataagagttaactatattttgggtacccttcacatacttcttaatattttgactcattagtatcttaatagatgtccattcactagttcatatattttacaagtctaaaaaattcatattattatactaaaaaataataggcaataaaaaagtttaattatcataaattcctataaactttgggattaaacttttaaagttaagcaaaataacatttttgaaaatgttttagtgattttttaaaggattaataattaataggttgttacaatcatttgtgtattataaaattataaattattcctttatgcaatcgccaataatatttaactattttttaaagtaacttaatgctatgaatatgatgaattcacttaatgctatgaatatgatgaattctcatttccgtgtttattccctctgcaattggcttcattgagagggtcgattttaaaagtttgcaatgttcgtagtttgccttaccaatagtcctctgaccagtcacctcaagccaggatgatttagtgatatccttttagggagagcaagtccagaagaagaccagcatctgacaaaggtcctttatgaacaatttgattcattcttgtctctgcaacttcactttctttctgtcccttacaagagttctcctggaacctcccctaactgtccaagtttttttttttttttttcatttttttgatgagagctttaattcattgctgtgattcaactttaatgtatatgcttctgattttcaaattcataggtttttagaccttacctcagctcaacattcacataattgaactgctaatatttctgcaaacaccacttttgaataactgcatatttttgtcatacagatatgttatacttgatcaatctttttaaaaaggttgtacatattttcctatcatgaatactgtggtcctgaatatatacttacagtaacttttacttgtattttggattatttatttatgacagatttctaaagttaaaagtaatgaatcaaaatgtgggtatattttaatatctcgatagttgtctacaaatgatcagaaatatatcatcccagtgttacatgagaatgccactattgctgcattctaaattttaaggctttggtaatttaaatgttgaaaaatcaccctctccccatatttgagagtcactcctgactgtggctgtcctggccaagcaggctgccccttttctttctccatccttatttttggtgtttcttgtcacttttctgttaaactccagtgttctctcttggataatgtatttgaggtatggttttctcatacattattttggttcttataagtggataagttgtctatgagatgcttctagtcagccatcttaaaccagtcatacttcattttaaaaattagcactgtttttattctaattgaacattgtgtaattggttatttaaaacataattccaatttccagtgctctcctaagtgtgtcctaacctgcttttaagtgaattctttaaaatactttttcctgtactgtgcttctgacaaactgggtaattcactgttctttatcaaccttcctagcttgattgaagtccatcaagtactccatgttacctgcttctggtcttgttcatttgatttcctactatacaaatatttttccttccatatctgtcaatcaaaattgtatctacatttcaagatccatcataaatgcttctttttcataaagtcattccatatatttcccaccagacacaatttatttcttctccagaccttcatatcattttatgtactcatttaaggatgtttgccttgtattgcctcttataattatatactttgtaattttcacaataccagaagagtatttatttttattttggaacagagagtatcaatatttgaaggctatttcaatagacgctctgagctcaaaataaaatgaaataaatttctttacatcccgtccagttagctgtgtaatatttacgtatttgcttttttaatctcaaaataaatatccagttttatttgcctgctgtcttctacaagttattgcattattctaagcgaggttattagacttgtgtcttaaaataactactcctggtaccttagaagaggaaaaattggacctatgcaaaataatcccatttccaaagattctttaatataataaaagctatgaaaaggccattttattgctttgttatcttatctctgcaatcatttagaccttataaagagattccataaattaatccatctggcttaaaatttatataactttcttatatttttcctaggcttccatctaagggcctgagaagaaaattgaccatcatagagttttatcttattcctcaatagacagaattctaaggaaaaaaaaagagttgatcttcaaatattttataaaattctttggagagaaatactgtaggggatcattaattaagctttcatttattcgacgagtgtttttgctaaatgcctaaaattatctaggctgtgtgatatgagctggagatacagagagcagtcagtttcttctctcaagaggttacagtctactggcagagactgaaaacaaagagtgccatggcaaaaattctgtgaagaaagatcccagaggaggcctgttaattaggttggatgggggcagggctgaggtcagaaaaggcttccctggtagatagataacagttaaactcaattttatagggcaaggagggattcaccactgacaatatgaccttattcatccaattatagttccttgaaacttttaagtccttctagaatggctgattttagctgaaggtctttgtaccagagagtgggaaatgtttagcaagattcacaatcatgtttgctttaatcagactttgtaattggccgttaacctttcaaaaagtcactatcaaaatgattaattaaactttctctaactagtatttttaattctttttaatgccttctgttcattaatagaagtatagttaagagctattttcaaatatggggtcctgcattaggggtttcacaagtcctcatgagaatggttctttgatttttcatgtaatagaaactaggtatataaatacttttatgaaacttattcctaaccaacttgattttgataaattacttttgcaaagtctgggaatcattatttaatgggctggaaatcagtattgtttccttattgtctgatttttcttttttttttttttcaacaaaccacttttattataaaaatttccagacttacataaaaacccctgtgaccccatcaaccagtttcaatagccatcaagtttgccatacgtatttaatctatcctccctttacctccccacctttttgctttttggctgaagtttttttttttaatttttatttatttatttatttattttttattatttaagttttagggtacatgtgcacattgtgcaggttagttacatacgtatacatgtgccatgctggtgtgctgcacccactaactcatcatctagcattaggtatatctcccaatgctatccctcgcccctcccccgaccccacaacagttcccagagtgtggtgttccccttcctgtgtccatgtgatctcattgttcaattcccacctatgagtgagaatatgcagtgtttggttttttgttcttgcgatagtttactgagaatgatggtttccaatgtcatccatgtccctacaaaggacatgaactcatccttttttatggctacatagtgttccatggtgtatatgtgccacattttcttaatccagtctatcattgttggacatttgggttggttccaagtctttgctattgtgaataatgccgcaataaacatacgtgtgcatgtgtctttatagcagcatgattcatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacattctctccagcacctgttgcttcctgactttttaatgatcgccattctaactggtgtgagatggtatctcattgtggttttgatttgcatttctctgatggccagtgacggtgagcattttttcatgtgttttttggctgcataaatgtcttcttttgagaagtgtctgttcatgtccttcacccactttttgatggggttgtttgtttttttcttgtaaatttgtttgagttcattgtagattctggatattacccctttgtcagatgggtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggcgtaaggaagggatccagtttcagctttctacatatggctagccagttttcccagcaccatttattaaatagggaatcctttccccattgcttgtttttctcaggtttgtcaaagatcagatagttgtagatgtgcggtgttatttctgagggctctgttctgttccattgatctatatctctgtttaggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctctattatttcattgagcagtggtttgtaattctccttgaagaggtccttcacatcccttgtaagttggattcctgggtattttattctctttgaagcaattgtgaatgggagttcactcgtgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagctcttattattttgaaatatgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagccttgtatcccagggatgaagcccacttgatcatggtggataagctttttgaggtgctgctggattcggtttgccagtatgttattgaggatttttgcatcaatgttcatcaaggatattgatctaaaattctcttttttggttgtgtctctgctcggctttggtatcagaatgatgctggcctcataaaatgagttagggaggattccctctttttctattgattggaatagtttcagaaggaatggtaccagttcctccttgtacctctggtagaattcagctgtgaatccatctggtccaggactctttttggttggtaagctattgattattgccacaatttcagctcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcggtggtgatatcccctttaccattttttattgcatctgtttgattcttctctctttttttctttattagtcttgctagtggtctatcaattttgttgatcctttcaaaaaaccagctcctggattcattaattttttgaagggctttttgtgtctctatttccttcagttctgctctgattttagttatttcttgccttctgctagcttttgaatgtgtttgctcgtgcttttctagttcttttaattgtgatgttagggtgtcaattttggatctttcctgctttctcttgtgagcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttgtaatttctgttcttttgcattttctgaggagagctttacttccaactatgtggtcaattttggaataggtgtggtgtggtgctgaaaaaaatgtatattctgttgatttgggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggaatctgagtctctttgtaggtcactcagaacttgctttatgaatctgggtgctcctctattgggtgcatatatatttaggatagttagctcttcttgttgaattgatccctttaccattatgtaatggccttctttgtctcttttgatctttgttggtttgaagtctgttttatcagagactaggattgcaacccctgcctttttttgttttccattggcttggtagatcttcctccatccttttattttgagcccatgtgtgtctctgcacatgagatgggtttcctgaatacagcacagtgatgggtcttgactctttatccaatttgccagtctgtgtcttttaattggagcatttagtccatttacatttaaagttaatagtgttatgtgtgaatttgatcctgtcattatgatgttagctggtgattttgctcgttagttgatgcagtttcttcctagtctcgatggtctttacattttggcatgattttgcagtggctggtaccggttgttcctttccatgtttagcgcttccttcaggagctcttttagggcaggcctggtggtgacaaaatctttcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaatgatgtgtcttggagttgctcttctcgaggagtatctttgtggcgttctctgtatttcctgaatctgaacattggcctgccttgctagattggggaaattctcctggataatatcctgcagagtgttttctaacttggttccattctccccatcactttcaggtacaccagtcagacgtagatttggtcttttcacatagtcccatatttcttggaggctttgctcatttctttttattcttttttctctaaacttcccttctcgcttcatttcattcatttcattttccatcactgataccctttcttccagttgatcgcatcggctcctgaggcttctgcattcttcccgtagttctcgagccttggttttcagctccatcagctcctttaagcacttctctgtattggttattctagttatacattcttctaaatttttttcaaagttttctacttctttgcctttggtttgaatgtcctcccatagctcagagtaatttgatcgtctgaagccttcttctctcagctcgtcaaagtccttctccgtccagctttgttccgttgctggtgatgagctgcattcctttggaggaggagaggcactctgatttttagagtttccagtttttctgttctgttttttccccatctttgtggttttatctacttttggtctttgatgatggtgatgtacagatgggtttttggtgtggatgtcctttctgtttgttagttttccttctaacacacaggaccctcagctgcaggtctgttggagtaccctgcggtgtgaggtgtcagtgtgcccctgctggggggtgcctcccagttaggctgctcgggggtcaggggtcagggacccacttgaggaggcagtccgcccgttctcagatctccagctgcgtgctgggagaaccactgctctcttcaaagctgtcagacagggacatttaagtctgcagaagttactgctgtctttttgtttgtctgtgccctgcccccagaggtggagcctacagaggcaggcaggcctccttgagctgtggtgggctccacccagttcgagcttccaggctgtgttgtttacctaatcaagcctgggcaatggcgggcgcccctcctccagcctcgctgctgccttgcagtttgatctcagactgctatgctagcaatcagcgagactctgtggggtaggaccctccgagccaggtgggggatataatctcatggtgcgccgttttttaagcccgtcggaaaagcgcggtattcgggtgggagtgacccgattttcccgattttccaggtgcggtccctcacccctttctttgattaggaaagggaactccctgaccccttgtgcttcctcagtgaggcaatgcctcgccctgctttggctcgcacatggtgcgcgcacccactgacctgcgcccgctgtctggcactccctagtgagatgaacccggtacctcagatggaaatgcagaaatcacccgtcttctgcatcgctcaggctgggagctgtagaccgcagctgttcctattcggccatcttggctcctccccccgatttttcttaaatgctggttttttttttaaatacatgaaatcgttttatgtattttgaatatttgaatgaggaatccatgctatttgtttcttctcacaggttaaaaatttcaaatgcttatatttagcttgcattattaacaaatgtctcttttctcacaattcatacatttaacaccactttgtgctctgttagtaatattttaattgttctttgacaccttaattagatagtaatcttttttagacaattttatagtattttaataatttgtctataaattttgggattatgtcaaatactctttgaattctattttgagaagcttttgtaaattcagtttcagccaaattttatacttttctctgaactcttcattttaactccatttacaatgttaaattttttgtttgaataaggatcattttccttttttattctcccctagtacatctatacagaagtcaaccaaaatttcgtctcactctgcatatatgtctgaaattaaaaaaaaacttttattttcaaatttcttctcaaataattttgatagatttatgaatatgccaactatgttaatttaaggaaataattgagggtcaatttctgaactctcttacaaataatgtattagtccgttttcacgctgctgtaaaggaatacctgagactgggtaatttataaagaaaagagttttaattgcctcatggtaccacagtctgtataggagccatgatgctggcatctgcttaacttctggggaggcctcaggaaactaacaatcatggcagaaggcaaaatgggagccaagactttatatagctgagagcaggaggaacagagagaagagggaggtgccacatagttttaaacaatgggatttcatgaaaaatctatcactagaacagcatcgagaggatggtgctaaaccattcatgaatgattcacacccatgatccaatcacctcccacggaggccacatctccaacactggggattacaattcgacaggagatttgggcagcgacacagatccaaaccatatcgaatggtaagaattattttaattcccattgaggttgtttataaaatctataaaactaacatacatttgtaggtatatatttatctatatatacattttatacatacacatcactacttaaatatgcacgtacagcacacacacagagcactcatatgtatgtatgtttgtatgtgtgtgtgtgtccttcagatgttagaacacatttgaaaacttccagaaattaatgtactttgtaacttttgacaagttattttatcattctgagccttggtttcttcatctgcaatatgcagtaacaatgtatggttttctgggttattggaataattagtgttagaacacctagcacagtgcatgacaaatatttaatgcttggtacatgatatttactcttcatggcatgtttggtatatatgaataacaggaatagctgtttctagatttaagaaatctagattaagaggttgcttcttaaggagtcatttatttaggaatagccaatcaacccacttgtcattaagatctgaaaacattaacttctattttatggagaatatctagtgaaaggtatacttagagttctaatcaagaactattattttgctcaataattaacaatgtctttctttataagtatttaaaaagagacttgtttttaaagtctcaggaaacttacattcatggcagacggcgaaatgggagccagcatttcatatggctgagagctgaaggaagagagagtaggggaggtgccacataagtcattctcttatgaacaagtaactaatactaccaaatctctttctagacttgtttttgtattataatgtttatatcataaacatgtattcataggcagacatatatttacttttattttaaactttttaagtgaacatatattactttgtaatgtattttttaactgaaaatgtcacatgctaaataacacactgtagtcttattttatcataattgaaacactatctctaagcaatatatttcaagaatgagacagagaggggaggggaagaaagaattctatgtcaaattacaaagactagtatagtcatgtggaactgccactgggtgtcttcaaatactggctctaccactactagctcatcaagcttgggaaggatgtttaatttttccctgctttcagtttcctcagttgtaaagttgaagcaatcacagtgcctgactcatagggttataatatgtttagaatagtgtctctcatataataaaatgttcaaaacaaagaaagtcaaacaatatttgctgtcatcttgtgaacagatttttttctctagtttttttctccactatatttgcataagcttccatttaattgacatatcatagcatcaggatatttcacccctaaacacttcagagtgtatctaggattcaatatttgtttctgacactttattttttaaggcaaaatttatatacagtgatgtgcatatgtataccttaaatgtatcacttgatgagtttagacaaatactgtatcccagatccttagcaagatacagaactttactatcaccctaaaagttctctttatatttcttcccagtcagtctgttgtctgtcccataggggcaatggctctctatttctttttttaaattctcactatgaattgaattcacatgaatcatttaaaactttgtaatgaagtcagacagcatgtacccttttgtgaaaactttattccaatcaacataatgcttctgagatttatccatgttgtatgaatcaatagttcattccttttcatagctgagtagtattccattgcatggacatacaagagcttctttacacattttcttccagagggacacctgagatttttatagagttcagctattatgataaagctgctagtaacatccttgtacaagtcctttttggacatctactttcattcctcctgagcaaatacctaagaatgaattactgggacatacgttagatgtatgtttcattttataaaaaactgccagatatttttacagagtaattgtataatttatactcccagtaacaatgtgtgagaattctagatgtttcacatctatgccaatatttgattctttcagtttttaaacttttggctattgcagtctccctcttctgtttccaaataaatgcgcttattcaaaaattctgatttgtataagtatgggtgattcttattttttcttgtgccttttcagtaagtttaattttgtaaaagcatttttagcaataaattcagcattttacaaaattaaaaaataaatttagctaaaaaacgttatataaatacttgtcaatgttgtgtaaatgattacagtacttgtagcttgcgatataatttcagggacttctttacattaaaatgcaaatatactgtatcccaaaccaacttgagtaaagataatggtttcagggaaatgtgttggatgatgaaagaaataatctgaactatgatgaagaaactaaaagagaagagtcatgtgagatatttgaatatttatgctttttaaattaaacacagtttttccgaagtaatagtatgtaatatgaggtttttaacattattgttaactaatttaattattattattagatacagtctttttcatctacatgtttaaaatttcactaatttaaattggccaaaacttttaagataatgtttgcattggtaaaatttggttatgtatattagttttaaaattcatttaaaccctttaatagtaactacaacaacataaaattattatattcaatgaataattgacaaaataatacgtttaaaatacatgtagataacttagcatgacaatctttgatctggacgttgatcctaggagtatatgattctcccataattacacaatgaatgtaacactgggactaaaaatcagtccttctcctgccttctagactagcatttgatccatttattatacaggcactcctcagagaaatttcaggtttagtttcagagcactgcaacaaaatgaatatcacgataatgtgagtcacacagattttttggtttcccagtgcatataaaacttatgtttgcattatcgtgtagtctattaagcagtgattgcattatgtttaaaaatatatataccttaatttaaaatacttaattgctaaaaaatactaatgactacgtgaaccttcagtgaatcctaatctttttctagtggagggtcttgcctcaatgttgatggctgctggctattcaggctggagggtgctgaagatatgggtggttgcagcaaattctctctctctctctccttttagagatagtcttgttgtttttgccaaggctgaacttgaactccggggctcaagtgattctcccacctcagtctcccaagtagctgggacttcaggcacacaacaccatgcccagtttggctgtggcaatttcttaagaagatggcaatgaagttttctgcatcaattgactcttccttttacaaaagacttatctgtagcatgtaatgctgtttgatagcattttacccacaaaacatttcaaaatttgagtaagttctctcaaaccctgccaactgctttatcaactaagtttatgttacattcaaaatcttttttaaaattcagtgttcacaacctactcattagaagtagatttcatctaaagaaaccactttctttgttcatccataagaagcaactccttatttggtttaagttttaccatgtgattgcagcaattcagtcacatctgtaagtaagctctacttttaattctagttatcttgctctttccaccacatctgcagtttcctcctccaccaaagccttgaacccctcaaagtcatccttgagggttggaatcaacttttccaaactcctgttagtgttgatattttgacctcctctcatgaatcacaaatgttcttaatggcatctagaataatgaatcttttccagaatgtccagtttactttgcccagctccatcagaataattatgtctatggtagctatagacttatgaaatgtatttcttaaataataaaacttaaaagttgaaattacctcttgattgataggttgcagaatgaatgttgtgttagcaggcaggaaaacaatattcatttacttacacaattccgtcagagttcttgggtgaccagatgcattgtcaatgagcagtagtattttgaaaggagtcttttttctgagtagttgatctcaacagtgggcttcaaatattcattatagaatgctataaaaagatatgttgtcatctaggcttggttgttccatttatagagcacaggcagagtagatttagcataattgttcagggccctagaatttttgggatggtaaaggagtagtggcttcaacttaatgtcaccagctgcatgtcacagtcagctgacctgcatgtcaccatcacgagctgtatgtcatcatcaacctctcctttgaaactttgaaaccaggaattgacttcttctctcttttagctataaaagtactagatggcatcttcttacaatagaatgctgtttcatctacattgaaaatctgtttagtgtaaccacctttatcaatgacctcagctagtgttctggataacttgatgcaacttctatatcagcacttgctgtttcaccttgcactttatgttatagatatgtcttctatctttaaacctcatgaaccaaactctgctagctctcagcttttcatctggagcttcctcaccctctcttaactttcatgaaattgaacagaaatagggccttgttctggattaggtttcatttaagagaatgttgtggctggtttcatctatccagaccagtaaaactttctcagtatagcaatgaggctgttttgcttacttagtgtgttcactggaatagcacttttaaatttctacaagaactgttcctttgcattcacaacttggcttactatttggtgtaaaaggcgtagtattcagcatatttcatctttcaacgagccttccttactcaggttaatcatttctagctgttgattcaaagtaagagacacatgactcttcctttgacttgaacacttagaggatattttagagctattaattggcctaattttaacattgttgtgtttcagggagtagaaaggcctgaggacagggagagagatggggaaacagccattgaatagggcagtccaaacacacacaacatttaccaattaagttcattatcttatatgtgcatagtttgcggtgcccaaaacaattacatcaatggtaacatcaatgatcactgatcacagatcacaacagatataataataatgaaaaagtttgaaatattgtgagaattaccaaaatgtgacacagaaacacaaagtgagcacatgctgttggaaaaatggtgctgatagacttgctagatgcaaagttgcacgaatctttgatgtataaaaaatgccatatctgtgaagcactgaaaagcaaagcacagtaaaacaagatatgcttgtattgtgttgcctagaaggaggtctagtttaagctcagacatccaagcaagaacaacctttactttaaagaagcatgaaaatcactcccccatggtcactgtgtatgaattgtgactaagaaagtcacactaataagcactcagaaaaaaagcagacatggcaagcatttgatgacttttaggacattaaaaaaaatgattggccctgaaaatgcaatttgtaaagtttctaattctttcaagttcataagcaaagtgtaagaaaatatctcctgacagcacttgagtaatttgcttcaatcttatgaagtaatgtaaataagaaatggagaaagacaccatcccactcttacccccttattcttcaaaggcttcagaagaactggaattaatttaagttgcattagaaatattcacaaatgagtatgtctttcagatgtacaggcacacagtttaactttaggaattggggttggatgacagtttttagagatttatgtaagagtaggacagatatgggaaaaactcttctttctagtaataatcagccaccctctccaaactgtctccattattaagttctataagtgattgtcatcatgtccagagcaaagataaatgaaaattaagggtaggtatatattgttatttatataaaataggaaaaatggcattttgtgtatgggaggctcataaacattaaaaaacattcaagggcttttctggtcccatttttctcacaatgtctcaaatctattaataattatatgtaaccatgttttcttccactagaacccatcagttctgtgagaggatagctactatatgtaattgtctgaaaagaatactccaaatgtataaacatgcctttgttattcttgttacttgagtaaactatttgaaaatgcctattacattaaattcactgttacagaatacactgaaagaaatacgttgaaagtaccgtaagtgtaatatatatattagtcatatctatatcaaggagcctgagcacacagtatatattttttggctttgtttttttcagtggttgcaaatgatggattttatgtaatactgaaaggcctagctcgacctcaaacaaacgtgtataaaaatctgattgaaggaagtgattcaccagactcgttcatatctcagagtttccacagcttcatttggagtgaagaattcaaaaactctacacttgctgagatgtacctaccttcatatgactcaatggtaagagatgagtatttgctttttccacaagcaacaaggtaacgggcttttgtaaaactttatctcttccagacattaagatccaatatctttagagtcctgaaatatttacgataatatagcctttaaaatataaatgatattattaatacttacatttgattaaacatttttgataaaggatgccttcaacagcatctgaccactggcagggtttgtgtggtgtatttggtaacagacaaggttgatgtggctggatccctgaaagaaggataatagtagtttcagataagtgagagggaataggtgatttgaggagggagagacaggaagactaattgattatgaaagacctttaaatcaagtcaagaatgtatgtttattatgtttgtctcaagagcaatgctaagatagtcaagtagttaattacattacaatcagaaattcttaattgaggaaaatcttttgcatctatataatatttcaagactattagctggtcaaaaattaaaagttccatatctttccgaatctctggatactccacatgggatagaggtctgaattgactagaattgtggctgatagtcagttctcaatttagggtgatcaagatgttcagagtagaaaagagtcaaagaaccaattaaaaccaaataatttagcattatggggtacaatcagaaaaatccagaactaatatcatattcaagagaaataagcatggatcatatccagaaagaatgacaaggataaaaatgaacaagcctataaaagtatattattcatctcacatgaatgaatgatgtttctgattgtcttcttgttagggatggaaaacaatgcatttgccatgtcagtgaccacatataatggacctaatgctattttagtctgctctagcaaatatgccacgtttagcacaacagctgtaattagggcttcaaagaccgattttttttttttaatgttcaaactcatgtattaaatggggatatgatgggaatcaccagatctgcattctgctttaggtctttaggagcagtactaatttctggcattccacctgagatgtgatatggttttcaatttcctatcttggccagagtgggggaaagggtagagagaagtttcagaggcttccacttaatctttactgtgatagctcttactgcacaggccaagaaaccaatgtggaaactctacccactaccaagtatccatttaaattttgcttttagggaccatggatattgcccatggggtaggcttatggacccagtgaagccactgggaaacagacccaaaccaaaactttactttttaggaattctgcctgtttattctctgtaacaggtgaccatgatgacattttgtgtatcaaggctttaatgtcactatctcaaattttacagctccacttctccatcagggccctagccttagcataaaataataataaaaaaatacttgcagaggttgagactgctatagcagagctccagagaagataaatatgaatatatttatatctatgtgcatatctatctctctatcatgtatgtatctgtctacctacctacctaccaattatctacctacctaccggcctatttatataccaagtcagattctcagatttttctgccctctaactgttgaaaatgagattttctttatgtgctgccaaagaaccctgggattagatcattcatcttaaatgggtgattaattttcctcttccttttattgtattcctttagtgcactgagagctcccagcagcaatcatcctatgccatggtccttataaatactcattctacaatatctcagacgtctgagatattgtaccttccagtacattcccttctactagtacctaatgcctgcttaacatcattaaaattttatcagtggtactgatacaactggtcagagactaccagtactccagtgatggatttgtattgctagctggctggcaggcagttaagctctaaatccagtattttttctagtttaataaaattttttgaaaaaatgaaaagatagaaatcaaggcagacaattttaacttgcagcaactctgtggtttttgttgttgtttaagtttgcagaaggacaagtatatgattactgataaacttatttcacattgctaaaaatttaaagtatccttgctaaccctgtcccctgtagaaattatgagtttagctggtgttatgaaacatgctgctctttccctattttaaaaatttgcctttttgtgtatttacttagtgggcctttttcaaataaaaatattactatttccaaagatttgtgtctaggagagttttgtagttttgcacacataaagggctatatttttctttctcccttttttggctttataaaaaaacattatttgcttttttattgagtttcaacagagaaccgaacaactaagaagaagaaaaaagttataacattttcactcttcaatttcaccctccaacagtttggtaaactaatgggcatcatttgagtataacaaacataaggtgaaaaacatctaatccaaggatcaaatttatttctcatgagataatgtatagttgtgaataaaaattgttaaagctccaagcatctgctgttctaactctttactacaccctggacgaaaaataagtgcagtataaatgtacagtgaaacaattttttttttgcttttctcaacatagatttacacattgaagctgaaagctttttcattagagttgattatataaggaaagagataaaaaattacacatttatttacaagatcaccaacttaatgcttctaagtagctttaaaatctttcattaattttatttttccaattagtcttacaacttttaaaattataataataaattcaaatttcttagagacatctcagcataaatatagtatggtctgtgccaaaacacacacacacacacacacacacacacacacacacacagacacaaacatgcacttctatatttcatatttatatacttctatattcaacatatattactatctgcagttaaacatattttactaaaatctatttttgctatgattaaatttagcaaaattataaaagcaaattattaagttgaagattctcaataattattaaaagaactttctagtttgttaaagtagttttctttgaaatacatttggaattatgtggaaaaaactgataaaaatatattaatatattcaacaggcagggcccagtgagggtaaattataaaatagtaatttttttttacaccaaagttttcaaacaagtggtgtagtattactcttccatgatacctggatcttagcacctcaatcagatcctaggtattaatgaataacctcactctttttggtcttacaaattccagtcctgtctttatatcaaattttcaaactttcatgcttgatactcagcttatgccttattgtgccatagaatccagcagtgggaagaatagtttaaattggtctattcccctttcttactttgcatactcttttactcactagcttggttttctggctctttccagtcaggaaaggaaggaggctgggaattaaaggcaaaatggtaatgggaccttatgtgattggatgtccaaatataggctcgttttctcagggtgtttcccctcctgcagttccctggagctggtgttgcctcctagagggctttttaataccgtacccttgatccctggcttcaggcagtgaccacttgaatcgctttttagggtcaaaattcatctctccaggaggttctccagggttgttcccttttcgtacagtttagctggatactttttgtgggtccccccagttgatgggctagggaaagtttcaagtttactccactaaattgctgtgtcctcactctgagcccagaggtcactgggagtggaggaaaaagaaaacttcaggactctaaaaattgtcatgaagcaggtatctttcaatctttgctgccaacttcctgatctcatttctcaagaggatcttgaatttacagttgaaggagtttgtactcatttgagacagtagttgaaattatggactttgaatcttatacttaaaatagcattgggcacaaaaatctgtatttggaagatttttttttttttttttttttttgaggagtctcgctctgtcgcccaggctggagtgcagtggcgcgatctcggctcactgcaagctctgcctcccgggttcacgtcattctcctgcttcagcctccccagtagctgggactacaggggcctgccaccacgcctggctaattttttttgtatttttagtagagacggggtttcaccgtgttagccaggatcgtcttgatctcctgacctcgtgatccacccgcctcggcctcccaaagtgctgggattacaggcgtgagccactgcaccccgcccatggaagatttttgaatggataacaatgaaagtgtctagcagggtgtcacatactaacgcaggaaaaataattataggttcactgctttggtctaggagtgagattacaaaggcagggaatacacagtgattaaattcttagtttgtgcctatgtaaaaaaatagtttaagtaataggatatcaatacctattaaaaaaacaaaatgatacttatttgtgatcattttggaagctataataataccatttattttcttggtaagataagaaaaggcaatggttctacctctctttgtaagtgtataagttggggaaccagagataataagcatatgtagagaatgtaaataaaaaataaaattctaagcccccagccaactgaatagacccctcgtcttagccaagaacattacaaagttaacctgaaaaactagttgaggacataattgccaggggggtcagacattcctcattataccctcttgcttttggtattcaggcacaactgaccagcattaatgttaaaacagagaccttaagactgacaaaacactctttgtagccataaaatgccaacatgacagatggcaggccctggaagatattgaagtattttaccccaaaatatatttctttgacatattttgaaatggccctgaaaagctgtctcttgtggggaaaatcaatattctatagaaaatcgccttccctttccaggtctttttcctgatacaagagaaaattagctaagaatctggcacctttttaagtctgatatgaaacatttacaatctattatgtctgaagcctgctacctggaggcttcatctgcataataagaactttggtagccacaaccctttatattaatgcagatcctttatattaattaaccctttatattaattaaccctcttctattgattcagggtctttagataatagcttaactctttcaactaattgccactcagaatgtctgtgaatccacctatgacttagaaggcccctcttcaagttgtcccacctttccagatagaaccaatgcacatcttacatgtaatgattgaggttttatgcctccttaaaatgtataacaccaagctgtagttcaaccaccttgggcacatgttcttaagacctcttgagactttgccttgtgccacagtcatttatatttggctcagaataaatcacttcaaatatctcagagtttaacttttttcatagacaataatttaattgcttatggcataaacttaattgttgatatttatattcttaatgggaataaatcccaactcaaaaatattctttattttcttgtatcaattactagctagtctgtcaataacaaaacctctgaaaaaggacagggtggagggaggaaatgtggtaaaatcaacctgctgccagtatgtatatttccttaatttacagtaaagttattttgaacaaattaatcactaaaccatcaaatcctaacttttccatttcccaaatacaaaatatttctaacctgtgttatcagcacaacctgtattattcaagctgaggataatgaagccatgagtattttatgcatactgcccagtacatctgaggttttatcagatatctagagaaaattcagaaggcattgataaatggtggatccaactaaagaaagaatatctcatttcgtaaagcagttgaatagcaatttcatcttcagatcctggataaaactcaaccaatttgtttcaaacaagaacatattccaattaattgtaagttctgcatcaagtgactattgggatatcttggaagagtaaaggcaaagtcatgtttgataaggacaaggaatttaagctatttgattttgctgcctccagatttctgataatgggtgctgcctgaccttctgagtacgccattccctgcggtcagtgctccatattcttttacttgtctcttcattatccaacattcttcacagattcattcctggtatggtcttaccctggttccctaaatcttttacctcatttattcatgggcatttttgaaagtggtgttttatagagcatatttttaatatgcaacacaactactataaaaaacaaaatgaacggcaactagaaaaataagttttcaatttaagaaacacatctaaattattcgtgacacaaaacaggagtcacaataaaaaatcaaaactatttcaattaaacaaaaatacataaatgtcacatatcaaaacaaaaataccatgaatcaaaacttgtaatatatatatgcagtgaaaaaagacacagaatgtgatttgctgtttagtattgatctatgtgtgactggagtataaagtttatgttttgtttttttaattaaaaaaaattttgtataaatttatggggaatatgagccctgaaaatttgagacaggtctcagttaatttagaaagtttattttgccaaagttaaacatgcgcacccatgaacagcctcaggtggtcctgatgatatctgcccagggtgttcagggcacaccttggttttacacattttagggagagatgagacatcaatcaacatatgtaagaagtacattggtcccatccagaaaggcggggacaacctgaagtagggagggggcttccaggtcactggtaggtgagggacaaatggctgcatttctttcgagtttctgataaacctttccaaaggtgacaatcagctatgcatctatctcaatgagcagaaggataactttgaatagaataggaggcaggttggccctgagaagttgccagcttgactttttcctttagcttagtaattctggagctccaagactttcttttcacagacccatatgcaattttgttataagtatataattgagagtgatcaagtcagggcatttagggtgtctatctcctgagtataatacatttttgtttaacaatatcgtcctccttgcttatcaaatgttgaatttatcccttttaagtaactgtatttttataccctttaacccagttctcttcatctgcccctcctccacttactcatagacatttaaatggttctttgctacttctagatgtcccctgactcatatcccaacccccagtgttaagatggcttcctttaagtcagggatcttatttttctctaatgcgtagtataagtatgctaggagcttttaaggtgttcaataagaataaattaaattaaatccagttaaatttaattagacagagacttcaaaatgtcaaagatgaactgtgaaatgagttttgattcaactaaattgcaactgatagaggatttaatctatattgattaaagttcagttttattacatttattttatctaaactgatgtttaaaatatatgtgattgctttattcttaaaataaaatgtaaacattagaatattcaaatgttcaaaactaaaatgtcaatcaggaaatatttttactataataatggaattggaacttaacatctaattgtctctccgatcatcgaaacatttaatacagatagcttgtaatatatttataacatgaagctatttcttaatcatcacaacatgtagttgccttttgttttcatcaagagttaaaatgtgtgctgtaactaaaaacaaacattgggtcatagtaaatttactactgtttaaacataaattagagaaaaagtaaaaattatactttgtgtaaaatttttacaactcttgtattataagagcaataaaagagatatgtttattggtacatagtaagtctgtttaccaacgcttttttaataacatcataaaataagaggacttcacatataaacattaactccgatatttcatttcagaaacatacacttaaatacaattgaagcttttgtttctttacatcttcccatttttttaatataactgtttcttattttactacatttatgaagacatcaaaatataatcaagcttgctgttgtttatctcatgatattaagtattgtatttggagattaaataatttcaactttatgtaagattaaaaaaaagtgttatatttgaaggtaggaaaataagtatagtttctggtttatggatgtttgcatgccttctgtgaagcgcctgatattgtgtactcgttttacttttgttttctttgtctttttacctattaatttataagacttttgattatagtagtgatataattttttaatatacgtgttgcaaatatgatttttaaatatattgttgatattctcactttatcattcttttattattatggatatattgtttttttctttattgatgtttgctttcccattattagcagtatttatgataagaaaactagtaataattgagtacatactatatgcccatttcatttaaagtacagcaggttcttggactaatatctcatatccattggtttattttactttagtgcctattttatcttcataaaattttccagaactactgccttaagccgattgttttcagttttggtgtttttttgtaattgccttgggattctttactcctttaatttttaaatttttctgacaaacacaaaatgatgaaaagatgaggcaagcctggtctataatttttactctggcaaacctgttctgtaatttttccattacttctggaaaaagcttatttatattcatttcccatgtcataatttccattatctctttctgtcattaattagactgggaatgagaagcttttgggtttgcaaaaccccaaatggatgatgccaataactatcagaattgttgacaacaacataagctttgagtatagtctgcaacttttaaatatagattttatttcttctcgagactgaaaaccatttcatgaaagttggttagagaatttggtcttaatctctgtatcagttaagagagttttggttttatgttatctaaattactgctaatgacttaaacaataagaatattttttatctcacagaaagtctttgagatagatgactttagggattaatttagaaccacaacaaaattacctggacacagaggctcccctgtctttccatcctgtcccttttagaatgctgaatttcttcctcagatttgcacctcaattgttagcactcttccaggcatgggagagcagcactccccaacctttttgtcaccagagatcagtgttgtagaagacaatttttccacggactaggggtgggggatggttttgggatgatttaagagcattacacttattgtgaaccttatttctattattattatattgtaatatataatgaaataattatacaactcatcataatgtagaacctatgggagccctgagcttgttttcctggaactagacggtcccatctgggggcaactggagacagtgacacccgaattatgttgcctatgtccagtctactccataatctcgttttggttactgtcactacagaaaactctgcttcacaaaggtaggatattggaaacaggagcaggcttttcagtgcttttgtggcaatctcaggataatctccaccttgactttaatccagaacatatggggatttgaagttgtctcaaacatacttttaaggccaccatcatttgtgatctcaagcagttgattcgcttctagcacggacaaagtccattcatctggcttactctcaaatgagttgcagatccattccttcccagttaagggctcttttctggtttggaagtaatgctccaactcttttgaaagctgagagaggtgatcacgcaccagctctgagtaagacggccctggctgtgtctctttcaaaatctttactaatatttgaaacatgtcagaaatcccaatgttcactcattgccccataattccagtttggctttgaatgcaattactttatctgatgacttgaacacagttgtcagtctcccctggagtgacagattaaattccttgaccatgttgaatgtgtcacacaagtaagcaagttttgcgatccattctgcgtcactgaaatatgctgccaggggtgattttttttctataagaaatctctggagtggctctcataactcaaaaactctggccagtgatctacctttagaaagccctctcatttctgtatgtaagagaagacgtgtttgctctgcatccatttcctcatagagttacgtgaacagatgtgagttaagggcatttaatgcggttgatacttttaatcacatcctgcaaaatgtttttaagttcaggtgacatttttcagttgttaagttcaggtgaaatggcatttttcagctagccacaatttctgtatgggtgacacggtgcatggactcacattcagaagtgacctcattgacctgagtggtgaaaccagaaagctgtccagtcatggaagccacttcatccatgcatacttacacaaaatgaccaattttcctgatgtgtaatcattcaaagactttaattgttctgcagctgtggtgttgttggttggccaaaaaattgcccataacatattctcatgcacatcctcctgaaaaatatatcacacaaaaccaagaattgttgccttgttgtcaacattggtagactcatcaatctgggttgtgtaccatggtgactcattaatcctctctagcaattgtgcctcaatatcttctgctatttcatcaattcatctggttatagtgctagctgaaaaaggaacttatgccaccttttaaactgcagcctctcctaaaagttcacaatggatgtttttagtagcaggtaggatcaaccttcaccagtagtaaaagacttcctagctttagcaatgcagttagccactaagaatgatgctgtcagtgcagacacatttgataaagtggtggccttcaataattgcttctattctttgtgttcacatttttttcttttgaaaaactgcagaggcttgtcttttaatacagggcgcttgatcgccatgtggagaagcagctttgaaggtctcatggcttcgttggatagcctgttgccacatattatataaagcaggattggagaatgtgaatcacctgttgcagtgaatctgcaatttaagtaggattcttggtattttcttttaaatacaactttcttttgttggcagtcacagagtcttttgatgtcccctcattgggtctttcccccttttcaaagaaatcttccagtgacatttggtttttactcattttggctatggttagcttgtgggcttaccaaaactgtgactgagacaagtacacagtgcaggaaagaggcgtgaacagaagtggtaaataaaataatgagagggccacgtatggactaaactaagtgtcagattctgacttaaagcctgccaccagatgcaactatacaattgaagtatatcaactcactactataactcctgccaccagatgcagcttgtcacttgccactcactgatagggttttgttatgagtctgcaagcaattgatttattatggtctctgtgcagtcaaacctctctgctaatgtgaatctgtatttgcagctgctccccagtactagcatcactgcctcagctccacgtcagatcatcaggcattagattctcataaggagcacacaacctagatccctcccatgcacagttcacaatagggttcatgctcctataagaatctagtgacactactgatctgacaggaggcagacctcaggaggtaatacaagttatggggaatggctgtaaacatagatgaagcttttcctgcttgcccattgcttgtgctgtgtggcctgattcttaacaggccacagagcagtataaatctgtggcccaggagtcagggacccttagggtagaggatgcttcttcatcatgtttttacccctttatctgtggagaaaacatttccacaaaatgcacagaaggcacagactcccatttccatcccattggctagactaggttataggtctatctttcaaccgcaaattgataaaagtgaatataatcaccattattagtttaaagcaatcaattaagattcagtcccaagaactaggttcatgatctatgtgcactttgcagcctaattcctaaccaaatcaggcttctgttagcaagcaaaacaggagtgaagtgctattgagcagatgaatatgtttctgatgcaaaattctcaggagttagtttgacagtatgcaagataacttaatcatccagtagattagaaaggctcattataaaaacaggacccttgaacttaaatataaaacttcaaactgttagaagaaatcattggagaaactctttgggacattggcctgaacaaagatttcttgagtaataccccaaaagcacaggcaaccaaagcataaatagagaaatgggatcacatcaagctaaaaagtttctgcccagcaaatgaaacatcaacaaagtggagagacaacccaccaaatgggagaaaatatttgcaaaccacccattttaaaagggattaataaccagaatttataaggagctcaaacaactcaatagcaaaaaatgaaataatccaattacaaaatggacaaaggatctgaatagccatttctcgaaacaaggcatactaatggccaacagatatatgaaagaatgctcaacataattaatcatcaaagaaatgcaaatcaaaactccaacgatatgttatctcactccaattaaaatggctgttatccaagacaggtaatcacaaatgttggccaggatatggaaaaaggggaactcttgtacactgttggttggaatgcaaattagtataggcactatggagaacagtatgggagttcctcaaaaatataaaaacagaactaccatgtgatccagaaatctcactacagagtatatatccaaaaggaatgaaatcagtatatcaaagatacatccgcactcccatgtttattgcagcactattcacaatagccaagatatgggagcaacatgagtgtccatcaaccattgaatgaataaagaaatgtggtatatgtacataatgggatattatttagccataaaaagaatgaaatcctatcatttacaacaacatagattgaactggaggacattatatcaagtgaaataagccaggcacagaaagagaaatattgcgtgttagcactcaaatgtgggagcttaagaaaaaaaactgaactcatggagatagtgagtggaatgatgtttgtcagaggcagagaaagatagcagggattgggggataaagtgagatggctaatgggtacaaaactacaatgggatagaggaagtaagatgttgtatttggtggcacaatagggtgactataatcaataatagtttattgcatattttcaaataaccaaaagaatggaattgcaatgttcctaacacaaagaaacaataaaagcttgaggtgatagataccccaattacccttatttgatctctgtacattgtattcctatatcaaaacatcacatgtaccccataaatatatattactgttatgtacccttaataattaaaaaattaaaattaaataaaaattataaattataaatacaggacccttgagatcattagtaaaatttcagagccctagtttttgtgatgttttagggccctagttcttcctaacgttctgaatgttggacatgactgttagtaatacaacagtctttcttagaaattggattgaggcctgggtgcattggcttatgcctgtaatcccagcactttgggaggccaaggcaggtggattgcctcaggtcaggagcttgagaccagtctggccaatatagtgaaaccccatctctactaaaaatacaaaaaattagctgggcatggtggccggcacctgtaatcccagctacttgacaggttgaggcaggagaatcacttgaacccgggaggcagaggttgcagtgagccaagattgcgccattgcactccagcctgtacaacaagagcgaaactctgtctcaaaaaagaaaaaaaaaaaaaaagaacaaaaattggattgactacttttgtctaggtaccatttaggatttattccttccaaatgctatggtaccattcagagtcacatgaccataaatatatttcatcacgctatttttctaattgtattctttagtcattttagggccacaatgggcaataggaagtttaggtaaaacatttcattcttcttacactggctgggtctcagacactcatctcttatatgaataattcttctgtatttatctttttaaaaaaatacatgtatacttctaagcaaactttctttgaagaaagtattttttttttctgagatgatgcttataggtagatttgaaacccatcattgtggaatccatcttgattactatatctgatgggcagactcatctattcccacataaattgataagaatttgagtgtttttgaagaaacaacaaacatataaaaacatttaaattagacttagtccctggtgacccttctgacattcatttctatttttccattctgttataatcagaattatattcattattatgataaatatggttcaacagtggtccaagatatactaaatcttacatcagaaaaaggaaaaggcttttccatttttaggtttacttaaatgagaagcaaagtgcactttcccttcatatctaagtatataaaatttgttgacaattgaatatcaaacaatgataattgactctcaatattttcctattgcagtgagagttttaatattattcaaaatcaattacgtttttattccaataattatttttacatgaagaaagacaatttcatatctacactctgtaaacttctttataatcagaggagcaattagttattttacttagagaataaattaattaaaacacataatttatttttccactggtattttagtatggttaacttaaccttaaggaagcacttgagctgtaaactgacggctctgctgagaactgggaaagcaaaaatgaatgcaaccttgatcctgttttcaaatttaaaatctagtatatattgttagtaaagttctgatagatgtcatggggaatccaaaactcagagggattttttcttgcctctaaagagtttacagtctggttgggggcttaaaacatgaaaacatacacagtaagtggcaagatgagttagtctcaattaaagtgctaaattacagggacagatgctacaggatgtcaggggtgggatgagctgcgtggccaaatatgcctactgagaatggggagcttgtgatgcactgtaaaggaaaagtagggcttgactaagtagaaaggagagagggcacatacgtttactgcaaagaatcacgttttaaacaatgatttagaaatgagtaaatgcctggtatgtgaaaagtttgggaaattcagtggacaatgaataataggcaggtctagagagaaaggagagaagagaaagaaagcagaggtcagactacgtcagattcctaagggtagtttaaaaaataagctaaaacagccaagccagtggaaagtttgaatatattctctttttccctttactcacttatcagggccactccccacccttctctcccttgccctttaccccaagactggcccggaggattacgtctaagggctcttctgccttctggcttgcagttagagtcagcccggggagagagggagcaggagaccagaaagaagtaacagagtggagatcatagtgtttcttccctggcatcctctgcagaattgctggctgaatctaagtctgaaggttgcagctcctgtcagatggccctgtccacacagccctctgggtcgtgaggtctagaaagcacgtccacctttcattatttaggcctgcaggaggtgcctgtgccctgcccttagccccaggatattccatctgatttgcctacaaccttaataggtagtttcttcattcgttctcatagtacccaagtgccatgtggtatctcttttctggtaggttcctgactggtagagagggaaataatgaaggaattgttttaagaaggttaatattgtggccgaaatagatagattgacaaactagaactagggagaaaattaaccaacagaaatgagcatttaagtgccaaatcaaggtaaagaaagtacagttgccattgggagattgattagtgaccaaaagtgatgaacaacaaaaacaacaacaaaacattaaacataaactaaatagtcatgaggatttcaagaatataagaattggacgggaattggaatttagttacataaaaaatcaacacgtataggatgaaatttgagtcactagtaaaattctagtatcatacacaaagtagaggataaagatctctaaattagaggagagaaaaagaattttagattgcaagttttagattacattcctatgttcatggagtaatgtctagtagaactttgagatgtgactggcattacagaaataggtcagaaatggagaacagtttaggaatattccaaatagtagtgacaccatgtcatcagagttgatgagttctcaggcaacgcagccacctaaagtgaagaacagagacctgaggacgaaatccttggaaaagactcccactaagcaagcctgagaataaaaagaaggcagtaagaggaactgagaaaaaaattccagagagatagttggaaaaggactcatagggtaacaattaataaagaggctatttcagtgctgtgtagcttatcatgtggttcaatcaaagcatttctgtttaatagtcaataatttgtgatataatttttgtcatgataagtattataacatgattaaaataggaaaaggaatattatttctttggatggcccaacacatccaagtggtatcaactgctcttccctctctgggttttggtttcaatgtagaggattctcatcaactgaatattcttctcagtatagatatgcatgtagagggatggtgctaatgacttcactgtaacaaagatatggataatttggaaccctcattcattattgttttgcaagttcttctggaggaaataagtcaggtggggattttcacgtatcacctgttcaagcaatatgtgaagtgcaatagcacccagatccctcccatccttaacagacactggaccttttaaaactatttttcagcactccttttatttagcgttaggtcagttccttgcttttactctgttttgaggctactgtaatagaaaatggggcaagaagaatgtcattgaaatatttagcttgctaaattaaaaagaaagtaaaagcaaaatacttttttttcctggttatatttcagtgactagttttaattaaaaactctattcactgattttttttaaaaaagatttttactacctgatctttatgcattcagtatggcctatgtgcgaaagaaggggtttgattatagaacataatgatgtaatgatattctgtagaggacaagtctgtctacatgcaaaattacttaatgcaaggttacttaagaccctttgcatttcagttggattatgtcatctaccttatggatttgcaaaaaaaagtcgacagagacaacttgtggaaacttgtggaatcaagggacaattggtgttcagggaagggagtggcatggaagattgagaaagaaccacaggaaacaagatgtagagggtccagtaaataaactctctgcatgtaaaaaaatgtactgagtagttataatttatacttactgttaatagcctgataaaatgatacctgtgcaagaaagtagagctaaggtgtaaaaagagaagaaatgattatagttttttgagaaaagagatcagagaaataacaatataacaatttaacatatacctgccatttaatatatagatttgataatcttaaatatttgaaaaatctatataaatataatcaggtttttaaaaaaatactaaaaataaatatctgttgttataattttttagcatttaatacaaatcttttcctcagtcattctgtatgtgactctaagctcacacagttaacaaaggacaggaattgagtcagctgacacattagagccaaactgcctaacttccaacattgaccctaccagttaccatctgtgtggccttaagaatgtgccttagccttctgggtctcatttttcttattttttaaaatgactattttaacaaactacttcatagggtaattatgagaattcagtgagtcttgagcatggtgcttaataggaagcatattatgccttaaataaaataagacaaaaaagactgatgttgcaagattcatatatatatataaaatactcatatgatttgcagctacaaatatatatatatatatatatatatatatatatatatatatatatttttttttttttttttttttttttgagacagggtctcactctgtcacccaggctggagtgcaatggtatgatctcagctcactgcaacctctacctcctgggttcaagcgattctcctgcctcagcctccccagtggctgggattacaggcacacaccatcatgcccagctaatttttgtatttttagtagagatggtgtttcctcatgttggccagggtggtcttgagctcctggcctcagtgatccacccatctcagcctcccagagtgctggtattacaggtatgagccactgtgcctggcccaaaaatatacttttaaattaagagaactgtactcatatcaaggggaaaaaataattatttgaagttacattattttttagaatgtatgtaagtattgaatccaggtgtcctggttggctctcctattgcctagctatgggaacctgagcagtgaagagcttcactcgtcccaggttgctgtgaagactgatacagatgaagtgcctggcagcagaaggtgttccacaattgccagtagtttatttcttcttcaacaaatccatccctctctaccctcttgggccatgaattctgagtatcaaaattctctctccccatatctaaagatcagtgatttgggggaaatttgtttttaatttgattctatacagcactttttttctttgggaaatgctgttcacatcaaggatgtcatcttttcttgggagaaaccatcctggttagttttcccttaaggtttacaatggatatacagttccaagagtataaagagatctttgtcagttgtgagattatgaatccaaggttcaaggttctgaagttttgctgtagtgtgaatggcaaggacagtctttctatgatgttctcataagatccaatcttcgggttctagattgtgaaggggttgtcctcagtgaaccacaaaaagctttctttacctggtgaaaatatactgtaacataataatctactgttataacatcaacactcttgcatgggaaagcttttatacaatcagaaaacattcattgaaaatgacaattgggctgggcatggtggctcatgcctgtaatcccagcgctttgggagactgaggtgggtggatcacctgaggtcaggagtttgagaccagcctggccaacatggtgaaacctgtctctactaaaaataaaaaaaattagccagtgtggtagcaggcacctgtaataccagccactggggaggctgagacaggagaatcgcttgaatccaggagatggaggttgcagtcagctgagattgtgccattacactccaacctgggcaacaagagcaaaactctatcgcaaaaaaaaaaaaaaaaggaaatgacaattgaatgaaatttctttataaatgtttatgtggccaatcaggtagccaaatgtacctgaagctttgattgtcttcctgggaatatggaaccacacattggttttaaactatttctgcaatttataagtcacctcatcaatatattcaaattggatcattttatattttccatgataagtcatggaatgcagaacctttaatagcagaagctttaaggactcaggaaggacaaggcagccatcctggttctccgtgagtccatgcttaacattggatttatgtcctcttgaataccagttgattctccaatttaggtatatagcactgataactaaggggttatcacaggtaatttgacttagactgtggagttcaaattgtacacctaaacaatttcagtatcagctggtttaacatgaatatctggaaaagtattttcttggtatttaattaatttttgttctacttgggttagcatttttatacaaggaaatttggttacttctatggtgtacaataacataataacgttaattatgattgacagcatatactcagacatattagaattttagaaatcccatacaattttgaaacatatcttaatatcattcactaaaatataacctgaagattaaacattatttttatgttgacaatgcttcccatgtaacttaacttgttaaagaattctgtttacctgtctttgggatgctttaagtgccctctgtatcatcccaaagttagagatcagaaaagaccattttgaagcttaaatttgattttgggaggcctattaaatatgttaaatgtttaaaacacttgatattgtaaactagaattccaggttaccataaggcattcatttagccaaaatgatgactcaaaaattttttaaaaggcaaaaacctttactcattgataaagggaagacttagatttgcaagcagtctgtcttttgtctttcccttctttatttgtgtgtgtagtgtatttaaaaggcaaacaaaaatttttcttttttttatttcttttttttctttttaagatggagtctcactgtctggcacaggctggggtgcagtggtatgatctcgactcactgcaaccactgcaactcctaatctcaagtgatctgccctcctcagcctcccaaagtgctttacaggcatgaaccaccatgccaggccaaaatttttcattatcttttaatattacatgaaaatcttgttgaagagagaaagccaaatttcacccttgcactagtggactattaatgtcaaccccaattttcagtaaaccttgtatacaaatctatccaatcctaatcaatttgaccataaggtgagatttttataaaccttttataaccctttacaaatttttgttaaagagaaaacttgtgctttaagaaaaccctgttgtgcttttatttacatgtccaatttactgaaaaacaaataatatccctttagtgaatattttcacacagagtgttttcacaaggttaatttttatataccttccacaacttgtttaaacctttagtttatttaatttaaaacaatcctttaacctaaactaagcaaacatttacattctcataccttctaataatctcttaccaaaacacatttcattctccttacacaccttgtatgtaaacctattttttcagtagtctcaattacatgttatagtggtaatttttaacaattttcacttttggtgcataaattttcttttataaatcctttcacaacttatacaggctatctacgacatccttggactttctgacttgtcctaaacatccctctttttaaacaacccgtcactttaggacaagaatttaccatgaattatatgaattatcttttctttataactttctttgcatagcaaggaagcatggctaattccacatatccctaggccttatttagaatttaatgtctccaaaataaattgaacaattttcaaaagttaaagcagtttatgaccttaaagcatttagcaaacctaatatctgacctgcataagttagaccaaatgtttttattttactaataatctttaaagctgttcttatttcccaaaggttactaaagttacaactaaaagacattactgtttttatttcactttcaaaatatttgatttaagtgcttatttttgtttaagccaattaattagcacttttttatataaacattacatacacaacacatatgtaactacacagacagacagaacgagattactacaatagttgtaagatttttcatttgcctgtttttaagtttcttaattggttattggctttggggtggggtccttggaagaacagagccaggaaaggctctctggtgcctcctgtttttcctaaggagtccagactgtgagagtttgaataaccgcttttaattaagctgagttttaaccacaggactctttaataaagtccttttaaaatttagtattacctgactttagataggccaaatggctgatatttctcacttttgaactttacgaaaggtaaccttccaggtgctcggagaaaggaaaatttaagacagtccgtggacaagaagagaatcgacaaggatacacagacattaaaccagaaaagactcattttttaagctgagaatcaaacctcgactgccactgtgaaagggaaaaaatcttagctactgagctacagcacaggctggtctaaattgccattgccagttggagtctgtagtagttaattttgagattgcaaaggcttttaactactccagataatttttagagctaattacgacctgaaccctaaaattcctgtaccctggaaggcagagaccaagagaaagtacccccatgtggttacaaggttaagctctcaaagacataaaacaagatggagacctcatcagtttttttgtttatttcagggacctgcagcaaagtttgttagtgaccatcttgctgggtcatcttgagcagtgagcttatgggggcctaagcccgtattttttcctaaggtactcctggacacagaaaaacaaattcatagcacaaaatgcaccagatttattacagcttaagactagcctcagaattcttttttgcattaatcaaaactttacaggggagataaagtgatttttaccattcattccactgtttttgcacagggagagaaaagccagaaatctgactggtaagaaactcttacccttttgccaggatgccaggtttctgggttttctttccttgagcggccctagtgacccagctcaccataccatagccatggaggccaacccacaacacagaagaaaatctttttctttttttttcactgtgttgttgttcatttggaatgttctactataagttatctttagtaagattttgtcatttctgtaagactttactgcctcctaggcctaatgtataagccagaaggaactcagttttccaaaaattgaggatcccattttttatctaaaatattggctttactctcaggttctcttcattaacttagtcaatgatttttcctacctaagcatgcaagaaaaatgacacaaagggatagaacacaaaaatccctgtgaattttttaaagccaaattttataacccctgcaatactactgcttcctaccagtccctttctgacccagtcagaggtaagagacctctaactaaattcaagacagttaattcccaaatacaatttgttcccggacccagtccagtttctatcatgacttgcaaacccagtttggatgagaaatgtgctcaaagaaactcagagagctcaaaacacaaatctgtggagctccaaaatctgaaagggagcttacccacgatccccagctgctctgagagatcaatggacacaaatgggtcctgcaggtaccttgcgggttcagtgctcctgggggttgctagaagctttactttggatcccacttctgacaccatctgttagaagaaaaacttcagctgaattaaatttaatggagtttaattgagcaatgaaccattcatgaatcaagcagccccagaatcacagtggattcacagagactccagcccagccacatggtggaagaagttttatttatagacaaaaaaaaaaaaaaaaaagagaaatgacatacataaatcggcagtgaggtacagaaacaactggattggttacgggttggcatttgccttatttgaacagaatttgaacacttagcagtcaatgggtggttaaattatggccattgggattggccaagactccgttattgttacaggtgcctacttctaagttaggttttcagtcttgtctgactattaagctaggttacaattcatccacagggactcaaatatagtagtacagagtccttctcaggtcatatttagtttgctttaaccgtttctagtaagttccttattaaaatgcaacataggccaggtgcagtggctcacacctataatcccggcacttcgggaggctgaggcagggagattgcttgagctcaggagttcaagactagtctggccaacatggcaaaactctgtctttacaaaaaaaaaaaaaatacaaaaattagcctgacgtggtggtgcatgcctgtagtcccagctactttgagggctgaggaaggaggatcacttgaacccaggaagttggggctgcagtgagcctggatcatgccactgcattccagcctgggtgacagactgagaccctgtctaaaacacacaaacaaaacaaaacaaaaaacacaatataaataattgttgaacattatgtttttattagatgtcgaaatataaaaactagaagcagaatgttaaaaacataagattaagtttcaggataagctttcctcctttgatagaattactttctaattacaggtttctttttcttttctgatgtgatgtttaattttatgtgtcaacttgactgaactaagagatgcagagttagctggtgaattgttttttctaggtgtgtctgtaagggttatttcagaagagattagcatttaaataaatagactgagtaaagaagatcaccttcaccaatgtgggcagccaacatccaatctactgataatctgaataaaacaaaaaggcagagaaaaggtaaatttgctctctctgtttgagctaagacatatatctcctgcccttcagacatcagtgctcctggttctgtttttctggagaaccttgactaatatgcctgctttgaagaattcctagtctaaggcaggaattataaacttttagcttggttctgctacttgagataaattattatgaaaatttaccgcttaggcatccaaaaaatataaacactttaaaagatccttatctgttctgttaagtgattgtattctggtatcttccttatgatcaattcacttttatagacagttttaacatctactatgtgttcatttggcaattaatacaaaatagtttctgtattggagataatgatgatggagtgggaatgggtagaaatgcatctgatagcttcagtttaatgctatgaatagagtgactaaagtaagcaaagttcattgtgggcgcaagaagttggagcagcagacccagattagagagctgaggagagacttcctagggttagtggagctccttttatatgtgttccttgtaagatgtcacctggaaagaatgatcaaaattgtgatggtattatatatagtggtttcaaccttgatgatcattcttccaattaaaaataatgtttatatttactttagtgtccttgtcaactatgatgactacaatttatttctccttataagcttgtcatttgtgtgaaaaccatgcatatttgtatataataatactagcagttgaaacttttttctatttttaagctttttttcagataatttttaaatgaattgtttttgcccacctttagaacttggtatgcataatttgaattgggcaacatgtatagctagttgaatacattattcaaaatcaggacatgctggctggctttggttccttaaagaggtgactaagatgttactcagccaacatgtaaataaatacacacagtcacaaacaaaattgttttcagtaaaattaggtaagtaattgtttttttcaaagcgtttacattatattcacatagaatagtatgacatccaacgaacacagttctgttattcttctattattagtagaaaataaaccaaaaattatttagagcaggaccatgaaattttaccaaggcaaacaaaattcctaacctttggtactttactcctaaaagagcttaatggataacatattttacttatactcaacatataaatataacaagcctggaaatggaatttccaaggccaaagaaaattaaatgtaaaacattagcaggcaacagagaagatatactaagaggaaattaatcaatttttaaaaatctaatactataatttttaaggtactttacagttcacaaatatcaaatcttattatactcttttataccatatattacataaaatatcactgttactttatgttgagtattaaaaagtattttattttatttttttattatactttaagttttagggtacatgtgcacaacgtgcaggtttgttacatatgtatacatgtgccatgttggtgtgctgcacccattaactcgtcatttaacattaggtatatctcttaatgctatccctcccctctccccccaccccacaacaggccccggagtgtgatgttccccttcctgtgtccatgtgttctctttgttcaattcccacctatgagtgagaacatgtggtgtttggtttttttgtccttgcgatagtttgctgagaacgatggtttccagcttcatccatgtccctacaaaggacatgaactcatcattttttatggctgcatagtattccatggtgtatatgtgccacattttcttaatccagtctatcattgttggacatttgggtttgttccaagtctttgctattgtgaatagtgccacaataaacatacatgtgcgtgtgtctttatagtagcatgatttataatcctttgggtatatacccagtaatgggatggctgggtcaaatagtatttctagttctagatgcctgaggaatcaccacactgtcttccacaatggttgaactagtttacagtcccaccaacagtgtaaaagcgttcctatttctccacatcctctccagcacctgttgtttcctgactttttagtgatcgccattctaactggtgtgagatgatatctcattgtggttttgattttcattcctctgatgactagtgatgatgagcatttttttcctgtgtctgtcagctgcataaatgtcttcttttgagaagtgtctgttcatatccttcgcccacttgttgatggggttgtttgtttttttcttgtaaatttgtttaagttctttgtagatttcggatattagccctttgtcagatgagtagattgcaaaaattttctcccattttgtaggttgcctgttcactctgatggtagtttcttttgctgtgcagaagctctttagcttaattagatcccctttgtcaattttggcttttgttgccattgcttttggtatcttagtcatgaagtccttgcccatgcctatgtcctgaatggtattgcctaggttttcttctagggtttttatggttttaggtctaacatgtgagtctttaatccgtcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgtcccactggtctatatctctgttttggtaccagtaccatgctgttttggttactgtagccttgtagtgtagtttgaagtcagatagcgtgatgcctccagctttgttcttttggcttaggattgacttggcaatatgggctgttttttgcttaaatgttaaaaagtatttttcacataagataatgggataataattttatagtttttaaaaaattaaagtaaataataggaattatctggggacttgatcaaatgaatgaaactctagatttgaggatggcagtttcaatctttgagctaaatctaggctgcagtctctttttcttaataaagtttttatggaacacagccacatccattcactatatatcatttatgactgctttctgctaaaacagcagagtagaataattgtgacagaaactatatggtctgcaaaactgaaaatatgtactatattgtctattacagaagaagtttgctaatcacctctctaaatggaaactactgaagaaatgagtaaaatattagaaaacattcttgtaaacacattgttgatttggcaataaaacaaaaaattcccagaaacttaggtaataatcagttggataatatcattaattaaaagattctatttaagtagctatacaaaagattgagcacttaagaaaaatatagtacactgtaagccagtacttttggaagaacattatacattttctttgaaagatatcacagaagggttcaatatagctaaattacattcatgaacagaaacattcaatatcttaaagataagtgtcccctaatgatttatacatttcatgcaattccattggaaaaaaaaatccaaacaggttccttgtggaacttgaaaaggtaattttaaaaactataccaaagagcaaaaggctaagaatacactagatatccctaaagaagatacttgggaaagaggagcttttcctattaggtataaaaacacaaaataaagctataataattaatactgggcactagcgactgataggtaagcacactgatatgtaagcaattccaaaaatgaggtccaagtaaaaaaaaaaaaaaatcttttttttttttttttttttttttttttttgagacagagttttgctcttgctgcccaggctgcagtgcaatggcactatgtcggctcactgcaacctccgcctcccaggttcaatggattctcctgcttcagcctcccaagtagctgggattacaggcgtgtgccaccaccccggctaattttgtatttttagtagagaaggggtttctctccatgttggtcaggctagtcttgaacttccgacctcaggtgatctgcctacctcggtctcccaaagtgctgggattacaggcttgagctactgcacccagccacaaaagaactcgatgtagaacagtgacatgaagagcagtgagtaatgtgggttcattcatttgggtaagggcagttggttatacagacagaaaagataaaactgcatgcctactttacaccattcataaaacttaatttaggcatcacatgcctaatgatgaaaggaaagacttcgaatattttaggtgctcttttcttcatggtatcataacagaaaacaccttaagtaacagacttacagaaggaaactatattgatacctgtttaaaatcagcagccatttgttcatccagagatattctaagtaaatgaaaagacaaggcacacactgagtgaagatatctgcatcatacacaaatggcaaaggattaatacctggaatgtatagtgatcaacaaatcaaaaaggacaatataatgaaaattacaaaatatataaattggtctattacagaacagaaactatgaaataaattggcaagtacaagtatgttcaaccactttagcaatcaaggaaatgtaccataaataatttgtacatttaaaaataaatctcagtaaataacaaaaatgtacagtgaatattatttcttacaccaaattggcaaatgaaaaaaaattagacaatatataatgatggagaaattgtgaagaaataaacattggaggtgttcctactgctgatatgaatataagaatttgtgttttggaaaacgggttggtattagatgctctagtgctaacatggcttataacaaagaaatcgtatccatagtcatatattttagagatactattatatatcaaatgaggtaacatgtacaagaatgcttctatcacaattgcttcatagctaaatgctgataaaaatataaatgttcatcaacaaaagaatgaataagtaatttgagtatagcatacaacaatggaaaatgaatggactacattaaacattaacatggttgcatatgctacctttatctaaatgggagaaatttggtttctttatccagatagtgggcccaaagtaattcattttatcattatttttcaatggatatatgattataaaagtagagcatatagttaagaaacttaatctctttaatgaatatggagcaaaaataaaattcaaagtgtttattttaactatacacaaaaattgtttaatttagtctgctagtatttttgtttagtagtattctgtttgcttatatgttttagggtctggcgatacacatgtaggtttaacacaggcaaattgcgtgttgctgagtcttggtgtatgaatggtcccatcacccaggtagtgagcacagtacacaacaggtagccttccaacccacaccctcctcctacccactcaagcagtccccagggtctatcagtcccatatttgtgtccatgtgtattcaatgtttagctcccacttatgaggaagaacataaagtatttggttttctgtttcttcattaatttacttagataatggcctacagatccattcatgttgctgcaaaggacatgattttgttcttttgtatggttttgtgttagttcatggtgtatatgtaccacattttctttatccagtccaccatgatgggcatcttggttgattccatgtctttgctattatgaatagtactgtgattaacatatgagtacatgtgtctttttggtagaataatttattttcctttgggtatatacccagtagtgggatggttgggttgaatagtggttctgttttaagttcattgaggaatccctacactgctcaccacagtggctaatttacattcccaccagcattgtgggaatgtaacctcaccaacatctgttgttttatgactttttaataatagccattttgactggtgtgagatggtatttcattgtgatttttatttgcatttctctaataattagtaatgagcattttaaaatatattcactggtcacatgtatgtcttcttttgagaagtgtctgttcatgtcctttgcccatttttaatggggtttttgcatgttgaattatttaagttgcatataggttctggatattagatctttgtcatatgcatagcttatgaatattttctcacattctgtatgttgtcagtttactccgtttatagtttcttttgttgtgtagaagctctttagcttaattaggtcctacttgtcaagttttgtttttgttgcaattacctttggggacttagttataaattatttgccatggctgatatccagaatgatattttctaggttgtcctctagggtttgtattgttttaggttttacatttaagtctttaatccaccttgagttaatttttgtatattgtaaaagaaatgggtccagtttccattttcttcatatgactagtcagttatcccagcaccatttactgaataggcagtcctttccctatagtttgttattgtcaactctgttaaggatggtggctgtaggtatatggctttatttctgcattttctatcctgttccattggtctatgtatcttcttttgtactagtactatgctgttttggttactatagccttatagtatattttgaagttagataatgtgatgcctccagcttcgttctttttgcttaaaatttgtttggcaattcaagctattttttggttccatatgaattttgtaattgttttttctaattctgtgaaaaaatgatgttggtagtttcataggaatagcattgactataattgctttgggccgtatggccattttaacaatatttattcttgctatccacgagcatggaatatttttccatttgtttgtgtcatctatgatttctttcagcagtattttgtaattctcattgtgaagatcttttacccccttcataagctgcattcctatgtgttttactcctttgtggctattgtaaatggaattgctttccccagactgaactggaagaaactgaaatcctgaacagaccaataaccagttccaaaattgaatcagcaataaaaaacctactaaccaaaaatagtcctggaccagatggattcataattgaattctaccagacatataaagtagagctagtaccattcctagtgaaattattccacaaaatcaaggaggaggaacttcctgattgtatgaagccagcatcattttgatgccaaatcctggcagagctataatgaataaagaaaacttcaggccaatatttctgatgaaatagatacaaagatcctcaacaaaaatactagcaaattgaatccagcagcacatataaaagttaattcaccacaatcaactaggcttttattcctggggtacaagactatctcaacatacacaaatcaataaatgtgatttgccacataaatagaattaataataaaaaccacatgatcatctcaatagatgcagagaaagcttttgataaaattcaacatttcttcatgtgaaaaaccttcaagaagcatttatgaggaatttaaacaaatttacaaggaaaaacaaacaacctcattaaaaagtaggcaaaggacataaacagacacttttcaaaagaagacatatatgtggccaacaagcatatgaaaaaaaactcaacattactaatcattagagaaatgcagatcaaaaccacaatgagataccatctcacgccagtcagaatagctattattaaaagtcaacaaataacagattctggcaagattgtgagaaaaatggaacacttatacatttttggttgggagtgtaaattagttcaaccattgtggaaagcagtgtggtgattcctcaaagagctaaaaactgaactaccattcaacccagcaatcccattactgggtatataaccaaataaatataaatcatcctatttgcattaatgttcatcaggaatattggcctgtagtttctttatttttaaaaaaatttatttatttatttttttggctgtgtcctagtcttgttttgctgtgtgggtaatgctgaccttatagaatgagtttgtaagtattcccttttctttttcttcttcttattcttcattctttttggaaggatttcataagagtttatattagttagttccttaaatttttgttagaatacagcagtgaagctgtaatgtcctgggcttttgtttgatggaggactttttattatggctttgattttgttactcattatttgtttgttgagattttctatttcttcatggttctatcttggtaggttatatgtgtccaggaatttatccatttttttctaggtttctgaatttgtcgttgtatagttgtttgtaattctctctaatgattctctgtatctctgtgatctcagttgttatgtctcctttttcatttcttatttaattttggtcttctctcttgtttttaaattaatccagctgaaggtttctctactttgtttatcttttcaaaaaaccaccatttcactttgttgatcttgtatatattttttttcagtctcaatttcatttatttctactctgatctttgttatttcctttcttgcttgcttttctagttcctccatgtgcatcattatgttctttatttgaagtttttcaactttttgaaacaggtatttacttctatgaacttatctcttaatactgctttttctgtatcccacagatgttaatatgttgcatgtcaattttcatttgtttcaaggaatttttaaattttcttcttaagttattcattgacctattggtcattcaggagaatgttgtttaacttctgtgggtttgtgtaattttcgaggttcctcttgttagaatggcttttataaaaaaaattcagagaataacagacgctgttgaggatgtggagaaagaaaaacccttgtacactgttgatgagaatgtaaattagtatagccactatggaaaacagtatagaggttcctcagataactagaaataaaactaacatatgctcccgcaattctactgttgggtatttacctaaaagaaaataaattagtatatcaaagggatatccacactcctatgcttattgcagcactattcacagtagcccagatacagaagcaacctaagtgtccatcaatggatgaatgaataaagaaaatgtggtatatatacacaatggaatgttaatcagccataaaaaaataaaatcatgtcaactgcaacaatgtggttggaaatggaggtgattgtgtaacgtaaagtaatccaagcacagaaagacaggtatcacatgtgggagctgaaagagtgaatctcataaagataaaatgtaggctggtggttatcagaggccaagaagggtgggggtgatgtgtggtgaagagaggttgattaatgggtacaaatacacacttagaataaataagacctggtgtttgatcagtaggatgattatagttaacattaatagattgcacatttcaaaatagttagcggggaataattagaatgatcctagataaaaaataaatatttaaagtgatggacatcccagttactctgatttgattatataaatgtatgaaatcatcacatgtatctaaaaaatatgtgcatctaatatgtatcaataaataaatgccacattgaaaaattttaaattattttcacattgaatttaggctgacacagttatttcaatttatatctcagcttattcaactgaatcttctttataagactatattaaattcagagtaaatgaaaatgtgagcaattgaatttagtgttatgtgggagaaatgttttcctttgaataagacaggagcaatgtttctagtttatgacaagaaaaagtctgtgatattaagctcccaaaatgtatcatcttttatacaaaattcagatcatatcagagcagtcaatttatacatggataaagcatataacaaatgaatgatggtaatccattaagccaaagggttttataacttcaatagctagtgaacatgtggtgagcagttgtgtatgaatacatataaagtatgcatttaaatgtacactccattaagtttttaataaaccttatgtgctaactttaaaaaatttatgattatttaaattagtcactaacaacttctttaattaacactaaatttcacattataacacagaaatatttttagttcttcatgctcgctcttccaaaaattgttaatatgcttatagttatattttttacagtgtaacatccaagtatggaggggcaattctaccaaatgatatgctgaaataattatttccagtgactgaatgatgttacccttatatatcagacagatcaatttcccctaataataggaaaattttaaaatttcaaataatagtagtactgtagtagtgattatataacagtagtacagtaacggcaatacagagaaccaataatgtttagaaaattatgaaatatagctcaaattattttattaattggtttaatttttaaaatatatatctggttgaattaaatattcaataattcctactgaaattcatgaaaatgctgaatcatgatgggtgactgttggaatttagttaataactaactgggcacataggaagaagaaacgttctgcctctttacgattaagtaagaagcccaaatctacctgaacagaaaagggagactgttgttccagtcaatgctgaaggttttgtttctctgaaacaaattcaaaataacaacaaaccaatgcaaataggagtacttgagatccacttgagattcaattcatggttatcagccaaactgtgctcttggactaataggatgcagcctgagctgttcaggagactttatgttgtgagtaatgtgacacttatcccagtaacttgttttctctaagttctccagttactttatcatgaatatcgttattctttgctgatccactccttttcttgcactcttatctttttataaagtagtaagtgtatagctctttaaaagatttttgaaataatttaattgacaaataagtttttttttaaattattatactttaagttttagggtacatgtgcacaatgtgcaggttagttacatatgtattcatgtgccatgctggtgtgctgcacccactaactcgtcatctagcattaggtatatctcccaatgctatccctcacccctccccccaccccacaacagtccccagagtgatgttccccttcctgtgtccatgtgttctcattgttcaattcccacctatgagtgagaatatgcggtgtttggttttttgttcttgcgatagtttactgagaatgatgatttccaatttcatccatgtccctacaaaagacatgagctcatcattttttatggctgcatagtattccatagtgtatatgtgccacattttcttaatccagtctatcattgttggacatttgggttggttccaagtctttgctatcgtgaatggtgccgcaataaacatacgtgtgcatgtgtctttatagcagcatgatttatagtcctttgggtatatacccagtaatgggatggctgggtcaaatggtatttctagttctagatccctgaggaatcgccacactgacttccacagtggttgaactagtttacagtcccaccaacagtgtaaaagtgtgcctatttctccacatcctctccagcacctgttgtttcctgactttttaatgatcgccattctaactggtgtgagatgatatctcattgtggttttgatttgcatttctctgatggccagtgatggtgagcattttttcttgttttttggctacataaatgtcttcttttgagaagtgtctgttcatgtccttcgcccactttttgatggggttgtttgtttttttcttgtaaatttgtttgagttcattgtagtttctggatattagccctttgtcagatgagtaggttgtgaaaattttctcccattctgtaggttgcctgttcactctgatggtagtttcttttgctgtgcagaagctctttagtttaattagatcccatttgtcaattttggcttttgttgccattgcttttgatattttagacatgaagtccttgcccatgcctatgtcctgaatggtaattttagcctaggttttcttctagggtttttatggttttaggtgtaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagctgtagatatgcggcgttatttctgagggctgtgttctgttccattgatctgtatgtctgttttggtaccagtaccatgctgttttggttaccgtagccttgtagtatagtttgaagtctggtagtgtgatgcctccagctttgttcttttggcttaggattcacttggtgatgcgggctcttttttggttccatatgaactttaaagtagtttttttccaattctgtgaagaaagtcattggtggcttgatggggatagcattgaatctataaattaccttgggcagtatggccattttcacgatattgattcttcctacccatgagcatggaatgttcttccatttgtttgtatccgcttttatttcattgagcagtggtttgtagttctccttgaggaggtccaatagatgcagaaaaggcctttgacaaaattcaacaacacttcatgctaaaaactctcaataaattaggtattgatgggacgtatctcaaaataataagagctatctgtgacaaacccacagccaatatcatactgaatgggcaaaaactggaagcattccctttgaaaactggcacaagacagggatgccctctctcaccactcctattcaacatagtgttggaaattctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagtattcttatacaccaataacagacagagagccaaatcatgagtgaactcccattcacaattgcttcaaagagaataaaaaacctaggaatccaccttacaagggacctgaaggacaaataaattttaaaaatgatacacacatatgacaaatataaccctcacagtaggaatcaatggtaaattcattactctcattactatctaatacgtatatatagtataggcattggagagtctttgttactaatacattgatattagttggcttgcttatcacctacaattaatgtcttcctatctatatgtagaaattatttttccttggatgttaccaatgccttccttttattaagatgctgtcatcttgatccttctttcagtttttattttatttaagggaaaaaatatcaaaatgagattcaggctcttgaggacattttttcctattacaagcaataatttatgtagaaatttttggtttactttaccagaatctccacctttatgagaaaaggcttggatgccatggtctggttgcttgttctgaataattttgttactcacttcataatgcgttgataagggcaagcaagaaaaaacagtccaaacaacagaaatggagaaacggaagtaggtcttgtttaaaagaagctcagttgcttcaatctattgaatgtcagtctgctttataccatggtgaagtagcttgcctcagaccagtccccttgctgagaacaactataaaagctgaataacaccaaattaataacagtttgaaggttttgaagagcaatcaagggaaccaagattagagtggctataattcaagaaagaagggaaatacattatttcgagccagacatgtcctgctgcttttccttagagacatccaacagcttgcaagcatcataaggataaataaatgagcagaaaatagtgaatagaacttacaggaaccttagaatgccagagcaccatgaatctgagtttagtctaccaggcagtcaggccttgaggggccaagatactgagaaaagggaaccagagaaaatggagcttgaataattattttttttttttgaaatacacatctggttgaattaactattcaatagttccttcttacatttatgaaagtgctgaatcatgatgggtcatttatatatatatatatacacatattcatatatgtatatgtatagatttattataaggaattagctcaggtaattatggaggctggcaagtccaaaatctgcagaggtgatgtccaagtttcagtatgatggctgaaaactgctatagagccagaaagagctaatgtacctgttctcaagctgtcaaggaggataattctgtcttattcaggggaaggtcagccttttatgctatacaggcctttaactttttggataagacccacccacagtatggagggcaatctgatttactcagtctatgtatctaaatgttaatctttaccaatttaaatcagaactcatccaaagacatctccagagaaacacacagaaaaatgtttgaccaaatatttggacactccgtgatccagtcaaattgacacataaaatgaaccatcacagaatttgagtaatatgtagctacaaatttaagaagtagaactttcgccagtctcatgtattttatagacagaaattaggagtcctgggtctgtcaagtataagaggtcctgaaaaatatgtcagtctatcagttgaaacccagaaccaaaacactgtcctaaagactgaaaaccagtctcaaaatacctcaattattggttggggccatttagtctgctcctatactaattgactgtgagaaaaataaagtacctcagagaaagatgacatagctagaacaatcaatggttttcatacacaacatccagcattgactaaaaagttatcaggaatgtcaaaacacaagacaacattttttataaacaataaaaaatcagtagaaacaaacacacaggtaatttagatattggagttattagttcacaataataataatatttccaagatcatatctgacaatgaaagaaactagaattgtgaacaataaataagaaaatggaagcttcataacttaaaaatgtaaaatgaaattaataactcaatagatgtagttattagcagattagacactgaagaagagagttactaaactggaaagttgattagtagaacatgtcataagtaaatatgaagaagaaaaaagatgaatgatagaaaagaacataacttagatatgagaaatgaaaaattctgataagtatgcaattaaaagcccaacacaaggataaataagaaatatagtagaaacaatatttagtcctgcctgaagcagtactgattgaaatttttttctgactgtggaaagacatctaataacagatttaagttgctgtatgaattacaagtgaaacaaccacaactagacacattaaaattaaactaatgtaaatcaaaggtagttaaaagtcaaagtagacaaaaaagaaacacactccaaggtaaattttaatgaactcgtaacaaataatgaatgccagagaacaataacatatatttttaaagcattcaggaaaaaaagtaacttctgacctagacttttataaccagtaaaaccatctttttgaatgaaggcaaaataacgttgtattcagacaaagagtaaagaaagatctcattgcaagcaaagttacagtaaaagggatgacaaggagacaaactttggcagaaacaaagttatccagaattcaagtacagaaaagtagaaagaactgaagaacaaagaaacttcttggtgaatatgtggataaatctaagtattagctgactgtataaatcaatattattccttgtgaagttcctacatgtatatagaaataaaatacatcagaagaagcaaaaacagcaatagaatagtgtaaaaaaatttttcaatccttgcctttctgagaagtggaaaaggtaatatagcacttccttcttatctgtggtttcactttccagtttcagtaacctgaggtcaactttggtctgaaaattccattattatgtttaaatttttttctaaatttataatttttctatttaattaatagttatttttgttaatcttttattgtgcctaatttataaagtaaactttatcatagatacatatgtaaagaaaaaaacacatataggattcagtattatctgcaatttctgcatgcaaaaacagtctggaatgtatcttccatgcataatgagggacactgtaatttagggtacactttagtaagacaaggatgcattggtaataactagactaatcaacaaaatgataatgaaagaatatataagttaaaagagaacaaaatatagaaaaatatttgattagctcaaaatttagcaataagtaggaaatgacacaaagaaatagaaaaatagcaaatattaagatggcagatttaaaagcaaatatacattaaacgtaaacagactaaatactttcattaaaaaagattgtcatattgcctaaagcaataccctgtatgattacccaccttattagaaggatacagaaagttgcaaagtaaaataacagataaaccagattatactaaccagaaggccaaagtagctgtactatagtaggcaaagtagattttattgcaagagcatcattaaaaataaagatatttcataatgagtatgaaatgtatatgcagtaaaaattattacctcaaaatatacaagtaaatatgcttatgttttatatcgagattatatatttttatatatatgtataaatataactaaatatgtgtagtgaaaccacagataaaaaggaaatgctttatattaccttttccacttctcagaaaggcaaggattgaaaaataatatatttatatatgtatgagggacataataggaagccatgcttagccaacttttaaagagaaatttattggctacatttacaaactgatttgatttgtaggttttacttagaaagtgcatattcatattatcctgaaagatattttttttctataattgaaaaggtgatcctctttgattcagcatataggtttggaataaatttatccagaaaatttctatttaagcatacagacccatccctcagacaatggaatgcgttaggtccccatcagattctcacattcagttagttccaactttaccttccagatatcagtgtatagtcccacattctcccgaagcatgtgaaatattataaaatgcaatgtctttctaatcttttcttatcatggtttggttttgagaatgcactttttataaaggccattggagtctaaatctttggagaaaaataatttttttcaatctggagcagtgcttattactcttctttggagacttagacaactttgagaatataattaaagctaatagaaactcattcaagaaaaatagatgtacaaataatcacaaactatggaataatatattagaagttcaagaagttcatctattgacgagattatgagtgcctgatctttgtgtttttgttggtccatttcatcagccccttagaaaagaaaaaacatgttgtgcaaagtttagagcaagctactatttaaaaatagtagctctaattttacttatggatcttatttaatgtgtaaatgcctggaggctaaaagcaatggaaaaaataaggacaaaaattatacctatgaaatacttctgtttttcaggaaattgtatttttataaaatgcagtttagaacaaatctcaacattatgactttattcaaaagaaagatttatagatttaccaattcttattcagagggagattgttcgggttatgtattattatagaagttgaaaaaaagcatgagaatacatcatttctcaataaacttagttatcaatttatttttcagtaaaataacatgagaatttacaagtatgagaaactgttccatctgtgcaactctaccaactatccccaccagaagaggattatctatgtagccttaatagatgatattttcaaaaaaattgagagactgagctataaagtaaatagctttatagtgttgtctcatttaagaactgctatatttattaaaaattcagaaaatacagaatataaagtagaccatgattattacctgcagttttcggatataacaactgtaatcatctgctgtatatcatttagatattttatgtatatttttaaaggtatcaaaacaacacatgtatggaagataactcagcattctgtttcaaagtcacattttaaatttctttaataagtgtctaaaatttacaaatgtaatacatactttctatggccattgaaacaaatacaaggaggttggaggaaattttaataaatattctgccagtttagctccatcactatcccctgaacatatgaaccatatcagcctgacatgtatgcttgcacatcttcctctgaattgacgctggcatttaaacaactacatacacatatggattactgtttttctaactgttcattttttaaaaaacgatttttaatatactatctactatttgtttttttcatcagaattcttctaggctaagatatatatatatatatatatatatatatatatatatatatatatatatatatatatatataactaatttttaccagtatattaaaacttagacttggttgaattccttaaaatgtatttatttctacaaggtagattcttaggagatgcgtttctgggtaagacactgcatacattttttagtttattttaatagatattgccagataatttctcatttttaaaggtttttacagtttccagagttataaatgaaagttatctccctaatcctataggttagaggactttaatattttcaatctggtggataaaaaccatgtggtattatgacattaattacaattttctgtctcctactgagattgagcaggtttcttttgtgtgtgagtcatttggttcatctcttctggaaataatttttcttctaaaaatatttttggtatttttcaataactgttttggttattttctttgagtcaaattatagatgtttattagatatttgaggtattattctttacatttgccatttttgtaggaaatatccctcacttcatcactttatttttttgtcattgtactttttttcaacttgtatataattaaatttgtaatttgaaggaaacctatacaatatttttctttcctagcccaagaatataaagattctcaaatattttaattctaactttctgcttgtctgttctgagtgtttgaaagcaatttaaatctctcttattttaaaagagtaccatattagtcattctaaaattattatatatcaataatgctatttacatttaccaatgtttttagctaattatttgccctccattttggattcagtattgttctagctgaaattcatcttttagtcatttgtttcttataatgtctaaaattattatcttgtttctttactcttactctaaattgctatttcaagtaaataaagaattctgggttgaatgttatttttcctgagcacttttaagataaccatatttacagaacaaaatggaaaattataaatattaatacttttaaaaataattcaactaaaataattggtgtgtaaggcgtattggaagttttataatttcctaattattaatattagggagtctgatgatattttttaattaattgagaaagaaagccttaatattattcaaagtcatggatgatttttgctttcataatggcttattaggtaattccaactaactccctaaaacaatagataaattgaaaaaattaaatggacaatatctgcttgaaattattgctagctaatgagatcgtaaataggagatctagcagaggagaaagattaggagaatataccaaatcctgagcaggaatataaaagcaaatgcatctttcagttttgtgtgttgcttggtttggacaactcacttccctcagccctggaaaacttgcagccattatcacttatgtatcaccgttttcccattcttttcagtttcttctagaatttctgttagatatatgctaaatggtctccatctatcttctgtagctattacaacccccttcttatttccatttcttctacattttattccagagtattttcttgtatattatccatgtaatgaattctttttaaaattatctttaatctacaaattattgtgaccattatttacagaagttttattttgttcttttccaaaatacttctttttgcttccatcatgtcatgttctgatttttatagtctacacattttaaatatttgtagtttcttttaggttgttcaatttttttctccttcttcatggacttccctttatagggttttattcatttgtgtggcttgtaattttttttattaagattttgtcatcagcaaggattgctttctgtgggagttcctttctctctgaatttatacataaggttaagtttgtataataccttcctggatcctaggagttttactagttgtgtaccaggctttttattgatttttcagctttgggtcttctactatgcataagtgtatgctctgtactcattcaagttgcagacctaggttcttgattttctaacaattctgtccagtttcatggctagatagccagcttctatgtggctttcgtaaagtactggatgtagttcttcctgtccccacttcacaactggggcaatcctccaagttcctagactttaggcaaggaggcacaattccaggctctcaccttgcatggctctgagtcccatctcctgttcctacatgtacaacaagcctcagaactcagttcttcaggaccttatttgggtttgataggactgtggctcactttggcctcagctgtgactgtttgacattttaaatttcctctatatatttggacttgcagattcgagctcagttatgcatttagctaaaaagaaaaatagtctatggatttgaagtagaaaaatggaagttttcccatatcatcttagataggcatatcgacctgatgttttccctaagaagctcctcagcctctcataaaaatacgctccttatccttcacatgccctccactttttcctgagtaaatataaatgtaggttctctgtgcaactatatataatatcattataacctaataactcatgacatgtattctagtagtaacatttttccatgcctaatatttattgtttacatattaaattaagcaatcatccataaatattaatggtttatatactgtttaacattttattcatttttgttattactgaatactaccaacatgtgataataaaacaaacagaagatcatatatataagtgtacaaaatttcttcattctttcaactactatttattgaatggctgctatattccaagcactctaataggcactttaaatcactgaataaaacagaagattttttatgttattttcttcatgtcggtgaaaaagaatggccatttctcttgccttgggaagtgacatcgagcagaagtagtaggagccatccatgcagagacagtttagaaccccctctttcatagaatgaaagcttgacctacaatccaatccttcactggcattttcatgttgatgagtggtaataaacattaaattgtctctggtatttttacagcttagcaaatggagtacctttgggactctggaagttatgcctcagaatgaatcggaaacacagatgttctcggtggtgacagaagacgattgtgaaattcttaaaatcccagcaaagggatatgcaaagataaaggaggtaagatgatatctaatattttatataaacaaaaattgggcataaactcaagctacattttgattctctagacaaagacagctatatctgttttatttttaaattttaatttaacctagagaccataaaaatgttatttgacaaaaatcacttaagagtgctggtgataggtaggtgaggtgtaaacaaaggtctcaatgaatatatttcaggtaatttttaaataccctttggcttttcattaattttaaactcattaatttattcattcattcactcactcattcattcaacaaatatgtgttttgcatgtccgcagcatgtcatatgctaagaatactagaataataagacagataatagtactgctgctttcccagtctctgtagtctactttaaaaggaaaaatacttgaatgtgattgccatgatatttcataattacaacagatatcaaactcagagctgcatgaataagtgataacaacttattctgattccctaattctgcgtttttaagataacttcatttacttaaagtttaataatttattctcttctaatcaaatccaaattttttcttgactcctatttttcctcctttggatatcagaagaagtttgtataaataatgagattgaggctaggggcggtggctcatgcctgtaatctcagcactttgggaggccgaggagggtgtatcacctgaggtggggagttcgagccagcctgaccaacatggagaaaccccttctctactaaaaagacaaaattagccgggcttggtggcacatccctgtaatcccagcactttaggagaccaaggcaggcagatcagctgaggtcgagagttcgagaccagcctgaccaacatggagaaaccctgtctctactgaaaatacaaaattagccggacatggtggtgcatgcctgtaatcccagctactcgggaggctgaggcaggagaattgcttgaacccaggaagtggagtttgtggtgaggaaagatcgcaccattgcactccagcctgggcaacaagagtgaaactccgtctcaaaaataaataaataaataaaaaataatgggattcaaaggtttccatgatcctgctgtttcatctttttttgaatgagcttaagccaggtgcaggtcctgcagaaagctggcataagccatggttcagtgctcatgtggagtggtgttgagaagacatccatcttcttgggtctccagtggtggggaattcttgtgatttagtggtcccagtgtcagtagtgcaggtaattctctcagaattcaacgttattccaaatccctgatgtttatttgttttgattttcagagtggctagctttaacaaaaaattctttatgttttgtttttatttcccaaatatcagtaccagttacttgattttatcaaacacaactttttagtttaatcttgactatgacagggtttttaaaaacttctaaaacatttatagaagtataataaattatgaaaggtgagcaaatataattttagtaagtagatctgaagattaacattttaatatgtctatgtggccatagagtgatgctcagataaaattcaaatgtattctatactaacttatattcatatggcctttattttacttctctcaccatttatctatttgctatttctttgattttaaattgcctgttattaaaaatttgataatgacattctgttttaggaaaaaataaaacttgaaaatatgcaaaagttgaaattaatccgtatgtgtccttattatgaggaatggcctactttatccatatatgagctaattgcactccttaaatggaaaaaatttcctccaggtcatggtaagtttaatgcaatttagatcattttgtttgcattctgttatattattggaattgaaattcttcatagttgtaatattttatacaatatttcttcatataaatattctctaatttatttgataataacatttgaattggacatttagattatttcctgctttttattaaaaatgatactgtactggcttgaagtgtggtctcaggactaaccttacttttaacatctctctctactccctttaactgttccgcacttgctccaccctgacagttactataagggccaaactgaaaaggataaatactagagggtatagccactcacacaggagaaaaggaaaaaaaccatttttttcttttcctttttcctgggtggataactatttaagcagcaagtttgctaatctgtacttgtgctacatatattagccatggaaaaaaataattatggagaatgagtgaggcctagataagagaaagcagcagtgaagcacctacattttcaatattcagcatagcaaggatgcacggatttcctggattatgtgtacacaaaaagtgtaggtggtattgagtcattttgcatgatttgtccatctatgaaagccaatttaacaagggttgctaaaccaagaggaactgtggtaggatgggccagagctttaggtctcttttggtaaggaaacacaattgctacatgagagacagccacagataacagagagaggatggcgacctcgactctctttcctcacagccagtgaaggagccagaacttagattataatggaagaggaagtgtttgaaagaaatacttctaccccaagtctgcaaagccacaattatagtgagggacatttttaatttaagtttgagattaaagttctaaaacgaatgaatctgattggtaaattctagacagctactattttaataataaaaacatggcagactagttatgaaatctggctaaggtatcctttgagggaaacactgtaacacaggaaaacgaggttcagcataccaggagttcttttactgaaaaaaagtaaatatcattagaggcaagtttatgctttaaaaagcagggatactctaataaaccacttaaatttggtgagaatctaaaacctttctcgtatttcttccaaatttccttctactgcttgcatttatattttatttatcatgtttttgagatgtagcatttaatccatgtttagtcaaataactatttttgctcataaatttgaatatttgtaatattatgtttttgtttatgacatttttttcctaattagttataaatggcatttttttaaccaaaagtacaaatggaaggcaagtagtaaactgacttgtaaaaaatcgggaattgaatatttctaaattccccatgtttattacatagaaacagatgagcatcccagaaccagtttgatacctccaggtcccagtgattcaagtacctgtaatgatgatgcctttttgttccttcattcatccttcactggtctcttttgttttggacaattttttctaacgtagcatattaattcttataataatttttcaccatatttgctatttttcatggttgctttattttttatggttgttttggatttgtcatggttttgtcacaggtttcccactttttatcagaaatatcaaattttgatccttgcctctcttccatgcttttaataaaaatataatatccaatctttgcccatctatcattatattaatatttttgaggtgattagaaaagaggaaagagaccatcataaagatattttaaattaggggatccaaaagaatttgaaatttggaaaggggagaatgattatgtgttttaatatgtttgattactaatgataatctgtctcttgatctaaaatatcaatcaaaagtactaaaattttgcatcaaagagctaaaaaggtactgagacagttaacatactgtttcctagactaatattgaattcaagttcttttttgtaaatatcttgaaaaataaacggtggtgtttgttaaactaccgatagcattggacaatctgtgagtctattgaataagtcaaaataatattgttttctcacctattcccaaacatataaatgtgtggtactttcatagttttagaaaatatttaacctccttagagaagaatgacaatttcatctgataatcatcaaagccctatgagttctgaaagactgtagtttttataaataaatatacctacgtgaagaataagtcctgtcaaattcatctaattttcttttatggtagtgacaaacttgatatatcaaagagaggaattggattataatacttcctgactgtttagtcaagatttagtttgaatttttatcagagaatgtagagaatgtagctcaaattacacttttattatctggtttgaaaattagcagtagtatgatttccaagcataattatgtgtgttttgatcttattttaagaatgtacagtggatagggtttcagagggatttagttaattattcaaaagcttgatagagtttaggattaatccttggcaatcaatgaaataagtaaagcttgtatctgactctatttgctttgttaacttcttacatcttcctacttttgcttcatatgccaagggaaccttattataatgaatatgtacagtgttgcttataatttgggtgtgtccagtttatatcacatcggctaaagtcttcccagttgttattctttcaagatgtggccaacttgaaagcgacaaccagcttaggtcactaatcaacctgttcccatgtgtatcatggatataagaaaaaatggtaaactgacttggcaaacatttaactatttatgcatattttgttgttttcttgcttatgtcagtatgcccccatctttctccaggtaggatttgatatagcaaacatgttaattggaaaaactaaaaaaattacagcaacatatttagtgcagaaagataaagtatgtgaaaatcataataataacagtaatagtcaaaattatatctagttatctcaaaccaaatgtggagtgtttcagtcacaaaatacataggctctacatcccttcaattttttgacatcaatctcttccagttcaatttactcttcagggaatcaaaagtcttagtcccatgagacactcttgagcatcccagaaccggtttgatacctcgaggtgccagtgattcaagtacctgtgatggtgatgcctttttattccttcattcatccttcactggtctcttttgtcttggacaatattttctagtgtagcatattaattcttttaataatttttcaccatatttgttactttttatggttgctttaggtcttaccatataaatttcaatttagcagaatctacttcagatttttactaacttaattccagttttaaatgtgactcatgtagctctatttccatttcctcctttatatgttattattattatacatattgcatctacatatgttacaaatttaacaatacattattattttatataaagttatgtctcaaaaacaaagaaaaaagagatcaaatatatatttatagggttcattatattagacatcatatttaccatttctagtcatttttatttgttcctgtggacttgagttgtcatctgatatgctttccttagttcaatatcagttttctcccacctgctttcttatgctgctattggcaaatatattatatttctatatgttatagatccaacaacattatacacatattatttcacacaatcactctttatgagtaagagaagaatggataagaaatatgcatttctcctaccttttacaattacacatttacctttagtggtactttttgatttttcatgtggattcaaattactatctggggatgcttgtttgcagcctgaagaactttttttagtatttctttgagggagtatatgctagtaacaaatactgccaggttttcttgtactgagaatttcttcatttctcctttacttttgaaagacagctttgcagggtgtaggatttgaagctgaaattgggttattttgtgtaagttaaaaatgcaatcccactttcttctggcttctattgtttctgatgtgaagacagctgttaattttattgggattcacttataagtgacaaggcttttgcttgctggtttcaatattttctccttgtctttggcttaaagaagttttaccataatgtgtctgtttgcttattttcttacctagtactagaattttctgtcacatactttatagccctatttattactaatctctctgtttctgactctctcatatattgttagctatgctaatcagttttaaagtttttcttgttattcacccacttagaaatagtctatgtcctctcattgttattcaggtaaaatgcaaaatctttaatgtagtttgaaaggacatttgtatctgggccatacctatatctcaaagttttaattttaataattcttctctttttgttcatgtttctgccaacctggacttttattagttcttctagtgtcactatcgccattgagggcttttacacatgttgttccttcttcctggagaagttacttacccctcatttcagtatatttactattgttaagataatgttttctggaccaattgagattctattgctctttcttgcttgcagagatgcctctttgtctctctgggggtcaagaaatattttctgctaaagagcagatactaaatattagctttgtaggtcatatagtgcctctgttacatatccgcctccttcttctttttaatgcctttaacagtgtaagaatcacccttagttgtagtgttataaaaaaaaatgggccttgggtcagatttggtccgcggtctaaagttttccaactcctgtcctatcttattttgttaatcgccttattttttggggtgagggggcacaggggacaaggtctcattatattatccaggctggactcaaactcctgggctcaagtgatcattcaacctcagccattcgagtagctgagactaaaggcacatgccaccatgcctggctttccttgtattatcttaacactcattatgctgtgtcataattaatagcttaagggtcaatttgtccactagacttaaaatttctttggaatggaaccatcttattttttagtacccaacaaatatctagaatttgcaagcccttgaaaatattgttgatgagtgaatgaatattttgatgtcagtgtttacccttagaccaaagttatgacttttttcttccaaaagaaaataatttaactctttgctgctcagtacatctgggttgtattaacatttggcattaattctctctgtttgaggaaaatgctgtcattgattcaatcttaaaatatattaatacatttattgataaatctcctgattaaaacacaagctattgctttgctatctttgagtagatgttttacagaattgcatcgttgcaataaatcaaccattaataatgctgaaaggctatactgtcttaaactcacaatcctgagagaataaaggcaatttggatttaaggtgaggttaaataaggaaaacattagcacggcattaaggacagcaatagttaaagaagtttgaaagtctgttctcttcagtgaatcaccaagagtaaaagatttgtagaatctatcaactaatttttatttttggtcatcatgtttaattctcagtatgcatgcggcaagctttctactacatggggtgtgagaaatggaatgatcactgataaatgcaattcaagtataatttccctccttcttattaagtttgtcatcatatgtattgttcttattaatacaactgtaagaaaaaattttggtgaatgatgaatactgtagattatatggctcaatgcctcttccaagcacttctaaccaacctgtgaaagctaaaaacagctaaagactacatgttctagaatcctttgtaaaagttttaattttgattgtggcctccattctgcccagtatatatttctctgcagtatctggaagaagtcaggagcagctctccttgcaaccatggtgatgagcatggtggttctaaagttcatcccctgtttcacacgtgatgagtggcacagagcagcaggagtgaggtttcctttagaagagctctgtgttgtgagtgggcatttccgctggctactctattttcttgctctatagtattgaattctagttttatggccctactagagcttcctaacaccctctgataaacgactttttatttaagttagatcgcaagagtctgctgtctgtacctaggaacaaagggctgcgcactgggtgttcattctaccaatggtctcctttgtgaatacctagttttttcaacattttttcatttcaaaaataaatttttttcataagaaatatgaaatttgtctcttcatatttttaacatctgtgtacagaacaccatgctagttgcttttgttgtggcaatgaaaagaaatacatttttaaatcacttaaagtcaggccggacacagtggctcacacccatatcctggcactttgggaggctgaggtgggctgaccacctgaggtcaggagctcaagaccagcctggacaacatgatgaaaccacgtctctgctaaaagaacaaaaattagccaggcacagtggcaggcgcttgtaatcccagctacctaggaggctgaggcaggagaatctcttgaaccaggaggctgaggttgcagtgagccgagatcgtgctgctgcactccagcctgggtgacagagcaagactccatctcaaaaaacaaaataaaataaaatcacttaaagtcaaatgcttcagtaactacactgtactccttactatgtaggacagtttgttgatctcaaagatttaataattagaaaaatacaaaaagtatgatttttaaacaaatgagatagatcaaaatatgatgtcttaaaatgattttcactatctcatggacatatatattatctaacataataaatatcaacacacacagtggaaactgaataggagagaggattttttggatatggtttaacccaaagtaggactgataatgtgaggcaggaaaaatagcataagccaatatatggttttcagatcttgctttagaatagttgatcaaacagcccaatttaatcagatgcatattcatgaacattgggagatcagtcagactttctgtagtctcaggcattttaaataccatattcatatgcttgggctttaacttacagataatgtgacatcattaaaggttttgaataacagaagagacctgaaaaagtcaaagttttaggggaatagcagagcaatatgagtgatagttgaaaggagagaggtactagaaaaccagaacaattaggagtctattttggtagtaccagaggcaaagagatgagaggcaatggagataagaagtagtggtgacagtaataatggaaataaattaatatgaggaatgttttcattatttgggagtattgtatagaatagatcttttcaaatacatttccacttctttgcaatgctgacagtctatacatgttggggatgttctggtttttcagatctctaccagagtgctctgttgctgcacagatgcatatgtctgtggatgtcagtttaaacacacatcagacactgagaacggattctcaagcatgggttgaaagggacctgtgctctcacccaccacctgcagcattagaacacacatttcctggatttctcactgtctccactccaaagtcttttgtgagtgcaggccactatttatatatgttcagaggagagttgcttttattttcctacccagagcccaagcataaagatagtttccagaatgactcatttcatgtgtggaaagatatttttaattcacattttcattgatagtcttcattgacattattttccctttactcttacttttgtcattaaaactcaagcactttgactactgccatctgcaaatgttcccaaggcttcttatgggcctgtttaccacttttttcagctttatctgtaatatatatttttttactatgaaaggatttatggtgatattgatcatctaaaggtacaaattcagaatatatgtattttattgttttctaaataatatttattaagattacttaaatataatccagtatctcaacatagacttttctgtgacaatttttttttacaattcaagaatcttcaatttatttgccatgaagcttctttttttataactgtttacttatgatttcatagtatacctttttgctagagtaataattagtaatagaaatgtgtgatggctatgtaaaatttaatgatttcattaacagtctctgaaaagagcttctaatattattaccagagaagctttaataatttacctcataactattatggctagaaatgtcattaaaatataatgttatagtataacaatgcactacagaatcactgattttgttttcaatcagttttgactttgacaaagatatttatatctatagaatacttcaaacatactttgtagaaagtatatagtttaatttcttactcagaatttagccttctgattttattaataatatgataaatgtgaacagtatattagttatgtaaagttaaagtactgcttatttaaataattatccagctgctagataataattaaattaaaataaattaagaatttatttaattaattcaaatccctcagaagtagataagataaaattaaacaccttttaataatggaacactcatctattcaaattccccatgagtagatggagcttttcatcagtaacccaggcaactactgaagctctttatagagctcttttctctacctctttctacttctcacaaatgaccattgcttctttattttgtcacaacataaactatatttcctattattgcaattaacttttagtattgtgtctcctgacatttagaaggaaagttggatttctcttcacctaaaaaataaaattgcataatttcattttctcacatttgaagcaaacttaatatataaaaataaatttgaaacttttttctctaagcaaaccaaatatgtgaacatttaaatctagagaaatgctaaattataaatactattcattttaataaaagtaatttctactaaaatttccaaagtagaacttttaaaaatgcgaactcttatgtttcgctatgaatattatttataaccaaactgttaacaatgattattgctgcttggtgctattgattgtcttttttcctgtttttctgtatattctagacattctataataagtacatatgtttatagcaaaataaataggtacaattataatacaatttgatttctaaaaacctaaaacaatatttttaataaagaagcaattcgtattggatgttgtgatccaccattcctgtcttctacccataggagtgcattagcataagtccttgccatcttagatttgacagttttcatgaactttggcaatacatacttttgggaatgccttctgcatggaaagtttcttcacattcggagggataaaatgaacaaagatagagcccaaaataatagaagtagtcagttaggtatgtaggggagggagaaagggggaagaagtgaaaatagaaaagaggttcttacttgcttccaaattctaaggccaggtcattagtgtgtaaaagtaaataaggccaaagggtttctttgtgaatggtgacatcttgagtatgtctaacaagaggacataaagaagcaggattgactgttgcaaaagtaattagtatctatatatatgtctatataatttggtatatatatatacacatatatatacatatatatgtgtgtgtgtgtctatataatttggtaatgctgtcgtgaccaatgaccactgaattcatttcctttgtatatctgatgtctataaaaagagaaataagactttaaatcataaaacaggctataattcataaagtatcatggtgtaataatatatggtttgaggaagtatcttaggctgacacttacagaaatataatgcaagccacatatatcattttaaattttctagcacatacatttaaaaagtaaaaaataaggccagcgtggtggctcacgcctgtaatcctagcactttgggaggccgaggcgggcggatcacgaagtcgggaaatcaaggccatcctagctaacatggtgaaaccccttctctactaaaaatacaaacaaaaattggccgggcttggtggcgggtgcctgtagtcccagctactccggaggctgaggcaggagaatggcgtgaaccagagaggtggagcttgcagtgagccgagattgtgccactgcagtccagcctgggtccgtctcaaaaaaaaaaaaaaaaaaaaaaggaaaaaattaaataatatattttatgtaacacatacacataactaatttaatatgtgaccaacataaaaattactaattagacactttatacctttttcatattttgttttcatattaagtcttcaaaatccagtgttattgtacacttacagcgtatctctatttgatcttgccacattttaaatgctcaatagctacatgtggctagcggctaccctatgggatagcacagtcgtagaacatgcaatactctttctgatactgtaaaacagaaaaagaggcaaaaatattggcataacagatatacgatatgaatttttaaatctgtgtaaagattaactattatttctttttaaaatatcttataaatcactttaataataacttcctaaaaagtggctagagctaagagagtgaaccatgtcaataaaggtttgtttttcttattctgacgtttgaatgtccttaatttgtctgtaatcacacatttacagatgcatttgtgagaatgtggggtgtgtgtgtgtgtgtgtgattatctcaagaaaatgaaaacatatttacctgtaatattttaattttcattttaaaataaactatgttgcactaataaatctgttgagataccaggattatgaattaaatatcttagatcttaatctttatggatgctaatgggcctcatgaagtgatatttatatctctatattctatctagaattctatattttatctagaattctatattctatatattctccctacatattctatatatctatatctatattaagatccttattaatatagacattaacatattaataagagctttattattaatatagatttgtataagctgagctgtattttaaatacatcaggaaacaatatttacagacataataattatttgagaaagtaattttcaaattttttgtaaatctgatttttattattgttattgtaactacattgcttttttttattataaaggtaattttatattccacaaagttttaccccacttgcaaatagactatgcatgtttatagtttaaaaattatatagattcatggtatcataaatttgaaatcttaagtattcccctcccctcaagaaaatagtattaactgcttaggttcccagggcaaagcgcgatggaagacttaaggtatccttctctgcttctgaaaatgaggggctactcctcaccccatgatcactacaccctgacccattgaacaacataaatggatattcctttagcttcaaatgtgccttggtttcttttttccctcttttttttttttttgagatggagcctctcactgtcgcccaggctggagtacagtggagcaatcttggctcactgcaacctacacctcccgggttcaagtcattatcctgcttcagcctcctgagtagccaggattacaggctcccaccatgaagcctggctaattttttgtagttttagtagagatagggtttcaccgtgttggccaggctggtctcgaactcctgaccttgtgatttgccttcctcggcctcccaaagtgctgggattacagatgtgagccaccatgcccggcccaaatgtgccttggtttctttgctttgtccagaagattgggtaagggaaaaatcagcatttattgaacatctgctctgtgtcagctactttctagttactttcacacacattgtctcatttacttctcaaaacctctatcagaaaagtatatttgctttattaatacagaaactcaatctcaaacgtttaccattccaagattagacttttggtaaatgtcatgtttgaaatccagaactgataaatgtgaaaataaatcttctttctgttacattatgaaatttcttcaagaggttttctagtgtttggaaaagtctgaagcaactgcctgtgggtttgcagaggtaagagtatcacgacaccagtcagtacaaaaatctgggttttatttattcatttgtaaactcaagccagttctctattccactttttccaattatttgcttttgagagtctcaggattatccttccttcctctccttccacattttctcccctgtcccttctcctggccatgcttctctagtcccgacggtcttgtttagatcacaatgcggtttgtagattttccttcactctctctttcagaaaaaaatgccaaaatggtgttttaagaagcttttattgctgtaataaacagaaagaaatagacatatggttaaaaagctcctcacagcattccatcttctcctcctgttcacatagatcttccttagttttcatgtaaatgaaataagtctttgggaacatgcagtcctgaattagatccaaatgcatttcccagaaaatcatagattaaatggattttggattgttaatttgataagttaattggattccttgtttgttggagaagaccagaatgagggctgaaaactcagtccaaatacgagacagagtgagtaatagctatgaaaattgtcccagatcatttgtcacctgggtgtatgttagaaaaaggtactactttctcatggcagatgtggccctatgctagggaacacatagtggtaggatcatgagctggatttcagccacaccacaccctgcagccaggtgtccttttgcagtgaacaacctgcaaaatcatgtatatgcagtgatcttccatctctctgttcttttctccttccacatataacattctgaaatcatatacttgagcttggattataaatagggccaatggcctagaaatatggagaaaaaaatgaaaaatataatatagtgaaagggaaacatgaagagttttcttagcccattggacacttggcttaacctggcaaatgttaacatgtggagaacatatgcaaatcagttatccataagtcagcatcacttgcagtttaaaaaatataaatatgatatcaaaactcaatattatagttttatgaattataaagtatttttaaatattttcaaattgattttattaatgttattctcagaaatggaaactattttaacaaaatatttgtgtccatgtatgtagccacagagattagacacagacacagcatgctataatgacaatgaattatatctcgatcaataagtatttacaatatataaaaccccaaaagtctggagagtcaccagaacgagtacctgttactactgattttaaaatccatattgaaaaactttaaaaaatctaaagttatgcattgttcaggtagaaactagacacactaacttctaagaagctaaaattttgtagctatactggtacgttagggccactagctggtcacttaattgaagacattagaaaatcatataaaatgacatatatagcttaagcattttattttaattgaaagtatttatcatggagtcagacacaatggatagtgcttgtagtcccagctactcaggaggccaaggtgggaagattattagatgtatatgtgtgtgatacacacacacatatacacacacattctatttccaatgtttggagggtgaaggcctcttattttagtatggttccactgattggagatctgaatttttttgtgtacttatgaattttagcataaattcatttaaagagggacaacaaataaaatcttttgtgaagactaaaaatttcttttgtacaatacaaaagatgaaacaaaatgttggttctttgaaaaaataaataaaattgatagaccattggcatgattaaccaagaaaagaagagagaaaatccaaataaccccactaagaaacaaaacaggagatattacaactgacaccactgaaatacagaagatcactcaaggctactatgaacacctttacatacataaactagaagacctagaagagatggataaattcctggaaaaaatacaaccctcctagcttaaatcaggaagaattagataccctgaacagactaataacaagcagcaagattgaaatggtaatttaaaaattgccaacaaaaaaagtccaggaccagatggattcacagcagaattctaccaaacattcaaagaattggtactaatccttttgaaacaataccacaagatagagaaagaaagaaccctccttaatttattttatgaagccagcatcaccctaataccaaaaccaggaaaagacataacccaaaaagaaaactacagaccaatagccttgatgaacacagatgctaaaatccttaataaaatatttgctaactaaatccaacaacatatcaaaaagataatctgccatgataacgtgggtttcataccaaagatgcagggatagtttagcatatgcaagtcaataaatgtaatacaccatataaacagaacgcaagtcaataaatgtgatacaccacataaacagaattaaaaacaaaaatcacaactaagagcagaactgaaggaaatagagacacaaaaaacccttcaaaaaatcaatgaatccaggacctggttttttgaaaagatcaacaaaagtgatagaccactagcaagactgatgaagaaaagagagaagaatcaaatagaggaaataaaaaatgataaaggggatatcaccaccaatcccacagaaatacaaactaccatcagagaataatataaacacctctatgcaaataaactagaaaatctagaagaaatggataaattcctcgacacatatacccgcccaagattaaaccaggaagaatttgaatctctgaatagaccaataacaggctctgaaattgaggcagtaattaatagcttaccaaccaaaaaaagtccaggaccagacggattcacagccgaattctaccagaggtacaaggaggagctggtaccattccttctgaaactattccaatcaatagaaaaagagggaatcctccctaactcattttatgaggcaagcatcatcctgataccaaagcctggcagagacacaacaaaaaaagagaattttagaccaatatccctgatgaacatcgaagcaaaaatcctcaataaaatactggcaaactgaatccagcagcacatcaaaaagcttatccaacatgatcaagtgggcttcatcgctgggatgcaaggctggttcaacatatgcaaatcaatgaacgtaatccagcatagaaacagaaccaattacaaaaaccacatgattatctcaatagatgcagaaaaggcctttgacaaaattcaacaacccttcatgctaaaaactctcaataaattaggtattgatgggacgtatctcaaaataataagagctatttatgacaaacccacagccaatatcctgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgctgatgacatgattgtatatttagaaaaccccatcatctcagcccaaaatctccttaagctgataggcaacttcagcaaagtctcaggttacaaaatcaatgtgcaaaaatcacaagcattcttatacaccagcaacagacaaacagagagccaaatcatgagtaaactcccaatcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgctatccccatcaagctaccaatgattttcttcacagaattggaaaaaactactttaaagttcatatggagccaaaaaagagcctgcattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgccgcatatctacaaacatctgatctttgacaaatctgagaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctggaagaaaacctaggcaataccattcaggacataggcatgggcaaggtcttcatgtctaaaacacaaaaagcaatgacaacaaaagccaaaattgacaaatgggatctaattaactaaagagcttctgcacagcaaaagaaactaccatcagagtgaacaggcaacctacagaatgggagaaaatttttgcaatctactgatctgacaaagagctaatatccagaatctacaatgaactcaaacaaatttacaagaaaaaaaataaacaaccccatcaacaagtgggcgaaggatatgaacagacacttctcaaaagaagatattaaacagccaaaagacacatgaaaaaatgctcaccatcactggccatcagagaaatgcaaatcaaaaccacaatgagatatcatctcacaccagttagaatgtcgatcattaaaaagtcaggaaacaacaggtgctggagaggatatggataaataggaacacttttacacattggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaacaaacccaaatgtccaacaatgatagactggattaagaaaatgtggcgcatatacaccatggaatactatgcagccataaaaaatgatgagttcatgtcctttgtagagacatggatgaagctggaaaccatcattctcagcaaactatcacaaggacaaaaaaccaaacactgcatgttctcactcataggtgggaattgaacaatgagaacacatggacacaggaaggggaacatcacacaccagggcctgttgtggggtggggtgaggggggagagatagcattaggagatatacctaatgttaagtgatgagttaatgggtgcagcacaccaacatggcacatgtatacatatgtaacaaacctgcaccttgtgcaaatgtaccctagaacttaaagtataataaaaataaataaataaataaaaatcacataatcatttcaatagatgcagaaaaagcattcaacaaaatccagcattactttattattaaaactctcagcaatgtcggcaaacaagggacatatcttaatgtaataaaagccatgtatgacaaacccacagccaacacaatactgaatgggaaaaagttgaaaacattccttctgagaactggaacaagagaaggatgcccactcccaccactcctcttcaacatagtactggaaatccttatcagagcaatcaagagaaagaaataaagggcatccaaattggtaaagaggaagtcaaactgccactgtttgctaacaagatgattgtttaccttgaaaaccctaaggattcctccagaaagctcctagaactgatataagaattcataagtttctgggtacaagattaatgtgcacaaatcagtagctcttctatacaccaacaatgactaagtgaagaataaaatcgagaactcaacaccttttacaatagctgcaaaaaaagaaaaaatacttaagaatatacctaaccaagaagttgaaagacctctacaaggaaaactaccaaacactgctgaaagaaataataggtgacatgaacaaatggaaacaaatcccatgctcatggatgggtagaactgatattgtgaaaatgaccatattgccaaaaacaatctacaaatcaatgcacttcccatcaaaataccaccatcattcttcagagaattagaaaaaacaattctaaaattgatgtggaaccaaaaaagtgcccacatagccaaagcaagattaagcaaaaagaagaaatctgaggcatcacactacctgatttcaaactatactataaggccatagtcaccaaaacagcatgggattggtataaaaataggcacatagacccatggaacagaatagagaacacagaaataaacccaagtacttacagccaactgaacttcaacaaagcaaacgaaaacataaagtagggaaaggaaccctcttcaacaaatggtgttgggataattggcaagccacatgtaggagaattaaactggatcctcatctctcaccttatacacaaatcaactcaaaatggattaaagacataaacctaagacttgaaactataaaaattctagatgataacatcaggaaaacccttctagtcattggcttaaacaaggatttcatgaccaagaacccaaaagcaaatgcagtaaaaacaaagataaatagctcggacctaattaaactaaagagcatttgcacagcaaaaggaacagtcagcagagtaaacagacaacccacagagtgggagaaaatcttcacaatctatgcatctgacaaaggactaatatccagaatctacaacaaactcaaatacaacagtaagaaaaaaaaccatcccatcaaaaagtggtctaaggacatgaatagacaattcccaaaagaagatatacaaatgtccaacaaacatatgaaaagatgctcaacatcactaatgataaaggaaatgcaaatcaaaacttcaatgcgataccacctcactcctgcaagagtagccataatcaaaaaatcaataaaacagtagatggtggtgtggctgcagggaacacttttatactgctggtgggagtgtaaactagtatagctgctatggaaaacagtgtggatattcctttaagaactaaatgtagaactaccatttgatccagaaatactgctactgggtatctactcagaagaaaataagttattattcgaaaaagatatttgcacacgcatgtttgtagcagcatgattcacaattgcaaaatcatggaaccaatccaaatgcccatcaatcaatgagtggataaagtagctgtgatgatggaatactgcacagtagtatatgatggaatactacacagccattaaaaggaatgagttaacagcatttgtagtgacctggatgagattgaagactattattctaagtgaggtaactcaggatggaaaaccaaacatcatatgttctcaccgatatgtcggaactaagctatgaggacacaaaggcataagaatgacacaatggactttggggatgtgggggaagagtgggaggggggtgagggatagaagactataaatatggtgcagtgtatactgcctgggtcatgggtgccccaaaatctcacaaatcaccactaaagaacttaatcatataaccaaataccacctgtacccaaataatttacggaaaataaaataaaagtcaatgtaccccaggatatgggggaacagaaaaaaatgtactcaataactatatctgaaataaataaatgacctaacctcaaaaataaataaaatgataggaaaaaataaaataatcgtaaaaatttgttttgtttttcccagactcttatctacatctaaatagaagatattattttgcaactcaatgtttagatctttctaacagattcgtcttagatttcataaaaacataagccctctcgaacataaaataattgttgttttaacatttgattaaatatgtacttacaatgcaaacgaaaattgtataaacagaatttggaacaaacacaactattgtgaagaacacaatttaactggcattaattgacgtacatgaggatattaaagtgtaggacactagctacaggtatttaatgggacataggcatgggtcatgctttgtagagtcaggttatttggcagatttgtaaaatggaatctggttaggaaatttttgctgaaaacttaagtgatcagaacttagcaagggctgcgtgcactggctcatgcctgtaatcccagcatgtttggaggctgaggcaggtggatcagctgaggctgggacttcaagaccagcctggacaacatggcgaagtgtcatctctactaaaaatacaaaaattagctgggcatggaggcacatgcctataatcccagctacttgggaggctgaggcaggagaatcgcttgaacctgggaggtggaggttgcagtgagccaagattgtgccattgcattccagcctgggcaaaagagtgaaactccgtctcaaaaaaaaaattatatatatatatatataacttagcaaggatattgcaagaaagcttcatggattctaaactaatatctttccattttaagtgatggcagtcaaactcaatgaagcaagagaaaaaataacaataaacaaaataatttattggtttatacaactaggaagttcaggcatttatctttcactaatgcctgtatccacaagttaaactaatctcactaggattgtattttccaatcctttgttcttttttcactttgcattagcttccttctccaggaagtttccccatgttatggcaaaagtagctacattgtctttacagccaacaagcgacattatctttatagccctgtgaaaaagtcccttttcctgattgttctaggaaaaatctgttatgacttactggctggagttgggttacatgcacacaatgaacaatttacttgggccaggggatggaatttgttgttcagttattgcttggtaacagacctgcccctaggaattggtaaagtcctttttggaaccctggactaccaagaggatgggtgtgtcacttgcaatttttaccaaaaaaatcatgtttcatccatctgggagtcagacatttcataatctttaaaatattcctgcagctctcagaattagttaataggactgtctccatttgagcttggatatgctttgtcttttttgtgtgattctatttcttctttcatgttgatatataatgtacatatttatggggtacatgtgatattttgacacatgcatacaatgtgtcatgatcaaatcagtgtatttaaaatatccataatctcaaacatttgttatttctttgtgttagaaacatttcaaatcttctcttccagctattttgaaatatacagtatattgttgttaactatagtcaccttactgtgatttggaacactagaatttgttccttttatgtaactataattttgtacccattaaccagtctctcttcaccctctcccctgacccttcctagcctctcatattgataattctactctgtacctccatgagatccacctttttagctcccacaaatgggtgagaacatgcaatatatgtctttatgtgcctgtcttatttcatttaatataccgacctctaattttatccatgttgctgcatatgacagcatttagttattttttatacctcaatcgtattctattatgtatgcatgccacattttctttatccattcatttcttgatggacatttacatagattccataacttggctattgtgaatagtgctaccttaagcactagggtgtaggtatccctttgaaatgctgattttcgttcttttgggtaagtagtcagtaataggattgctggatcatgtgatagttctaatttcagttttgaggaacctccatacatttttaaataatggctttatttatattcctaccaacaatgtataagacttcccctttttctgcattctcatcagcatttgttaattgtctttttgtaatagccattaaaactaggataatataatcggtttcttcttattaccaaatcatctctgcttctccatgccactgtatccccagttatacctgtcatttcttgcatttcttggtacctaatattttagctgtcttttattcgggtcaacatttaaattacagattttcctccaaatttctcagaggcagtaatgtttctagtgctattgctttgtgtatttctatttataactgccttcatatgatttcgggaaatataattccctgtgggaattttctagaattcctaaattgactcctgctcaagacttacgataagaaaagtttttgtagacttccataaacaaaactcatatctgtatatctgtagctgtgtgtctgtatctatatctttatcacttatacctatgaataactatatctacatataaatctgtatttatgtctatatataatcaatcatctcctggatagagtgatacctgtaagtgatttccatttttcaaaagcaagtcatacttctgttatcctctttcttctaaaagtaccatattgaaagtcctagccagggcaatcaggcaagaaaaaaaataaaataaaaggtgtccaaataggaaaagaataagtcaaactgtttctcttcatggatgaaatgattctgtacctagaaacccctaaaaactttgccaccagtccctgataaatgacttcagtagagtttcaagatacaaaatcaatgtacaaaaatcagtagcatttctatataccaataatgttcaagctgagaaccaaatcaagaatgcaatcccagacagatatggtggctcatacctataattccagcattttgggaggccaaagtgagaggatcacttgagcccaggagtgtatgaccagtcctggcaacatagtgagactccatctctacaaaaaagtttaaaaaattagcttggtgtggtggcacatgctatagtcccagcactcaggaagctgaggtgggaagatcacttgaccccaggaggtagagggtgcattgagctgtgatcatgccactgcactccagcctgggtgatagagtacaacactgtcttaaaaaaatgcaatcccatttacaatatccacacaaaaaaataaatacgtaggaagacatctaaccaaggaggtgaaagaaagacctctataaggaaaactacaaaacactactttagaaaatcatagatgacacaaacaaatggagaaacactccaccctcatagcttggaagaatcagtattgttaaaatggccatattgcccaaaacaatctacagttttaacactatttctatcaaatgaccaatgtcatttttcacataatttgaaataagcgattctaaaatttatgtggagctaaaaaagggcccaaatagccaatgcaattttaagcaaaaagaacaaagccagaggcatcacatgaccagacttcaaactgtactataaggctacagtaaccaaaacagcatggaactgtacaaaacagacacatggaccaatggaaaagaatagagaacctagaaaataagctacacatctgcaactgtcagtctttgataaagttgacaaaaataagcaatggtactgggatagctggctagccataagcagacaaaactggaccccttcttttcaccatatataaaaattaagtcgagatggagagaagactgaagcctaagacctcaaaatataagaaccctaggagaaaacctaggaaacagtattgtggacattggccttgggaaagaatttatggctaaatcctcaaaagcaattgcaacaaaaacaaaaattgacaagtgggacctaaattaaactaaaaagcttctgcacaacaaaagaaactatcaacagaataaacagaacctacagaatgggagaaaatattcacaaacaatatatccaacaaaggtctgatatctagaatctataagaaacttaaacaattcaacaagcaaaaaacaaaaaaactcacctaaaaagtagacaaaagacataaacagatgcttcttaaagaagacataaatgaagccaacaaacatgtaaaaatgctcaacatcactaattatcagagaaatgcaaatcaaaacaactaggagataccatctcccaccagtcagaatggctattattaaaaagtcaaaaaataacagatgctggtgaggctgcagagaaaaggaaatgcctgtccacagttggtgggaatgtaaattagtttagccactgtggaaagcagtgtgcagaattttcaaagaaaaaatggaactactaataaacccaacaatccaattattgagtatatatctaaaataaaataaatccttttagcaaaaggacacatgcacttgtatgttcattgcagtactattcacaatagcaaatatatgaaatcaatgtagttccccatcaacagtgtattagataaagaaaatgtggcacatatataccatgaaatagtatgcagctataaaaaagagcaaaatcatgtcatttgcagcaatatgaatgcagctggcggtcattaacctatgcaaattaacacaggaactgaaaccaaatactgcatgttctcacttgtaagtggaagctaaacattggacactcatggacataaaggtgccaactgtagacaatggggactaccagagtggggagggagagaggggagcaaggattgaaaaactaactattggatagtatgcttagtacctagctgacaggatcaattgtaccccaaaccacagcatcacgcgatatacctatgtaacaaacctgcatatatacccctgaatctaaaatgagagttgaaattatgaaaaagaaaatctctaatttaggcatttttcctctgaaaggtgcaaattgtaattttcgcaataaaacatatattcccctccccccaaaaataaaactactatatcgatattttgacataatctatttttaacaaaatgattccttgttgcaaggttgcaatgctttcattttaaccttttgtaacaattgtgtgtgagttacatatgcacacattctctattctcttggggcaattgctgcatgattagtttgatctctgaatattgccactcttgaatttgtgtcagtggcatttctatacattttgggtcccaaacacatgttaattcaaggcttcccaagctatgaattaatgacaaaaatgagctgatcttcagatcctgtgaaatatagtggggtttgacattgcttttataaagagagaaaactaagactctgctagagacaatctatcttttctgactacagcattcttatttcctattttaacttttttgcacttccatatgcaagtaagagccatatgagtaattaattttccataatatcatatattgattttttagctttaatgaaaatagtatttcgaggtgtttttttaaaaaacaaatctagcactttagaagactcagaaatttcagctaggaatattccataaaaatttttttctaaaaacaagagaaatattgggtcagtacagggcagccatgtcaaagacctgcatttctcttttggtcttagattgccaaacttcacaggagtttttaggaagatagagctatgagatttgtatttgctcccagaaaagttgggcatttacatgcagttagtattcaacgatatattgttctgcctaaatttcgcaaacgacatactctaagtgttttgaattattttcattatgtaattttggctgctttgtgagggtagtaccattttctgatgttacttaatattaatccactcttcactcagaaagatgggcaaggatttttactaaaataccatatacccaacttctgctttagaaaggataaagtgatattgaacttgaaaaggtttgatgctttttgcacatactacgttaatatttatttatccatttgtgtttgttggacaaacgttgttttagaaagaattgcagggacttatttggagaaaatatttgtcatagaatgtaaaatgtaaatcaaattggagttactatccaagaagaaatgacatgtgtctgaataatgcaatgagagttagtcaagtattttacacagaacaattttatgtgcttaagcagttacactcaagaagtactgtggtctcatatttattcatgccatttctcaaatatttaagacagtttcaaagagaagaactataatgtatgtaacttgaacaaattcttcaatagtgaaggaactatcaatagtttttaatgcatggaaccatagaatatcatttagcaaactgtctcaaccactcattctgtgtcctgcataacaagggaagtctttgagaagaaagtgatgtttttttcttcttctcaggaagatctgatacattacactgtgttcttatgttccctttactagatagaaaagaaaaagaaatatgcagccttttacaattacttgttcttaaatagaaagatatagaaaataagattaaatgcttatatgcatttaattttttaacattttacctactctttttacataaatgacagtaaggaaaacatgtcagcaacaaaaataatttttataatagtataccaaggcaaaaaattgtgtttacccccattttgtaccttgcattttctagtctaaactgtttttaccttgtgtgttcatcttagaagactgatcacagcagcctcttctggaatattggagagatccctccagagtaccaaagcacatgtaataatagcatgaatgctttacagtgcataagttacttgatttgattacattttcaagaagtagatgatgccaatgctttttttttctaattcagtataatatgggagctaaaactgacaaagataatataaaaaaagattatttatggatctaaaatgtgaatatcaatataaaaatcctaaaaattctatttggaaacataatctagcagcactttaaagaatggcacacccaaaacaaagttcatttattctaggaattcaataaagcatctcattttttaaaaaaaaagatattaccatttttcacttaaatataagtcaggggaggaaaatcatatccttatctttatggcagctaaaaaggatttgaggacagtttcatctattttttgacacacattcttaataaaataagaatagatgaaaactttcatgatatgataaagtgatctaaaaaaagaagtcagctacattcttacagtaaacaccagaaccattgccatgaaagtgatgagcttgctaacatttttaactaaaatagtaaatatgaaatagttaaagggggaggcagtattattattttttctcatgatattatcagatttgattatctatggaaagtcaatgacaaaatttttaagaaatataaaattaagtgaggtaaaatcttgcaagatgaatatgtacacatttattttataatagctctttgtcaattttaaaggaagaagaggttacatatatgatagcaccccaaatactaaatatctagaaaaaagttaccaagtaatataaaggtgctgtatgaaacaaacaagcaaaaaaccctcaaatgatgtaaaataagacagttcagacagaacttgttcttggataggaaaatgctttgctgcaaagatgtcttttatcactaaattcattagcccaacgtaaactttaaaaaatagtagtaggattttttggttgttatattgattctaatgtctacacggaaaatttaacaagcaaaagtacttagaaaatactttcaaaatactgagagattggaacataaatattttagtggacagattaattgaagaactaagtcagaaagaaaaaaatgagaatttggcatacaataaaaatattatttaaagagagtagggaaaatagtgtaacaaatattttgttttagacaaatagtgaatagaggtgaatatattccagctggatcacaaagctctatacaagctgtgataacactgctataaaaaattgacagatttattttcttacctctggtatctctgtttgtttgtgttgctaaaaaggaatacttgaagctaggtaatttattttaaaaatagagatttttttttttggctcatggttctgcaggccatacaagaagcatggtgcaggcatctacttggcttctggtgaggacctcaggttgtttccactcatgactgaaggcaaaagggaaccagagatcacatggtgagagacaaagcaaaagaataggaaggtgccaggctcatgtggaaactagcagagtgagaactcacgccttaccccgaaggatggcattaatctattcatgaggggtcagccctcatgacccaaaaacttcccattaagctcaaccttcaacattggaggtcaaatttcaacatgagttttggaggggtaaaatatccatagcagctgggaatgtaggttggttaatggtttcaaaatatagttagattgaaggaatatctcagcgtttgatagcacagtagggtgataatagtttataatttattgtatattttaaagtaggtagcagagaagatttggaatgttccaatcacaaaaaagaataaatgtttgaggtgatggatttcctaattaccttgatttgatcattacacaatttatgcatgtatcataatatcacatgatgtgccccatgaatatatacaattattgtgtattaataaaaaatttaaaaatcataaaataggtaaaaaacataaattgaaatattcatctcagagtaatatacttgatcttagccaaaaggctgagaagtgattcatctaagaataataaaaaattagtattctacatggcaaaaggtttaataaataaagcataacatacaaacagcaagctgtaatattgttgcatacataaaaaagaaattgttttgtcatatacaaatgactcttaccaacgaatagtaaaatctcaaggaggtgaagagaaatacaattagaatgaaaagatagtttctaaaaggaacaaaaattcctgtctaagtcaatttaacttataattttgaaaatatttagtttccattttttgcttatcacactggcaaatttttgaaattttattaatgtatgaaattttcctagaagttagaaaacaagaatcttatgtaatttaggtaggtgtgtcaattgatgcaacatgtttcaggactgatttaaccaaacctatgaaaagtaaaaatctgaatactaaaacagtgtgtgtctaaaagtttatactaccaatataaacacacttgtttgttcagaggttcaaagatagatgtacaataatttctattacactttttttttgcaataggaaacaagtggccatcaaggcacaggttaaataacttatgaaacattcacacagtgggagattgtagtcaatgaaaaagaatgaggaagatcataagcagacgtataaggatttccaatacatactgaaaaatcaaaaagtgccagaatgtgtgtagagattgattttagttgtgtatcgttatctagtgtatatctatttacaactcctatttatatacaagtattaatcgatatgaatttattattatataaatattcattatataatggaatgcattttagaatgtgacttaagaagtcacaagtactcaagtttgaagtctagttgtattatgtcctatttgtgaggccttagatgaattacataaacttctctaggtctcatttttcttctttgtaaaatggggataataatgatacttatctcagagggttgttataagaaatttttttgtgggggtgaactgtctgactagaaaatatcagttctatttatcttctcaaagaaatagccttggtttcattaattttctccattgatttttctctttcgttgatttctccttttttattatttaaattcttctgtttgtttggggtttaattcactcttatagtagcttaaggaagtagctcaagttgttgatttgagactttttttttattttctaagctagccatttaatgctgttctaagtactgcttttgatgtatacacacattttaatatattatctttttgttttcatctcactcaaaatgccttccagttttcctgtagatttctccttggcccatggtttacttgaaaatatcaattttcaagtaaatttttaaattttattgttatttgaaaatatttagttaccatttttctatatgttattattaattgtgtaattattttgtatttttatacattttttcatttagtggctttgaacttaattccattttggccaaagatcatgttttgtattatttgaattgccttaagtttatttagacttgtgttatggctcagaatagggtctgtgtcgataagtgttccattacacttttaaaaatgtgtattctggtatattggatgaggtattagtttttatcaaatattgggtggaaaaattttggaaattacatcttcaaatgcctacttcctcttttctgagtacactctaaatacataagattaggctcactgaatttgtcccatgtttcactgtttctctgttctaatatgtatgtgtatatacttgattttttttcttctctgtgtcttattttaggtgaatttctattggtgtgtcttcaagttcaccaatattttcttctgcagtgtctaatctactgtacatcagaaccattatattttttatatcagacattttagtttccatctctagaaatttaatttgactcattttatattatgtttttacttaaaatgctatttttttcactaacttcataaacattatgggatatgtgtttgataatgatttttatgtaattgtcttctgattctaatatctctcttatttctggttttctttcagttaattaatttttctctttattatagattatatacccatgcttctttgcatgctttgtaattttgcattggattccaagcatttaaattttactttgttgggtgctggattaaatatgtataagttttcttgagctttgttctgagacactgttaagtactcagcaacaattttatatgttcttgtcttgcttttaatctttctcaggcaggatcagaacagtgtttagtttaggtctaattttccccactgctgaggaaaaactgttctgcatactctgtccaatacaccatacgttttgaaggagcccctgcgtgcacatcagaggttgttccctctaataatgctggatgattattctcagttttgggtgctttcctcacatgcaaggatgctcacccagtacagcttcccagaaacgctggaggcagtcagtaaaggaattagatagaattaaagagaatgatactgaaataaaacctggaagactctcagaggaaggaaggagatggggagggggggcattggataattgcaataaatatagaaattgacacaatttcaaaatatatattgtatcaggctgaccaggcagaccctcagtcagatttcagagacaggaaggatagtcatggtaagtgatatgaatcacaccttagcatactctttctttggaagtagcatcttaacactatctttcatggaagactgatagccaaacttgtaagagttttaggagagctaaggctcatcagagaaaagaatgagcataatgaaataaacttggagcaagaaatttttaagcaacaaaaagaagagtaaataaaatcatgggttcattaaaatgagatcaacataatggtgtgtgtttaatgcaatactagtataaatcaaggaaggagaggatattaggagagaagtggcccctcaatgctgagagcacatgaaggatattgattgataatgtagcacttgatttcacatttagaataacactagttaccttcaacagagaagtttcaggaggatagtattacaggaggaagcaaggaagggggtaataattcaatgcttgatgtggaagtagaactggctaaaatggacaataaaactggggcccaataaaaggcaatgagcctcatattcccataggtatttttacattgttctaaatgccttgcctatagcagtaataaaaccaacaggtaatgaatacaattctcttctcctttgacaatacttgcagaaattttacctcacgtaaatggagtttagatgagtactcatagaataacctatatgaactttatttgaagaataaaaaatgaggaagcaaaaaagtaattttacctcattggaaaatttctactatacaaaaaagttacaggataaaagaacaaaactattactagaattgtgtagcaacaggggaaatatactttctttcagtaactaaatgtgttgttacagaaaagtaacatgtttttacctcaatttaagtttttcctctttaacatatattgattgaaaaataataatgctctataagaataaaattaacagtgaaagtagtagggtttgaattaaccattcaaaaaagcgtttctatatagctcataaatgttcattttatgcttagataagtgataaaggtaatgtgtatgagcctacataatttatttgatacccttgcattggattttgtcctaagttcttgatgttttaacaacaaaattttatcttttcccgtctctttttgagaatggcactattttaaaatgatctgaatttcaaaaagtatgtcccctagcttggaaacttctcagaataatgaattccaaaatcaagtacagacttcacaccatctgaacaaaaatatattgagtgtctgctgtttgcattgcatgacattgtgatagatgttcttttaactccaaaagagaaaaaattaaaaactgacttgaaacaaataccttttaactctcttatactagcttaactttttattgtttgccttatcaagttcattatatttcaggctttgttaaggacataactaattgtgttttgtgcatgataggagttgcatcctaatcacttaattacattaagtgatttacttttgtttctacagtttagttaaaacaagtaataagatacagtttttaagcttgaaaaataacttagattttcaatacctttataaaaattggctgaaaacattactgagactatcttcaatggtttctgcaaacacattatatgtgatgataattctggagtttctgacagaggcaaattattttgccacgagttaaaattatgtgccacctcccttagttcaatcattgattaacaggatttcatgtaatttaatggtcttatttttcaaaagaaagtgtgtgtatgtgcacgtgtgtgtgtgggggggcggctcagggtacatttagatgaagaagtcacaaaaaatacagtaactcaaaggttacaccttaaaacctatgtgtttatttattttttactgtgataaaaaacatgagacctatcctaacaaattttatgtgcacattacagcattatcaactgcaatcacaatgttgctcagcatatctctctaatattttcaccttgcataactgaaattttatattcattgcacagcaatttcccatttcaccttccctgcagcccctggcaaacaacattctattttctgctatcaatatggctattttagacacctcatattagtggaatcatgcagtatttgtcctcctgtgactggcttatttcacttagaataatattctcaaactgcatccatgttgcagaatatgagagtaattccttcttatttatagatgaattaccacattttatttacccattcttttgtcaatatcacttagtttccaccacctggccattgtgaataatgctacaacaggacatagtagttttttgagatcctgatttcaattcttttgaataaatatccagaagtaagaatgctgaatcacatgatagttctatttttaattttttgaagaatcttcatactgttttccataatagctgcaacatttcgcattatcaccaacagtatgcacgagtttcaatttcaacatgtccttaccaatttgtagttttctggtttgtgtttgtttgcttgtttgtttgattgtggccatcccaacacctgtaaggcaatatctctttgtgattttgatttgtgtttgtgtaataattagtgatactgaacatcttttcttatacctgttctacatttggatgtctttggagaaatatctattcaaatctcttgcccattttttaaagggttttttgatttttgctactgagttatagatgttccttatatattttgaatattaaccatttatcaggtatatagtctgcaaatattttctctcattccataggctgcctttttctctattgattatttcctttgctgcacaaaaactttttaatttgatataatctcatttgtctatttttgcttttttgtgcctgtgcttttggtgtcgtatccaagaaatcattgccaagaccaatgtcatcaggcttttttctttttctttttctttttttttttttttatactttaagttttagggtacatgtgcacattgtgcaggttagttacatatgtatacatgtgccatgctggtgtgctgcacccaccacctcgtcatctagccttaggtatatctcccaatgctatgcctccccgctccccccaccccaccacagtccccagagtgtgatattccccttcatgtgtccatgtgatctcattgttcaattcccacctatgagtgagaatatgcggtgtttggttttttgttcttgcgatagtttactgagaatgatgatttccagtttaatccatgtccctacaaaggacatgaactcatcattttttatggctgcatagtattccatggtgtaaatgtgccacattttcttaatccagtctatcattgttggacatttgggttgtttccaagtctttgctattgtgaataatgccgcaataaacatacgtgtgcatgtgtctttacagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctaacacctgttgtttcctgactttttaatgattgccattctaactggtgtgagatgatatctcatagtggttttgatttgcatttctctgatggccagtaatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttagacatgaagtccttgcccatgcctaggtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcagcattatttctgagggctctgttctattccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtacggccattttcacgatattgattcttcctacccatgagcatggaatgttcttccatttgtttgtatcctcttttatttccttgagcagtggtttgtagttcttgaagaggtccttcacatcccttgtaagttggattcctaggtattttattctctttgaagcaattgtgaatgggagttcactcatgatttggctctctgtttgtctgttgctggtgtataagaatgcttgtgatttttgtacattgattttgtatcctgagactttgctgaagttgcttatcagcttaaggagattttggactgagacgatggggttttctagataaacaatcatgtcatctgcaaacagggacaatttgacttcctcttttcctaattgaataccctttatttccttctcctgcctgattgccctggccagaacttccaacactgtgttgaataggagtggtgagagagggcatctctgtcttgtgccagttttcaaagggaatgcttccagtttttgcccattcagtatgatattggctgtgggtttgccatagatagctcttattattttgaaatacgtcccatcaatacctaatttattgagagtttttagcatgaagggttgttgaattttgtcaaaggctttttctgcatctattgagataatcatgtggtttttgtctttggctctttttatatgctggattacatttattgatttgcctatattgaaccagccttgcatcccagggatgaagcccacttgatcatggtggataagctttttgatgtgctgctggattcggtttgccagtattttattgaggatttttgcatcaatgttcatcaaggatattgatctaaaattctcttttttggttgtgtctctgcccggctttggtatcagaatgatgctggcctcataaaatgagttagggaggattccctctttttctattgattggaataatttcagaaggaatggtaccagttcctccttgtacctctgatagaattcggctgtgaatccatctggtcctgggctctttttggttggtaaactattgattattgccccaatttcagctcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcagtggtgatatccactttatcattttttattgtgtctatttgattcttctctctttttttcttagtagtcttgctagcggtctatcaattttgttgatcctttcaaaaaaccagctcctggattcattgattttttgaagggttttttgtgtctctatttccttcagttctgctcggattttagttatttcttgccttctgctagcttttgaatgtgtttgctcttgcttttctagttcttttaattgtgatattagggtgtcaattttggatctttcttgctttctcttgtgggcattcagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgggcggctttgagtgagattcttaatcctgagttctagtttgatttcactgtggtctgagagatagtttgttataatttctgttcttttacatttgctgaggagagctttacttccaagtatgtggtcaattttggaataggtgtggtgtggtgctgaaaagaatgtatattctgttgatttggggtagagagttctgtagatgtctattaggtccgcttggtacagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttcaagtctgttttatcagagactaggattgcaacccctgcctttttttgttttccatttgcttggtagatcttcctccatccttttattttgagcccatgtgtgtctctgcatgtgagatgggtttcctgaatacaacacactgatgggtcttgactctttatccaacttgccagtctgtgtcttttaattggagcatttagtccatttacatttaaagtttatattgttatgtgtgaatctgatcctgtcattatgatgttagctggtgattttgctcgttagttgatgcagtttcttcctagtctcgatggtctttacattttggcatgattttgcagcagctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattgacccccactctcttctggcttgtagggtttctgccgagagatccgctgttagtctgatgggcttccctttgagggtaacccgacctttctctctggctgcccttaacattttttccttcatttcaactttggtgaatctgacaatgatgtgtcttggagttgcacttctcgaggaatatctttgtggcgttctctgtatttcctgaatctgaacgttggcctgccttgctagattggggaagttctcctggataatatcctgtagagtgttttccaacttggttccattctccccatcactttcaggtacaccaatcagacatagatttggtcttttcacatagtcccatatttcttggaggctttgctcatttctttttattcttttttctctaaccttcccttctcgcttcatttcattcatttcatcttccattgctgataccctttcttccagttgatcgcatcggctcctgaggcttctgcattcttcccgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacagcaccctcagctgcagatctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggctggcctccttgagctgtggtgggctccacccagttcgagcttcccggctgctttgtttacctaagcaagcctgggcaatggtgggcgcccctcccccaccctcgctgctgccttgcagtttgatctcagactgctgtgctagcaatcagcgagattccgtgggcgtaggatactccgaaccaggtgtgggatatagtttcgtggtgcgccgttttttaagccggtctgaaaagcgcaatattcgggtgggagtgacccgattttccaggtgcgtcagtcaccccttttttgactcagaaagggaactccctgaccccttgcgcttcccaggtgaggcagtgcctcgccctgcttcggctcgtgcccggtgcgcacacccactgacctgcgcccactgtctggcacttcctagtgagatgaacccggtacctcagatggaaatgcagaaatcacccgtcttctgcgtcgctcacgctgggagctgtagaccggagctgttcctattcggccatcttggctcctcccccttttcttaggttttcttctaggagttttacagtttaaagttttatgttactatctttaatccatttttgagttgatttttgtgtattgtgtaaggtaagagtctgtgtgattttttttttgcatgttgatatccagtttttctttttttaaaagtttagtttaatttctgggatacatgtgcagaaaatgcaggtttgttccataggtatatatataccatggtggtttgctgcacctatcaacccgtcatctaggttttaagacccacatgcattaggtgtttgtcctgatgctctccttccccgtgcccccaatcccccaacaggccctggtgtgtgatgttccctccctgtgtccattgttcgatatccagtttttctaaaaccatttactgaagaggctatatttccttcattgtttatttttggcacccttgtcaagatcagttgacaacatatgtgtgaatttttctgggctttttattatgtttagtcttttaaatataattattttgtttaatcttttaactactttatttaatatttaatactttaattattgtgtataattttttaaattatgtttaatttttttcataatttattgtgtttaattttttttctgggcttttcattatatttaattggcctttgtgctagtaacatactgctttgattactgtagttctccaatatgttttgaatcagaaactatgaggacttcttcttttttatcaagattgttttgactgcttggagtcctttgtgattccatatcaattttaggattattttgtctgtttatctataaaatgctattgggttttaaatacaaatttcatcaaatctttagattactttgggtattttggacattttaacaagactaagtcttctacttcataaacatagtttatctttttatttatttatgccctctttaattttttaacaatgttttatatttttcagtgtgcaagcctttcactttcatggtaactgtattcataaatattttattctttttgatgctactgtaaattagaacattttcttaataccatttatgaattaataaaaatcttgtcaattatttcttgcatggatcatgcttttctttttgtatagtcattaccaaacccaaggccatctagattttctatcttctaggagttattccttcctaggagttttatacttttctcctaggagttttatttttttttattttaaatttaggtctgttatctattttgagttaatttttgtgaaaagtatatggtctttgtctatattcgctcttttgcatgtggatgtgcagttgttcagcactgttctttggaaagactacctactgtactgcctttgttctgttttcaaggatcagttgactatttttatgtgagttcatttctgggcttacattgatctatttatctatatctttttgttaatatcacattgtcttgattactgcagctctattgtaactcttaaagttggctgtgtcagtctttcaactttgttcttcttcaatattgtattggctattctgggtcttttgcctctccatacacagttttgaattagtttgtcaatgtctgcaaggtagcttatgggaattttaattgatattgcatagcatctgtatattattttgggaaagtctaatatcttaaaatattggagccttgcattcatgaaatataatatctctccagttatatagtacttctttgatatattttatcagaactttgtagttttattcatacagaaatacattttgttagatttgtaactgtttcattgatgggaagtgctaatttataattaaataatattatgtttttaatttgaaattccatttgtttgttgctagtatatagggaagaattgacttgtgtatattaaccttgtatccgcaacccttatatattatcccttattagttccaggaaatttttctctattcttttagattttctatatagatgattatgtcatcagcaaagacagttttatttcttacttccaaatccatatatatttttctcctctcttgttttactgcattagctaggacttccagtataatgttaaaaggactagtgagaggagatatctttaccttgttctttatcttagtagaaatactcctagtttcttaccattaaatattattttaactgtagggtttttgtagatattctatatcaattggaagaaggtctactgagagtttttaatctaggcttttaatctagtttttaatctagatggtcaaatttgtgggcataattagtcatagtatcccattatttatttttttaatgttcataagatctgtagtgatgtcccctattttatttcccatactggtaatttgtgttccttctctctttttttttttttcagttagcctggttagaggcttatcagttgtattaatctttttggaaaccaggttttggttttgttgattttctctattgattttctggtttcaattttattaattttggctctcatttttactagttttattttttttctgtttacttggattaatttcttcttcctttcttgatttcttaatgtgattcccctctaagcatggattttgctgcatcttatacattttgataagttgttttcctttcaattagttcaacatatttgaaaatttctcttgagattttatctttgacccatgtgttgtttagcggtgtgttgtttaagtctcaaaatattttcagttgttctggatatctcttagctgaagatgtctagattaattccattctattctgagagaagaaattgtatgatttcttttctttcacatttttaaggttggttttatgggctgaaatgtggtgtatctttgtgaatgttctatgttcagataagaatatgtatgctgctgttaatggattaagtagattatagatgtcaattttaccaaatgattgatgatgttgttgagttaaaatatgaattagaatttaactgtgaaatacatatatataaaatgtacataatagattaatattagatataaattaggtttctcatagccaacatatagttgggtcttgattctttgattcactctgacaatgtctgtcttttaattggtgcatttatatcattgatattcaaagtgattattgatatagttgctctaatatttaccatatttgttagttttctttttttattctttatttttttactttaagttcgaggatacatgtgcagaacatgaaggtttgttacacaggtatacatatgccattgtggtttgctgcacctatcaacccattccttagattttaagtccgacatgcattagctatctgtcctgaggctttcccaccccttgcaccccgctgacaggtccaggtgtgtgttgttccccgatgtgtgtccatgtgttctaattgttcagctcccacttatgagtgagaacatgcagtgtttggttttctgtacttgtgtgagtttgttgaggttgatggcttccagtttcatcaaagtccctgcaaaggacatgatctcattcctttctgtagctgcatagtattccatggtgtatacataccgcattttctttatacagtccatcattgatgggcatttgggttggttccatgtgtttgctattgtgaatagtgctgcaataaacatatgtgtgcatgtatctttataatagaatgatttctgtccctctggttatatacccagtaatgggattgctggatcaaatgatatttctagttctagatccttaaattatcaccacactgtcttccacaatggttgaattaatttacattcccaccagcaatgtaaaagcatttgtctttctccacagcctcaccagcatctattgttggtttactttttaataattgccattctgactggcatgaagtggtatctcactgtggttttgatatgcatttctctaatgattagtgatgtcgagctttttttcatatgtttgttggtcgcataaatgtcttcttttgagaagtgtctgttcatatcatttacccactttttgatggggttttgtttttttcttgtaaatttgtttaaattccctgtaaattctgtatattagacatttgtcaaatgggtagattgcaaaaattttctcccattctgtaggttgcatgttcactctgatgatagattcttttgctgtacagaagctctttagtttaaggctgggcgttggggctcatacttgtaatcccagcactttggaagtctgaggcaggtggatcgtttgaggtcaggagttcgagatcagcctggccaacatggggaaaccccgtctctattaaaaatacaaaaattagctgggcgtggttgtgggcacctgtaattccagttattctggaggctgagtcaggagaatcgcttgaacgcaggaggcggaggttgcagtgagctgaaattgtgccattgcactccagcctgtgggacagagggaaactctgtctaaagaaaaaaaaaaaaaaaagaaactctttagtttaattaggtcccatttgtcagttttagcgtttgttgtaattgcttttagcgatttcataataaaagatttacccatgcctatttcctgaatggtattgcctaggttttcttctagggtttttatggtttggagttttacatttaagtctttaatccatcttgagttaatttttgcataaggtttaaggaagggatccagtttcagttttctgcatatgcctggccagtttttgcagcactgtttattgtagggaatcctttccccattgcttgattttattaggtttgtcgaatatcagatggttgtagatatgtggtcttatttctgaggtctctattatgtttcattggtctgtatgtctgtttttgtacaagtaccatgctgttttggttactgtagacttgtggcatagtttgaagtcaggtgatgcctccagctttgttctttttgcttaggattgcctttgctatgcaggccgttttttggttccatatgaattttaaagtagttttttctaattctggaagaatatcaatggtagtttgatgggaataatattgaatatataaattactttgggcagtatggtcattttcatgatcttgattcttcccatctatgaggatggaatgtttctccatttgtttgtgatctctcttatttccttgagcagtggtttgtagttctccttgaagaggttcttcatgtcccttgttagatgtatctctaggtattttattctcttcatagcaattgtgaatgggagttcattcatgattttgctctctgcttgttgattgttgatgtataggaatgcttgtcatttttgcacattgattttgtatcctgagactttgctgaagttgcttatcagcttaaggagtttttgggatgagacaatggatgtttttctaaatatactatcatgttgtctgcaaacagagacaattttacttcctctctttctatttgaatatcctttatttctttctcttgcctgattaccctggccagaacttccaatactatgttgaataagagtggtgagagagggcatccctgtcttgtgccagctttcaaagggaatactaccagcttttgcccattcagtatgatattggctgtgggtttgtcataaatagctcttattattttgagatatgttccatcaatacctagtttattgagagttttcaacatgaagtgatgttgaattttattgaaggccttttctgtacctattgagataatcatgtggtttttgtcattagttatgtttatgtgatggattatgtttattgatgttaaaccagccttgcatctcagggatgaagccgacttgatcatggtggataagctttttgatgtgcttctggatttggtttgccagcattttattgaggattttcgcaccagtgtttatcagggatattggcctgaagttttcttttttttgttgtgttcctgccaggttttggtatcagaatgatcttggcctcataaaatgagttagggaggagtccctccttttcaatagtttgaaatagttcctgaaagaatggtaccagctcctctttttacctctggttgaattcggctgttaatccatctggtcctgggttttttgtttctttgttttttggtcggtaggctgtttattactgcctgaatttcagaacttgttattggtgtattcagggatttaatttcttcctggtttagtcttgggagggtgtatgtgtccaagaatttattcatttcttctagattttctagtttgtttgcatagaggtgtttataccattctctgatggtagcttgtatttctttgggtcagtgttgatatcccctttatcaatttttattgtgtctatttgattcttctctcttttcttctttattagtctagctagcaacctattttttaattttttcaaaaaaaacagctcctggattcattgatttttttgaaggattttctgtgtctctatctccttcagttccactctgatctcagtcatttcctgtctcctgctagcttttggatttctttgctcttgcttctctagttcttttcattatgatattagggtgttgatttgagatatctctaggtttccgatgtgggcatttagtgctataaatttccctcttaacagtgctttagctgcatctcagagattctggtatgtttttctgtttttatttgtttcaaagaacttgatttctgccttaattttgttatttacccagtagtcattcaggagcaagttgttcaatttctatgtagttgtgtggttttgagtgagttttcttttttcttttcttttcttttttcttttctttttttttttttaagatggagtctcgctctgttgccaggccatagtgcagtgcagtggcgcaatctcagctcactgcaatctccacctcctggattcaagtgattctcctgcctcagcctccagagccgctgggactacaggtgcccaccaccatgcccagctaattttttgtacttttagtagagacggggtttccaccattttggccaggatggtctcagtctcttgacctcatgatccacccacctcggcctcccaaagtgctgggattacatgcatgagccactgtgcccagccaagtttcttgatcctgagttctaatttgattgcactatggtctgagagactgttatgatttcagttcttttgcatttgctgaggagcgttttacttccaattatgtggtcgattttagagtaagtgtcatgtggcactgagaataatgtatattctgttcttttgtgatggagagttctgtaggtatctattaggtccacttgatacagagctgagtttgaatcctgaatatcctcgttaattttctgtcttgttaatctgtctaatattgacagtggggtgttaaagtctcctactattactgtgtgggagactaagtctctttgtaggtctctaagaacttgttttatgaatctgggtgctcctgtattgggtgtatatatatttagaatacttaactcttcttgttgaattgatccctttatcattatgtaatgcccttttttgtattttttgatctttgttgattaaaagtctgttttatcagagactagggtttccacctttgcttttttctgctctccatttttttggtaaattttcctccatccctttattttgagcctacgtgtgtctttgcacgtaagaggggtctcttgaatatagcacaccaatgggtcttgactctttatccaatttgtcagtctgtgtcttttaattgggccatttagcttatttacatttaaggttaatatggttatgtgtgaattttatcatgtcgtcatgacactggctggttattttgcacactagtagatgcagtttcttcatagtgtcactggtctttatattttttgtgtgttttgcagagcctggtactggtttttcctttccatatttagtgcttccttcaggaactcttgcaaggcaggcctggtggtgatgaattccctcagcatttgcttgtctgaaaaggattttatttctcctttgcttctgaagcttagtttggctggatatgggttgaaaattcttttatttaagaatgttgaatattggccccactctcttctggcttgtaggttttctgctgagagatccactatcagtctgatagccttccctttgtaggtgacctgacctttctctctggctgcccttaacattttttcactcatttcaaccttggagaatctgatgattatgtgtcttggggttgatcttctcatggagtgtcttagtggagttctctttatttccttaatttgaatgttggcttgtcttcctaggttggggaagttcttctggataatattctgaagtgtgctttccaacttggttccattctccctgtccctttcaggtactccagttagttgtaggttcagtcttttgatatagtctcatgtttcttgaaggtttttttcattccttttccccttttttcctctaatcttgtctgcctgccttatttcagccagatggtcttccgtctgatattcttccttctaattgatcaatttggctattgatccttgtgtatgcttcatgaagttcttgtgctgtggttttcagctccatcaggtcatttatgtttctctctagactggtaattccagttagcagctcctctaacattttgtcaaggttctcagcttttttgcataggtttagaacatgctcctttacctcagtgaagtttgttattacccaccttctgaagcctacttctatcaattcttccatcttatcccctgtccagttctgcacccttgcttgagaggtattatgatcatttagagaagagccactctggccttttggattttcagtgttttttcattgattctttctcatctttttgagtttgtctagtttcagtctttgaagctactgacccttggatgaggtttttttggtgactttttttgttgatgctgctgtcattgctttctgattgtttgtttttctttcaatagtcaggcccctcttctgtagggctgctgcggtttgctgggggttcacttcaggtcctattcatctagtttactcccacacattgagatgtcactcaaggaggctggagaacagcaaagatgggtgcctgctccttcctctgcgatctctgaccttgaggggcacagacctgataccagtaggaatgcttctgtataggatgtctgataatccctgttgtgggatcttacccagcttggtgggatgggaagaaggacccatttaacaaggcactttggctgtcccttggtggagggtgtttgctgtgctggggggaaacacactcatctgggctgcccggagttatcagagctaggaggaggaaagattaagtctgctggtttgtggggacttctgctacccctccaactaggtcctcagacccagggagatcagagttctgtccctgagcttctagctggagttggatttcctacagggaggccctgcagccacagtgttggctgccacccctcccccaaggagctcagatggcttagactgcaggcagcttcagcagtggtgatggccattccctccccctggcttaggccaattctagctgagtggctgttgagaatctgtgtggctccatggtggtgacccaaggccctggtgacatgggcttttgagtgtgatcttccaatctgttggttgcacacttttgtggaaaaaccacagttttccaggctgggcagcacactcactcattgcctcccttggctgggggtgggggctctcaggtgtcccgtgtggctctcaggtgagctgttgcaccacagtgttctttcttcctcttcgtggatcatgccagccacctagtcagttctaatgacagaacctgaatacctcggttgctgggtgcaggatttgcatgctgctttgtatctttccaatgggattctttgattgctgctgcttctagtcagccatcttgaccccacccaccaatatttgttagttttctatttgtcacccttgtttttctatttttgtcttctatattgtctttgactttcctaattttattattttatatgatttaattttttatgtcctcactgagcatatcaggtgtacttaaaagaaattagaggttgccttaaagtttgcaatatacacttaaacctaatctgattctaatttcaaataatactataccacttcacagaaagtgtgagtacctttaagtaacgttataagaatgaaataatctattccctctcttcctttatatcattgccataatgaattttgcttatacataagcataaatatctattatctgacagtcttcctttcattatatagatatgagtttctgttttatatcattttccttttctctaaatatttcttttaatatttcttgcaaggcaggtctgacagcaacaaattctctcatttgttgataaattaattgtttcctcgttacttttgaaggataatttttcaggttacagaattcaaggttggtgattttgttgttgttgttgttgttttgttttgttttgtttttcaacatgttaaatattttactccaacctcttcttgtatgcatgatttctgagaagtcagatgtaattctcctctataggtaacgtattttttattctctgctttctttcattttttctttgtttttttttttctagtttgaaaagtatatagttagatatgttttgttgttatttggtaggttgggttttcatttttgtttttgcagctatcttgtttggtgttttttgagcttcctggatctgtggtttgatctttgacgttcatttgaagaaattttcagtcatgttaatatgtcttgtaatttttctttgtagcctgacatgatgtactggatagaagacactactataaatagacctttagtaatgtggttgtaaggtgtgtgggtgaggggaagtgctcttaatcctatactcagacctcagtgttttagtaagcccatgtctctgaactgtaaacttcacatgtgcttcacagttttctcttcctttaggtgggaccagaggcctaaaatgggctacagtttggtatttcctttcctccaagtggaaagctagagttagagttgaatatttttcttccttcaggtcaagcagattagagttcgattaaaccatttctcttgagagaagatcttgttaaggagaatgaaatgctctgaagtatttcaaattgttcttcccctcccctcactggaagaaccaagtgattactatctgatacttactataagtacatgctaaaactccaggatgtaaaaactcataaaaattcgagcatcatagtaatgggttctccctggagtttttgtgtctcaggcttgcccacaccaagctccaacaatttgtcagttacaattcaggtttccctacgctcgcgtcatttcccatggaaatttcagcttatgggtttctgctctgttaagttttgattgtctgttttgtgtatcaatctctccaatttctggggcagtggttttctctgtgacctcactttttttaaggatgtatgaagagttgctgatatttcagtttgttcagcattttgcttgttattaagatgaagtggtgacttccaagcttcttatatactggatcaggaaccataaatctcattttgttaattttttaaagtgatgtgctttgatttccttcaggttttcttttctgtatttttaatatatatttccttttttcctttggttactgtggggcttacataaaacaccttatagttataactgtctatttaaaactgataacaatttaagtgcaattacatacaatgagtctacacttttactcttctcccttctcacatttatgttactgatgctgtttatttattaacgtatttctataattataatttttattcattttgcttttaacttctataccaaaattaatagtgatttatgcatcagtgttatagtattacagtattctatttttgtctttatagtaatctttacctgtgatttttataatttcatatgctttcatgttgtggtttagcatcttttcaatttaacttgaaggactccctttagcatgttttgcctaaggcaggtctagttataataacctcgcttagctttgtctggaaacatccctctcgttttcattttcgaaggatagttttgctgcatctaattatatttgttgatggcacttttctttcaacattgaatatgttatatcttcttctgaccttcaatgtttctgctgagaaatctgctgatggtcgtatggaggtttcctagtaggtgataattcatatttttcttgctgctttcaaaattaactctgtctttgacttttgacaatttgcctatcaaaatcaaattgtctttgattctgtgtctgtatgggtgtggagttcttttgatttattttatttgggaggcattgggcttcctgaatctggatgtccacttctttccccaggtttggaaagttttcagcccttatgtctttacataaactttctgtttctttctctctcttctcctttgggaactctcataatgcacatgttggtcaccttgatgatatccataaatcatttaatttttcttcactcttttactctttttctgttgttgttttttttccttttgcttgttattaagcttttctgtcaggaaaatttcaaattacctatcttcaagttcactgattaatttgctttataaagtctgctgttaatcccctctagtgaatttttaattcagatattctattcctgagttgtaacatttgattcttttttatattttctctttatcaaaatttttattttgttcacatattgtttttcttagcttgcttatgattattttgaattttttgttgggtaactcctataccgccatttctttagtgtcagtttctgaagttttatttatttatttatatcttgattcatcagttttcccatttttttcatgtttcttataaatatgtgttagtatctgcgtatttgaaaatacaactatctatctctttaatttttcatacatacgttcatacagggaaggacttttatcacttagcctggcaagagattctttgggcttctcaagccttttctttagatgtatcttcttggacttgtgcttgtaaatttctaattcaagatattttctatttttggtttttccccttaggcactcataacctcttgctctccctagtgtctgcttgttgtagcactggtcctctggagaagcagaatgcttcccagctctttttttctcaatgacacccagatatctagagtatgctgggtctcatcagtgctctgagagagatgagacaatgtctgttcctctggcagctcctgtcttctttaaaagtgtgaacattgaatgtatgtttcagtctttttttccatccctagggggaaactggttgctgggagttttctcttaatcacatagtgctgtgctgggggtagaaacactatgacaagagggtagtgtaaactcttctaatagtcttctgctatggtttgaatctttgccatctacaaaattcatgttaaaatgttattgctgttgtaatagtattaagaggtggaatgtttaagaagtaattgaatcatgagggctccaccctctttgatgggattggtgcaatcataaatgggcaagcccaatccctcttgctctctcttttccttttgctctgatctcttgtgaagaaaagtgtttcctgtcctctggaggatgtagcaacaagacataatcttggaagtagagagcaaaaccttaccagacaccaaactttctggtgctttgatattggtcttatcagcttccagaattgtgaaaaaatgtgtttctgctctttataaattacccagtcttagatattctattatagcagtacgaaacagactaagaatctatgtggtggtttcatgttcactcagatacagaagcctcttaatggatttctgggtttcttacaaacaaaactcatctgggcttggcgcagtggctcacgcctgtaatcctagcactttgggaggccgaggcgggcagatcacaaggtcaggagatccagaccatcctggctaacacggcgaaaccctgtttctactaaaaatacaaaaaattagccgggcatggtggcaggcatctgtagtcccagctacttgagaggctgaggcaggagaatggccagaacccaggaggcagagcttgcagtgagctgagattgtgccactgcactccagcctgggcaacagagcaagactccatctcaaaaagaaaaaaaaaaaaaagaaaactcatctgtgtactcttgttgaattagtgtctccatgggaggagtaagagtctggtgcttcctattccactgtcttgtttgaaaccaatttatttgtattctttaattagagtatatttctctcagttactacattatgaatcagttattttaaaattattttagaaaatgtaattatgttatctaattatgaaaataatgtaaacattatgtatacatttgagaaaaactattgggggaaccagcccccaatatttcaacatagtttctttctgttttccctaagtgtcagccagtctgagaaataaagagaaagggtataaagagaggtaattttacagctgggcctctgagggtgccatcacatattggtagggccgtgatggcgacctcgagctacaaaatcagcaggtttttattagggatttcagaaggggagggggcacacgaacagggagtaggtcacaaggatcacatgcttcaaagggccataaagatcacaaggcaagggcaaaattagaattactgatgagggtccatgtcccactgtgcacgcattgtcttgataaacatcttaacagtaaacagggtttgagagcagagaaccggtctgactagaattcaccaggctggaatttcccaatcctagcaagcctgagggtactgcaggagaccagggcatatttcagtccttctctcgactgcataagacagacactcccagagctgccatctatagacctacccccaggaatgcattccttccccagggttattccttgctgcaaaaagaattcagcgatatttctcctacttgctttctgcaagaagaaaaatatggctgtattctgcccaaccacgcaggcagtcagaccttatggttatctttccttgttcctggaaaattgcagttattccgttcttttttagggtgcactgatttcatattgttcaaacacacatgttttacggtcagatttcatgttgttcaaacacacgttttacaaacaattggtacagttaacacaatcatcacagggtcctgaggtgacatacatcctcagcttacaaaaatgatgagattaagtgattaaagacaggcgtaagaaattattaaagtattaattttgggaactaataaatgtccatgaaatcttcacaacttaattcttctgccatggcttcagccggtccctccattcggggtccctgacttcccgcaacaaaaaacagattataaaacatgtaacttataactatactcttgtcaacatctcctgttaacctttcctatgtgttgtttaggctttcaattaaggagcagagagcttttgtacattttaacaaagttgaatactataaagttagtggaacactttttcattgcacattgaaaagtgagcatatttctatcagtaatcattttaaaaaatattaacttattggcagtataatatattctatgggttttcataatttaatcatttaccttttgattaccatttacattgcctaaaatgtctgaaatacagttttgtatacttaatatataaatatgtagatatttacctgatttttttcctaagaaaattttgtacaattaatggtatttcctcaatgtgtataaatatatcatacttgatacatattataaattacttcctataaaagctctaacaactttttcatgctctttgcttaggttttgatttgagcactagatagtcaatattctaatgtatagaatggtatgtagtttgtaacagaggaagtgtcataaatcagtgggaaaaggccagtaatttttaaaataaaatgtgttagaaaattatctgtacaaacaggaaaaataatcaagttatttaacccaacataatgtgtcaaaaattatttcaaatgaactagttattaatgaaatatcaataggaagaaaatatgggtaagcaatttttattcagtggttctatatacaaaataatgagattaagggtaaaataatagtttcagaataatcaaaaatactattacaaaagagatgtattaagaaggagtttacaaagtctaataagaaaaacatgaacatttcagtttaaaaatagaaatggattttatcatatcattttaagattgtttcaaaaaataatttttaaaaattttcactgttatttactgtcactattgtgtacagaaatgaaggttgggtcaccaatatctgtatgaaatatgattttacatatagtgatcgaattcatttgagtttaaataaccaagatgtaataaaataaatctctttactacaaatggtttacctgcccctgtgtagactactttaatgtaaaccaagcagaatatgtcttgaatctaaattaattattgtgaaattaatcaggtacgtcattatttcacataacaaaaaaattactcatactgtacacttggtacaagtgagtgaatgcgttgcatggtaccatccatgtacttcctttgaccagttcaattaatagtagttattcatctctgaaacaatgctgcttaaataattgaactgaaatcattataggtagttaggcagtgttaggatgaggtaactaatcagtgtataatatttaaatggacagttaccctggttaactagaatgtatgactaaatatgattacagaaactgaaaacatagaaacttctccttttgacacaaatatgaaaatattttccttctattgattttgcgctagttatagtgcactgtgccttacacattaagttagagtatctcttttgatgctctaacaaactctgtgacacaaagtcatttaactacttcagctaaaatagaattttgattcagaatgtcaggctgaacatactttccctagcacacaatatcttattgaaatgaagcatatacacttatctatttaagtacatccttccatgtgtatttagattcaacatagtgctagaaaaactgaagggttatattagtgaatcacacatatttttggaacttggtaatcatacaattcttatgttatttgaaacatttcccttttaatgtttctacttgcttagcatctaatcagtcatttggtactgctatctaaattcttttttggtgctctaccccttctgcatagccagaagtcccccaagtatcagtcacttgacttcgtttattttgactgtggtgtctaaatgcaattgactttgggtcaattgtcagtcttttccttaaaaccttccctctgactacatcaacaagaatcaattttcatttcaggcaatcaataagtcataatttatataatcaacaataattgttcaaaataatgagaagtatcacttaaatggtgtcagaattgtagattcgaaactgaactaagcaagaaaattaatgaaaatgcaagctctttatgaaataaacataaaaaagacttaaaaattaaattggaatatcaaaaacataaaattccaccaaaactagttgtgatttcaacagagtatcaataaaaatcttgatgagtacacccagagtaattaagtctgttgactactgaaaataaaaagaagttaaggagtatttctaccttgcataaagaggtgactaattaatttctaaattttgattaaaataaactgatattcaaatgcatagttctttgaaatggaaatatattggttgtgttacagtttcatggccctgattataatataaaaagtcatgttttgtttaattttctttttttttcttttttttgtgggggggacagagtttcactcttgttgcccaggctggaatgcaatggcgagatcttggcttaccacagcctctgcctccctgatttaagtgattctcctgcctcagcctcccaagtagctgagattacaggcatgcgccaccacgctcagctaattttgtatttttagtagagatggggtttctccatgttgggtaggcttgtcttgaactcccgacctccaggtgatccgcccacctcagcctcccaaagtgctggtatcacaggtgtgagccaccgtgcctggccattatacttaattttcttcataaaatttgagaatccaggtttgatatgtgtttaatattaatttaataatacttttattaattatattttttctaaaatttctatttggttattttttgtaatccaattggccaattatgaatctctttttcttccataagtgtagtcttatatttgctatttcatcattgtgatgtctctatctatgtgtatattcgctacacatagaaagtatacatatatatacacaaaaatgtataatagtgtgtctgcatatatatatatgtatgtagacatgtttttaagagtatagtgactatgtgctgatatactaatatatttgctaatagagcatgtatttcattgagagtttatattccctaaaatagcatcttattatatagagagattctttgaagcttgggataaggttaattcattcagaaataatttattttcctttattccaagcattcagagtcactaaaacccagtatggtttgaaaatgaatgtttagttaaaggattttattgcctcacaggtggtatggactctagccccaatatcatgagtgagaaattttcagagacttgctacctttttgttttttcatttaattcagagccaggaccaagagaggaaaatatctccaggagctctttctctgaggtgggctttttccacttcacccactgagagtattgctctttgggggcttatgtaggaggatttccacatttgatctttcacacgtactttgctactgcctccagggctttcttacccaccgccagacagatacaactgtacactttctttttattaatgttttttgataaattctgttgctgttctgccacctcatatagttttaaatattttatccagaatttttaggaggactacttggggaagggtttcagaaaaatctaagccaccatattctgagcttttccttatgctcaagaaaacctttgtttaatgttgagattcttgagaatatgcattcttccaacaaatatttgttgagtgcctatatgtagatacataagtgaacaaaagataaatatccttgccttgatggagcttgcatcctaatggctagaaaatataatatacaataagtataagcaataaacaaatcaataacttatacaataagtataagcaataaacaaatcaataacttagatggcaacacacaccttggggatagcaacagagaaggatgaaaagctagaaggagcagtatagagtagtcacggtgatctcattgagaatgtgagatttgggcaaagatttaaagttggtaagaaagatgaggtaaatgtatggtttaattggttattgggctggacatcaaatctggataatctcttcttccttgatctgtagatggctccatagacatagcatttgtcttacattgcctgctgagaaggggagaaaggggtaaatgtgggagcaatagatagtaagaggggatctctaataccaaatattgcccttcttcaccttccctattttgcagtgagtaaccatattctgataatttctgtgactaattctataaatatattattttagtaagttctttggaagtctctgaggcatattcaaaatttaattttttaatttgtatttctctagatttcctcaggtttgtctataactgttttccaaatcacacatttctaacattagataagtgtacatttatttttttcttatgccaagtgacaggtacttaatatacaagggatattttgtgtatagtattcattctttaggagaacaacctctttaaatgtgccacagaattcagaaggcattgtataattggaaattaatcaaaacttcattcttctcagatgcacttatctttaagaatttgctctacagggctataaatgctatctatatttatctgcaaataaatatacatttttaataataaagaagtagtgtttaatattgggtaaagtattgatgtttacatggtattcgcattggtatggactgttacagagatgtaaagccctttctaaccaagttatttcttaacatttttaaagcaaactatatatatttggaaggagaatatattcagaaaacattctcaaaagggaaaataaagttcaaagataacattaattggtactattactttatacttttcttcctttagtagtctatctttacaaggagaggaatccattcagctaatggatgtcgtgctcaaagttgcctcggcattgtccatcctgagatatattcctgttccaaacctgttttggtatgttagactagtaggctgaggtttatcttaaaataagaggatgtcctttaataatctctctaatcattagtttctatttaaactgagaccttcactatcccagtgctgatgctaatagccagtagggaattattcttcttatcgtaacttcttctggcttaatttagaattagaataaaatgattttattagacttgggactatttctgggcgtatgataaacaacagaaagaaaaggaacaaggcctgatgtttaatttctgtgaatccttctgatattcttcttttcctttgccttaagataaaatcaagtttgttcttttcataatgatctaatgctttcaggtcttccgagtctgagtcttgataagggtctttaaatattacttttaactacaagttccactacattttgtaaacataaatgaatatgaccttgagataataataaataaaattttgtctatatagttcatgattaagtcttttcatttaaaaatgtgttacaatcctgcagatcatcgtatgttatttgtcattttctatataagggaggaggaaagggtatccaaacaacatttatcttgacagcataagttcttaaaaatggaaaacatgatcagaggctgaatgagtaaaattaggaacaacaatcagggtagggagtaattgcatgattctgtttctagtccaaaatagtaatattaatatttaaatgttcttatttaagtgtgaagatacaatttttttttgaggcggagtctcactctgtcgctcaggtgggagtgcagtgtcatgagctcagctcactgcaacctctgcttcctgggttcaagctattcccctgcctcagccttccgattagctggaattacaggtgcgcgccaccaggcccaactagtttttgtatttttagtagagacgaggtttcgccatgttggccaggtgttctcaaactcctgacctcagatgatctgcccgcctcggcctcccaaagtgctgggattacaggcgtgagccaccgcgcctgaccagaatatatgatttttatatgtatttgaattcaagttttttgcctaggtcaggagggttttgctgtattgtcttcattgagatgaatatttgctatggttatcataaagaccatagacaatgattcgagtagccagttccccctctagggaatgagactgcgtcatagattttgcaacaatggtttgggttttccaattttgtcttgacttcaacacaaagaaaaattcctgtggccttattcctctttgttgttatatatacttctctgtgacctacatagggtttgacttccaagaattatagtagtacaggtctcatagttaaaaataatggatttctttggtacatgtttaagtgcattatttccttatctataacaattgctaggagcttctatgcctttctttatatccttgctgattgactaaaagaagatacatagtttctactatcatatgttttggtggaagagttcctcttacttttaagagaaaaatctgtgagaaaatatttcacataattctacgcatacgttatacttttacattgtaatataattttaatatcattttctgctgtaaaaaaagacaacagaagagttaccataaatttttatttaaacaaaataaatgattgacaacagtagaataaccttttaattttttattataaatattgaagtaactattacatgaggagaaaaagatagactatcctcataattatgccaacaaaattattgaatcccacttcatttatcttgaagtacttattccattgtatgttgatgtttattttttgctggtggtaaattatatttaacaattgttaccgtgttattttagccataatttttaaagaattatgctgtgctctaatttctttactattttggtaacatcaataatttttattatgttgatatatgctcttttatgctagaaaacaaatagggatgccttcaagtgatcaaaaaacttgtttttgatagtttatatactttataaaattatgataaagttgtatatgtgtctttatatttaggttactactgctgtgtttaaagttttcagaattaaatattgatatgtttcagatttcataacgtagaaaatattttgaaatactaattttaatttatatattgccaagtatttaaatcatgatgataatttaaaatgttatgtagatcaagggatttttattttaatacgttgatagttacaaagttataatagaattcaccttcaaatgtatcttggccttagagtgactttacaagtttgaaagaataatgataataacatcgatttattgtaataacatgatattgtgttatactgtgtaccaggcaacatgctaaatactttatatgccccatgtggtttatataaggcttaaagtaaggactcctaattaatttttccattttaaagatgaaaaatttgaagctcagaggggttatgtcatttatctaaggtgacataggaagtagcggagtaggttcaaactgggccaatgtggcctcaaagcccttgttttaactgctactataatcagtagagtgttagtacagcccaagatataggctctggaaagtgaattttcaaatatttatcaatattgtgggtttgttattaaactatcagaaatttcaaatgagccatggtggaaatatttagaccttggaactcagcaaatgctacagatcaaggtttcttctatattcccctttccttcctgcattgtacagtatactagcatatcagtgcctttactgccaaagtcttgtcagtgtttgcaatattacatgtattatgttagagatataaatactgggcgtaatcttttacatcttgtattaagtactgtctataaactggaatctattaagaaacttactattaatagttattgaattaaatacattaacttttgttgctaaaatatctaaaataatttattaaagacaagaatgtgtgaaatgaactatctctcttcttttcagtgatagtggaaagtggaaatataatttcttttgtgggttatattaactctggatgctgtaacatttatagaagtattataggatttgtgaaactacgatcaaataaagtggtaagttttcaacatgtattctttttaatcaattaatctactctaaagaatagtgtcagataccttttcatgtacttactagacatttatttgtattactttgtgaaatttctattcaattttttgaaatttttgtgtttgtttttggtttagttataagatataagaatataagttgtaagatatattgatttgtaagatatacaaatgatcaatgaacacagtaaaatatgcttcacgttcttattcattagagaaatgcaagttaaaaccatagccaggtactactacaaacataccagattggctaagatgcacttaatcatttgacctaattccactccagatagtttctccagagaagtgaaaacatatgtctacacgaagacttatatgaatcctagggctgggcacagtggctcatgtctgtaatcccagcactttgagaggccgaggcgggcggatcacgagatcaggagatcgagaccatcctggccaacatggcaaaaccctgtctttactaaaaaatacaaaaattagctgggtgtggtggtgcacacctgtagtcccaggtactcaggaggctgaggcagaagaatcgcttgaacctggaaggcggaggttgcagtgagccaagattgtgccactgcactccagcctggctacagagcaagactctgtctcaaaaaaaaaaaaaaaaaacttatatgaattcttacaaactaaaaactggaagtagtccacgtatccactgacagttgaatgaatagaaatgttacagtatatttatactatgaaatgccacatagcagtaaaaataattatggatacttgtaagaatctcaaacatactatgtagggccaaaatgccaaacctgaatgagcatgttctatataattccatttttatgaagttctagaacaggcaaaaatatataattactgtggtagaaaagttagaactaatcattagttggtcagggagacttcaatggaattcaattaaatatctaaactaacttgaattctgctgcactaatcatattcagtgtaaagatttgccatttatataggtgcaaatattcaagttatattggatttgactccaggttatttagtaaatgctttagcctcttccaagttcttgccactttcctacctgagggctatattctcttttatatatcttagtggtcatcaactcctagcaaatctccccgcaaaggtaatttgaggtctcaaaattttctccagaaccattcatattgaacatcctgtaggcccttctccacaaggtctcttatttgaaccaaaattatagttccctgagtcaaactcattttccatgtttcttttgtacttaaacagaaaagacagggaataatccctcctttttgacttaataccatcggttctggccctggcattttctgcttattttccttcttccctgtgggttcaacaagagtgccttgtgactagggctgatgtaacaaacagtggttgacaaaacatcttaaatgaaactatgctcacaaaatgatatcctagatccttgaaatgtggaattagttcaatatttcctaaacatctttgtggattctaaaggacaatgctttcaattaccttagatatgcctaagttatctatgaatttactattgctctaatataattgaaatgcttatgtaagtaaatttttctgtaatttaaatacaattgctaatttattttaaatatcatttagtaaaatggtttatgagtgagtttctgataaaaacaatactgattcattatatggaagcagttgcattaaacatcaataatatatttttttaacagaaaagatctcaaaaacttgtttatatggggaaacttaaggagaaggagtcctttggtgagattagcgtccttcttcaagttcctttcacgtgcacaatcattaccaaaaaagaagttgagatggcaatcattgaagataaggacctatttggtaaatgcataaatatcttttaactgttataccattttattggatgagttcttaaattttttaaatttttttccttattaatcagatgcatatttattaaattggggttcacctgcaaaggatggagtatttgcataatctcctccagatcatttctctcttggtgaattttgaaaagggcacatgtttgtagagtgggctggaagggaacttcattttcatcatatagaaagaggtgaggacttgatgccgaggtttgatgcaggggctgcctgaggcttggtctcctggtcctccaggaccaccctgaactgaagttggagaacccagggcaaccagccctgctctgtgtcctgtccttcctgcaacttgctggacctcacagctgaaaatgggagccttgtctcattctctgtgtgagtccttaggataatggtatagtaataataatagcaataataatattagtctaagtcacacaatagtaagtgaaagcattccattgcagcataaactataaagaaatatttatggtaagcattcaggggtacttggtggatcccaggcagggacctgggcctcatgagggtactttaattctctaggatttctttttttttaattttattattattatactttaagttttagggtacatgtgcacaacgtgcaggtttgttacatatgtatacatgtgccatgttggtgtgctgcacccattaactcgtcatttagcattaggtatatctcctattgctatccctcccccttccccccaccccacaactgtccctggtgtgtgatgttccccttcctgtgtccatgtgttctcattgttcaattcccacctatgagtgagaacatgcggtgtttggttttttgtccttgtgatagtttgctgagaatgatagtttccagcttcatccatgtccctacaaaggacatgaactcatcatgttttatggctgcatagtattccatggtgtatatgtgccacattttcttaacccagtctatcactgttggacatttgggttggttccaagtctttgctattgtgaatagtgccgcaataacatacgtatgcatttgtctttatagcagcatgatttataatcctttgggtataaacccagtaatgggatggctgggtccatcagagaaatgcaaatcaaaaccacaatgagataccatctcacaccagttaaaatggcgatcattaaaaagtcaggaaacaacaggtgctggagaggatgtggagaaataggaacacttttacactgctggatgagttttttaaaagagtagagatatttcacagacaaattgggatactcaagtgagtgtttgtatgtatattatgtacaaagacaacatagctatacactgccccttttataatatattctgaattaattgtactggtgttagaatatattagcaatatttcaaaagactttgttttgaaattactaaaatctctctgccacttcccaggttaccattaatagcaatgttcccttcttttctgggacatcttctggctttcatctctaaggtcattgcttttatgtttttggttcaggtcaagtatgtaacatcctcaatatttaattaagatcaagcatatatgaaaatctaaggctggtagtatataagactttatctaaaattttagagctctagtaataataacagaataataatgcagccacctgtattcagccctccaaatactataaatactcaaattggaaatacaattgagtatgaaggagaaatgaatagaagctaataagttgtaacataataggatattaaagaaaattgtagatatgtacaataaaactgggagtaaaggatgaaagcaaagaaatttgtagacattaccatgggtgagaggtatgcttcaacagactaaattgaaagttgttcatgataaaccatataagatttgactgaatactgttatcctgaatttcaattatgttttatgtctctgacatgatttggatgtttgtcctttccaaatttcatgttgaaacgtcatcctcaatgttggagctgcagcctaatgggaggtttttgggtcaaggagatggatcctttatgaatggcttagtgtccttcctgggtaatgagtgagttctcactctattagttcatgaaagagctggctctttaaaagtgtctggcatgtttctcttgctccttctttcaccatgtgacacacctgctcctcttccattttccaccatgaataaaaccttcctgagtcctcaccagaagccaagcagatgttgttgccatgcttgttagaccctggcaaactgtgagccaaataaacttcttttctttataaattacccagcttcagatattcattaatgacaacacaaaactaatacagacgtggggtgttgctataaagatacatgaaaatgggaagcagctttggaactgggtagcaagcagaggttggaagagtttgaaagtctcataagaagacagcagatgaaggaaagtttgaaactacttaggatttgctaaatagttgtgaacaaaatactgatagaagtatggatagtgaaggccaggcttatgaggccttagatggaaatgaggaatctattggaaaatggaataaagtgtatccttgctatgccctagcaaaaatcttggctgcattgtgtccatgccctaaagatttgtggaaagttaaacttaagagtggtgacctagggtatctggtggaagaaatttctaagcagcaaaacattcaagaattagtgtgggtgcatccaacaacgtacaatcatatatgagcataaaagatgacttaacgttggaaattataattaaaaaggaagcagagcataaaatttgaaaaattcacactctagctatgtggaagagaaggaacgtgcattttctagagagaaatttaaatgcactgtggagcaacaacttgctagagggattagcttgactaaaagggagacaagtgccaatattcaagataatgggagaaggtcctcaaaggaatttcagaaatcttgaagacagctcctcccatcacaggcccagatgcctaggaggaaagaatgttttggggagccaggctgaggatactgctgccctatgccacctcaggacgctgctctcagaatctgagcagagccatcctgggctcaaacagccccagatacagcatgggctactgctccagagactgtaagctataagcctttgtggcttccacatggagttgggtctgcaggtatatgaaatgcaagagtgaaggaagcttgctatattctacctagatttcagagaatgtatcagaaagccttccagagagaaggctcctgcaggggccccacagagagcctctataagagaagtgccaaaaggaaatttgggattggagctaccacacaaagtccccattggggcactgcctagtgaactgtaagaagtgggctgccaccctccagacctgagaatggtagagccatgggcagcttgcactctgagcctggaaaagctacaggcgtttaactccaacccatgaaagaagccacgtgggctgcatccagcaaagctgcaagggtggagctgcccaaggccttgggaacccatcccttgcaccagtgtacccataattagagtcaacagagacgattttggagctttaaaattttaatacctgctcttctgggtttcagacatgcatggggaatgtttcccctatcttttgtcttatttctgtcttttggaatgggaatgtttacttgatttctttagcaccactgtatcttggaaattaataacttgtttttggtcttacaggctcataggtggaaagaatgtgtcttgagtctcagatggaactttggacttttgagttgatgctagaatgagttaagaccaggggactgttgggaaggggtgattatatattgcaatgtgagaaggacatgagatatggtaggccagcaacagaatgatatagtttggatgtctgtcccctccaaatctcaggttgaagggtgatcctcattgttagaggtggggactggtgaggggtgtttgtgttattgaggtagactcctaataaagggcttggcttcatcttcatgataatgagtgagttgtttctctgtgagttcacatgagagctggttgtttaaagaagcctagcagctccttttctctctcttgctccctctctctccatgtgacatgcctgctccttctctgccttccaccatgaacaaaagattcccgaggcctcatcagtagccaagaagatactggtgccatgcttgtacaacttgcagaactatcagtcaaataaacctctttcctttatagattacccagccttgggtattccttcatagcaatgcaaaactgactaatagtctcttacagaatgtgttaccaatacttgcataacactaactcaaaatgaaaaaaattaattcaaattcatatgtctaattttaaaagttgtaaatctgaaatgacatttgttaattttattttcttctgtgacattcaaatacaacctccctcaaggtaaacattgcttaaaaataattactaaccaccaattaaaatgacaatattctcacttaatattttttcttttcctatataataatatgttttttcttttcctatataaatgatgttaactggtgcaaggcaaatacactgtggactcttttatgtaaaacaacatttcacacgttgtattatacaaagttcttcaaaaaaaacagaaccaataggatatatataaatatacaagaggcgatctattatggggattggctaatgtgattgtagagtacacaaagtcccatgatatgctttcagcaagctggagaatcagtaaagccagtggtataattcaggttgtgtctgaaggtctgaaggggaactgagggtgtaactcccagtgtgaggccaaagccttgaaaactggagagggcagacaggaggcagttgtattaagtcctggagtctgaaggccagagcaccaggaatcctggtattcaagaactgggaaagatggccatcttagctgaagaagagatagacagaattcctctgcctttttaatctattcaggcccgcaatggattaggtgttatctgtttgcattggtgttggtggattttccttaattcatctactgattcaaatgctaatctctctaaaaaacaccctcaaagacacatctggaaatgttttaccagctatctgggcatcccttagcccagtcaaggtggcacataaagttaagtgtcacatacaaaagtgtttcttttagtcacttaatagaatctcctttgtcatctggcagcctaacattcaaatacttggcattgtatgggatttagtaatgtttgtgtgtgtacaaacattttaattcattccatagtctgttttattccatagtctgcatacatcagactattccatagtctgaatttcattttaaattcattccatagtctgttcatttgagagtgatgttctaaagctgctgacatgatgtgtgcctaattgaatattctctaaatagaaatgtgcttgaggactagattttgcttgttttttcaaaatttacaaggaaataaaatattgtgtttatttcagaaagcattttatttctacattctaatatttcatattctattccaagatagttaaatgtacattttaagggctagataattctaatgaaaaattaatggttaattttgctgaaataattttcacatatgaagaacaatgatattaatttgcatttaatctgctatatcctatctccatctacttcatttattatttgaaatatagatccacctctatgaaataacataggacaggactcaagagaaagtaaaatgagtcttaaatatatcaagttgaagacaaatgaaaatgctgtgctggaaaactcagcgtgagcaaactctatgttatgtcatcttgctatcaagtgttattattagctgttatattacataggtgttaggaataatttaaatttgagaaagtccactaaaaataaacaaaaataaataaaataattatgttccaatagaatcctcaattattagttggttatgttgccttcactttctaatttttcaagaattgttaaaaacagcaattcttttagaactataaaggtattactgaaaaaataaattaatgcttatctttctccaggtatatgggttatactctctatttggtcttatgtaaatcatgtaaagattcagttcatcttgaatgaatcaacaatatttggtaaatacccaaagagagcaattcactcactgtacctgtacttcaagataggtagaatagaatctagagaatattaaagacttcataaatgttaaatgctctactggagaattatatatgcaaccgtctatatataaaatatagtaagatgtatgcagcaattagttttgtaatatttaaaaggacttgaggagtggcttatttgttccttttggtggttaacttttggaagttaggaaatatctttttttaatctatatgcatccttctcagacattgccttgaacatctaaataagaatgagaatagcattattaagcttaagcaaatataaatttcctctgtttttcacatgctactgagaatgtagtttattattatttttataaagtcaatatatctttgtccagatgcagagcttattactcaagtcatttaaggtaaagataattgcaagtcaatataactattttaattttactgatgtcttaaattctcattccaccattagaacaagtgtactacttttgtaatgagaaagaatttctttttatctataaaatgaattactgatgttttttattatatctcattcaacaacttatgattgaaaaataaggaatagctaatgtgcttaatttgccataccgaaaaggaaaatttcaattccaaggtgttattggtataaactatctgaaagtttctgcttgtttttaaaaaggaagaatgcctaaagactatctctcataatgcttaatacaaagcacaggaggtcagagtttttactgcagatatatctgttaagcatttcaggggcaataaatatattcatattcaaaaacttcttcccaacacatcagcatttcaccttaatgatgagataagttatagccaagattatccttgttaaattaacaaaactaataaaaaggatttaagctcttgaacagtttgccacagggaatacacgactctttccccttttgcgtttttgcattgtgatttaaaattttgatatatgcaattccaagttaaaaataagatagggcacttatttttaaatcagataaaaatgcttaaaagcatcttctcctcttataatttgttattccttactaatacatgttaaattttaaaaatgtaagttacaaagttgagtgaaatgttttttgaggaaaaaataatattttatttgcaaagcttgacaaaatgctaatatctttaatgataaatgagctcttagaaatcagtagaaggagattaacattacaagggaagtgaaaataaaaagaacagaggaaaatgaaataacacaaatgtcttacaaggctatgtgaagatgatatagcttaccattaatagatgaaaaagcaatttcactataaattacattatcaatgcttacaaatattgatatctaatgtttatatagttttaggaagggaaaatcctcaaatactgggaaaatttactccagttataggaaatttactcaaagtatagattttgcatatactttgccccagcaattccagttcatggggatcattccaacaaaatagttggatgaatatatatatatatatatattcttgttcactacatagaaaatctttggctaatatgtcatcccccaagaaactacttatgtatcaattggtttataaagaaatagatgggggggtagaatttgaaatataaaaagcattgaagtaaaaatacaagatttcacaaaattctatgttccttgaattcttgaaaaagaactttctttaaatgaatcagttttatatttactctgtgataagtgaaaattataaatgtatacacttcagacttatggaagcactgagatgaaacacttttaattccactatcctggcttctttgtttaagaatgtctgtcattccatgtcctgagattgagtccaatgacaaaccatgaaaacaattaccatgcttacttaaaatctacttcaatgacactctttaggttacttttcaaaaatgagctttctcagtcaagtttttctgatctgcaaggaatgtccactgcaatgcctgtgaggagtctccatacatcatgaagaccatattttggttttggtgaagatgatattagaaacaagggcacagtctccctctttcagtcattaaaatcatattgccaagaatgcttgaatgagaatactgcaacaggtcattcagtgataactgaggtttttcaataccagatgtgtttatccaagttcaggaggaagtgttagctattgtacacactgccccttgttcatccaacagacagtccaaggcaacttgattatctacaaaaaaatttagcaagggagtttagaaaagtttgttgggcacctatagcctttgcagtaaacttagctattactatagctaatgcttgagacagatttttaatcataaccttatttacatttgtgccaagccaataaagttacattctaccaaagatggccattaagaggaatttacaccattttgtctactccatggcaagtcatggactgcagtttttagtaatggaatctttaaggactcagaaaagaccaggcagccattcgaaccctctgtgagtccacgcttaacattaaatttatatccttttagataccaattttgcttttccaagtcaggtacatataacactgcttattaaataggttattataggtgatttgacttggatcaatcttatggagttcattcaaattgcatattctaactttttttttgtactttaagttaagaacgtgcaggtttgttacatgtatagacacatgccgtggtggtttgctgtacccatcaacccgtcatctatattaggtatttctcctaatgctatccctcctctagtacgccccacccaacaggccctggtgtgtgatgttcccctccctgtgtccatgtgttctcattgttcaactcccacttatgagtgggaacatgaagtgtttggttttctgttgttgtgttagtttgctgaaaatgatggtttccagagttatccatgtccctgcaaaggacatgaactcatcctttttttatggccacatagtattccatggtgtatatgtgccacattttctttatccagtctatcaattgggttggttccaagtatctgctattgtgaacagtgccacaataaacatactacatgtgcatgtgcctttatagtagaatgatttatcatcctttgggtacatacccagtaatgggattgctgggtcaaatgatatttctggttatagatccttgaggaattgtcacactgtcttccacaatggttgaactaatttagactcccaccaacagtgtaaaagtgttcctatttctccacatcctctccagcatctgttcatgtaagtttcctaactttttaatgattgccattctaactggcatgagatggtatctcattgtggttttgatttgcatttctctaatgaccagtgatgatgagctttttttcatatgtttgttagctgctaaatgtcttcttttgaggagtgtctgttcatacttttcgcccactttttgatggggttgtttgtttttttcttgtgattttgtttaagttccttgtggattctggatattagccctttgtcagatggatagattgcaaaatttttctcccattctgtaggttgcctgttcactctgatgatagtttcttttgctgtgcagaagctctttagtttaattagatcacatttgtcaattttggcttttgttgtcattgcttttggtgttttattcatgaagtccttgcccatgcctatgtcctgaatggtattgcctaggaaattttggtttttttttttttaaacgaatgaaaaagttttagacaaatctttgacaaccatttgctggctcaaatgttgttgttttctaaggtgtttctcaacatattgttttattccattaggtattttatagaggtattatactgttttgttaatgagaaaactagctaaacattttgaacatcttgctgacatttaaaattaatttttacttggagagattatctcaaaaaatattgtatatcacatatatttataagtatctatatatatgtatatatattcacacatctaatgtgtggaaaagataacattactcagaaaacaatgatgaccttgatattttagcctgacaatatgtgtttgaccactcataaactttgtaaatgtttgtttattttgtaagaagaagttaatgtttttgctcgagtttggcttttagataattttttctctatcaagtgtattaaactgttttactttttaattcttttaaatccaatttgtctttttattttattttttaaatattttaaattttattttatgttcagaagtacatgtgcaagtttgttatataggtaaactcatgactcagtggtttagtgtatagatttttttgtcacctaggtatcaagcctagttcccattagttatttttcttgatcctctctctcttcccaccctccccctctctgataggccccagtgtgtattgttcccctttgtgcattcatgtgttctcatcatttagctcccacttacaaggaaaatatgctgtatttggttttctgttcctgcattaatttataaggataatgtcccccagttccatccacattcctgcaaaggacatgatatcattcttttttatggctgcatagtattccatggtgtatgtgtaccacaatttctttatccagtctattgtagatgggcatttaggttgattccatgtctttgctattatgagcagtgctgcagtgaacatcgctgtgcatgtgtctttataatagaactattcatattctttttggtatatacccagtggtgagattgctggatcaaatggtagttcttgttttaggtctttgaggggttgccacactgctttctataatggttgaacctaatttacactcgcaccaacagtgtataagtgtccccttttctccacaaccttgccagcatctgttattttttactttttagtaattcagtcaaaatggctattctgactgatgtgatgtgagatgacatctcatttaggttttgattttcttttctctaatgattagtgatattgtgctttttttcatatgcttgttggccgtgtgtatgctaaagtatctgttcatgtcttttgctcagtttttaatggtttttgttttttgcttgtacatttgtttaagttacttatagattctggatattagacctttgtcagatgtgtagttagaccattttaacttgtagatggcagagttgattttagcccataaaaaagccacagtaaaatgttgaatatcatgttttcattttcagatttgctatacttgaaaccacttgttccactgtaaaatgtaatcctttatgaattttatatttattgattcaaaggttctatgtttacattgccatgccatgtctaacaataaggtccacttgtaagtagatttatttgttattggtaacaataatctcacacaattttgatgtattcaggttaaaattttaagtatgataactttgctttcctgttgtagaaagattttaaaattaacattaatatgggtttatgcatgcctctattaaaatataatcagaagcaattattagatttccaataaataactggtttattgaataattacaactcacaggaagcatttacaaaggaattttataatgtctcccacattctttattatttgttcaagttggagaagttcttttcctgctctttgaaaactcaatgtaatgattttacgatcactcttaagtcataaaatgtcctataaatcatttttagttgccaaatattctcagttgggataataataaatctagcctggtaagaagccagtatccagacttcattgtaggttgataggccagctatatgtgtgtattaatttccttttgctacataacaaattaccataaatttagcagctttaaacaatactcatttatcatctcacagttttgtaggtcagatgtctgggctggttcaactgcgttctattcttagagtttcacatggctaaaatctaagtgttggccaagctgtgatctaattttagggctgtggagaagaggtcacctccaagtccattcaaattggtagatttcatttccttgcagctgcagaactgaaattcctgttttcttgcggtttttacctgagggtcactctcagccatcagagcctgctccatccatctggccctctccatctcagcaatgaagaattccttctgctgaccctctctctcgttttgaatctttctcttccctgccagctgaagaaaactctttgtgtttaaacaattcatgtgattgggctaggcccacccagataacctgcctattttaaggttaactcgttagtatccttaattacatctgcaaaaatccctgtactgtgtaatataacataatcacaggagtaacaccatgggctgaaggtcgtgggggccactttagaactctgctaccatagtgctggaggtcagcagtgggtaaggagagcatgacaggtatctctgctttccactgccatccctaagctttctatttattgttctgatttctctgctatgaggcagcatggggtactggggagaagaggatggcaaacaaataagaaaggaagtgaaaatgttcttaattgttactgttataaactgttttttcactatgtgtttgacagttgtttcaagctaagcctttctagtgagcaccttcaaagagttttggatatcccttaatattggggaatatttgcctgtaattccttaataaggtagtacattttcctccctgggaatccagagataacttcagatttcctctgctgagggtactttactcccagcctcctctctcactaatataccattgggactttatcctggctgtcttttacacatgagattatatgtggcctacataggaaagtctacatgggaagacactcctatattctttgtcctgacaaactttgagagggcaggccaatttctgagcagccacttatgtagcttgtttgtcaactgtcaactagcttttctcttaccttcacaggtctcaaggtgtagtcagacaatagtgtactctactgtggcttttaaattctcagaacgtatataaagctctccaggtgggctttttgaagatcccctctttcagttgaggtgatgaagaggtatttctcattacatccccttgcagatggtgaagcttagaacagaactcttcgagaaatctgcttcaaaaatcttctatcagtctctattctcaacatttcagtgtgcatgaaggacttgctttctgcttctccacatctattaaaaaaattggtacgttgttatgagatgtactgccttggattctgagctgattctcccactttttaattaccttgaagtattcactgtgttccacacattattctacatactttatatgttttatctaatcaaatgttcacaacaacccattgagaaatatgcatttaatagccctattttgtggatcaggagaataaagtatagaaagattaagtgatatcaatgctctctatcgaaaggtcatgggggacacttctgtggttgactgaattgggtttgttactcattgggatgagagagaactatggggaaccatagattgtctcagcaaaaggacattaaaagaatatgttggccgggagtggtggcttacgcctataattccagcactttgggaggcagaggcaggtggatcacgaggtcaggagtttgattaccaacatggtgaaacccaatctttcctaaaaagacaaaaattagctgggcatgatgatgtgcacctgtagtcgcagctactcaggaggctgaggcaggagaattgcttgaacccaggaggtggaggttgcagtgagcctagatcacaccatttcactccatcctgggtgacagagcgagattccatctaaaaagaaaagaaaagaaaagaaaagaatatgttatagaatttgggttttggttgggtgatttgggaagtagcctaagaatgtagaaatttgttcttgattgaacgctgtcaaaaaacaatatatcccaataaatcttaagttttggaagggcagactagagtgaagataaatatgtaattaataaaaaagtagattgggcatggcagctcatacctgtaattccagcattttaggaggctgaagtgagaggactgtttgaggccaggagatggagactagactgggcaacatagtgagaccctgtctgtacaaaaaatagtaaaaagttagctgggcatggtgcctcacacctgtagtcccagctacttggtggactaaggcaggaggatcccttgagccaggagtttgaggctgcagtgagctatgatcaagccacttcactccaccctgggtgacagaacaaaaacctatctcaaaaagagagggagagagagtgagagagagacagagagagaaagagaaagatagcacctgcttctattagccaaaagaggggtatttggtattttgtaggcatcaagctgaccttgcttttgtctgtgcttagacaaaattatgaaatgaccttgcttgtctcattttatcatgctcatggacaacatatctgagggttacattctgtgcaaatctgccataggagaattatgtggccaactgaaaatgccaggcccgcttccaaatgtcagattcggcttccctcccctccttcttttccttctcatgacttgcttaatattacagagctattaaggggtgcaaccaggaatcaaaccctaacactctgcctccaggatccatattacaacaactatactttactaacagtttaactgataactcaataatttttttaatccattatccttatgtagttattttattccatatattttagccataattgtataaattttggctagatttttggctaaatgatatttaataatggccttcaatgttcacatgtatttaggaaggaaacatatttttcttttactaggattcattacattgatatagctaagaagccctgaactcaagtgtaagatttggtttcctaggtcaattctaccattccgtacatgctgtttgagtcatctatgttcttttttgtgattgaaaagagttccagtgtatatttatattgtgttttatacttacctatgtaattacctctgctcatgctctttatttttcatgtggaactgaattaccacattctatccttccttttctgtctgaagatcttatttctcatacagcaaatctgcaggtgacaagttctctcagtctttatttatctggaaatgtctttatttctttttcatgtttgaagattagttttgttagatttagaattcttggctgatagtctttttctttcagcactttgagcatgttattcctccttcttctggcctctatagtttccaatgagaagttgctgttagtaccattgagtatcatttgtggatgatttgtcactttcctagtgctgctttcttttttttttattattatactttaagttttagggtacatgtgcacaatgtgccggttagttacatatgtatacatgcgccatgctggtgtgctgcacccattaactagtcatttagcattaggtatatctcctatatgctatccctccccactcccccgaccccacaacagtccccagagtgtgatgttccccttcctgtgtccatgtgttctcattgttcaattcccatctatgagtgagaacatgcagtgtttggttttttgtccctgcaatagtttactgagaatgatgatttccgatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgtagtcctttgggtatatacccagtaatgggatggctgggtcaaatggtatttctagttctagatccctgaggaatcgccacactgacttccataatggttgaattagtttacagtcccatcaacagtgtaaaagtgttcctatttctccactactctccagcacctgttgtttcctgactttttaatgattgccattctaactggtgtgagatggtatctcattgtggttttgatttgcatttctctgatggccagtgatggtgcgcattttttcatgtgtcttttggctgcataaatgttttcttttgagaagtgtctgttcatgtcctttgcccactttttgatggggttgtttgtttttttcttgtaaatttgtttaagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttagtccatcttgaattaatttttgtataaggtataaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctgtgttctgttccattgatctatatctctgttttggtaccagtaccatgctgttttggttactgtagccttgtagtatagtttgaagtcaggtagtgtgatgcctccagttttgttctttcggcttaggattgactgggcaatgggggctcttttttggttccatatgaactttaaagtagttttttccatttctgtgaggaaagtcattggtagcttgatggggatggcattgaatctataaattaccttgggcagtatggccattttcatgatattgattcttcctacccatgagcatggaatgttcttccatttgtttgtatcctcttttatttcattgagcagtggtttgtaattctccttgaagaggtccttcacgtcccttgtaatttggattcctaagtacttctaactcattttatgaggccagcatcatcctgataccaaagccaggcagagacacaaccaaaaaagagaattttagaccaatatccttgattaacattgatgcagaaatcctcaataaaatactggcaaactgaatccagcagcacatcaaaaagcttatccactatgatcaagtgggcttcatccctgggatgcaaggctggttcaatatatgcaaatcaataaatgtaatccagcgtataaacagaaccaaagacaaaaaccacatgattatctcaatagatgcagaaaaggcctttgacaaaattcaacaacccttcatgctaaaaactctcaataaattaggtattgacaggacatatctcaaaataataagagctatctatgacaaacccacagccaatatcatactgaatgggcaaaaactggaagcattccctttgaaaactggcacaagacagggacgccctctctcaccactcctattcaacatagtgttggaagttctggccagggcaattaggcaggagaaggaaataaagggtattcaattaggaaaagaggaagtcaaattgtccctgtttgcagacgacatgattgtatatccagaaaaccccactgtctcagcccaaaatcttcttaagctgataagcaacttcagccaagtctcaggatacaaaatcaatgtacaaaaatcacaagcattcttatacaccaataacagacaaacagagagccaaatcatgagtgaactcccgttcataattgcttcaaagagaaaaaaatacctagtgctgctttcaagattttgtttctgttttttgataatttatgatgggccctgttgtagatatcttttagtttatcctacttgcagttttcactgaggttcttaaatgtatactttgatgtttcccatcaaatgctagttttctgtcattatttctggttcctcactggataaaaagtaaatactttataatgtttgttcccactccactgatttccaaatttcttcagaaactctgggttgattttctgttttagagtcaccataaacgtggtctccaagattaagttcttagaagattatgataggtagaaaagagtctatgctgttataaacattgatgacattgaaaatcaatctagtaatagcttttttgttacataatactttatttgtccacaaataagtggcctcttttctgatgctcttacctatcaatgattattaaaattctcaaacttttatgtggcaacgttcttaataatttaagttcaatcacctcatatatggcaaattttcactagatgtctagaacaaatttatttctgtatgtaaactatgcttcctttttatagatggtataagccatggtattttccactttttgtgggctcccaggaagagcattgtcaactttgcatataactgtggtagcttcctttacctaagtaaactcctgtgatttttttcttcctgtttctgtctaccttacacttctgttactttaagtagttttaattacatacttatatgatattttttattatagtagttagattataacttttaaaaattatgaccatttcaagtatttggatgggtgaattcttccagtaataaataaaggcatagtttacatatttttaaattggaagttgtgggtttaattattggctcttatttttctctcaagaaaaaaagcaaatgttattgaaaagtagacttttctgcaaatgatgattaatgaccaatgatacttctactgacccaatgatacttctactgatacttctaatatagcggtattagtttaatggtgaagccaccaatcacttaggtaatattgaaatatattgttgaccctaaccacaagtaacataatttggagtgctgctaggcagaattttttaaaggcattatcacaaacccttgctgcatctctcgcttacctaaacatgaaacattttgagaccaataattagttaagttttaattcttaacattcacaggttttgattttatactcttgtaattatgatgccttaaatgtaacttgtttttcagcaaggactttagatgactggtatgtaaagttgtaggttgtatatcttcatttaggaaatagtttgtatgctccaaaagtctaattgtctgtagatgaaagaaaattacaataaatgttggcttataggaattgccaattcaggccaaaaagcctaactggtttagcaaacaatattagtcagatatcaagttcaaaacaaccaaatgttatatgaagaaaaagtgtatttttaggataagtttatataaaatttcaggccaagtttctgtgtaaaccttaaacttcaatatttttagatagaacccaagtctatgcctgtacaaatgtaattttataaacttgttatcacattctatttcatgattaatttaaatatttgtattgcaaaatattgcttaattgttagaagctacaacagttttcatctgatgaattcagtgttacagctactggtaattacaactaggcttttatagtatatacatttctctcctttggttgattatattgtttggcaaaactaatcccctaaaaaattccttacaaaataattcatcataaaaaaagaaaatcagaatgtaggcaataatgtgccccatcaacatgtatatgacagctctttccaatatatagcataaccactgaaatataatcatcattgtgaatatttaccgtgcacttcatctgtcttttactgtgcaatagtgtttttcttgggtatttctgatatcaaatccttgtggattgctaaattttgattttcactcaatttttaggaagcctgtaataaaataaaatgtgtttcctaagaaatttgataaaatttacagagttatgcacaaatgataaaaaataccacatttaagatagttccttaaatcaagatcctaataagggcaactttagtataacagactattactgaggattttcattttcattgcccgtctttacatacccagttgggttctagactggtacaccttgtatggaagagattagttagagactgaacaactctctcttttgtcttcattagtactggggcacgttaaatttcccagcctctctagcagttaggttggagccatgtaactggctctggttaatagaatagagggaacatattattgcctggccatgaaatatatgatttttccatgatctcactcactgtctggaagtcaagtactccaaaatagcagcatcacgtgatgatgagaacctagaccttggaattcttttcttggatggaattgctcagaaaaatagcttagctagaaacatctgtattggactttgtgtaagtgacaaataaacatttgttgaattaagcaaccaagattttagtttgttatagcaactaccaagtgctacactgagtcatacaactggcaaaaatgcaaggttttctgaggagttctcaaaacaagtaataatttctggattagaacataaaataaatatgctttttgtgattattcttttgtccttaacatttataaatcttccactcaaaaataattatacagtacatttagaaatgaaaatatatgtgcataaagaagatatacactattgcatctaagttttagtatggttttgaatagtactattataagaacaaatgtacatgaattcagctcttagttttgtaattaatgcactttcacaatctctgacaacactgtttttaaaaacagctgatagtttagttacaaatttccaggaacttagcaaatgtcatagggtaagctgtgtgctgtctgttaacacagagagaggtaagtggaatttagcacatttcaaagagaaagcaaaaagttagacaaaccaataatcaaaattaaattttgtaaactatgttagataaatgcccaccaagagttaatagaacaaggcttagaaatatctgtagataaagttatcagtgactttactgagaaagtttacaataaccatcttttccgaagccatagcattccttataagtttttatatatagtttaggtatcacacagattctattttcttaggctatcataggaaccgaatcaaggttattagattggaatattggtatagaaaccattccaaagcttcaaagaaatgaatgaaattcattatgtcttgcaagacaaaacttccatctcttatttttaaaatgtctgcttaaatgaaatccccaaaaattacttatagttaccttatatgagaagttaaatttgagttaaagttttcaagttcttttgcaaaggtacactgaattccgtcactaaatactttcctaatatgcttttggaaaatatattcaagatcctatgtctgtcttttccttttttcaggccttggatctactcagactatgttgataaaagataaatagatctcttgcaggaagaattgtactttctgcgataaaaatttaatgggctaatatttaattatgttggttggcaaatttaaaaattatgcaatatgaaggattataacatcaaataaaagcagagatgaactttttagttcaaagattcagcagcttgttctatcacttactgtagactgtgactgtaaaggaaatatagtttagatgagctctcagttcatactgcttcaatgcattaccatgggctgggtggcttaaacaacaaacgtttattttcccatagttttggagggcaagaaatccaagatcaagtccctggctgatctggtgtctggtgagggtacattcctggtttgcaaaaatagctgtcttctccttgtattctcacatggctgagaatagagagcaagctctgacaagggtactaattcctaagggctcggccctcagcacctaattacttgccagaagaaacctactaataccgtcacattggacgttaggatttcaacctatgaatttttgagggatgtaaccatttagcccatgacacatgctaacttttttaacagtaaaaaccggcctaaaaataattatcttctgaaaatatcctgacagatgtgaaaccacatagcaacatgcttcgcacacatttggacatatgtattcatagagttctatatttgggtacttccatagaaatctttaatagctaaagcagtgattatttactatattaaagtgtttttctgcattatttcatttcatcttaatgaaaatcttagttaagtttattaaacccattttataggtaaggcaacaaaggcttataaagcataagtaacttgcacaaatacatagaaatttgtaagtattggagccagaattcggacccaattctgtccaaatcccatctcttactcaagcttcttattttatagattaaaaatcagaaccttagaaagaagaaataatttacttgaggacacatgtctaaccactgttagagcacatcttggaacccaaatattctggctcatatacaatactaagtgttgatatttgtttgttaaatttattttttttcttttttttttttacatttagaaaactccaatttttatttttatttctttattttattttattttatttcttatttttatttttcgcagataatttttgtaattttattttatttatttttttatgattattatttatattattattatactttaagttttacggtacatgtgcacattgtgcaggttagttacatatgtatacatgtgccatgctggtgcgctgcacccactaactcatcatctagcattagatatatctcccaatgctatccctcccccctccccacaccccacaacagtccccagagtgcgatattccccttcctgtgtccatgtgttctccttgttcaattcccacctatgagtgagaatatgcggtgtttggttttttgttcttgcgatagtttattgagaatgatgatttccaatttcatccatgtccctacaaaggacatgaactcatcattttgtatggctgcatagtattccatgttgtatatgtgccacattttcttaatccagtctatcattgttggacatttgtgttggttccaagtctttgctatcgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcactgtggtttcgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaagttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggactaacgtttaagtctttaatccatcttgaattgatttttgtataaggtgtaaggaagggatccagtttcagctttctacatatggctagccagttttcccagcaccatttattaaatagggaatcctttccccatttcttgtttttctcaggtttttcaaagatcagatagttgtagatatgtggcattatttctgagggctccattctgttccattgatctatatctctgttttggtaccagtaccatgctgttttggttactgtagccttgttgtatagtttgaagtcaggtagtgtgatgcctccagctttgttcttttggcttaggattgacttggctctgcaggctcttttttggttccatatgaactttaaagtagttttttccaattctgcgaagaaaggcattggtagcttgatggagatggcattgaatctgtaaattaccttgggcagtatggacattttcatgatattgattcttcctacccatgagcatggaatgttcttccatttgtttgtatccgcttttatttccttgagcagtggtttgtagttctccttgaaaaggtccttcatatcccttgtaagttggattcctaggtattttattctctttgaagcaattgtgaatgggagttcactcatgatttggctctctgtttgtctgttgttggtgtataggaatgcttgtgatttttgcacattgattttgtaaactgagactttgctgaagttgcttatcagcttaaggagatttggggctgagacaatggggttttctagatatacaatcatgtcatctgcaaacagggacaatttgacttcctcttttcctaattgaataccctttatttccttctcctgcctaattgccctggccagaagttccaacactatgttgaataggagtggtgagagagggcatccctgtcttgtgaaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctagtagacatctacagaactctccaccccaaatcaacaaaatatacatttttttcagcaccacaccacacctattccaaaattgaccacatactgggaagtaaagctctccccagcaaatgtaaaagaacagaatttataacaaactatctcttgtttgttaaatttaaaaaaaatccatgagaaatagatcttgatgactagagaactgcattcatttttgatgaagaaataaaagggaaaacattagcaaataatgtaatggtcataaaagtgcatattaaattaatgatgaaacattattgcactgtcagaataccagtaattttttttaagaaatacgtttataatatttgtaaaattacattgattgaatctgattgttttatatataaaaaatgaaataattttctaaaaaatgaaataaggaagttgaagtagaattataaaaacacaggtataatacattatctagagcttagtagcaaatcctaagcaaaattctgagtaaaaggaaaatacacgagaaatacttaaatatgaccaaatgatttaccagaaaccagttagaaacatttaccaagtggtaaaatctagattatgacaaaaatttcagacatcatccactggtgccacttgggaggttttagataatgcaagacaataatataaactagtaaggataaacttagacaaaggaaccaaatatctgtgtttgcttattataattacatacacaaacaagagtatttatataattaccagctaaaagattaatataatttaataatttgtgctaatatttgaatattaaaatgtcaaatgtcaagatagaaatgcaaaatgtaatagcttctctacctaaatagtatacagttagaaatggacatgataatacttaaaaataagatcattcttggcacccttgttgaatatcagttgatcatatatacatggatttatttctgtattttatattgtgttctattactctgtatgattgtctttatgcaataccatactgttttgattactgtagctttgtaaggtattttcaaagcaggtggtgtgatgtctccaacttcatccttctttctgcagattgatttggttatgtgtaattttttatggttccatatgaaataaaaaattgttttgtctatttctgaaaaaaagcaccattaggattttaatagaagttttattgaatctgtaggtctcattgggtaatagggacattttaacaatattgtcttccagtctgtgaacgtgagatgtcttttcatttgtttgtgttctttaatttctttaattggtgttttgtagttttcagtaaacaagtcttttacctccttagctaagtttattctaagtattttattgttttttaggactgttgtaaatggggttgttttactaatttaatctctacaaaaatagcattggaaaattggatatccacattcaagaataaaattggacccttaccttgcactgtacttaataatcaactaaaaatggattaaagacacaaatgcaagaattgtaactgttaaactcttagaagaatacgtagttaaaaatattttcacatttgtcttggcaatgacttcatggatgtgacaccaaaagcacaggcaacaaaaacaaaccagtgagaccacatcaaactagaaaacgtttgcacagcaaaggaaccaatcaccagagcaaaggcaacctatagaatgggagaaaatatttgcaaaccgtgcaactgataaaggattaatctccaaaatatataagacaatattccatttcaatagctaaaaataataactcaatttaaaaataggataaagacttgaatatacatttctctaaaaaagacatacaaatggccagcatgtgtatttttaaaatgtccaatgccactaacaggaaaatgcaaacaaaaccacagtgaaatattacctcatacctattagcattgcttatatttaaaaacacaaaagagaagtgttgacagggatgtggagaaattggactttttgcactctgttaatgggagcacaaaatgatgtagccactatggaaaacagaatggaagtcccttaaacaattaacagtagaccatatgatctagcaggcccagttctagatattttctaaaggaatttaaattgggatctcaaagagatattagcagtaccatgttaattgcagcattatgcataatagctaatatgtgggaaatctattgacagataaatgaattaaaaatatgtacataaaatggaatgctattcagccttaaaaaggaaattctgcaatatgtaataggagagatgagccttgaggacattatgctacatgaaataagccagtcacagaatccccaaacctgaccactcatacgaggtatctaaaatcgtcaaatttataggattaaaaagtggaatggtggttacgaggggttgaggcatgggaaatgggaacctactaatccatgggcataaagtttcagttacacaagatgaataagttctatggatctgctgtacaacattctacctatagtcaacaatattgtattgtacacttaaaaatttgtgttgagggtatatctcatgttaagtgttcttaccatgataatataacattttaaaaaataaatagaagagtgactcaaccacagagagccagtctatattaaaaaactataaaaatgttattaaataatagaaaacaaatatagacatataatttaacatttgattaaaaaatgtcaccttttccaaaatgttcatggaatttaatatagctctgttcagcattttggcatttcctatggaattctagctaactggttagatacaaaataggtaagatgattttacattcatatgaaacaatgactgccaacaatttagagaaaataattatcaatttaaaatatcagcaagaaacataatattactacagaaaacataatttggttagaagagaggatcaaatcactccatataattatagaattttccttgtggaaaaatgatcactctcaaatgtcattagagggggtgtaaagtgttacattatttctagaataagctctgacaatattatttttttcttttaaagcataacccctctgactcagcaatgtaattttagggttctattctgtaggaaaataattaccaaaaatgagtatttattatgtaacttcttgtttgtttgtttgccttttgcagtggcctagatctagaaacaacctcagtgaacattaattaagaaagtattgactaaataatggaataattgcattctggaatactatcaaactaccagcaatgaatttg

SEQ ID NO: 723 - DNA, 462269 bp, Homo sapiens
tcaactgcagatgttgtggatcgttttagatgctaatagaaatacctcatgggactgtttcctggggttagaggaaaaacaaaacaatagtgcaactctaagaccttgaactagtaaaaggcctgacacattttataggctggtggccataagctagtgaagagattcttcatttaagcaacttcatttaatcacgttaattacaccctgtggccctgctccagaattcacggtacatattgctttacaatttcttgggtgacaaacgtgtttttaagttccttagaagtttatttacgatgctatgaaaatgtagccatgccagagaggtgagatctgtaagcttctgagttgctgtgtgaggagaaggatggggcagaatgagaaagcctccggcagctctgaagtggaatgtgagaggaatggcaaaaggataacaaggatggatactatttttatgtcctattttggcatgctccatgaaataatcattagaagtaatatattattaaattatcatcacaacttaatgaggcggatactgagatccacatttgagagagaaggaaactcagagaggcaaagcaacttgccctggtagggcctgcaatgtcttagccttaggatttctcagcgtggaagattcttggatcgggggtgaggataagtggtggttaccttactgcagccccaggagcctccaaatggccaacagttcttctcttgggaatggatctgctgcctccttttcttcttcattcttgggaatgcctcttgctttccctgctgtcctccaatccccccgctaccctgatggctgctcaccaagtctgagcagacacgaacctgtattccttgcctttctcccagacagctactgctcagtcacactgtattcatcagttgttgaagtttgaactcgtatggggagaaagcagtgacaattatttggtctctcccattgactagttagaatgacttttgtttctaactgatattttatctgaaccaaagagaagatatgacctatttttttctcttttctttttctttttttcttttttttttttttaaagagatggagacttgctctgttgcctgggctggagcgcagtggtacgatcttggctcactgcaacctccacctcccgggttcaagcaattctccttcctcagcctccagagtagctgagattaaggcacatgccaacacacctggctattttttttttttttttgtagttttagtagagacagggtttcaccgtgttgcccaggctggtctcaaactcctgagctcagtcagttcgccctccttggtctcacaaagtgctaggggatatgacctattttctaaatgcaccttggtagagtctccaaataatctcaatgtgtggcctcagtaggctgactcaggatcacattcctggaacacttacataacaaggcctcttagccaccttgtacttgtggttccatgctaatatgttactgatgaggtcatcaggaggaccagaatgggaaaggggcatgcccaaaaacacacaggacagcaacccgacctaaccctgagttactatgtatccatttccctcaacaaacataattatgctgtgagcaagatgttggccaaggtgctgaaggaatcaacagccaaccctaatagagttttgagtccagcattaaacattaaacaatcgcacaatttgtcattgttcgccactctaattgcacagggagtggggagggactattaacatgtgtaactgggagacttggtctagtctggaggtcagatgaggctatgttgcacaatgatgttgagctctgaaatatgaatagaaatgacattgagctcagaaatatgaatagaaatgacattgagctctgaaatatgaatagaaatgacattgagccctgaaatatgactagaaatgatatcgagccctgaaatattaatagaaattgattaggggaaggcatgaggagaagggattcctgggaatccaggatcggaacagcacatgtggagccccaagaggagaagcagcacatgtatttgaggaactaaagggaagaccatggcttcggtaggaggagtgaaggggaaatggctgggatggttggcagggccagggatgcagccttgaatgacacaggggcttggctgttctgttacagcagtgggaaggagtcagccaagcaggagaatggctgcgcctatttgctcttgagagaacatcaccagctgctgtgtcccaagtccagttccagagcagcgtactgggcccctggtctacatgcactgaaacttatgctgccatcacggacatgtctaaaataaaagagcttttcttttatttgtacttcttttcctgctttgctattgtggattaataaaattacatgcatgaaattactaaatttgttttaaagaagataaagctattcattatagaacttttcatgtttaactattagcttcatagaaactgaaagtagaagcaattctatgaaagatactgaaatatgaaaatattgtccccgtcctcaaaaattatcccgttagatctagatagaaccaggatacctataacaggatcacaaaaagactgataggtgcaatgcacgtttctaagcattgagcagcttgttttcttgaaagatacatttctttaatgaccactcaaaatgtcacctacaggagatgcagggacattagtttgtgacttaaactgaagtctttatatagtgcgttgcttactgggaagcgttgggaaacttgccaccctgagcactgatccttcaggaaaaccattgcctcctacctgaatgcagatggacatacccttcagcccgtggggcctgctgcatcctgaaggctgggacctcagacagtcatgtggttatcaagcctggaatgaacccgccagggtgtggacacagcatcacggaccagtgcaactgcaggatcaggactccagggttcaagcccaattcttttggggaaaatggggctgatcctgcctgcctatgggaagtctgtacggttcaacaagagtttcaaatttttttgttaggggagattttccactggactagaatcttttcagcaaaaataacccatagacagttaaagtgaacacacacacagatactaagcgagagttgtttatgtgagctgcttttatgaggtctctattgagaactacctgaatgttctctttggcagggggctgcccttggggcggagggctggtattccctgcagatgcacccccctgcctcacctgctcccctcttgcctcccagctggtaagatctgtatctgttagagaattgagtccttcccgccagaggtctgctgagtttgccaacacaggcatatcttaaaatgttttattcactttgtctgtgactcagaaggttcatttcatccctgggaaaccacttaccatgaggcagagaccctggcatctgctggcttttctgcagcacaccagcaatactacaggactctgatgggaacttactaaagaaaaaaaaaattacagctcccaagatatttagatcctacagagatggcttgaattcttcttccagaatttagaattgatttcaaaaatcagaaatacaaatctgagtttatgcaatgctcaggtgtgagttaaagaaatacagggaagggctgggtgtggaggctcatgcctgtaatcccagcgctttgggaggccgaggtgtgcagatcacatgaggtcaggagttcgagaccagcctggccaacagggtgaaaccctgcctctactaaaaatacaaaaattagctgagagtggtggcatgtgcctgtaatcccagctacttgggaggctgaggcaggagaatcacttgaaccagggaggcagaggctgcagtgaggcgagattgcagcactgcactccagcctgggcaacagagcaagattccatcaaaaacaacaacaacaacccaaaacaaaacaaaaaaccgggaagaaagaatcaagtactcatttttaagtatttcagtaccagaaatgctggcagtttgcagaggccaccactgtggtttctttcctttagtctttcagggggtcctgtaagcaaaccaggtcctagaacaggaaggaaaagtgctttctggaaaatataattggccacatttgaacaaatggtaacccatttttcctgctctgctgtttcctgcctagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagcgcacccagcttgcctctggaggggatcaccgaaggcccggtatgaccagtgtcctgggaggatggacactaagccctgggcacatctgccaccctgacatcataacacaatagaaatggttttctgtagtgtatttttcatcagttgtttctcaaagtcatcgtacttctgcttctgtttcactgatggtgttcctgctactttaaatgtctacttccaacatccttgaatttgcaagtgaaggacaacaatctctgagagacgtgtggaagaggctgtgaaggtggggtttggggagcttggccgattcgtctatctgaaatgtttgctgtaacagccaccttcctatgttttcatggttgtaaaacataataaaacctcccacgtggaagacttggtgttggccacccagcgcaacaagtcatttggagatgcagcaggtttctcagagacccaaagccagctctgtctgtaggtcattccaggtgctgagcttggaagcaaaggctcagaacctttctgagccatcagcttctcatagcccacgtctctaaaatagatttgaaacttggagtgacagcttgagcatttccagggcttttgaatcattgaatctggaagcaaataaaattaataacttcatgcacagacttccaccaaacacaatgagcatgaagatgcatgagtgcatgtgtgggggatgaggtcacagcagttgcctgagggttcatgggcacaatatccttcccatcttccagtctaagtttatggagccacttctgtagctctgcctcatacagtgaatttttggggcacgggggctttacttggctcttctgcaagaagtgatgtgaccgatctcacagatcagaaaccgcatgcctggggctcatctcaagggagtggctgagtggccattggggataagaagcaacttcaggctgagaatttttcccctttaggatctgagttttgcagagctctgctctaaggattctccaagtggtggtgtgttcctgttcctatctagctggcaatatttcagcatgataggactctggtagaaggtacaagaacagaatcaggaatgtgctgtgtctctcgctcagctctttgcattgttgaatacagccagtcaatatgaacctttttcagtctgagtatagagcacgctgctccttggccagctagttttttcaaggcaaggagcatccccttcatccaattctgattggatgtaccatgtggttgttcagattcctgggcctgggtgctacgaggtgatgcatctttgctatccagagtgtcacttttttttttttttttttgagatggagtctcgctgtgtcgagactgcactggagtgcagtggcgtgatcttggctcactgcaacctttgcctctgggttcaagctattctcgtgcctcagcctcccaagtagctaggactacaggtgcccgccaccacacctggctaatttttgtatttttagtagacacggggtttcaccacgttggccaggctggtctcggactcctagcctcaagtgatctgcccacctcggcctcccaaagtgctgggattataagcgtgagccactgcacctggccaagagtgttgcttttgggcagttagcataacagactgcattttgagagactcaggtggctgcctaaatggtcagcttatcagccctgggctgcgtgtgcaagttagaagcatcagaatatctttgatcagccatttctgttaagctccatgggcttaagcttggagtgcatgtaccactgactatgctccatgagccccagtgcagccctctccagccctggtccttccaaactggctttggcacggtcatgtgattgtcccctggatggagtgggagagggggaggcttgaattgactttcatccaaagtcaagccattgattttttaaaaattatagcagttacattggcaagcaactttgaagatgaatgtgagatattttaagagataaatcatagcaattgaaaagacataattttaaattctgagctaaaattcatttaaaattagaaaattaaacaatactctaatttaactaaaaactctataattttcaaaaataaagcccaaaatagaaatgtaggaaaaagatcctttgctactgttaaaaaaaaaaaccccatcctgatgtggcccacattcttatttgattctagttttatctgagcaagaggaaaggaaaagggttgtacttcagttaataaagacttaaaattctggaccatcaagtgtaaatttaatataaataattttatttaaagataaatggccaggaagtactctgcaaagtaacaacagagtattactaatgctgataattacatggaaaatcctaatactggccatgtaaaagctttgattaaaatataattcaaattacagatgatgtaataacatgaagctggtggtaggatcctcaggagccataatgaacagtgtaagccagttcacaaaaggcaggcatttttacagatccttatgtttcaatttcatgctctattcacgtgaagtaaatataacatcacagtgtaccaattaaatggccataatgagaacgtttattcctcaacccctgatttttttttggatgtggggttcctaattcagtctctttggaaaagcaggttacacacagtgtgaagagtccgagcccaccctgggagctgtgggatgtcggaatttcttcctctttgagtaaacttactcagagtccatgttagagatcggcagccacaagctcagataccttgaggtactaggaagagaatacagtgaatgaggcaagtggggtcattaaggaatagtggagactgtggaagactaaaagcacacaccccagggaagtggtgctggagtgcagtggcgcgatccctgctcactgcaagctcggcctcctgggttcacgccattctcctgcctcagcctcctgagtagctgggactacaggcacccactgccatgcccggctaattttttgtattttttagtagagacagggtttcactgtgttagccaggatggtcttgatctcctgacctcatgatccgcctgcctcggcctcccaaagtgcctggattacaggtgtgagccacagcgcccagcccaaacacatattcccccaagagaagtcaagaatcttcattttatatgagattgtttgattttaccttgggcaactgtttccattgagatacattagaatgcaaccaacaatacaccccagtgaaagaagcttaatcagtaggggtttattaagattaaaaataataagaaattgagaggttggtggtctcaaagcccccaggctttcccatgctcttgctccaccatcttcagtatgccagtgattctccctcatgatcacaaggtggctgcagcatctccaagaatcacatcctcatcccatcatgctcaaacgaagaaagaaaggagcccagtcatgtgacaagataactctacttgtcggtctgtttatcagggaagaaaatgtttcccagcacccctgagaaatatcccctttacttgcattggctagaatgatgttggatggccacccccagaagtcatgggggcttggaagagtgaatatccagcattttcagtctctttgcaggagaaagattctacctgcttgggaaaagggttaaacaatggccattgggttgacaatgaacagcatctgtgacagcaccaaacttgtttaattaaaacacaaaaatggcacatcagtcacataaaaatgtagagcaggctgtttgcagtctcctttagggctcacatgtcttcttagtgggttagaatttgagcagaagagccagctctttagtcaatctatttagccctattgaattgcccttctcctaaagagcttttctagctaaagccatggtccttgttgtctgggcatactccatcttcctgaagcttctggcacgttcccctcagctttaccattttgaagatactgttcttttccttaaactcaccgttttctcacctcccatgacttatcacttaagatatgtcccattctttccggttcagaacaaatgggggtcacattcatagttatctgcttcctcttcacatctggagttgaccccacttgggaaggttcttctttccttagaaaaaatcctcacacacaggactagggttccagaaatgatgactggcaaacttcccttccccctccccactcaaaagggagacccccagcctaggtgagccaatctcatctcactcctaggagctagaacagagctgagccaccttaatggcagcctcttagagaagaaaaacataagcccctacttccagatgccccagagtgccccatttcctgcctgcctgaaatggttgctcagctcttctttcagtactgtgagccacccagagcctgccaatgcaagcattttttcccccaactagagctgctttctgtttcttacaactgaaacatcttctaaagaagagctttaatttcatctgtcccagctctccatatgtggaagagttatttccaagaggtgtgcagagcactgcgttgatgacaccgggcttcaaaattccactcccacctgtcaaaaccgaactttccaaaggttggttcatccaccgtgcaaccccaggtggaaatttcagagaatgcctggcaggtagttaatctaaactggcatgttccccaagtcttcagcatttagtgattccaaactctggcactctggcacacacacgaaacatccagctacagtagcatttcgagggaagcctgacacagtgcttggatctttctgtctgtccccacttcaaaacaaataaaagcaaaacaacaacagtaacaacaacaaagcaaaaccattttcctaagttttaaaaagtaaaatgccaatttcagtgtaaaatttaccatgaattttaaagatgtgtgcttctttggggagtattttttcccttgcacgtgtgtttgtgtttatgcctttagaactttgatgggcatgtcctatctcttctcagcacgtcacgtgcttggggacatgtgtacctgctttggtcaagaagaactgttaatatattagaaaatggctttgatagcccctggctataaccatcccaggccaaaggagttcagtgtcaattaggataaatactttaatgtaatttgcaccattgctgctgtctgggagtagaggaaatgaagaactagaaatctagaagcagtttttgtttgtgtgaaggcagaggaaaagaagagatggcctcacaccagtgtttctcaaagggaatttcacagaactggtccagctttgtgaaaatacaatacaatacagatgtgattaatagattctaaattatcctcttacagatccaaatttaaaatagcatattaaaggctctgaaaagtactgccgtgaagaaacatgcccctttttattctttttttttttttttttttttttgagacagagtctcactctgtcaccaaggctggagtgcagtggtgcgatctcggctcactgcaagctccacctcccgggttcaccccattctcctgcctcaatctcctgagtagctgggactacaggtgcccgccaccacacccgactaatttttttgtatttttggtagagacggggtttcaccgtgttagccaggatgatctcaatctcctgaccttgtgatcctcccaaagtgctaggattacaggcgtgagccactgcacccggtgcccctttttattctttgatgacatcttttcatcccagtgcttgcagtggtgctgccatgactgcttgccagtggattctgtaaatgatcaggaataataatgctctcagtgacagacaatgagagtaacatcttaacacaaaatatgctgtgtgatgggtggcgtctcttcttgctatgtggtgtctcttctttttttgccctggaaagatccccagactgacatagaacacagtcacagatgccctggggacatcatacactgtgatgctaaacacctgctttcatccacatacagagtgctcttcaaggatagcacggaggaaagaaccacttagaatggggccaggcagccctgccaacatctctgccacttaaccttgagcaaactgcttcacactcgtgagcctcagtgtctgcatctgcaaaacaggaataacaccaaccttataggaccttttacaatggtttagtgatttagaatgtattaggttggtgcaaaagtaattgtagttttgccattaaaagtaatgatcaaaacagcaagtacctttgcgacaacataataagatatcagaccatgatagttgtgattattgcagagctcctggggtatctgagacatgaataaagtaagcacctggcactaaaactctcttgtcttagtctgttcaggctgctacaatagactatcatagactggtggcttataaacaacaaaaacttatttcttacatttctggagactgggaagtccaaaaccaaggcacctgctgatttagtgtctggtgagggtgtgcttcagggttcatagacccctgtctttttactgtgtcctcacatggtggcaggggcaagggaactctttggggtccctcatatacgaatactaatcccattaattagagtcctacccttatgacctaatgccctcccaaaggcccccacctcttaataccataacattggaagttgggattttgacatatgaatttgggaggagacataaacactcagtctgtagcatctctgaagagtaaatagcaattctgatacaagcaggagaatttcactggcaacactgttatggtaatcaggtattaaaaccctaattgaattataatccctctaatcgctgctgccaccagtaggtaatgatacaatttatcctcttagggaaccagattccccctataagaaggttgaattaataatacagcaaaattcactatgttgatttttagaaacattaatatgtctgaggggtattcaacctaagtcagatgttgctccaggcaccagctatttgggagaaaaaggcccatctgagccaaagccaggacaagacaagcagctttaggggtgctaaggagtgagaagcctccatacaccagggctcactccttaggaggcctcctgaaagaaggggagcaggagaggggcagggagaacctgcatctatccaaggaagggggtgagctaagctgatggatacttgaattattggagaaaagtgtgaaattagaaaaacccatgaaaagacccagaggcttgtgagcctcttagggattgcagaatgttttcgttcacatggaaaccaattgcacaaaaagtgctcatacctgtattccaggagccagcaaggatagtgtgtatgcaaagagagcttcagtgaaaggggagtttcaggaaatgatggacccagccttccttaaaaagaggagtcagatacctccttgcacgcatgtgcacacatgtgtgtacacacatgcagacacacacacaatagagattgtctaaaggtgggtagtttatatagctctccctggatcatataaactgtgtttcacttggacttgccattgactgaagcagactttgcagaacattccaatcttcagctggttatcctggactcccagtcagccccatatctacaccctggagctctagaaagatcccttcctggcacagtggttcacattgtaatcctagcactttaggaggtggaggcacgaggatcacttgaggccaggagttcaagaccagcctggacaacatagtgaggccccatctctacaacaaatttaaaaaaaaaatagctgagcatggtggtgcacacctgtaatcccagctacctctgaggatcacttgagatcagaagcttgaggctgcagtgagctatgatcatgtcaccacacttgagccctaggcgacagagagggaccctgtctctaaaaacaaatagaaaagaatgatctttgaagtcacactcactgctgataacttgagggtgaacccccaaggcaaagcaggggctgccttttggggttgatctgatgaatatcatcaaaatagagtgattttccaccctcataatggacaagagcaaactcagccatgcttgggatcaaatccagctcagatactttcttgagcaaattacgaacctttcaaagattcagtgtcctcatgtgtaagatgggtttttttgtgaggattaaatgaagaaagcatgtatagaaagtgcttagtacagggcttggtacacggtaagtgctcaataaatgttagctcttgtgattggtcaatgtgagctgtcactgtgttgtgaggcacgggctgttctacatgaatgcatttcccagaagagtcgtgtcttgagcctctctcacatgctgaccattttgtttaaaatatttgatagatgaattctacactccctggccttccttgtccagaggcttcttcctaagaactcagtgccaggattttgagtagcactggatattctgtgcaatgggttcgttcatccaatttccaccactttacagatgaactggggatcagagaaggcaagccacctccccaaggtcacacagcttgtgagagcaagacaacagcatcgaggcctatgtaatagcagagccattgcttctttggctctgcggaagcttgtattgtggtatatctgtggtgtagctttgctgtctcctgtgtcaatgtcaggaggacaggctgagctcctgggaccagaacccctcagattccaggaggagcagagaaagcacagatggcctggagagtcccaggggtgaggccagcaagtactttcttcccccaggtgctcagagcatcctctgagttgccaaacagactcccagaggggtcaactgtgggccctaaaccagacagcagctgggaagcaggctctcaggggaactggggtctcaccagctcaggagcaggccaggactcctcagcacagaagctgggaatcttgagtgtccagatcagcctgaaaatctggacttgggaaaagccatctggctggggccacctgcatgccgctgtgactggggcatcctgctgctctcctctctcacaaggtggtgccatctgccttgtcactgctcctcaggacaagcctgactgctctccctgcacctctggccattgagaatccggctgctccatcgtggtggaaaatcttccatgctcagagggacaccttccgacactggggttctggagagcctggtgccacgagacaaggagccatgtgacaagagggggaggggtaggagtgggagacacaagtgtggtttgggacaaaatagggcctgaggctcacgtgttataaaaccccctttgctctgcctgtctccttgaattgtggccagtttcacatgggaagcaacgtcgagggacagggagactgcaggtgaggcctcagggctctgcattcccatccccaaaagtcaccagcgtgtggccttgtgggtgtcactcccctctgtggagtcaactttgtgcagtgacatgcagaggctggactgctgccacctcatgcccctcctggcatgatggtcgcatgaggctgagtgatttgcaggtctatggggaaacccgcctcagagatgtggaggagaagccaggcagagcgctgttcattccatttctttctttttttaatctaaaggagggaaagagctttattaactcaaacaaagggatgccatacaacttcccaacgatactgtgcagtgatggtattagcttccacctgttcttccattctgggggcagggtgtgaggactggctgctctgggagacgctctgagctgagagagaagaaatagctatgctaatagctgccccttactgagtgctcactctgtgtccggggctacaccgagtgcttgcagcgggttctcaggcgcacttagaacagcactgtgagaaaggcacttttgctgccccttgtgtacagatgaggacaaagagggacagagaggtttagaaccttgacctatatcacacagccagtgagcagacgaccggaatttgaatcctgcaatctctctgcagagcctgcgcatttaataccacacacagttctggcctgcagtgaatttggttgttcttcctgcctggggtggtcagtttccaagcctttccagatggacttctgcagcccaaagctgcgtgctccccgtgcaggcccttgtcagagcagagaaagatggctgaagttgttgtccatctagatttttatcttcaaaacattgctgaaatcaatctctcttctaccgtctccgatttcctttgtccttatgggtggtctacaactttactatcattttagtggatgcaagaggagtggagataaacacgtgttcagcctgctgtgaatctctgcagtggctatgttgtttcttaaacagatgtaatgaggcatctattccctgtgtgccatgtgccccttgagtaggggacatctgttttgtgttgtctgtgtctccagcattagaatggaacctggcacacaatagaggctcaattagtatttgttgaataaatgaacattaagaaacagaaaagagccttgttccttccttgtgtctccttcttcatgttttgtagtctgttggaatctcattactagattattgttccagaaacatgttccaaggacaggcatgtgcaggcagaatggaactgggaacgtaaacgggaagcttgaacctggaaagtcacaagggggatggagatttggggagaagtgggagctgggagagcagcagcccaagctgaagatctaagctgggggtcaggagagccagctgagagctttctaggctgcagctgagcaccctgtctatgggcctcccagcctccaggtcaccaaccttgtggggaggtgggagcaggtgggagcataggtgctgggccctagtggacatcgaggtgcacaggtggccagtgaatgtgggatccatgggggcagagggaagccctaggatgctgcagaagcctgaggccagcccgaggccggctctgggaagagggggaggcagctgccataggtgaaggctcaggagggcactcagagatggagactgaaggccggcttgcttctgcttcctctgcccagaacccctgaatttcaggaaacagagaggatggaaggacttagggactctggatgatgagagtttctgcagtccgggacttgcagcatgcgtttcctctgtgagcctgctgtgcagccagctcccttctccccctgctctgtgctggtgcccacagaggtggcactccctcccaaccccagcacaactgccatctcagcagtcccccaaggaagaggctgagatcctgcctcggggcaccctgaggggtccacttcactctcctgaccaccctgccagcctggactccccaaccccatttccaacctctgcacactcccagcctagagtgggattttctgggagcctgaagtataggctggactgggagggcttggctgcagcctcagctcaggaccaccccctggtggcccccttgggtgggagcccatctcttgatggataggtgagcctgtgtcctcagcagtgacctgagctgctagttgggggaagtgactcagcaaactaggccgctgccaagtggcatcaggatccaaagcatccccacccagtggcttcaggttgttaaattacatttagcctaaagctgcctccatacatattttaagttcagcctaaaagtttctacatgcatagtgaactgtaacctaactgaatgcgtaagcagactatcacctgctcttttgccaatcagagttcagccaatcacaggcagccaactgttcaaaccacgttcaaataaggcaaacaccgagagctgtaactaatcggctgtttctgtaccccacttcccttttctggacgtcactttcgtatttttgtccataagtcttctaccatcacgtggctgcgttagagcgtctgtgcatctgctgtgattcttggggctgcctgattcacaaatcattctttgctcggttaaactctgttaaattgaatttgtctaaggttttttctctatacaaggttaagacataacctgtgtctgacccagggccaactgtgggctgtgtgtggcgggtggcaggggcgtgttattccctttcttccagaggctgtgttctcaaagttgagttctcaggttgctcgcgcacaggtgccatggtgtcctcattcatgggattatcgagacccagataccaccccagagctactgagttagactctggggatcagaactgggactctgtaatgagcactcacccacatggatctcaggctcacctggtgtgggagcttctgccctctgttctgcctgctggacacaatgtagaagagacagttttaccaggctgttcttggggtatgctctatcctggaaagagggatctcgggaaatgatgacatttctttatgtttggttggtatttcacagtgtattgtgcattctgggaccactatcaactcacctgcttaaacctcaaccctagggacctgccttgattggtccttttcttgattctcttcttctaatccatcagcaacccctctggctcctaccttcaaagtggactccacacctaaccacaccccccagctcactgtggccaccgtagtccacccctgttgtcacccctgctcacctgagctgctgggatgtctcccacccatcagtgccacattcacttcccccaaatccattttccactgcagcccaagtgtgtatgtgtgtgttccttttttattaaggcactgttttcagagaacagttttcacttgttttaagtgtacggtgtttgaattgtgatccttgtacataataactatgtaaccaccaagaccgaaggcagttccctcatcctcaaagctgccttttgctcctttgctctccatccctggacccaggcagccctagatctgttttctgctgtctgatttttgccttttctaggatgacatatgcgatggttaatactgagtgccaacttgattggattgaaggatgcaaagtattgatcctgggcgtgtctatgagggtgttgccaaaggagtttaacatttgagtcagttggctgggaaaggcagacccacccttaatctgggtgggcagcatctaatcagctgccagcaaatataaagcaggcagaaaaacatgaaaaggcaagactggcctagcctcccagcctgcatctttctcctgtgctgggtgcctcctgccctcgaacatcagactccaggttcttcagttttgggacttggattggttttccttgcccctcagcttctgtccctctaaagaacgctgactaatacataactgtgtaaccaccaagatagaaggcacttccctcatcctcaaagctgcttttgcttctttgctcttcatccctggccccaggcagccctaggtctgctttctgctgtctgatttttgccttttctaggatgtcatataaatacaatcatacaagatgttgtccttgggtttggatttttttctcatttaagattcatccatccacatcactgtatattttcatctggactctctctcttttgcacatcaaactgttgctaaactgccgggttcaccagcccactgtgcagcaataggccaatactcagacagcagggtttgcggcagagaaagagtttaataattgcaaggccgctgaacaagaaaacgggaggaattcccagcttcaaatctgtttgctgaggagttctgggcaagagtttttaaggggattgtggaggatgaggggctggaaaatacggggtaaatacggggtcatcgattggtccggtaaaggagtgaaattatcaggatgtggaaactgtgtcttccaggagtcagctgcttagtgggcccttcagaggagggggatggatagttttgtcagtttgcagaatctaaaggggaaacgcttagattttatccgtagaacaaagagccttgtgaggagggctaccttattctggggttgtgagcagcgaccggctacaaggaagtgggccaaagggcaagctggcttagtgatttctgctgattgtgttgctagtctagttgaattttttcttttttcctttaatcagttttataaagttttttggggaacggtttcaaaaccagctgagcggtttctgaccatgctgctgtgcctctgcctggatggctctccctcacctagttctttctcctccttcaggcctcagcctcaatgccacctcctgagccctgccgtcactgtgacggctcccccctcccccaacacacacaattagtttttattgtattttcctaagttccttcatgtcacagttatattattcatatattcttatgggtcaaattgtccctgtcccaaaaatttgtatgttgaagtcctaaccttcagtacctcagaatgcgaccttatttggagacaaggcctttacagaggtaatcaagtgaacatgaggtcattagggcaggccctcacccaacatgactggcatcattattcagaagaggaggtttagacacagatctgcacagaagcatggcgatgtgaagacagccatctacaagccaaggagtgagacctgggacagattcattctcctcacagccctcagaaggaaccaaccctgctaacaccttgatcttgaacttccagctccagaatggcaagacagtacttttctgttgtttaagccacctagtttttggcactttgttacggcagccctactgtactaatacatatatatatatttcctttctgccctctctagagtgcaggcttcttgggagcagggatcccctctgtctcattcatagccctgtccccagagggggccttcaatatattaatatttccgcattaatgaatgggtacatcatgttattttgttgttgccattatccctataaggttggcttgccaagtttaggctccttacccaagttgatggctaaaagagagaactcttgatacctggggccgcatcattccaattatgctacagttccctgagggccttcttatgttagataaaatctggaaacaaattctactgtcttttccttcttataggatacagaagacttgttcttctaaaagtgtttcaggaagttcaaagctgtctcatttgggctgtggggagagaagcaaaaacaacaacaacaaatcaaccaaacccagataccttgaatgacatttttccagtaaacaaagcaaaccaacaaaccaaacaaaaaccttctttattttttttaacctaagtattggctatcatactcatttataaagcagacaccccaatccattctcatatgattatttactccaatgtgatttgcaaagatctttcaagaagctgtcagttgcacacttggagctgtaggcccattgattaaaacacacttgcaaactaagagacatttgccagaatggccagaaaaaaagaggccatggcagcttttaaaccaacaccagacaggttctgagagaccaaatgcatgcagaggggtgtttggggatggagggtgggcaacagatagtaaatatattactgctttgagtggccagatacctacctggaagcaggtttgcaatatgatagcccactcaattaatttttttttccccaaggggcctaagtagtatagctattctttaatttgaaatgagttaagtttggggaatgatagcatatttaatgtacagctgggcactggtgcattctaactctggctatgttctcttttgtggttttgccttggtctctatgtccttggggtgtcttttctctgtctctatacatcacagtgtgtttctgacttctctgctcattcttctaccagcacctctctgcctctctgtttgtctgtcactgttgtctctctctgtcgtcctgtcatattatcaggctgcctgtttggctacagtaaaacttcatcagcctcccctacactgagagcagagcttttttgtggaacacaatagcattcagaagagagaaaaatctctttaagtgtgcaaatgctgtctcattatcctgagactggagggaggaacctctcaagctttgtcatttcagtaagaaacaaaaacctttgaaatttttacaattatcttcacactcatatctccttgtcccctacaccagctaaaagatgagtgaatagcgctgagtgctcgttggctggtccatggagggaaggatcatttattgagatattaattcaggttctatctttgctgctgaaagagaatcaaaaagaatgagaagctttgctgtcctgtgctctgggtctctccctcccccaggccctcagctgggcaaggaggcagggagggcctattatacatgcttttatacacacacacacacacacacacacacacacacacacacacacagaaatacataagcttaatctcttcttttggttgaaaaagtatagctgagtgggtgagagtaatagctccagaattatgcaaatcatagctcaaacacaggttcatacccacagatttacatcccagctgtactatgtggctttgggtgagttacctagattctcttaccttcagtttgttcatctgtaacatggtgataatgaggaagttactatgaaaatgaaatgaatcaattcatttaaaatatctagaaaaagtgcttggcccctggcaagtacctgagaagctggctcttattttcactattacttactgactaatcttggagaaggaaattgttagtgattacccaccgtaaagctttgaactggatgacttctgaagttctatacttctctaaacaccatggacacgggtttctcataaggccttatactcttctctacttttgactaacaatgggtaaaagccatgattagaaattggactgaaaatacagtggcttaacactttaaaaagaaagatctagggctcacagaagaccaaccaatgatctgagtcatgtggcaaagagcacgtagggcagggtttgggttaggtataccgtagcattattagcacagttcacaaactcttcttcctttgggacactagtggccccaggagggaatgcaatttacctccgagagagtgactaactggacaaataaacaagagaagaaaaaagtgaagacattgaaacaaaaaaattggcttatctgatttataaaataatctgctagagggtggctgatgtcttcacaaagcctttcacttgcatgaactccgggctgctgttgggaggagcatgttcaagggctccctggctactatatcttttgactctttgggagagagaagaggcaagggcttcaaatcagcctagagtttgagactgagctatttgaaatagtgagaggaaagaacagtagctgtcctgaacatgcagaaagtcttgactgatcagtatctgcagggcagattttcaatccttttaatccctttgagatggattccacaggctctactgggtagtggatccaagatggctgtgtgatcctggacaagcctcatctgtaaaatggcagcaatacctgccctatctaactcatagagtggctgtcagactcagagaagacaacaagtgaatgcttggggacctgaccagttgtaatggcacaagtgggaaaatgcttcccattctcgttctttttctctctcattcacttatgtccccatatctgtagtcaggcatttgtggtataaatagcttggttaggagtagagtgggtagccatgagcagggtgtggaagttaaaatggcacctttgccaattccagccaagcctatggccaacagccaggcctggcctcttccacttgacactggcctgctggtgagactcacaagacctccttgctttgtaaacatcatccaaaattcttccatcagttgacatcaccatctagtggggtcttctctcatgggaacttctgctcagagagcgaattgctatgagtcagtaggaatgactaacagagattccagagagaagacactgccagttcatggcctcttaaagaaatgaatacatcagttaaaaggctcttgtctgctgtctatgactttcagaacaacttctcccagttgtctgacattgagagtaatggaacccttgggagaagtatcaacgtaattaacaaacttagacataatgatccctgatacttttaacaaaacataaaataaccaagaaatgtctaccactttataagttcacattggaaacacacctgatataaataatgagtcagaacagtggtttcactattaaaagtcagcaggtttcattattaaaagtcagccaagaaaacgtgaaaacttacaggctgaaagaataattaaaggcgatcactatagattttaagcattattagttctcaaaacttctgactggctgatgatgaagacaaattcattctaattgtccttgataatttcatgcttttaaaatctcatggcaagaccaacttgggagccatagtcctcaacagtgggcatggtcagaatgatggctggtaagagcagagccctaatccatgacagaatctgttagcctgcatggatacaagtgggatgatgactaatgaagccactatttagcattgtatctaggatttccttgccatctgtaaaccgtgacccctcccttcaggcagttttttaacctgaggtggttacctgtttttgtttgctgtcctacactcctggccccttgatagaattcaactcttctttgataacgattcagtcttcccctgttcaagtgatcaatgtggggctgaccccacctcagcttcagagatgagcatgtgaccctgcctggccaatgagaataccatatctctctgaccatagtgattggttaagggatgaacatgtggcccacagctgaccaatcagagctactgagactcagttctatggtttcaatggaaaccactgaaaaagagaaactctcttttggctagagttgctgtgaggatggaatggggaacctggacagctccagcaatcttactgcagaaggtgcttctgggtggatcccaggcagaggaatcagaggcaaaacatggagggagtgaactcctgaaatcacttgggttctgaatccagccaagcccgaaaccagccctgccctgggcttttcaggtacttgagccaatgcattctcttttcctcttcatcaaggtttgtttagagtttgcatcccacgtgactgaacagaatggacattgctcttagcaagggacagtaaccatgagtccaagtcctgaaacagagatggggtccccttcctcccttctcactggtttccttcctcctgagtggggtctatctgagcctggcatttccttcgtgacagtttcatttgctcctggacggttcccttgctcaccatcagccctcgggccagctctaacactcagtttgtccagataatgttaggaacctgtaaagaggaactctatgttgttcaactttttctctcattagcacactgtttttctgtcccgggtgatgcaggctgaatgcaaagcagcaagatgtgctggtttgaattccgtggccttccttcatcagcctgagtgtttgtgtacacacagctgggctgcaacgtcagtttctgtctgatggctcagagccacaattttaccctgttattgatgcccattatgtcattttagaaaatgtagggatgtggctgtccaacttatctgaatatctgtatataaataaataaatgtacatttaaatccatcctaactttgacgtgatctgagggaaaaatgaggtctttgtgttttcccatagaaataagaagaaagtaggttaataaaccatcagtatcacaagcaataatgcaacacatgaaatatcatttgcaaattatttttgcaattacaatgttggttttccatgaagagttgtagcagctgcctcctctctcaaataacatattcacctgtggacagatggggaattgctaagatcccagcttatgtttgtgaaaagagaagcaccacagtttagtgagcaaggaggttactaagcttggtgtgcactcaaaggccatgtctgcactgtgtgtgatgaagtggaggctttggatacccatcagcaagttttatgttaataaaatattttttcttctatcaaatgctaagaccaaaaagtttgtcatctgaatgtaatcgcgtaattgtcttgactctcagctccattttgtgctcagaagaaagcagttgtgtcacgaaatggaaagatgaggtctaggttcagtagaccagtattggcattctgggaaaaataagaccccaaagataactttttaccatgatttcacagacaaataggacctgagattttctttttatggagcaagaaagcaatgcttatgaggaccagatctgggtctagtactaccaaagagactgcagagacttgtggaggcatgtgatggtgtttctgaacaatgtttttaaattgtatatgttttgtaacaggaagagagagatagggaaagggaggcgggaggaaggaaagaagaaaataagaggaaggaaggaagaatggaggaaaatttctcttaatcagagaaataatgagagcaaaaaagaaaaagaaacccagagagtcagaattctattgcagcatcgttggctagagaaaaggacactcgggatttgacaggtcgttgggagtggctgctgggtttgagcagagtataacacatcaagagctatgatatacgaaactgagtaggcttatttcttgcatggcagaggaaggattagaaccaatgagtaggaaagagactttggttcagttttaagaactttcttaatagagaaatgggcttgccagtgagtagtgagtttcttgtctggagactttccagcagagaccaaacacatatagggtacgttgacaagggaatttaaacattgaggaaaatgttagactaactactgagattctatgtttcacattcgactcttggaaattaagcagtcatcttaatagaatacctggaagaatctgaagccactgggaacaaataacccttagactcatgcagagttcagaggaggaaaaagctatggcagcaagaacaaagcacaaaccaagttaacactttgcagcaatgaggcaattacttccctccaaaaactccacagggaacaatagtaggtagaagttaaatcacaaacacttcccctcattatctaggaaataacttgagctgcccttctaattagcatctgtaagcagccctgtgctgtcagttctggataactctcagaacctagtaagatgattatacaagatgctcaatcccatggtcattgttggccagaacactgccacccacacaatgacatgagtaagaggcactgcagaagccacttaaactcctggacatatgggcataataacatttggagctattgtatagttctgcaattcagtgagcttcagcatattctgagaatgaacaagcttccttcttatggttagagttgctttggcacctaactctccatgtaaagagccttgtgtgcaggggcagagatgattacatttaaaataaaggcttacatttgcattaatcacatttattaggaagctaagcaaaatctaagctactgtttaaaggttctgatggaaaacattttctccttccacctgttcttggggcaatatattctatggacatggtgacggccactttcttcaggttgtcctaggtagctatttataaaatcatagttatagaatgttgggtcactttttaatgtgcttattaaagccaaggaaataatttggcataactccccaggcatactagagaaaaccaaggcatgatccaagtaagagtctcaattttgcatttctctactttcttctgggagcttgtcaatatttgctatttggttttcttacttttttactttgaaatcactataggtgtgggttggggaagtgaggatgagatacactttcaaaaagttcatacgggctggaaaggagatgggcaccttaagtccctgggaggaattcatcaagtattagttattttcatgtgtcatgggtgagaagcttttctcctctcatccaagcaagcccagcctttggtttttccaaggcagagaccgtctactggtctctaaggactttctgtaaacatcttgttaattagctgttaagcacattaagtgagaaataaacatgagtgacttcatatttatagagtttgacaggggtaaaatcaattgctaattgagaagaagaatttgaaaaagagacaaaaatatacctaaggattttggttttgagtctctgtttctatagcctaatttttctcctggttgtatagactatcatttcttgtttcttggcctgtacagtaatttttatctgggtgctgaacactgtaaattttactttgttgagtatttggattttgttgtcatcctttaaagagagttagactttgctctggcagaaagttgttatttgagcatcaaattgtttttgttttgttttgtttttgaggtttgtttttaagctttattagagtggtcctaaagtagtctgtagggctagtacaatggcatggccctcatgaagtctctactaaatgctctgggattttaaccaggtctctctactctggctggttggagctaaactatcttgcatccctgcgtgagctctgggaattgctcagctcacagcttacaggtagcagttctttgaccagttctatggagttttactctgaaaatacacagctcagttttcagtcagagacccatagagacacccatgcagatttctggagctttttctttgtacgtttttttcctctccagtatactacctcacaaagctgcctcagtctctctaaactatgatccctgtcttgtcaattcacaaagactgctgtgttctccttggcatcgctttgggcactgaggtctggaaggtgcctccaggcagaaatctggagtggttgtggggctcaccttgttatttatcttctctcagggactatgttcttaatgctacctgttgtccaatgcctgaaagcagttttatatattctatttagttttctagtaatttatgatgggaaaatatatcagcttccagctactctgtcatggccagaaatggaagttcttcatttcctagtctttgcatacacatgttgcactgtttctgctgccaacaattcatcaaacattacatagttgaatagaaacaggacctggaggttggggttggagaggagattgtaactcagtggcaagacattcatataaataagtccaccatggggaagaataatagagacgtgtagtctgggcatggcctggctttccctgtctaggactctcacaccgataaccctctaagctgggcttaaacacttcttccctttcccattatcaatactgactcatccttgacccagacttacttttgtttatttgttgttttgaagcagtcttttattcttttttattttaaacttttattttaagttcaggctacacgtgcaggtttgttatataggtaaacttgtgtcgtggaggtttgttggacaggttgtttcatcacccaggtattaagcctagtacccattagttatttttcctgaccctctccctcctcctttttttgagggatgacgacagttgctaatcttgatctagtaaatgaatatggactgtgtaatttcctcccaagatcctggatccttagcctagacatgattcaaatgaataatgatatctttatgcagcagggaaggacaataggaatgactggtgttagatgagacttgtcaaattatgccaagcaagcaattgtctatggctagtgaacaccctcaaccctagctccattgcttttcttagctaactccttccccagtcccccattcaggaagatcctacttgacttctccatcagcttttttagccttcaagctcagctccagcctatctcccctctaggcttgttatatcatgtgtgccaggatgcttacttggatgtatggcttcttgccagcatatattttgttcttgaggcttattcttaagtgggtgggccactgaagtgtcattctctctatgtaagctggggcaggaacttgaaaattgtttgatggaggagaataaagggaagtttgctgaaaggattaaaacaagcctgaggaaaagtcatgaagcagtaaaagtaataaatattaattacagtcaaatggaattgtatgatgactattagttgtttgcagtttcagctacaaatgctggattcctttgatctttctgaggaaggtaagtcctggttccatctctaggttgtatttgcaattctcaaggctgattaaagaacgttatagcatcttcacattaagaaagcttgccaaagcttttccctgttcatggggataatgcctgtattttcacaaggtctgatactcagctaatgtggttcaaaaatataactgtcctgagtttgaaaccacagaagaaacagaaaagatcccagaattttgcttaatattttgtattccacccagaaagaaaccttatgaagataacatctgtagcagttaatttgattttagcaattctgactttcagaattttgatttaataagcctcatagggtccacccaaatgctgtatctacatgtttgctcttgactaaagacatcatagagataccaggagaatgtctgaacctgaactcttgaaggaaaactagacgcaggttaactggctatgaaggctctgcgtgattctaatttctgactccagattttccatcctaagaagttggttaaaatgcacatgcacacattcacacacatgtcacacaccaccaccaccaccaacaacaacaacaacaaaattctcaacttttgtagctaaaggaatagtttggtcttgctggactcttctttttccccagaacaatggagacacctgtatgcccctaatccatcatcagccatccacactgcctctgtgaaatacccactttgtttctcagggcccttgtgactgagggttgagatgttgcctttgcacttactctattgctcaaagtatatcctctaacaccatgagttttcagtcactttatttctttgaaagatgttgccctgttctaatatgccctgcaggatgctagctgcttgctggaaggggctggctgaggctgctggggctgtatgctttttcagcatgactcatttgcatctgtcttttctttggcagttatattcttgctctaggctgtcccaatgggaggagaatttattaaatcaactttattgaagtataatttataccaatgaaatgcacagattttaagtatacaatttgatgagtcttgacaaatatatacagctgtctaactgctactccaacatagaacatttttatctcttcagaaagtcacatgcactccttcagagttaatctgtgtcccacagccaaccaatgatccaatttctatcaccatcataagttttgctggttctagaatttcatataaatacaattaaaggcatacattcttttatgtgtgacttcttttgctcaacatgtctactaggatgatcttggttgttgtgtatattatcagttattttattgctattactttttatggttgagtgtattccattgtatgaatatataaacagttctccttcgcctgtttgtggacattgagaagtttctaggttttggctactataaatgaagctactatgaatgtttgtttttaagatttttgttgaagtatgtttttatttctctttgaaaaatagagtagaattgttggtcatagcagaagtatagtgttggccttataaaaaggaaaaaacttccaaacagtttgcaaactgtatcatttcacattcctactagcaacgtatgagaattcaagttgccgcacatccttagcaacactttatcttgacagtctttttaaattttagttctcctagtgggtaggtattggtatatcattgtgttgttaatttgtacttccccgatgaccagttatattgactgtattctcatatgtctactggccattcttctgtgtgtgggtgttttcaatattttaccagtttttagttgtgttgtttcttttcttattattgaattgtaggagttctctatatattttggttacatgtcctatttcataaataggtattgcaaatactctttcccagtctgtcatttgacttttcattttcttaacagtttccttcaaaaaacagacatttttaattttgataaagtgcagcttttcatttttttgtcctttatggttagtgttttttgtgttttgtcaaaaaaaaattgtctttcctaacatactctttattatatgttgtttttccttagaagttttggtttttgcttttgcatttaaatatatggcccattttaagttgctttgtgtatagatatatattatatattgtgtataaacatatatattgtggctttatgacataggagaaatgataaaacaacaatactggaattggggtataagaatacacagttcttaggttatacttgaagtagtgtaatgttgagcatcctgtgatgagttaaagacatatattatacatcttagagcaatcaccttagaaaagggctaaagataataaactaatagaggaggtaaaatgaaatgctaaaaatactcaatccaaaagtgggtagaaaaaaggacaaaaaagaaaaacaagatggtatatttaaacccaaccatgtcaataattacattaaatgtaaatggcctaaatattccaactaaaaggcagagattgtcagagtggatgaaaatataaaactcaactatatgctgcctttaagaaattcactttaaatataaaggcagataggttaataataaggtctgtaaaatatatatgtaaatattaatcatgagaaaaccgaagtggtcatgttaaatagaccaatgatgaaagagttaattcactagaaagacatgccaatcttaaatatatatgcacctaacaacaagtttaaaacacattaagcaaaggcgatagaactgaatggagaaatagagccacaactataactggagattttaacactcctctttaaataatttatagaacaaattgaccgaaaacaaaattaggtatgaatattggataaaggagatttgaataacactgtcaatcaactgactcaattgacatttataaaatactcaacccaacaatagtataatacacatccttttcaagtgcacatgggacatttgccaagatagactatatgctgggccataaaagaaatcttaataagtctaaaataatcaaaatcatggagtatgttctctgaccaaaatataattaacttagagattactaataaaacatatctaaacatttttcaaatatttgcaaatttagaaatacacctctacataacccatgagtcacagaagaaatcataagaaaaatagaaacactttaaaatgaatgaaagtaaaaacacatcatatcaaaatttttagtagaaagctaaagcaatatttagagggaaatttatagttttaaatatttacatttaaaaagaagaaagatataaaatcaattatttgttttcaacttaagatacagaaccaagagccaaaaataagtagaagaaatgtaatgataaggataaaatactaacttattagtaagattttaaataatttttaaaggttcatctatgtctataaggccttgcacatactaggtgccttgtaagtatttttttccagttggaataaagccttctactttctaatatagggttaaaacagtgtggcttagtagaatgaacataagttaaagagtatgggcagtctagagtttaaatatcagctccctcatttaataattgcatgaccttggacaagccatttaatttctctgagctataacaatagctacatttattgagtacttattgatggtatgcaccttatatgtattaactcatttaattcttataacaactccatgaggtaggtacatttaacatcctccttttaaaggaaatagtatctcatatggtttagaagcccctctgagatcacagagctagcagatggtagcattgagattcaaagacaggctcatctgacagtaatcttatgtactattcctgaagatccagaaaacttcagtttcttcatttgtaaaaataaggttattgatgcaagattgactgaaggggaacaacaggaatggagaacaacaatacacagggtctggctgtgtacagggagagagggagtggaatgtcccccaagtgctattcaacagagcagttccaagatgcatttcagcactagggcctgcagggagagaggtcaggaacatattgtattgcccattggtgccatctactttgctgtgtctggcttgccaggcccaagcaggtcatgtaaatgagtacagtggtaggtaaggtgggccgtgacaatgagtgatgaatcttctaaagcgtcagcagccccttgcctcagactccctgaggccacactgaaatgtgcacccagcatcaccagagcttctgagttttcaagagatgccagtaatctggcttttaagtactctcaattcttaggtattgactcttaaactttttaaggaaacactgtaggggctaaataaaatacatttgatggctggctttagctcatgatgggcagtccatagtcttgggtttacacttagtgtgttttaaaggatattccaataaccagaacgaaagtgtttttcttatcttctaagttcttttgagtaataattccaaagtactatatggacatcaataggttgggattaatatttatgttggaatgaaaaaagaaaactgtgtgtgtgtgtatgtgtgtgtgtgtgagagagagagaatttcttaaaagacttcaaagcagaaaactatgtggctaatcttattagtggaaaaaaaaaaagacttagcatctctgggagatactcctttactcctttggttggagtcacccttgtcaggcgagaaaggaaaggtgatagcacagttttcctcttagctacaaggggggaatagagaacttagcagatgaatgatgaccaactgaagaaggctcagggtaacatcacaaatccacaatgcataatgttgctgggaagaatatgtgactaattgccacctgtatttaaagcagtggggagagaggtgtttccctttctttgaaagaaacaccaaagaaggaaggaaagaaagaacagattacatctgtgcttctctaaatttcatgtgcacacagatcccccggggaatctcattaaaatgcagattctgaatcagtagctggagggtagggtagggcctgggaatctgtatttcttacaagttcccaggtgatgctgatgctgctgggtccagggccacattctaaatgacaagaaactagctgttctattaaagtgagtgcaaaagtaattgtgattttcccattgttggaatttgctgtttgatattggaatacattcttaaatcaatgtggttaagttatacatcattttaatgggcatttctctatttttttttgctaatgacttattacttgctgtttattttaaactatggaaatgatgttagacaaaaagcaaattcaagcaattttcttatttgagttcaaaatgggttgtaaagcagcagagacaacttggaacaacaacaatgcatttggctcaggaactgctaatgaacgtacagtgcagtggtggttcaagaagttttgccaaggagacaagagccttgaagatgaggagcacagtagcttgccattggaagttgacaatgaccaattgagagcaatcatcgaagctgatcatccttacaactacacaagaagttgctgaagaagtcaacgttgacccttctatggtcatttggcatttgaaacaaattgcaaagatgaaaaggttccataagtgagtgcctcatgagctgagcaaaaatttaaaaaaaaaaatcattgttttgaagcgtcgtcttctcttattctacacaataacgaaccgtttctcaattgaattgttacgtgtgacaaaaagtggattttaaatgacaactggcaatgaccagctcaacgatcggactgagaaaaagctccaaagcacttcccaaagccaaacttgcacccaaaaaaaaggtcatggtcactatttggtggtctgttgctggtctgatccatacagctttttggatcccagcggaaccattacatctgagaagtatgttcagcaaatccacgagatgcactgaaaactgcaatgcctgcagccagcattggtcaacagaaagggcccagttcttctccaaggcaatgcccgaacacacatagcacaaccaacacttcaaaagttgaacgaattgggctatgaagtttcgcctcatctgccatattcacctgacctctcgccaaccaaatatcacttcttaaagcatctctacaacttttttctagggaaaatgcttcatggtcagcaggatgcacaaaatgctttccaagagtctgtcaaatcccaaagcaagattttttacactacaggaataaacaagcttatttctcattggcaaaaatgtgttgattgtaatggtttctattttgattaataaaaatgtgtttgagcctagttacaatgatttaaaaattcatggtctgaaacagcaattacttttgcaccaacctaataaattctgaactctagtgatagaagaacatttagagatcatcaaggatgtccaaactgaactaaagagttccttccatcctctgctccccttcctcccaggagctccttgtttctgtgatggcgcaaaccccaggcctctctggttgaaacctgggacctgtttaggctcttgcttgtctctcactcccagccctagccccttcacatggcagcccaagtttaaccccttacctcatttgtcagttctacttccatagggtcactctatccacccttatcctcccctgccttccctcgactcctgcctctaacctgggttttgtgtttcctaaatggcctctttgctgcctgtatcctccctatactgtttattctatgcagagcttcccacatgcccttcctgagtgctgctcactgcactctcttgctcaggagtaatcaatgcccaccttctcctctgtctcttctacctctgccttgcacaaacctgcacccatctcctcccaaacccccttgatgaacctactatctttgcccaagctttttttttttcctctagagcacactctaccctctcagctgtcaaaatcacacctcaaggactagctcaatattgatgagaactgagaaatacattttgtacccttttttcgtagttttaagtttctgctgaatatgccttaagcctgtggtgttttcttcatgctgaaccattacctagaaatttctctgtgacctattgttactgccagccccaggagatgggcaggtgcccattttgatagctagaggcatgctgcttagaaaattcatccttccctgggcctctcctttccacttcctccccagagcctgttcgtttgatcacccagcaggaagtgataggtacaccccctttataattatagcctttctccttctatcccctaaaataatagtttcctcatttccatccttgtctgaaacacagagcaacagccctccattcatcttccaaaatagcaatacttgttttgtttttttaaaacttgtcctcccccatgtcttcctcagcctactctttctctctcttctcctcccatctcctcttctaaatacagccaatagactcttcagtttttcttccaaatgtcttcagtccctatttctcagaagaggagccactgtgtccctctggaatgcctccttctaaaggagcttatgtcacttcttatctcccctgtaactagtcattaacctcagtgttcaaccaacttctgatagcagctcctgctaataacctgaacttcattaatacccactatgtgccacgtgctctgcaagcatctctcattttgttttcataacctcacaaaataaatattattactatccccattgtacagaacagaacattgaaaactcacctgtctaaggtgtacaaatagaagatggcagaggtacaattcaaatccaaatccaggttactctgatgtcaaagccagcattcaatgccactccccaaaccatgtcaccagttagcctgcgtatttattttctttggctgccataacaaatttccacaaactgggcaacttaaaataataggaacttattgtctcaaagtcttggaggccagaagtccaaagtcaaagtgtcagtaggactggttctaagggaaaatctgttccatgcccctctcctagcttctggtggctgctggcaatccttggtattccttgccttgtccactcatcactcaaacttctagctctgtcttcacatcatcctctcctctgtttttttttttttctccaattctcttctgtattgagtatggtttccccatactgttctcgtggtggtgaataagtctcacgagatctgatggtttcataagggatttcccctttcacttggctctccttctctcctgcctgccaccatgtaagatgtacctttcagcttctgccatgattctgaggcctccccagccacatggaactgtgagtccattaaacctctttttctttgtaaattacccagtctcaggtatgtgtttatcagcagcatgaaactggactagtatacttgtcattggatttaggactcatcctaatctgagataatcttatctccaaatccttaacttaatcactcttgaaagacccttcccccaaataaggccacagtcattggatccagatagacatgtcctttgaagaaaggagcgtttatctcactacaccatgtaaagaaaaatcagcatgagaaatcaactctgatggagatgtacaaggagattaatgttttcatgcctgttaacacagcatccattctatagcctgtggatcaaggagttatttttattttcaagtcctattatttaagaaagacattttgtaaggctgtagctttcagtggatagtgattattctgttagatccaggcaaagtaaattgaaagcctctggaaatgattcaccattgtaggtgccattaagaagattcatgattcatgcaaggaggtaaaaatatcaacatgaacaggagtttgggaaaagttgattccaacactcatggatgactttgaggggcccaagccttcagtggaggaagtcactgcagatatggtagaaatagcaagagaaccggaattagaagtggggcctgaagatgtgactgaattgttgcaatctcacgagaaaactttaatggggtatggagttgcttcttatggaggagcaaagaacatggtttattgaaatgcagtctactcctagtgaagaggctatggactgttgaaataacaacaaaggatttagagtaatacatctacttagttaataaagcagtggcacggtttgagaggactgactccaatttctaatagaatttctaatactataggtaaaatgctatcaaacagcattgcatctgcagagaaatctttcatgaaaagaggaatcaattgatatagcaaacttcactgttgtattattttaagaaattgacagggccacccaaaccttcagcaaccagaaccctcatcagtcagcagccatcaacattaaggcaagatcatccacctgcaaaaagattatgactcactgaaggctcagatgattgttagcatcttttaacaataaaatatttttaaattaaggcatgcagattgttttcttcagatacaatactattgcacacttaatagactatagtgtaaacgtaactttaatatgcactaggaaaccaaaaaaaatgtgtgactttctttattgcaatatttgctgtattgcagctgtctggaactggatctgcaatcattccaaggtgtatctgtatttttccatgccactgttactgcagctccaatgactaatttccaaatccctgcatggaagtcacagccagagtgtaccctggctgtctgtgctgttgacagaatgctctctgccacatgccatggcagccagaggagggttgtggcccactggggatgttgtaggaaatatatccctccccagctgcgtgctgctgctggattgattcttccagtttaactatagctggagtcagtgccttatagattgctatgaagtcaggccctacagaaacgtctaagttcggtggcagaacagagagggactcagcggcctgggctgcatagtgaagctgttcccttaaaggtgtcatggctgtgttctgtgggaaggaaaattgcaagtggatattgttatagggttatctctagacccttcgtcacctcctgaggagggcagctctactcctgaaggctacaggagtctgagtttgcaggagccaaactgtactcccaagaaggagagaaagatttgggactgacaatccattggtaagaccctaccagggttagaacactgaatactcctgtaccagtgggatgccagtaaacagtccccagaactcaccgcctgcatatcattcagccactagtggctggacctctgacccagtaggggtccttggggaccctgatcatgtgttctggagggcacctgttagactagttggtgctctgtagttgcttcctaaatattttaatatcaccctcgaggaacaagagaaacaggaaccaatgaaacttgaggttccctgggcaggaggcaagaaggagaattaccacggggttccagcatagagctgtggggaggaacaacatgttgatggcggtttctgagcttgcgtgccatttgatacagcttctgttaaacccatcctgcttgaacaagattcttgctgggagctgtgagagggctgagcccttggccaaggcaaagtcaacctgcaggagcaaggagaacagtgtgcatttgtgatagatgtctgtgtgctgaggtgccaggatgtcactgggctcacagccccacagccctgcttgtcctgggaagggatgtgttcctgctggtgagtccaggggtcagtgggtacagccggacacaccagggcagagagtggcaaaatacaacttgtgcttatctcctttgctgtgtggctcatcgggaagagggcaggtgtcgtattagccatgctttcttataaagaggcaaattctctgacggtcgcagggactgaagcagtagctatttggaatgctctctccactgaacagcctaccctttccataaggaggacttcctgtttctgcctgtctctggtttccacagtcaacaatgttttgcccaggattggatttttctttgcttctgctttgagcacaagctcagagactataaaggtgaattagacactgcctgtggctatcccagcctagttgtgggcatcagcaggttcttcagggacaacccctatgtggctgagggcattctgttcctcatgctcagtttctcttccatacgaggggtttatctcatctctgttttgtacctgtctatacactgggctggacttccttccccaactcacagaagagcccctctcccaaatgtgacttagaatgtgttccctgtttagtggtcaagctctccttgaagtgtaataaattctccctttccatcccaagttttctgtctacattagatgttgaacccctcatagttacatttccagagttccttggacctccattttctaatctgtaaaacagaaggaatgaggctagatgaatttcagatattctagacattttatcacattttacactttgttaataagtgctagtccacaaagcacatttatgcaagttttaattaaaagcatcttcctccaagacagagactattccaggaccatggcttggtgagcagagcaatggctagattcagcctctccttacgcttttggccaggtacccttgtgtagtgaataacctgcacaaccatactgtatgagtctgttctcaagctgctaataaagacatacccgagactggatgacttataaaggaaagaggtttaatttattcacagttcagcatgcctggggaggcctcaggaaacttacaatcatggcagaaggggaagcaaatacgtccttcttcacatggtggcagcaaggataagcgcagagcaaagggggatatgccccttataaaaccatcagatctcatgagaactcactcactatcatgagaacagcatgaaagtaaccaccccgatgattaaattacctcccaacgggtccctcccacaacacgtggggattataggaactacaattcaagatgggctttggatggggacacagccaaaccatgtcacatatacatcagccttgttttccaagtatcaggaggatatacaattgctaaaaacaagtagacaatagtcatagtctatattcagaacagtggttctcaagcaggggtgattttggcccctttctccaggggacatttggcaaactctgaagacatttttggttgagaaaatgaagggatggggtggcaggggtgctaatggcacctagtggttagagccgctgctaaacattctgtaatgcacagcacagccccacctaaaaataaataattttccaaccctaaatatcaacagtgccgaggtttaaaaaccctggatgaaagtactagccatgataataattagacattgcacaaacaaaaataaaaacttaagcgggaagtaggaggaaaagtttaaattcggagcaactttaacagatatttctgaataatggttttgaatctgtctctttttatgcctgtttgaactacatgtctgcttactgcagtagctccacctttggcaagaatactgaattctcatttgagaaataaagaaaaagcctgaagcttatagcccctaagggtggttccttcagtactttgttgtacctttccaagcttatagaaaccccttgctaaattgcaggttcgaattacaaagaaaaatttaaattttcatgcagtgaacttaactataaattaatctacaactgagtctacaatttgaatgtttattctacacaaaagtactaggtaaaatgttatttaaaatctttattatgtctttagctttaaacagtgatgcaaaagttattgaccttcagaagatactaaagaggcagtatgtggtattttattattgaaattacatatttacataaacagaaatatatattaaatagaaattccaattgtaaaatggaaagcaggttaactgcacactagttttgctgctgttggtcttaacttgaaagaaaattaagaatcagttttcgtttaggatgtggaaacctacatataacaatgagaaaaaggcagaaaaatctatagcaattgttaagttttcttgagcccatcagagggctgaaatccaggcaatcaaacaaaccaaattcctaagagggacaggctctattaagggctgaggagacataaaaacattcaccttacacagaacatgggagagagaggtggctgccatacagatgtgtaaaaagaaatcagttaaaagatgttaaaactattaaaggctataaaagaaaatacaatttcagggctctctaaatttattatgccaaggggggatgttaagctctggagactgagtcacatagcatgtttgctattcttcttcttagattatggactatttctcttcctcattgttcttgttctgtaaatgactaggagaaaccagaggacagacccctcacctcctaatcatctatctttgttaaagattcactgcctgctttttttgtccttacccaactcagaccagatggggcaaaagactccaggactgttagatctttggtgtggaatgtcaaatataccttttcttaaagaaaaaaatcaccttgactgattagatcataactatgcattaagccttacatagaatgatgttgaaattctgttaagctttcctaaactttgtttatgtaaatgatcccaaacttctacattttggaacactgacttccattctttggaatctctgctttgtagctggctgtccttaaactttgtgcttgtgtaaactctctttaaactagattatgacccttttgattattttaggttgacaaagccacatgtgggctagaatgtcagtttggaataactgggggcccagacacaaaggaagtcagagacacatgctcttctccacatggctccaccagttactgagagaaagatgtagggcaggagcctggagcaagccccccttggtggggtaggtgttggggagctctctgtagttgtagggagaataaacacgatcctctccccaacccttccctcctaggagagaagccttgaactgtcgggggagaggcagcagactgtctttccccaaaggcacaggcaaaagactggtgtgctagggagggtcaaagaaaaatctccaacccccagtgaaagggcaggaagctgtgctgggcccaggatatcttactgccagggaggggcaggaaactctggcccaagtccaagctcagatccaaagcagtgtttggctgccatggggaggagggatgagaatgctgagaaagcctcacccccaggcccaggcacatggtgcctgcctaagactaaggctaaaccaaaagaactgagaaccacctctcttcccttgcccctgtatcccaaaataggcccagcactgaataataggccagagtcatctgccactgggataggggagctaaaagcgtggacagaggattctctgtggcatgtgtaagccaggctggctgtgttggggctcagagaatgataccctaaagtacgattctttggcatgctgagtactttttcattaaagggaattggaaggtcttagaatctgcctcagaaccaaagaccttctaaccttctcctgtttcttccctccaccctgaaaccccaagcacagtaagggacattctctagaagtttcctcatctgaatgagaaaaaattattccaaaagaaatgcaattgtcttaaaactccccccctagaaatctcatcaaatcaccaggaaagatgaactactagagaagagaaaagactaaaagtcatcaccacatccaggcagatttttcatctattcttctgagggcagctctgagatattacctggaagatgttatctgcataataagacaacctttgttcacagggaagtcccacccctcaatttcccaatacgtgttgccaccttccccacagctcagaggaactttgtcccaggccattgtctattctttgcgctcgttggttttccctaaaaataattcactacccctcaaaattgcctacattcccccatcttcctccccctatgaagatgacagtatttaagcttcagccatctggcctgtccttgaatctcatattttgtatggctcccatgcatacttgcatattaatgaatttgtatgccttgtctcctgttaatctgtctattgatagttcatttcaacattcttgacccttcagagagggaggaaaaattctcttcccctctacaacagaaagctgaggggcaagcaggaaacctgggaaagagtctagcaccttggccctcacactaagcacaagataacacgattcccacctctagaggaatttgaagcctgtggtctattgaaggtaacagtggcaacaataaaacccatacccacctcaactactgactagataacctcaaactctgacactaatgctctcacagaacaagatattgggatgatttatagaataaataatatttaccttcatctctgctgtcctatacagtcacaaattatgagatatacaaaaaagcaagggaaaaaattgtaaagagacaaaggcgatcaacagaaacagactcagggatgactcagatgttgagactttgagatagagaccataagaattatgattaataagttaaaagagtaatagaaaaggtagatatcatgcatgaacagatggagaatttcagcagagggatgaaaaatgatagagttaaatggaagtgctagaaaaaaacacatgatatcaaaaatgaagagagtcaataagtttttttaatccatggggacatctgcatatagattctttaagggaattggagcttcactgaaatagtcttatgacataaggataattatatatatattagagtcttagagttcagctgacaacaaataattttgtatctccaaaggatttgagatattaaaagtaattatagttctaaataagccttgtaattagaactaagattctattgtagcaatgggagggaactttcataacctgaatggacactaatgagagtggagatctctgaggcataacactcaggacagtcagaatccgatagaatcacaaatggaattgaattggctccataattttataggaagaaagaaccaacttttaatatatgtgtaaaccaaaaataaaattctaagcccttcaaccaactgatggaccctctccttggcccagggcattctaaagttaacctgaaaagctaattcaggccatgatgagaagtgggggttgaacattcttcattataccttcctccctttggaattcaggcacagttgaccagtattaacattaaaatagagatcttaagactagcaaaacgactttttttgtagcaataagataccaaattccagcctgactctagtatagcattacatcacagatagcaggccctgaaaataaatcaaactattttaccccaaattatattctttgacatattttgaaatggccttgcaaagatgactcttgtgggggaaaatctacattctgtagagaatccccatttctttccaggtcatttccctgatccaagagggaattaactaagactctggcccctttttaggtctgaaaagagctctgaagcctactacctgaaggctccatctatatgataaaaccttagtctctgaaacccctaattttttttttttttttttttttgacaaactctggttctactctccaggctggaatgcagtggcacaatctctgctcactgcaacctccacctcctgggctcaagccatcctccctactcagcctcctaagtagctggaactacaggtgcacaccaccatgcccagctaatttttgaattttttgtaaaggtgggttttgctatgttgtctaggctggtcttgaactactgagctcgagcgatccacctgcttcagccatccaacgtgctgggattacaggcatgagccaccatacctggcccaaaaccccttatcttaacccagacactcctttatattgattataggtctttatataataattctttcaaacaactgccaatcagaaaatctgtgactccacctatgacccggaagcccccacttccagttgttctgcctttctggaacaaaccaatgtacatcttctgggtattgattgatgtcttttgtctccctaaaatatataaaactgagctgtagcttaatcaccttgggcatatgttttcaggatatcctgggactgtgtcacaggccattggtcactcatatttggcttagaataaatatcttaaaatattttacaggctttgactatttttgtcaacatacgcacacccaacttaaaaataagcaattatttctacaaaattgtagaaatattcattcatttttgtgaaaaacaaatgatttcaaatatagacagaggtgatcattgataggtttgggacacctccaacttatacattcaaaaaagaaaaagagagatagaaaagtgtaacctgtggtcccagtcattaagccagttgtccagaaaagggtataaaatttcctttgattttgctttaactttttattaacctataatttacatacatacacataggatatgtatctgtaacctatactttacatacacatatcctaagtgtgcagcttacataactttcaaactgaaaacacttttgcaacaagttccaaaatcaaggaatataacaccagcttctttgaattctccctcatattcccttgaagtctctatcttcttccaaagctagccattatccctatattaattagcatagattacttttgccgttttgctcatatgaaaatggaatcatacattggtactattttctgtctggctttttttcctcagcatgtttgtggggttcattcatattgctgtgtgtggttatagtttatttgtgctcattattggtatagtactgtattttcttgttgacaggcatttgggttgtttccagcttagggttatcatgaataaactatgaatagccttttaccaggcattgtgtaggcaaatttttttttccccttagattaatacctatgggttgaattgctgagtcataaggtatatggatgctgccaaagtgtttataaaagtggtcataacaatttacatcccactagcagtgtgtgagagtttgctgctccactagggatatgaaattttaagcagcagcaaaaaccacaagcaaatgtaaaattcgtattgttgcacacagactgtgagaaccataactgttcagaaagaataagaattggtgagagcaggagtgtgggagaagttcttcctggacagaggatgggatggatgggctgaggggcacctgtgagacaccctttggttcaaggccaggttccataactgaccagctgcatgaccttgggaaagttactggatcaatccgagcctccgttttatcatccgcaaaaaggggaaaataagaaacctgctcttaggctgaaatgacaattgtgcatggaggacactgagtatagtggctaacacatagaaacttgctattttattactattataaataacaaagtggacaagaattgggctttgcaggatggctgggactggctcagtggatgggcagaagagctctttggaaaggggagaacaggaaagaacgaagcagaggattagcttggtatcttcacaagcttaacagaggcaggccaaacacacagggacaatcccttctcctgcctgtttgtgtttgtgtttagcacagggtggcttactcctggaagcctctgtgaagtctcccacctcccagcatccattcataggggactcatttgagttagcacccagagggtacttctctggttgtacttaactatcttaactgaaactgctggcttattggcctctctttgtccaggaaagggttgacctccatgaggacaaggcttggtgactcactgaaaaccatgggcctccgtccctggaagaggaatattgtttcattccaacaaaggattattaaaacacttaccatatgccagtcattatgctaagtgacctacagtgtcgatgaggagacctgttgcagtgtttagaggtcagcaagaagaaattcagtgtttgtatccaataactgaccgagcacaggaacttgtttctcccatgaagtcatgaaaacttgcattaaaagaacataaagaactgaaccaaatcaagaagaaaagtttcaatgacatgagtgatgaatgataacaaagcgcaatttatacctttttgcagccatgatccaggttaaagtccacccaaaataataatttctaagtaaaaattaaggtaataagcatgggtcagattagatactctggctttgtaatacaatttatacttctgttgtatgttcttctttagccaccttagggtagaacaaatggaatcatctccccacccacagtattcatttgactccacttttcattcctggactgtacttcggaacagttgcactgcctgagggtgaggaggaaggtgtgatttgaagggaaggaatggatttagaaatgatgcactcccacacatttgaaaataaaatattcggtaacatcacaaaacacctgatatttaactttcccagggaacaccctcaaggaatccagaaaactcctgtagatctttaggtcaccttgggaatcaggacatttttcttagaagcttaaaacaaccttggaatagtcagaaagcaccaaagaatttcaaagaaggaggagaaaaggggttattgaagtcagagaaggaggcgagactagtacaggcagaaatgagcaactgcaggacagggccggaggccagccagatgccagcaactcagaggcacctgccttggcctgcatttcttaggaggccaacctggaggaagatgtctttgttgtgtaaaaagtagccttttctctgccaggcacggtggctcacgcctgtaatcccagcactctgggaggccgaggcgggcggatcacctgaggtcaggagttcaagaccagcctgatcaacatggtgaaaccctgtctctactaaaaatacaaaaaattagccagacgtggtggcgtgcgcctgtaatcccagctactctggaggctgaggcaggagaattgcttgaacccgggagacaaaggttgcagtgagccaagatcacaccattgcactccagcctgggagacagaggagtttttttgaaactccgtcacacacacgtacacacgaaaatataaaaagtagccttttcttttactaaagaactgacctcttgatttataaagcatgacaccaaaatattccttagaattgaatgtcttcccacagaatattttgccaggtattctagttggtaattatgacggccttgacagtgctcctctcagatccccaatttctaggagcatagctggtgccggtctcagctgaggcccatccctccattagcatcacgctccacacgctgctcactgccaatgactgggcttggtaggaattctaaggaaagttcattcgggagaaacaagaatcctccgaaaacagacttgggctcgagggcgccccctgggctttgccaatgtcttagaaggactctgccctctaaggctctccccagcctgcctcggtccttccctgcatcctccactcaaaccagacctgcatctgatccctcagctctgctagactcctccggcttcccgcctccgcctcccatttcccccgcaataaatctcttccacatccatcctatgttgatacctgctcctcggaggacctgaattaacacaacaatgaactttctgaaagtatctttgtttgcatttgattgtgcatgaggttctttatgagggaggctggtgatgtgagatggaaaaagcttcattaggagctggggcttggctctggctcctcccagctacgtggtcttgacatttagccttgctccctagttagacctcagcttctttatcagaaaaatggggataataaattacctgcatcataaagttattgtggagattaagaagatagtgaattcaagatctcagtgcacataacaatagctgctatttactgagtgctttccatgtgcttttgatataactcacttaatcctagcaatttccatatgagatatgtacttcactcgcaagaaaaccaaggcatagagtggctaagaggtagagctagaatttgaacccttcagagcccagagcttcagagctcaggctctttaactaccaccctatgattttccccaaatagcacatgctcgggaaatgactgttgggattccatcaataaatccaatatgtttttttccactttctacccctgtgactgtggcaagggtcttcaactgaagacaatcttgtcattttgtgaaggtgaagtgaggaaagggatgtaaaacagctgtggttggtgcttagtagctgttcacctgaatttcagctaggattaaaattacaattattattagctttgaaatgctgattcctctttctttgtatacttaatgggtacagtaaaggagcaatgggttgtttgttcccagctttcagatgtgatgtctaaatgagaattgaaataaaccatgaaggaactgagttgcaaacacttctctgatgactacagcaggtgaataatcagctctgatatttgatcacaccctttacaagcctgaacccctttgtaggtcctttgccatatcctctacttgtttctctgtagctcaacctactgcctgcccagggccatcaataataaatgtccacagacagctgaaggacattaaagacagatggtgatggatcagagcactcatcagccactgggtgtagactgtataaaaagctgagcccagaggccaccatgatcaacctgcaacctggcaagaaatggactcaactccacagacagcagttgtcagggagcccaggtgagtgcacggctgcttcatctttatgtacttgttatagcacaaatgagtctatttccttccttcctgaaatagcaaggagaaaataggaaatgcatggtgcatagtttcttttttttttctcttctctccgtctgtgtcatactttattaacaaggtcaaaccaaaatcatacagatgttctgggacatctcaggtgaaactgttaacaggctaactttgttcttgccattgtcatcctccactccccttgtcatttcctgccccccaatccatacctgtcaataccctctttctgaagaatgtgtctcaattcttacttccctgctttgcttacatcaatagtcacctgggttttatgactcaccctttcagggttccatttgattaatacttaatatgttaatcttactcatacaatttcattgtgcaaacatatgaacacctgtagtgctagacatattgaaggacacaaagaaataaaatgtggtccttgccttgcagagactaatgctgcagaccagtgattctcactaagtgtacatctgaattacctggaggatttgttcaaacacaaactcttggactccacagtttttgattcaattgacagggagtcaggtctgatcatttgcatttctaacaactccccaggtgatgctgatgctgctgatctaggaaccagattttgagaacactgagctagcctgagacacacatgtccataggtattgagataattggtacaatagtggttgtgttgctatgttggtggaggccagtttcttaatgggtcatcccagagaagatggaatcattgattgctcacaggtaacttctaggcatgcaacaatggagagaagtggttttcatgaggcacatcgaggcactgtggcaaatcaaggaagaggggtctggggatgggtagcaactttggcatccctgagaaccacttgttgactgaccccatgaccttagctggtacttgccctgactcagggcaagagagggatgtttacaccagaaaatgcttggtctcctcatgttagggaataattcattttgtttcttttttaagtgaatgtttcaaagacatttgtgccatttgacagatctttcaataaataatgacaacaccaaggtgaagacactcatgttcacacaaccaacacataacaagtcattgtccagaggaggtgtgaagaacaaggggaagagatggtccttgcactctggagctctcatcagcctcattgaggggcctctaaggagccctaggatccacgacacaaggaagcagctgagccatgcctcatttattcatttgtttcttcatttcctctataaacaagcattgtattattattttaggaacattattgagcccctgacagaggaattgggaataaaaatgaatgagactcattcctcttatactgtaattcagattaagcttctgggtaaatttggtgagtttttaacatgcatctatgactattccctcttgaaacaacactaaaatgacagaaaagggatattttgaaaatataaaccctcaaggacagggaggatgagagagatgaaaatagcaataacaatttggaagctgggaagcagacagacaagggtaaaaacactaatctggatcctaaacctgcaatggaaaggctgaagccaacttgctttccagaataccctaaaggacctggaattactgcaatggtatatctgtaagtggacgttaagggaaggaactaaaataagaacgaggaaaaagtggcatcagaagtgattggttcccaggtttctcctctcccttctggaagactagttttccctccctctggagaggataaaacaggatttcacgaatggtttggcacaggagtgccatacccaaaatagaaaaaataagcactgaatgctgaatgccaagcgtccagccctcttccccaagttgacctcacaatgctggtgattaggaacctgcctccccgcaatcctcacaacaaagcagaaaatgaggagagacctaaatatccgttcatcagacattctacaaataaaagatcccaccagttcacagctttgaagtctgcaatcaaccagctccacacacatgctcagaggctccagtcccccacttttaaatataaacagacaactagggatggccaggcagctgaggaaatcctctaacatggaagatggaattacaaacaaaacaaactttgaagaaacaagctacgaagggaaaaggaaatttcagaaaatctgtactaggtatcctcagagatacaaaagaagacattgtaacagtgaaataagaacaagatgtcattagaaggaatattctgtcaacaataacagtgcaacaacaaaaccattagatatttaaaacgtaagaaaaataaaatgtactataacacgtggaagatgaaaacctcagaaagtagagtgtaaaaagacaaacaaaaataaggaagaagggataagaccccaaggaccaacctagaggtgcaacatctcaataacaggtctaggaagagaaaaggaagaaaacaggaggcaaccatctttttatgaaattattcaagaaaatgtagcagaacctgaaggggcccactgagtgctcagcaccatggatgaaaatagacactcactactgtacataatggtaaacatttcagaaaagtaggaacaaaaagatcttacaacttccagagagtaaaggccgttcatatgtgaagggtcaggaaccagaagggctctagcctctctaaagcatcactcaaagttagaaagtaatggaaggacctttaacaatcccatagggaaatggtctccctaatagatgctgtcagtgtccacttgtattcccaatactccctgaatctgtgcacgatgacttgatggcttccaggacaagcatctataactctgggctgaggactttcttgggacactctgaaggaaagtgaatgccccaggagcaggagtagccacagtcttcaactgaggatgggctctcttgcccttcaggtgaggcatctctgaggtgtgctctatgcagtctcccagagttccccagcaagactgaggcccagttgcccacaatggtaacctgttccttcctgtccctgtctcaattcctcattctcctcttgatgctcccaggatcacctcccaaatacaataattaccctaacttccttgtcttgggatctgttcctgaggaaacccaaattaaaacacctgctgaactatcaagtgtcaggttagaacaaagacatatccaaacatgcaaagtttcgaagtttacattccagacaccctttctgggaaaatatcagagaatgtgctatacaaaaatggggccataaatcatggctataggaagaagtatccactgcaggacagaggtgaggggattcatgaaaatgatggtaaaaggagacgccagggcgacagctgggtactgggtgcacagggccactggtccagcctggagcacagctgaaggttctgggaaagagcttcctcaggaagatgaacttgaaagagtaccaaatgcatctaaactttttgtgaggatattcagacaattgtttatgagtttgatcttagattactaataagaacatagtgtactatgcaaatttttaaaaagcaactccagggaataaacaacttagttatgttacgatgtcataatattgtaaacgctgaatattgatccaattaaaataacaatatggctctactgggagaatgggaagtagaaggacgcacatgggcagggactaaagtcctatcttccctagtgtaaaatcaattaaaaatgccttaaactggttgggcacggtggctcatgcctgtaatcccagcactttgggaggctgaggtagggcagatcacctgaggtcgggagtttgagaccagcctgaccaacatggagaaaccccgtctctacaaaaaatacaaaattagttggatgtggtggctcatgcctgtaatcccagctactcgggaggctgaggcaggagaatcgcttgaacccgggaggcggacgttgcggtgagccgagatcgcaccattgcactccagcctgggcaacaagagcaaaactccatctcaaaaattccttaaactgaaaaaaaagaggttaattcaaatctgctatataaagacatgaagatgaaaatgaaaacactgagcagaagggggtcaacgtggcttgcccagatgaacaagaaatagtagaaaaacagggatgaaaggctttctacaacaaatcttgaacagtttggctctttacactgtgcgtttgcctccatgcaaacaacccaaacctacaatacaatacagaagagaacctcagctgaagaaccagctttcaggaagctctgcttccagagtctgacttacatgctattttcttgtgcctgccccgtgtgagggacattgaaagtgtaaagctcatcttgggttttctggttggtttctccagttagattctaagctccttgaactcagggacccagggacttggccaatgcagctccatgtgccgagtgcccacagtcccagggcctggcacacaaggggtgctgcactgatgttcattgaatgcagtaaaggaaagaagggaagatgtccaactagagagccgcacaggcagcggtgatgcagggagcaagggctcagatcaacctgagggcagtctggtggttttgcaggaggactgggtgaactggtaaggtggggaggggcacacccaggcaggtagagtagctgtgtaagtgtgaaaaggcgctgtgtgcaagcgtgtgtatgtgtgtgtgtgtgagcacatgcgtatgcttagagagtggagtagtctgaaatgagactgtgcttgtgagctgaggtcaacagagactctttggccactccgtgggtcttagaggccagttggcctcttcacgcctaaagggattccttaagctgattcctcatcagaatcaccaggggagcctttttaacatagtctcgagcctcagtctgagagatcatgagccgtaggtctgtgactggatccaggaaactgtatttgtcagaagactccccagacctgcgcagacgagccagcctttgggacaggcttggaaagaggggaaggtgatgagggagggagtgcgcaagggccaaatctgggctttcgagtccagagtcacattggactgttcctgaaatccaaagtgaatgcattttaacctatttgaataagaacagaataaataatgcctttgtgttgatttgaaaacaaatactgcaaaagagttactctgtgagccttttattgccaaatccatggacttattgctgaaatgaagtgcattaaatatgaaaagttaagatcgatttccagatggcctactttcattactagaatttaataggttctctaattttctttcttctgtttattagtaacagtgaagtaagtcctaaggtgagctaatgtatttcacacctaatatgtgacattggtaccattcaaaatatacaattttaatgagggagaatgctttaaaaatactccaaggaaatgccattccctaatatgcatagtgtgattcctgtcatgatgttcatttatttcagtcttatcttacttcagaatcaaccgatatccactgagttcttcctgtctgcaaggcctgggttggggaacaggaagctgaactgctgtagggaatataagaaaacatgagccatgagccctgttcaaaagaaatttaccagctggctgaggagataagactaaaacacatgaaaaaattaataaggacttcaggctatgatcaagtgagaggtataagcaacacaagctataggaattcagatggggggcagggagagctatgggctcaactggtcagggaaagcttcatggagaaggtgtgatctgggctgggcttgaaggctgggtgagattttactagacagagttgagaagagacactcctggggcagggggtaggagagaacctaagtcctgatgggggaggatgtaagccacattcaagaagaaggctagatagaggtaaagtccttatctttgaattattcaaggtgaaactgtataaaatgattagggggtgaacttgggagaccctggatgccaagattaagaccagtaggcagtagggagtggttgatgatttttgatttggttagagaagaggcagatgaacatagaattttgggaatgctaatttggagaagtgttcaatgaattagaaaagcaatgagaccagttatgaggctgatgtaacaggtaagtccaagggaatgagattctgaattagaccatgggattggcattggttttttgtttctttttttaaaggaaggtagccggaaacgttgcaatgaacaactaagcaggctctatagcaagctatggttggcagaaggaagaggttttgcatgggagccattggaggagtgatggtgttgctggtaaaaataggaaggtctggtggggatgctggtctaaagagaaagaagacttctgttgtgagcatgttggtgtaagcaggcagcagaggaaaatgaaaacaggcaactggagatggaattttattttggagaagatttgcaactagttatccccatggagacaagctgaagttgaagagtgaagaagattcattcatttattcattcacatattatttagcaaatatctattgtgcgccagccacttccaaaagtgctggggatcctgcaaagcagatgaatctcttgtggagcttgtattttgctgtgggaagctgaccataggcaattttacaaaggttttgctacgattcaagtatctgtcccctccaaaactcatgtggatgtttaatcctcaatgtgacagtattgagagatggggcctttaagaggtgattgggtcatgaagattttgccctcatgaatggattagtccatttgtggattcatgcatggatcaatgggttaatggattaatgtgttattatggaaaagggactgttggttttataagaaaaggaagagagatcagagctagcaggctcagccccttcattctgtgatgccctgcaccaattcaggactctacaggcagaccccactagcaagaagcttctcgcctcgtgcagccccttgaccttggacttctcagcctccataacagtatgaaataagttctttttctttataaattgcccagtttgaggcattctgtttttaagcagcagaaaatggactaagaggactggaggaagaaaactgcaagagtgagtgagcaagcaaaggagcttctttctttagggtgtgggaaaagaaagcagaagcatgatgcaagccagaatgattctgaactttaaaacagagaagaggaatcaagagcaatctaaactgttgcctgcccgggacctctctggggccctgcctggttgtccaatgtacttttaggcacagaccatgtagtttcagaggcagctgccagcccacttattttgaggcagttccaaccttagattgtgaattaaccaaggaatctgcatgacagctctccatgcacgcctcctcaaaggagctggaaaataaaatcactgaagggcaagcagtcgatgttaccctcgtgcatttaagggaaccagttggaaaaataaatcagttagtggtgttctcacattaattccccatggggtccagtgatttctttagaatgcctgtggatgcttcacgatgagagccaagctcatgttcccattagctaaatgaggcctctcattacatagttcctgttggagggggaatgagtgatgttgatgtgactgatacatatgcattggctgatcaataataatggcagtgagctgaggtccttgtatgaattttgcatgaactcataacaatgtgaggaatcagtgatggattgcaactctccccttagttggccaacccttaccaagctcattgggcacactgtgtagcagaagagaagggattcttgggggcttccagagtttccctctctgcagcctgtgtgtcagttcttccccctacatctctcatatggtacgtggcccacagtaatacaatgattactttcctggcttccctcctggtattggagttcttgaggacagagactgtttttatcaaactctatgtcctcagtacttagtacagtacatagcacagagcacaggtgttcaccgaatgtctgtggcatgtggagctcatctggatgtccctcatgaaggggaggggtgtggagcagctataggtactgttaagtggtcaaacccaccaaaggaatcctggagaataaagaaccagttcttctttttaaattcaagaattacattccagcccacctggaggaataggtgaaagagaatgtgcacacatgtctaggaaaatctcaaatgctctgcagacctgagataactcagcctgcaaagtcctgtctggaaaggagtagaaagaccagtgagtgaataggttcagccatgcatggaataggttcagcctgctgggcatagcaggaccaagcaccacatacaatgcagtgacaccagggatggtgcaggagactgcaggatcctctaactgccctcttgtttgatactctaactcccttccctaacacaaaaatagccttgcatgaactgtgtgcttcccccaccctcaacaggctcctgagttgcaggagattaatgaggatggtgagaagtaaaaacaatggagaccttgtggatagaaggcagcagctcattcttggcaccagctagagaaaagcaagaggacagtaggggagagccctggggactgggggaaggcccgcctagggagtgatagcaggactgcttaggttaccaaggagatttcacaggttgaggtatagaatcatgttttttattttctgtattttgtgttgctttaacatcttggggccttgcagacctgaggagggactgcccctcccagggttagctaattcctagagataacaaatgacttacctgtgagcacatctttgttatgaaaatcaaccaatctagagctcaaacccccaaccagctcctttatctaactcacacacaaagctgatattcccatggccctaaatcaccctagagcctggtactggataactagagaccacccctatatccctgagcctgccaacattattcaaattggacaaacctgagttgtttaccccaccttggttttccacggaaaccacaataaaagccatgcttataccattttgttccttctgcctccagacacaccctggtgcctccctacatggcctgtatggtacgggatgcccctgtttctagggatccgtgagaataaaaacttttttcacaattgtcatttccatgtctgcatatcttactatacctgattaaggatttgtacattttaaagcatgtggcaaaacacaaagtttcctgttagggatttagcagaaaagaaaaagaatcacatgctctttctcccaaagtatcttccactttgtgtcttgggctcagtaaagatgcaggccaatttactgtgccttctgtattcactttgaggcaccccagattttctcattaagtaatatattgacatattcagagtattgtatgtaacgaagccgatatgtggatgctaaaggttttagaaattatttttaatggttgatagttaaaaacgaaacaatggattcctgtgtaacgatatgatgcatagtttggattatttgcttctaagttaaaaaaaaaattaaataatatgaaagaaggaatgggttaggagcttctatacttctatacactggaaggagggcattgaaggacagtggaacaaacagccttcagagggacaaagggcatagctcaagggtctgggagtaggaatccaggggtggtcttttgagggtctgttcatcagaatgactcagccccaactgctgtcctccttgtggggttttgccccaaagtcaggacagagctggtggcttggcttaggttggatgtccctctctttgcccatggaagaggccattgtggttgacagttccctgggcccatgtcaggaagccgtcctcccaatggagagcccggaggaagtgtgagggtgtgtgttgcaaggcgggggagctatggtcctattgccctgggtgcaaaacctagatctgcactgggtggctatgggtatgtggtttttgtcttcctgtgagatgaaaatgctagccatcccacagggtaacaataggatatatagtttgtaatctttgcttatatgtaagagaaaccaatttaaataaattaacatgaaagaagaaatgggctaggagttcctagcccatggccaccctgagggttagtgtgaaaattacgtgaagaccatgcatgtaaaatgcctgctctagttcctggcataaaacagacattcgaaaatgaaagcttttaatcataagataaaaatcatccactgagtttggcctcaattaggccgaactcctcattccatatgatttctggccaatcaggaatttttacttttctagcttgttttaatttttagagtttaattgtagcttccaagcacactcagggccacaaataaagcattttaagattcttctaagtcaaaatgtttaaggtaataaaaaggcaaattgtactctcctagtcagagcttggtctgtttttctggccactctcctgagccctaaccctcagggtggctcttgccactctcctgctggtgacttcaggcacatcactcccttccctgggtttcagtttctttgtctgtaaagtgaggggtgttaactgtatagctccaaataatgaccaacatctttacgctattttgagattgcaaagttctttgatatctattatgatatttatttaattcttcaagtgtaatgttcagtcgctgtgtaaacgtgatagacatctttgcaacccaccattgatcagtggaaacagctgcgcagctgcagtcttgctgttctgatagtccatatggattagtgctgttcttctccatagatctgcagatacaacagcctcatctcaatctcttagaagagtagctgaggcaaaaagaagccaagcatgaagtcctagagaatggatctgaactaattagctttccacgcatgccttcatcaggaaacaaggcacagttgtaatatcttaggagcaagcctcttccctctgcccccataaaaagtaatattaatggattcattcacagtaggatctggttcattctctggggtggagggcatgtagcacctcacttcttgttctccaccaaagttagactgacctagtagctttgtatgttcctaaattggcttaattgtactggtggtgaatggtagtgtgaacttgcccttggagaccatcaatatcggattcgcacagctcatagaatgccatagtggacaaatatttcctcctttgtgatccctggtgtctgagtgcttcattcagttcttcatattaattgattttggttttacctatcattattgtttgaagacatttctcattctcctacttaatttggtgtgttttgttgggggctgggggctgcaagtgattttagagataatccactgttttattgacacaagttagttgaatcccagagaggttaaatgaatgactgaaggttgcagggctctgaattcagatttctgacactcatccagagccctttacacttcaccagtctgcccagaagaaagactgcaggaacattcttttattacctcaggtgtcattattgtgaacaaatagtgacaaagagccagagatgcaagagtggaacagtggtgggagggagtgggaaggagggtaacattacaaaactagatgcaggttataaatgatagtagggaagtcgacagtactctacatgaaggcttactttgtaaaactgagttccctaaacagcagcacgggataaaaagaacttcagcctcaggtttcttaaatttcatcaatgcctttctatctgcttctggatcccaacaagacatttttaggcacatatgccgtttaaaactagctagcaagacactaggctgagtttgtgtgagctgctttcctgacatcctcatagagatgtatttctctcctgagctagcatgcgggtttatcacacagcatgcaggaaagctccagcagtctctgtgctagtccttcaaaaaaaagagacagacaaagaagagatggggctggaatgtctttctctacgcaggcctgtctgagtgctctagctcagtggggacatgctttggggaggaaggcaaaggaagaaaacgagaacaagtcctcagccgggcatggcagctcacgcctgtaatcccagcactttgggaggctgaggcaggagcatgacttgaggtcagcagttcgagaccagcctgaccaacatggtgaaaccccgtctctactaaaaatgcaaaaattagccgggcgtgttggcaggcgcctgtaatcccaactactcaggaggctgaggcaggagaatggcttgaacccaggaggcggaggttgcagtaagccaagattgcaccattgcacttcagcctgggtgacagagcgagactccatctcaaaaaaaaaaaaaaaaaaaaaaagaacaagtcctccgttttgtgcccaagaatagcagggtgttgcacatgggaaaggtcctgaatggggctctgataccttcactatgagagaaatctcgccacccaggcaaggtctcattcccattccttcctgaatctgctaaagcccctggggagtttagtgatcctgggcacctgaaatcaatcttggcaccactatttatgatgcattgttttacagtgactacctgtattttactcgacttctattttgttatacagcatagaaaattaacctgatgtgaaacttcaaagattttgtgtctctgaagaacatgccactgacaaccagaccatatgtggtacagatagtgacacagatagtgccccaaacgttggtcccaaactcaaaacaaaagaaacctccttcacctcccctatgccccagaaaaagcgcttctgggctgctctccctgagcccacccaaggcagagagatggtttaagatgggttccagagcaagcttttgccagaggatttgggcctgtccacctgcctgcagctaatggtttactgttcttctcaatgactgcccataaaaacagatgtgattatggtgaagaaatgcctggtgatgaggtgagaagctgcacacccttcagttgactgtggtccctcggatctctaaactggccacagaaggttggagggaggaagaggaagggaggtgagccagccccttggaaggtgggattccctaggcagtaaaggagcaggaaatctgaggcgctcccattaccctctgctggcttaggggcagcatgactttctctctggggcaggtgctggaagtcctcctttaagagctgtggtgtgaccacatctggtcaccccaatgtggcttctttctgtggggctttttttccttttaggaaatgcagaggaacccaggcttaaaaaagaaataaattacttttacttttcacaaagtataaccttctacaaccaacacaaatgcttaaagactgaaatcatcaagaagcgctgaaaatgaaactctttacacttgaatactagattcctgcctggacaccatttgaaacctccctttaaataaagccatttgtttagggtgatccagcctgctgatagggaggcaggcaagatttaggagaggccactcctacccagcaaggccctttccattattggccgtttttcattattattatattccattaatggaaataatattccattatttccaatattcctttctagccatggacatcctctacccagaggtgtctacacagggggcacaattgacatcaggataccttttcttcttcccaccctctcaaccacagccagtgcaatgtggtccactccaggtggcagtgtggcctgctagagggatcatcagatttggagttccatattctctactcactgcctgtggaacctcaggcaagtcaccagctctccttgaacctcagtttcttcctctacaaagtaggagcaacatatgtgccttgcagtgttgtgaaaattaaatgtgggccgggtgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaagaaaattaaatgtgatcatggatatatggatattaaggcaggcacaaagtccctgctcaatgattggtaattccaattgtaattgaaagatcagggactggtaagctttttctgaaaaaggccggatagtaaacgttttagactttgcagattataccacctttgtcatgaccactcaactctcccttgtagagaaggcagccacagacaatatgcaaacaggtgggtgtggctgtgttccacttaaacattattcacaaaaagaggcagccagaggatttggctcccataggccacccctgacctggaagacgagagtctaggaagggagaagactaggaagggaatgtcggattatcagtggcatgttctttagagacacaaaaccttcgaagtttcacatcaggttaattttctatgctgtataacaaaatagaagtcaagtaaaatagagttagtcattgtaaaagaatgcatagtaaatagtggtgccaagattgatttctggtgcccagctagtcctcagccccgtgcaggaggccaccccaggtcatcctccaggcaataccacatgacacaggtcatccctatcatacctgctcaagttcctcacccacagaatcatgagtaacggtatgagtgtttggggcattacttgtgtgtttgtttaaccatgcaatagataactgactccatttattgattgaaaaaatttacctaaaaatccaaatttccagcttctgttgaaaattcagatgctttggccaaatgaaccactatttccacagggctacaatttcctggacccaagtatcactggtcatctgtagatgaggtctacagtctccaggtggtctagccccaccctgtggtctccttggtgtcacgtgttgcctgtcctcacacttacagagctgttctcctttctcttggcctgcctcattcatttatgcaaactgattggttcttaaaggcatttgagtgtgctacccctagcttagatggatggctttttgggggccatgggtccccttgatctttttgattgccacctgatctgctcctgcatgcctggccttgggctaagcactgtggcaaagacaactagctgtcgtcaaaaatgtacactcctctctccatcctgggaggcagctgacctggaatgcatttcccagcctttcttacatgcaggtgtgctcatgagctcagtctcgtcaatacaatgagctgggtcttatgtgccacttccaggaccagggttttaagtgagtgttcctggcccactatttctttctccttacaaggtttaagtaccgactccctagctcctaaggaatggcaggatcatagctcagaaagagactgggaacttcattgtcacctggagcaatgccgcctactgaccacacactcccacatcggggtgatgtgtgagccataaactttcgctctttggacagtaacatgttggagtttgtttgttacggcacctcatgttaacacttcatgcatgctatcacacttagtcttcacaataagcctttttctaggaaggtgtttcctccccattttacagataagatgacgaagtgggaaagcaacttgcctgagtccctagtgagaggcagagaggcagaagcagggtttgaatgtaggcaaaagtgaattcaccatgaaactagtgaagcttcagcttcagggtcccttgcttatactacttccaaaactctggaccatgttaatgtggtcatacatttttgtaaaatttgcacaagtaaagtatcttgtctgcaatcagttaagattactgtctctttccactccaggttcccctccatctgcttcactctttcttactggtttgactttgcagtggctgttggtatgtctggggtctaactaaggggatgatgaattgggtagcatttggtttagttagtggaagatttgttcatggtttgcaaccacttctgtatcaggttattgtttgttctcgagatgtaagcatgacttccaggaacattcctaccactaactgtgccaactcacctcaaatcaggacaggttatatctggtattttacaccaggaataaagaagagaagaaatgaagctttacctgtatgaagctatgaggtcgatctgtggagaattcttccaaaagttacatctcaaatacaaaaagaatatgatggacttttcccaaatttaacaacaatcctaaaacttgtatggcattaccgatgacaagttgtgaacacaaatgtttctaagttatcaacaaatataaaacaaatattggtcaatcatgttagaggaaaggctcaattagcttcctattttacttcatccaaaaatgttaaaaaggaaatcagagagtaagtaaacaaaaaaattatagaaaaaatatagaaaccagacagtgattaataaaattatcgtattattttatggagatcttgactgcaatatttgtcaaatttataaaatttgaaatttactgtagctcctttttgcattctaaataagctttatagtcacattttttgttctttttttcttgaaggaatctcaaagattatatgagcttttgaccccatgaaacttgtactgcttgtaatctaggaactctgaatataaagtacatattgttgatagcagggctgtgccacaccagagctgatcacagttgtggagactgcccctggaaaaaacacacttgctaacactcacctgcaattctccatttgatttcatatttacagacaagcctctgtctctgaggctaattcaaacactgctggctgagttgactgcacactctgttcctacgtttccaaatagtgcattacaagattattaattttttaacacaactttgtttactatctccagaatttatgaggtgctcgctagaagaaatttgctcttcatgaaggggattgccttgcactgtctggaatttgtgcaatctcagggctgttcaggcagactcaccagcagcaaggaggcctctgggaacttcctactttctgcatttcctatgcctcgagcctacctggaacccccaggttctgctgtcgctggtcatctcaattgcaaaggagggtgcggcagaggaggtgttaggcatgtgggcccaagctagctttcccatcgtttatattttttcttttcaaatttatgattactgaagtattttttgtgtgtttggtcataattttgtcatctttcattctagctttcggggttatttttcgatggggagagattctgtttggttttacttccttgctatgaccttggttttctcatttccagcatgaatatcatggtggtttgtttgccttcattttctagggcaaatgaaagttataaacctgattttaggtatttttaaagaatattgaaactacaatttctgtaattatcaaagtcaagagtgaaatcgtgccttctgacttaatctaatataaaagaaaaattaaagatgcattttctcactccatttaggttttgggaatatagcgtagagattaaaactcctgttttgaaggatatttgtattcaaacttctcacattcattctttgagaaaagttgttttcataattacttgagccacttgtctgagttttccagagttcatcatctttgcttctatctaagggcctgagataaagcacttttaaaatctaggtttctagaaatctctttctcagctccaagaactcggtggcatcataatcaggattgtcattttctgtattcatcctgtagctgtatgttcgtggtctcccccagggaaatgggtattgtcctgctttttaaaggactctttaaaaagtatagtcacaataaatgtggcacttaaagttttgggatccaacttacgtgagtatttagagtagtcaaattcatagagacataaagtagaatgggggtgccagaagctgggggagaagagaaggggagttgtttaatgggtgcaatttagcaagatgcaaagagttatgtgcatggatagtggtgatgatagcacaataatgtgaatatacttaataccactgaactgtatactcagaaatggttaaaatggtacattatatgttatgtctattttactacaattaaaattattttaaaatctttataggatcaaatatctagagataatacttattgaatttgtgttagatttttttttttacctcatttttcccccccaccaagtctattggtgacttttatcagagttggatccagtaggtctagagcggagtctgggcatctgtggatttttaaaagtgatttgggtaattctgactctcttcattgatatctctgttctattatccgattgcaaatggtacctttcactgactttgtctcttacccaatggtcaactctttgagaacagataaatattctgctcacccctgccctccctacagcatctagcaaagctcttgtaaacagaagatgttcaataaatagctgtttattgagatgagaggaaaacctaaagtataaatattccatgcacggtggtgttacccattgacttatcaaaggctaccatcctctctaagctctagaaagggttacctgcttctgatttcctgtaagacactagggaactgtgctctgtgaccagacttccttggactctcagcatgagttctaattgacccaatcatcagatgctcttcttaagtgtgcaaactaacatgaaagaatagtttttgttctataaaagtttagaaaaggtaaaagaaaagaagagtcttctcctcttatcaggttcttcagtaccttggttctctctagtctaaacaagaaaggtaagtgccatatgatgaaggtgtcagataagcacaactcctactgaggtgtcctatgctgtgtgagacaaccaagggccctggatgcctggggacaatgatgaaaccagcagcataaagccagatttatggacaagtaaattgtttatatcaggatttcccctgttcgttgtagagaagatattttccaaaaataaaccaggacttatcagttcaaaaaatgctcctttattagtctgtattcccaatttttctgtgataaacatgttatacttagaaacagaaataatcattatttacaaatcaggatccctgatttcaaacctataagacatttgttatgagttggaaggttgcccatcttttaatgcccaactgcgaataaccaacaggattctttaaaaattattagggccattgactttgatttgaccatataagaagtaataaagatcaaaaccttacctgactagggactagttcatctattaattcattcagctaataattattgcatgcctactgtgtgccagacactagatgagatgctgcacatctttcagtgaacaagattaccccaatccctaaagaccttatgtttctgagagagagagacgctaaataatttttaataaacagcctcattgagacataactgacatataataagttgcacatatttaaggtgctcattgtgatgaaatttgacaggaagatacacttgtgacaccatcaccacaattaagatagtgaacatatccatcacctccaaaggcttcctcttgtccgtttgtaatcttttccacccacttgtctccacttccccattctcaggtaaccactgatccacttttggtcactatagactagtttgcatttttaaggattttctgtaaatagaatcagagaatatgccctcctgttgtctggcttcttttactcagcatagttattttgagcttcaccactgttgttgaatatatcaaaaattcattccttttaattgctgagtagtatttcattgtatgggtatactacagatttttgttccttcaccttgatggacatgtagattgtctttagtttttggctattttaattaaagcttccatgaatattcatgtgcaaatctttatataaatatattcttccatttttcttgggtaaatgcctaggagtagaatggctggattacattatatatgtatgtttaactttttaagaaattgtttttcaaggtgctttttactgttttgcacccccaaaagcagtggatgagtgttccagtttttccacatccttgtcactaattggtatggtcagtctatttaattttagccattctaatagcatgtcatggtatttcattatgatttaatttgcattctagtggctgataaacatgactaatattacaaatattatgagtttgtgtaagtgggaagcaaaatctcaactacgtgagtgccttttctcgagaatactgattattatacaattcccaaagcctaatacatatctttccagtggatctagtttttgtgtgaatctgacagtcacttgagtaataatctgatatttggctactctctgcctcttctgtaggctaataatctctgtttggatatggatatgcctgaatatttccctgaactgggccattttcagctcagtgaatttatgggtgtttaataaatgcctaatctttcccagccccaatcctacccctcacattccacttgtgccaacctttcccaaggaatgagttcctctacaagtgaaatgttcagagcctttttctttagcttgcacaaagataaaggtgaaatcttgcttttgtgtcatttgctgtgtggttacataacaagatcgctggccccaagacagagctgaagggagtgaggaatagaatacttgagtcctaagtcagggaaaaagaaaacggatgcagatatggctcatcctgccagaagcctccaggcccacactgctgtcttgcaaagtggctcagcaactccgtggtgtagggccttggctgcttatgagagggagcagggtgggatgactttgctttttgagtctgaaacaaggaaccagattgcttggcaccctgggtgttcctttgctccaatatgagtttctacaactaagaaagagaaaaaacaaaatatagcagaaagcacactctttagtttactggttttatgtttctacttaatcttcatagttgattattccttggtcaaaatgaaaattccttttctcatttcctcaaatatttaaaataatgccttagttgtggccaaacagattaaaagaaaaataaacattaagtgaatgtcccttggtgatatttgcaggaaaagtgaagacattgaatattgccaagagccattcccagctacctcatgaagctaagcaaaggttctcagcaatcagggaaattaaaacacttctctgcagaattatcagccctcaccttttctttgtaccaggcagtttagtcttgacaatcccttgcgttgtaccttctctgctccccctagccctatattgtcttatctcttgtaccacctgaatgtcaatgacaacactgattttattggctttctatatttaggaccctttatcactgatttaatgttgcaatctctttgtcatccctaagaatattctactgcaagtacttgttaaagttagaagtctaaattaattttatttggaacttactgatacgtgttgtgagatggcttgagacaatatcgcatccagtcatgagacaaatttttcctaaaaagaggatcaggttggcctagtgtgggcttggggtctgtcactagtctcattgagtagccaggaggagcagggaggtgtggcacaaatatgaccacagggaccacctttgcatgtcctcgaagaaaggggaagagcacatagtggacactccaaacctgtctgctatgtggagaaaaagagcaatggatcctagctccactttccaaataagactagctcacctactgacttgcattcaacactattctgtgacagcagtgtgtaccactggcatcatcctggttaccataaatgtttattgagtgacaggcctggtgctaagtatctatgagcattatttttttcaattctcatgcaaccctaagagacagatgctatcattatccaaatatcatggatgaggttaagttacttgcccaacatgatacaactggttagaggcagaacaattctatccaagtccatcttgctccaaagcacagtcttgaagcatcatgccagggtacctctcatagttttctgatgattcctttatagatctgttacatcctaataagccaaatgtctctctccagctggctatgataatcattcacggcaaatttattacacgtggcttcaactggcttctctagttcttgcttctctgccctaagcactgattttctaaggaccgtaattctcctagaaagattttgcaaatcacatgatagtcttttcccaaggttcaaagaagtaaacaaaaagaaaagaaatacccaaagctgctttctaagactctgacaataatctgcaggagatgtaaattctaagtgactaccatcttcagcaatttctagcacagtctctgggtgtttagccaattcaaaatattatagtgtcctcactatgttataattttttcaaaataatatcaaatgccaaagctttcctttccatcttgatttgtgttgtaaatagctctatttaattgtttgccattatctttactgatatcgcttttaaaattttagtatcattttagggacacagcttggtattggctataacacaatatgttctctctctgaagagagaccacaattatttgagatgtgttcaggcgtctcccctcattttacattatgaggaatattcatgagtatgctatcaatattcaaacaggacacattaaattttgctcctggggaaaagctgtgtaacggtcaaacataaaattaagatcttgcctgctctttagaagaatgatgtttatctcccccctgcaagaaagactccagatggtaaccaagatttgcaaaagatgaaactgctccccaattcatttcttccaggctgatgttcagctctcattaagtcctaaaatgttaaaaaagatgcttgttttgattccttaaagacttatgatactactggctgatgtccaccttcccctcccccaaatctgagagaagtaagtgaatattttctctgctgaagcatttagaatgggtaattgctttcatgccagacatttttgtgaaatcaaatagtaaacagggttttaaattctgtttccctcaagttgcatgagcttaaaaaaatttctgtggagaattttatttcttgtgctgcaactttaataactccattaaggctcctgctttctttctgatccccagctgtgtatatttgggtgtggaatgtaattttctctggctacagctagaaggaagcttcttaaaatgttcaatttcttctaaaatgtgaaacacaatcaagtttctcctgggaaaataatgagcatttattgactaattcaagagtctgcagactttttctgtaaagggccagatagtaaatattttaggttttacagattatatggtctctgttgtaagtctcttctctacctgtgtagtgtgaaagcaggtatataatactaactgaggatggctgtgttccaaaaaatactttacttatggacgttgacatttgaatttcaaataacttgtacatgtcattagtattattttgcttttttttaatcaaccatacgaaaatatagcaaccatgttttgctcaggaatgacacaaaaaacagacagcaagtcagatttggcccatgggtccatttgctgactcatgtactaattcattaggccaattttttttttgaacatctactatgtacagtgagaaaaacagacataatacttgcccttacattgcttatggaagagaaaactatttggaaatattgaaaacaaggacattttcaagtttgggagaaaggacagcttgcatttacttaatcatgtcccaggcaatgcctccaaaaatcttgaccataggcagttctgtacagttatgtctgagtatcgctaaaagctgaggaatatttgtctcgagttggcttatagccccatgtggcaggaacagaagccatttctcagtctgtgaaatgcagggacttaatttccctcaataaattcacactaaagatggtaagctccttgagagtagaacattgtacttgatctgtatctctgctgtgagcacaggtcagcccagtggaaaaaggttatgtgtaaaagcactcagagttccttagaactgcactgtctaatatggtagccacttcttgtggtgtctatttaaatttagatttaaattaaatgtaattgcgtttaaaatttattttctttttgcattagccacattcaagtacgcaataactgcatgcattggacagtgcagatgcatgtttccactatcatagattgttcccttgggcagagatgctttagaacatagggatacttttcttccctctgctgttgcacccaagcaaattcattgtgaaactatgagttctgtaatctcatcctcccttggcaaatggtgaagaggtattttggagtacaagaatgaaggtggttgtactatcggatggcagcagcattgtgtgatagtcattgaacctccctgaattcccacataaaaagagataaaagtaactcaacaataattgagaaactcatagtcaatatttacaaaaacattaaatgattaggtatccctcacaaaatccaagatacaaataggtggggacaaacctccaacagccagggaacctctatgtggaaagaagtggagggaagtaatggggcattagaagccatgaatgaggaacccaaatacccagaagatattcacagcaaaacaatcttactaatttttgaacaatgaataaaactgggagtaagtgaatggaagaattccttagcgagttctgaaaggggatgaggcagtccacataaatttgaatttgaaactaactggccagggctcctttctgggacagaaattcataccaaggacaaatatctcagaatggaatcattctcagctaaagtaaggtaggaaacaacaccagaaaaaatttagagagtgagctatcatatttttgcacacttgaaaacaacaacaagaacagcatcaacaaaagcccagaagaggaaactctgaggagctagaaaagttattctgaacattgcctccttcaggataaaataaactcatataaaaataagcagcaaatctaattccaggtcagagttataataagaaaaaaatgagaataaagagatgaataatatccataagacagtgaaagcatgctgaaaaaccaagcccagaaaactaacctactttcaaaatgaacaaaaagacatttgaaaaatgatacctaacatgaagaaacaatataaattaaaatcacaaaaactcagagtggatacaccaaactccataaagaattagaagtaaaattttaaaatatactttaaaaatgaagactaaactttttaacccatcgatggctagtgttcctgttggaacgctaagtttgtagtagttatttatatcctactgctcaaggtcatcgccaagttctgatttttcacacaaaaaatttgcaacctccagcataaatgggttaaggaatacaaaactgagtggtttttaaaaccaaaaagaaacaaagaaagaaatcaagagaattcaagtgaaggtcgcagatattgaagatgggcaaagaatatccaatatgcagacaacaggctgcttagaaaagaaagcaagagagcaaaacaaatagcaaacaaaatttggaaatcatttactgaattaaatatctaaagctacatagttttgtaaaaccccacctatgtgataatatcaacacagaatgatcagtgtcaaagtatacaataatgaaatgactagacttttaagaaaaaaataaaactttgggcatctagacaaaatgaataagtgatttagagagaaaaatgaataagtaatttagagaaagaaaatgaagtgattatcatacttttgacagcaatgctttatgtcagaagaaaatggacaatatgctcaaagaaaatgtgagccaggtgttatatccagcaaaactgacttcaaagtatgaaacgtgcaatgtattatcaacaagaaagaattcagtttatgtgattcttcctgaaaaatataaagtagaatgtgaacttcagaccaacatattggtatctgcatattggatattctttgcccatcttcaatatttgttaccttcatttgaattcccttgatttccctccttgtctgtttttggtttttaaaatcactcagttttgtatttcttaataattttagtcttcattttaaaaatagatttttaaattttacttccaatcatttaccgaagactggtggtgagcagtaagtatatagtagtttgtggaactataaaactacataaagttaaaaaagagagagtatagtgtgcatagctatctgtatctgtacatatataaagtgtttgtgtgtatatatatatatatatatatatatgctatggcaatgtagatatgatacaactattttttaaagggagagaataaagagagcatatgtaggaaattctttaataattttaataaacatattacagttgtaatatttgtattatcattgttattctgaagctattaggcaatatattgtaaaatgaagcaaataagtcatcccttggttttgagaatttcatcaggattctcaagggtggaaaagaagagatacagatgtgatatacaaaaggaccctatagccctgcatttaaattaaaaatatcttattaactcatgagatttgtattaataaaacttaaatacatacatataagcaggaacatagaaatatacgcatacatatatcccagctctttgcacttaaaagcctagaaacaatgtcctatctgctgatagttttaaaataccattttctatcaaaagaaatcatggctgatcccaggtctggggtagaaaaagggcaatgtcctggaacttattgacacagcagatggcaagaaagttatcgaagaccactagcatcatatcaaaagtcaacttgactgggttcccacttgctagagatagtacagttattactccaatgaggataataattgcaatggattaaaactcattaaatatttgagttcataagtttataataatagttttaaaaaaactaattggttcacttcacagattttcattatcttgcaaattgaaaaataaagggaaagaatggtgcttttttttttttctgtaagaaccatactactgggtaaccaaatagtaggtgagggaaagcatctctgtataaaaacactccaattaaaagaaaaaaaaagatgaaattagaaaaacaccatttaaaaatccccactcaacagatctaggcattatgaattaatagccactaacatcacaaaaagagacaactagatattgtttgcctcccaatgacagaacacaacatacctttagtcttatcaatgggatcaaacttgagtctgatcaagcctttggatcccgctgcagtttgactgaaatatttaggaaagagggacatatggcactgcacaacgagtattcagtcaacaagatttaggctgctggaaactataggttacgtggcctgtgtttttcaacacataaatgtaaggaaaagaaagggatgggggtaatcctggatattaaaagacatttaaatgacaaataattttttaaatgggaagatgaaactagtgtctagggatacacactggggtgaaaaatctaaaaagaaacccaaggaagtgactactataaaagtcagaatggagggaggtataattgggaaggggctcaaggaggagctctgggatagctgaccaagtttgatttcttgacttggcggttacaggatactcaccatagaaaaatgcattgattctagacccagcaatcccattactgggtatatgcccaaaggattataaatcattctactgtaaagacacatgcacacctatgtttaccgcagcactgtttacaatagcaaagacttggaaccaacccaaatgcccattaatgatagactggataaagaaaatgtggcacatacccaccatggaatactatgcagccataacaaagaatgagtccatgtcctttgcagggacatggatgaagctggaagccgtcattctcagcaaactgtcacaggaacagaaaaccaaataccgcatgttctcactcaaaagtaggagttgttaaacaatgagaacacatggatacatggaggggaacgtcacacaccagggcctgtcaggaagtgggaggcaaggggaaggagagcattaggacaaatacctaatgcatgcacggtctaaaatctagctgatggattgataggtgcagcaaaccaccgtggcacatgtatacctgttacatggcacatgtatatctgtgtaacaaatctgcacattctgcacatgtatctcagagcttaagtaaaattttaaaaagaaaagatcataaggaagaaaaaagaaaaactcattgaattgcatatttgttttatgtatttttctgtatctgttttgatttttttaaggtgttgacagaatttagttcagagaggctggtttagctgatgtcaggacagggtacactgtcttatttagtcccagttaaaacagacactaggggaggcgctcaggtttactatgtcttaaaagatcccccaaagattctaatgcacagtccttgttaagaagcactagccacatggtagttcttgaagcattggaccagcagcttcaaaatcagctgggacgactgtaaaaaaatgtattttccttacctgagaacttgctagaaatgtaaattctcacactccactttgtctactgaatcagaaactctggggcccaaccatttgtatttcagcaaaccctcccagtgatgctgaggcaagctctagtttgaaaccctctgcactaccccaaacagagccactttctccagtttgtcaaaggctcaaacccgtgtgcggatgaaaagagcaaaggctctagaaagtgctaggagtggccataattttagactgaattcatctatacagagagggcccctcatcttctttccctggacagtaactaccagaggaaatgcaaattcatgtttggactatttttcaaattttgacagtctgataggtcctctcagctctggtaatgcaatatacggagatcacgattattactttagagcaggcatatcttcaactgtaagctggttccattgtcaaaccttaacaaatcttgatggtaacactgctgaactctctgtgtaaatttaatatgcagaaattatccttttagagccactcaacaatagcagcaacaagaaagaaaaaaaaaaaccatgaatctgtgtgtgtttatttgagttcttagagcacagccatctctcggcctgtcaggaggtaagcacagtggaaatacattccccacaagcttagggactcatccaagaaagccatttctttcttatttgtaaattctggggcaggttttctgcaaccttcatctgagcaatatgttaaaagtctaaaaattgctgttctcaaagtaccttttggaagacatacatggctctaaaactgggaaacttcattctatatgattatttgcaaagggagatattttagaagtgatgtcaggggaaaagtagaattattcctcctggatggccttggctctcggtagtggttcactagtgacgattagacatgctctgttgaccgtgcaccaggcgggcacaggtttatgctgtttctccaggacagagagagatttacattcatccatcaggaggcaagaactcttctgagttgcagctctctttccctagctgtagcctgagtcagagcacacccaggctgcaggttccaaagctccatttggtgccagtgacttcttaacagcacctaaaggccctgggtgcccattccagaaaggatcataaacaaaatctgggagaaaagtgactttcttcagaaacacccacacttttgttttttgatccctgatacagggacacaatggcctggagtgctaagattccactagcatctgtgaatataaagatagacagagacggtttgtggccacaggtatcttgcagtctagggaatagacagacagatggtgaacaaggacagtacagagtgatgagtagtcagtggtgacgcatgccttagctcagaaagaatgtaggagaaggatcctttctctgaggaaccagagcaggcttcacagagaaattagactttgagttgaagtgtgaagaatgagggatttttttggagggggaggggaacaggcagacagctagtgggaagttgctccaaacagaagggtcaggcttggcaaaggtttggagacgtggagccgcatataacccgctggctgtgtattctccattgtcactgtaaggtggagaccagtaaagacaatggctgagcaggtctggagctgagtcggagttaaggtttaatccagcttgcgaggagagagcctttgaaaaattctgatcgagagaagagcgtagaattaatagttatctcagcgttattattactatttacatctagtgtgtgctaaacactgtactcagggattccgttgaatcttaaaataactatgaaataaacattggtctcttcattctacacatgaggaaataatttcagaaaagggaagcagctggcctaggatcacacagtaggaagtagccagctcctgactgagactgaggtgggtctgactcctggaggctgagctcagaaactctttggaagtttggattatagatggagggggagaggctgcaggaactgctccagagggggatatggtagaactgaagatgcctgaatatagcatttttcaataaaaagtacatgtgtctgtgttcctattttgtttgagttttggtctttaattgcctctttaggatcaaaacaattctgtagatgaaatctacccatgattacattggatatttgctatagcaatgttccagcaaccctggaacaaactcaaaatttagattcatattcatttcaaactctgccaatttggaattttctttctttctgcctagacgctgatgagcggcatctaaacttctccatagccaactccgataccagagccttgaaaatatggatcaatcttcattctaggctttataaggtggccccttataaataaatttaacccagagagagctacttgctgccaaaattataatttagtagtgaaaaggggattcaaaaggcctggggcttttgcagtcctgtatctgcaagcaaatttgaaactctttgagcttgtttttttttttttttttaccttcaaaatggagatgagggcccttgtgaaggtcaggtaaagtcacattcatggacatatttcttggtcttctacagctgtgccaggtcacctaattcttatacattatcagtgccttgctttgtccacttccacagagaagggaagattcccagatggcctgccctcatttatccatggagtgagtagcccatagcctacatcacagatgtgaatttatagcctctgcaaagacaatggaaactggcaaccaaatgcctaattgaaaaaaacaagacaaaaacccaaacaatagcccatgaagtaaaagaacagggtaaacagcagtcaggaaggaaaaaggaatgaatttgaggttattagactggctgtttttcccagatcacagaaaacaattatgccatgttaaactatgcagaaattacatctatactgctcatttattcattcatttattcatctaaccatctaatctaccatatgccaggcactgtgctagtgctggagactcagtatgaagaataatctaatggaggattcaattgttgatccagtaattacacaaataaggtttatataagtaaccatgaattgtactgtcatgtcaagtttttctgagctttaagtgcatgtgaggaaagtgggaggaattcaatctagaccaggaggactgagaaagatctaaagagtgggaagtagctgaaaggtggcttggtcaggtggagagagaaggatgttccttgcaggtggaaccatgtgtgccagtgccctgtgatgagagggctaacagtaattgagaaacgtaaagaaagcttgaatgcaaggacagagatagggaagactgggatgggagaggagtctggaaggcaggtgggggttattctatgagggtcttgtaaccatgtaagaatctgggtctttggattaaagcattattctcaacctaggtgcacattggtgtcacctcgcaagctttaaaaatcctgagtcctgggccctgcccccagagattctgattttaattggtgtgggagctgcctgggtatcaggattttaaaagatgctcaggtgattccaatgtaaagatggatggataaatgaatgagtgaatgaatcagtgaatgagtagcatggatgtaatttctgcatagtttaacatggcataatatttttgaaaaatgctgtttgtgaatcttcagttctaattcagttctgccataccctctatgaggcagtacctgcagttctctagcctctcccgctccatctataacccaaactgccaaagggtttatgagctcagcctctgggagtcagacccacctgggtctcagtcaggaattggctactccctagctgtgtgatcaatggcttgagagccactggattaaaacgttttacatgcatatatatcaactgatttccactttgaaagatcagtctggctgtggtgtggagaatggatagacagggcagggtagatgggacgggactctagtgagcagagtagtgcagtgtcctcagcccctggtttaccaggctctgcaagggcgtttcattgtctatcatggcagccatcagtttgtctagaactgttagacactccaaagaggtaattttgctttttttttttctttttctccttttattttaaaaataagcccaatctggtttcttaaaacggaaacaaattggtctaatttctgctccttgggacaaggcagaatgagttttctcccctttctacatggcagcctatcaataatggaagatgatgattgtggtgccctaaagatatcttttttttttttttttttagacagagtctttctctgtcacccaggctggagtgcagtggtgcgatctcagctcactgcaacctccgcctcccaggttcaagcaattctcctgcctcagcctcccgagtagctgggattacaggcatgtgccaccacacctggctaatttttttgtatttttagtagagatggggcttcaccgtattggccaggctggtctcgaactcctgacgttgtgatctgcccacgtcggcctcccaaagtgctgggattacaggtgtgagccaccgtgcctggccaagatacctttctttaatactagatgcgtggacttataaactatttcttatgccatgaattctagatctctctgctgagtatatcctaatttgtcattaacatgtcctcttaaaaatctgttacttttttgctaaatatggcttctctattttcttttattaagtcattttgattattacagaaaatgctaacagaaaatactgtgccaaaagcaaagctttgatttataaaaagtgtccatttgtcttctaaaacaaatgatatttaaatgacatataaaaaagcacttaaagttttactctcgggcttggaaacagttgaagtcagcatttgaaattcaaactttcttatttgttctgttggtttaatggatataacttctttttaggaaaaaagtagaagctacagaggactttcccttttatgtttctcaaaaattttaaatttttccattgaagaatttgagaatttgacttagcacataaacaatctttcttctgtctctaagtgttgaaaagtaagatgaatcagcatcactaccatttattaagtggtttctacagctggtatggagctcatcagtttgcatgttgggcatctcatttaatccacatcacaattcaagagagaggtatgatcgttatctctgttctgtagatgaaggatgaggagttaagagctggtccaaatcataccagtagcacccctgatttctgcctctacagcacagcatggcacccttttgactcccacattcaaaagcaagtttatgccttgactaaagagtaacggccgggggaggggccaagaatggctgactagaaacagctgtggtcagaggctcccactaagaagaatgaaaatagtgagtgaatcctgcaccagcaactgaggtatccaggttctctcatttggactaactaggcagttggtgcaacccaagaaaagcaaggaaaatcagggtggtgatggcccgcctgggagccacagggagcaaggggagctcccatcccccagccaagggaggcagtgtgtgattgtgctaccctgcctgggaaaccatgcttttcccacagatctgtgcaacccgtgggtcaggagaaccccctcatgagcccatgccaccagggccttgggtcccaagcacaggcctatgcagattctcagcagccacttggctggagactgcttaagactacccagttcttatccagtgatggagggtcaacctccatcactgaggttgcctgctgcctaagacaaccaagctcccagggagaggggcagcagccatcactgcaactgcaatctgccattttttccctgctggtgccagggagattggatggtttggacccaggaggaattccccacagcgcagcacagtggctgtggcagatggtggccaaactgcctctttagtccagagcctgaccaatcccacctcactgggtggggcctccctgcaggaatttcagcaactccagccagggatttagggacagaactttgatctccctgggactgagcccctggagggaggggtggattcagtctccatagatagcagacttagtttttcctcctgcgggctctgaggaatctcagcagtctggatgagtgggattccctctagtacaacacactccctccaccaaggggaagccagagtgctccattaagtgggtcctggatcccatgccccctgactgggtgagaccccccaataggggttgccaggcaccttatacaggagcattcctgctggcatcaggttggtgcccctctgggacagagatcccagaggaaggagcaagcagtgatctttgctgttctttagcctctactggtgacacttccaggtgcaggagggactcaggaaactagggtctggaatggacccacagccaaccgcagcagccctatggaagaagggcctgactgttaaaagaaaaacaaacagaaagcaacaacaacagcatcaacaaaaacgtccccacaaaaatcccatccaaaggtcagcagcctcaaagattgaagctacataaactcatgaagatgagaaagaatcaacaacaaaaacactgaaaactcaaaaagccagagtgcctcttctcctctagatagttgcaacacctctccagcaaggacacaaaactgggtggaggctgagatggatgaattgacagaagtaggcttcagaaggtgagtaacaatgaccttcactgagctaaaggagcaggttctaacccaatgcaaagaagctaagaactgctatagagcaatacgggagctgtttaccaatatagccagtttagagagaaacataaattatctgatggagctgaaaaacacaacccaagaactttacaatgcaatcacaattatcaataaccaaatagaccaagcagagaaagaatttcagagcttgaagtttattttgctgaaataagacaggcagacaaggttagagaaaaaataatgaaaaggaatgaacaaaacctccaagaactatgggattatgtaaaaagactgaacttatgactgattggggtaaccgaaagagatggggagaatgaaaccaagctggaaaacatacttcaggatgtcatccaggagaacttccccaacctaacaagacaggccaacattcaaattcaggaaatccagagaaccccagtaagatactccatgagaagatcaaccccaagacacataatcatcagattctccaaggtcaaaaagaggaaaaaatgttaagggtggccagtcagcaagaaaggccggatcacctacaaagcaaagtccatgagactaacagcagacctctcaatagaaaccctacaagccagaaaagactgggggccaatattcaacattcataaagaaaagagtttccaacccagaatttcatatccagccaaactaagcttcataagtgaaggagaagtaaaatccttttcaacaggcaaatgctgagggaatttgtcaccaccgggcctgcttttcaagagctcctgaaggaagcactaaatatggaaaggaaaaaccaataccagccactgcaaaaacacactgaagtacaaagaccaatgacagtatgaaatggctacatcaacaaatctgcaaaataaccagatagcataataatgccaggatcaaattcacacataacaatattgaccttaaatgtaaatggactaaatggcccaattaaaagacacagaatagcaagcttgatacagagtcaaaacccatcagtgtgctatagtcaagagacctatctcatgtgcaaagacatgcataggctcacaataaagagatggaggaaaatttaccaaacaaatggaaagcagaaaaaaagcagagatgcaatcctagtttctgacaaaacagactttaagccaacaaagatcaaaaaaagacaaagaagggcattataaaatggtaaagggatcaattcaacaagaagacctaactatcctaaacatatactccaatacagtagtacccatattcataaaacaagttcttagaacctacaaagagacttagacacccacaaaataatagtgggaaactaatgctccactgtcaatattagacagatcattgagacagaaaattaacaaggatattcaagacttgaactcacctccagatcaagtggaactgatagatatctacagaattctccactaacaagcaacagaatatacattcttctcagcaccacatggcacttactctaaaactgatcacataattggaagtaaaacactcctcagtaatgcagtacaactgaaataacaataagtatctctcagaccacagcacaatcaaattagaactcaagattaagaaactgactcaaaaccacacaactgcatggaaattgaacaacctgctactgaatgacttatgggtaaataatgaatttaagacagaaatcaagaagttctttgaaagcaatgagaacaaagagacaacagaccagaatctctgggatgcaactaaagcagtgttaagagggaaatttatagcactaaaatgcccgcatcaaaaagctagaaagatctaaaatcaacaccttaacatcacaactaaaataactagagaaccaagagcaaacaaaccccaaagctaacagaagacaagaaataaccaagatcagtgtggaactgaaggaggtagagactcaaaaaacccttcaaaaaataaatgaatccaggagctggtttcttgaaaatattaataaagtagaccactagctagactaacaaataaaaaaagatgaaagaatccaataggcacagtaaaaaatgataatggggatattaccactgatgtcacagaaatacaaacaaccatcaagaatactataaacacctctatgcaaataaactagaaaatctagaaaaaatggataaattcctggacgcatacaccctcctaagactgaaccaggaagaccttgaatccccaaatagaccaataacaagttctgaaattgaggaagtaataaatagcctaccaacaacaacaacaaaaaagcccaggaccggacagatttatagccaaattctaccagaggtacaaagaggagctggtgccatttcttccaaaactatttcaaacagttaaaaagaaggaacttctccctagctcactttatgaggccagcattatcctgataccaaaacctggcagagataccacaaaaagagaaaacttcagaccaatatccctgatgaactttgatgcaaaaattctcaataaaatactggcaaacaaaaaccagcaacatatcaaaaagcttatccaccatgatcaagtcaccttcatccccaggatgcaaggctggttcaacatatccaaatcaataaatgtaattcatcacataaacagaactaaagacaaaaaccacatgattatctcaatagacacagtaaagacctttgataaaattcaacatcccttcatgttaaaaacgctcaataaattacaagcattccccttgaaaattggcacaagacgaggatgccctctcccatgactcctattcaacatagtattggaagttctggccagggcaatcaggcaagagaaagaaataacgagtattcaaataggaagagaggaagtcaaattgtctctgtttgcagatgacataattgtatatttggaaaaccccatcgtctcagccccaaaactccttaagctgataagcagcttcagcaaagtctcaggatacaaaattaatgcaaaaatcacaggcattcctatacaccaacaatagacaagcagagagccaaatcatgaatgaactcccattcacaattgctgcaaagagaataatacctacaaatacagctaacaagggaagtaaaggatatcttcaaggagaactacaaaccatggcagaaggaaataagagaagataccaataaatagaaaaacattctatgctcatggatagcaagaatcaatatcatgaaaatgtccatactaccaaaagtcccaaagttatttatagattcaatactatttccattaaactaccattgacattcttcacagaattagaaaaaactatttcaaaattcatatggaaccaaaaaagagcctgtatagtcaagacaatcttaagcaaaaagaacaaagctagaggcatcacgctacccgacttcaaactataccacaaggctacagtaaccaaaacagcatgctactggtacaaaaacagacacatagaccaatggaacagaatagagatctcagaaataagactacacatctacaaccatctgatctttgacaaacctaagaaacacaagcaatagggaaaggattctctatgtaataagtggctctgggaaaactggctagctatatgcagaaaattgaaactggacccctttcttacaccttatacaaaaattaaagatggattaaagacttaaacataaaacccaaaactataaaaaccctagaagaaaatctaggcaataccatttaggacataggcatgggcaaagattttatgacaaaaacatgaaaagcaattgcaacaaaagaaaaattgacaaatgagatctaattaaataaaaaagagcttctgcacagcaaaaggaactatcgtcagagtgaacagacaacctacagaatgagataaaagttttgcaatctatctatctgacaaaagtctaatatccagaatctacaaggaacttaaatttacaagaaaaaaaaactcattaaaaagtcggcaaaggacatgaacaggcacttctcaaaagaagacatttatgcagccaacagacatgaaaaaaagttcaacgtcactgctcattagagaaatgcaaaccaaaaccacagtgagataccatgtcatgcccatcagaatggcaattgttaaaaagtcaagaaacaacagatgctggtgaggctgtggagaaataggaacactttcatattgttgttgggaatgtaattagttcaactattgtggaggatagtgtggtgattcctcaaagacctagaaccagaaataccatttgacctagcaatcccattactgagtatatatgcccagaggaataaaaaatcattctattataaacatacatgcacacatatgttcattgcagcactattcacaatagcaaaaatatggaatcaactcaaatggccatcaataatagactgaataaagaaaatgtggtacatatacaccatgaaatactatgcagccataaaaaggaacgagattatgtcctttgcagggacatggatggagctggaagccatcatcctcagcaaactaacacaggaacagaaaaccgaacactgcatgttctcacttacaagtgggagccaaacaatgagaacacatggacacaaggaggggaacaacacatagtggggcatgtcatggggacattgggagaaagcatcaggataaaaagctaatgcatgtggggcttaatacctaggtgatgggttgataggtccagcaaactgccaaggcacacatttacgtatgtgacaaacctgcatgtcctgcatgtgtatcctgaaacttaaaattaaattaaattaaatttcaaaaaaagagtaagggctagcttgcatccatattctttctaggaacttttctcaatgctccagcctgagtgaccatgcccttctctagatttcataacacctgtctatattagaggaggcaattatgatgggcctacgatttccaacattactcgtagttattaaccactaaattattatttaacttcttatctctgtgtggattttttgtctctccacatagactctaagtttcttggggaaggattgtctattacgagtctttgctttcccatagtgcctagcatattgctttgtccatatgcaaggcaaccaatttacttgagttaatgaataaataaactaataaagacccaccagttattttggaaaatgcaaggtataaatatcttttaaaaccctgaaaagctcagagcaaggaggagaagggcctaagtgcataggcacaggagatgcacacttctgggctcatgttccagctctgccactggccagctctgtgacctcaggcaatgtcagtcacctcatctgtaaaatatggataataacttaatacccagactagaggattgtcgtgagtgtcaaatgagatgatatgtgtaaatcctttaacctaattcgtggcctatttgcataaatcgtagctattatagtcagactagctcttattattgaatcatgctttattatgtatcaagagcctttctgtacattgtcttgtgtaattattgacagatgtttactgaacactatgatgtggtgggtacacagtagcaaatacataggcatagtccctgaccccatagagcctttgtcacataaacagtgaaatacataagacagctatatttctccccattctaccaatgagaaagaaggactgaggagcatgactcaggcttgccatttggtgacctgatattcaagctgtgctgtttctgcctgctatggttcgaatgtgtcccctaaaagttaatgtgttggaaacagtctgcaatgcaacagctttgggaggcctaatgcaaggtgtcattattgcgagagtaagttagtcatcacgagagtgcgttgttatgaagcaagtgtgacccctaatgtctctctcttttgcatgtgctctcttgccctcccacccttccaccatgggatgatgagcaagaaggccctccacagatgcagctgctcagtcttggactgtccagcctccagaaccatgagctaaataaacctctattctttatagattactcagttcatggtattctgttatagcaacagaaaacagactaggatactgcctcacaagacgttcttgccatgacaaccaggtggattgtgagaggaatattctgtgagcagggctgtttccaaaccagggagatggtgttcattttaaatatgttcatgtgtatggatgttaatttagctatagctattagctttgatttgtttgatgttaaataaacctgaacagacatgatacagtataaaattaagtactgtttgattcctcagtatatttgctattaatgagtaattatgaatataattcataaggactgcaaatgtataatttgtatgtacatgtgtatgtcaggattggtagaaaatgtgaaatattaaattacactgcttaagatagcctactacaagcctacttatgaggtcatttagtgttaattgcctttaagaagaatctcactaccaacttcatctccccatcaccatctgcccataagatatgccaagtatctatttgaatcctttctttttaaaattcttattttaataatgaatcaaaggtgtctgtgttcctatttggtttaggttttgatccttaatagcctctttatgatctatacaattctgtagatgaaatctacccatgattacattggatatttgctatagcaatgttccagcaaccctggaacaaactcaaaatttagattcatattcatttaaaactctgccaatttggaattttctttctttcagcctggactctgatgagaagcatttataacttctccatagccaactctgataccacggccttgaaaatatggatcaatcttgagtgaacattcattctaggatttataaggtggccccttataaataaatttaacccagaaatagctacttgttgccaaaaatataatttaatagtggaaaggggattgagaagacctccagctctggccctggccctgtcctttacccgtcctgtaactgcaagcaaatttgagcttggtttctttgccttcaaaatggagatgatgtcccacagggcccttgtaagagtcagatagagccacattcagaggaatatttcttggtgttctacagctgtgctggattacctagttcttacacactaccaatgccttgctttgtccacttccatagagaagggaatattcccagacggcctgctctcatttatccaaggagcaagtagcccacagtctacatcatgaatgtggatttataatctctgtaaagacaatggaaactggcaaccaaatctcaattaaaaaaaaaaaaaaaaaaaaacaccaggccaggcatggtggctcatcctataatcccagcactttgggaggctgaggtgggtggatcacctgaggtcaggagttcgagaccagcccggtcaacatggtgaaaccccatctctactgaaaatacaaaaatttgttggatgtggtggcgcatgcctgtaattccagctactcgggaggctgaggcagaagaattgcttgaaccggggaagcagaggctgcagtgagctgagattgtgccattgcactccagtctgggcaaaaagagcaaaactctgtctcaaaaaaaaaaaaaaaaaaccaaaccaacaatagtccatgaagtaaaagaacagggtaaacagcagtcaggaaggaaaagagaatgaatttggaattatttacctggctcttttcccaaatcacagaaaacaattgggaaagaccctgagaatcgaaataccctcctccttcccaactctctcctgtgtgtggtgagatttatggatttaaaggctgtgtaatagaacatacacggtcaagtcttcatgggcaaaccgtggcttcacttcatgacagcagtagggttggcagtgaagtgaaaacatcagcaaaacatttcccttaaaatctattcatggggacactaacagggccattccacatagcacattcttctatgtgtggggcaaaggccacagattgtgaggccacagcgtgagcatggctgagaccctggcaagaaagagtgtgcacaggtcagaggattcaggcatccttgatcatcaaagaccaatgacgtttgtctggggttaacccagagtgaggctagcactggccacgtggagcatcctgagccgttttgtggctctcaggctgtggcctagtttgttatatgtctcaaaataagcaccttgacctcttctccctgtggtgttttattttgatatggtagtttaacagttattaatatgaaagtataatatatggaggaaaattttaaaactatagaaaagtaaaaaaaaaaattatttgcattacattataagcctttcagcattttgttctcttttctatttagcctttaaaatatgcagagattttaaaataaaactggactcagtttgcatttttggttttctgttttgattttttacttatcattatgtcatggacatttttctaagtcattaaacatttttaagaaataacatttttaatgtatcataggctgtcccatggttggctgccagtgtggattatgaaagcattgttcttaggacaagactatttccaaaccagggaaacgatgtccattttacgcatgttcatacgcacagatgttaatgaaactgtggccattagctttgacttgtttgatgcatagtatgagtcggatatcccttacctgaaatgcttatgaacagaagtatttgaaattttggatttttttattttggaatatttgcattatatttactgggtcaacatccctaactgaaaaatccaaaacggcctctggagcattacgtcagtgctcaaaaagtttcagatttttaagcatgtcacaattttgaattttcagatttgggatgctcagcctatagtccattgcataactatactgtatttttattaatcatttctctctatcattagttgcttagattccttcatctgtttctgtacaaataaacactgctatgttttatttaatattataaataaaaatgaaacagattagttattgttatttctaacagtggcacatattttaaatatgaaaagtagtaacagtgtgacttgatgcaaaaataagccaacagagtaaggaaacagaaaagacagccaaggaaaagatcctaatatataccatgtattgaatgataaaaaaaaaatgtatcacatcaaggttaagagttaaagccagtaaaatttttaaaaaatcacaaatcagtgggggagtgattattgaacaaacattgctgggaaagcctaacctcatactacatcagcagaataaattctacatggaataatgagttagatcttaaaattgaaatcatgaaaatactggaatagaaccttagtgactaattgttcttagagtttaaaaagattattaaagcaatgaaagaaatgagggaaaagtgatacatttgcctccataaaaatatgtaacttaggccaggcgcagtggctcacgcctatagtcctagcactttgggaggccgagtgggaggatcacctgaggtcaggagttcaagaccagcctggccaacatggtgaaaccccatctctactaaaaacacagaaataagctggatctggtggcatgtgcctgcaatcccagctacctggtaggctgaggcaatagaatcactggaactcgaaaggcagaggctgcagtgagccgagattgcaccactgcacttcagcctaggtgacagagcgagactctgtctcaaaaacaaaaaaaaaaaaagtaagttaaaagaaacaaatgcgtatatattttttgcttctgtatgtatggtggatgagcagtagataaaacaaattcactcttctaaaggagctcacattcgaatggaggaaggtaggcaaaaataaatatattcagaaaaataaaatagggtactggaagagagaatgagcatgcttatttttctttctcagctgtaatcatctgacaggtatacatcctgactttaattgtctttgtagctaccatcaagttttttcagactttctttaagttatggtcctgtaatgatcaaaggcaaaaatgaagcactaccttttgtttcctttttgctacacttattccttctctctattgtcctctgttaatataagttgtgattgtgtacatagattccattataaaattattgttttatctttccttccagtaaatatatttgaaaattttatttttgtaatcagattttcttttgaatttaacttttaagctaattttaggatttactatagacacatttataccaggattttcccattttaagtacttagcttttattcttatcatgcttaaaattgatgtacatattcaagtgttcttttttcaccaaataagtaaagatatatttttttctgaattcttgtctttgtggtaatgtctttcttctagtttttcacataaccagcaacttggccttggaaaatccctgggaaccagtcctttgtcctcgtgtctccttagctgttacttctttgtgttttagtctttagcattatagagggaaaaaaatcataccagtttttaatcacttatagataatctatttttctttttgcttttatttctaatttgatttgttttcttgttttaaacacttgtacaattttacatttgttcttgcaattcaataaagggccagggtatttttagacatgagtctaattttattaacattacctgttacatggcaaatcttctgtatataagtatatattgtcttgcacctcaggaaagtttatttctttttatgtctttattattttagttttaggttttttttcttcctttggaaaacctgtaacactttagttcagtcttcttcgttatcttctgcatcttgtatctttccttttattattttggtgtctttgccttttcctatgctttctggaagagcaactcactttcttcctgaatatccttgatttagtttttatgtaaattttgttctttcttgcctccagttcaggttttaattagacccttccatttccttcttagtttatctgattcccttgcctcctgcgcttatccttccctgcggcattctatttctgtttcaaaaggccaagtaattttataaatcattaaatatgtctgataaatttctaaaaaggtgttttgatatctggagtgaatcagagtgatgcatttcctttgggctttcagaatgatttttcttcttactcattttatagcttaaaaaaattgttgggtcttactgcgtttcttaatttttcctaaaacagagagctatatagggctggtgttctacagacaaggcctgtcctgtcttgtctactcacctggtatcccccgcacagtacatggcctgacacatagtaggcacacaacgattatccattgaatgaatgattggctagggaaagcaattcaactagttttcatcttagacatatgttttaaaaaccttgtataacagaatcaaaataaagaaagggagttttattgcttgggttggaaggaatttatccctcagctgatggctcagtgaacacagcaaaccgggtgagctttcaccatcatcttgctcagatgtatttttctatactttcccctgccagttgccaagagacattaatgaatcttacaaaagtctggaccatatatatcttcagaagtgtctgccctgctcagcctgtggacaattattcaagtcattggagatagctggcccagtcaggaaggccgtcttcctcacaaccaaggcttgggtttgacaccttgtacatcctgcataaacaaactctgtttgattcaggccccaaggcagacacaaaacaagcgttacccacaaagtgcagctgggaggaagcttgtctgttatctgggaggaggacagaagctcaagctacgcacaaaacttgcttggctcattttattagataacccctgccccccgccccccgccccacttcctgactctctctctctctctctctctctctctctgtctcacacacacacacacacacacacacacacacacacacacacacacacattcctcatctgagcccagcccaggaaggtccagaaggaggcatacacatgcctagtgggccttgtattgtagtgaccattacaaagaaatgttttaaaggaaagtaaaggattttgcagaatcccatttgcagggaaagacctgttctgtgctggcacctgctcctatgtttcttctagccacatttgaaggagtctctagagcccatgaagaaggcacatccgatgtgtgggaggaatcagagtgcaagaggatgcagaggtctgggaggagcctccagagggaaaagcaacctgcatcctagctccacagatgcgcagtctcccctgccccaaatcctggagctggcttggcattttgtctgatgaataacgcagggttctccaaaatagttttgctctaaagatcgatttcctcagatatcaaaacagaaaccatgagcagccctctctccaactaaagataagacatttcagaatacgagagggcacacgacccccaagactgaaagagagagacttgttgatgccacatgggagtatacttcatttggcaattatcctctcccatttttaccctcaatggatctggaaatggagtctgcagacactctggctgatttcctaatgggatcaaaggagtaatcctgcagagctccctgtggacgccacagcaggagcgggagggtctcctggcaatgtttgtaacacctcctttggatgttgattctgccctaaggtgcatgatgttctgcagtggaaatgggttggctcccagttctgctcagactttcagacattaatctctcagacagttcagaagctacagtcaagtcagaatgggagggaatgtgtctgggtgccaggtccagccgttagggcccttctcagcatgactccacacttccttctggccttaactcccaatgttcctttatacatcgccttaaactacagtaaaactcagcagctaagcacaaccttacttttcaacttccgttttgagtagggtggagagacaccttcacttgttgtcttggcctagaataccctctacctcttccctgcccacacatcaaaatattttctttccaccattacaaactttagtaaatagcctgggttttcccagaacagtctaacctgcatacagataagggcttgttttcctcattattggtttcctttgggaaaggcttaatacagaattttaaattctgttctgctcatattttacacgcagtggtgtgtccatccttgtcattttcaccctctcaatacaaaccttatgtacttagagacttaattaatagcaagctacatctaaaaataagagaaattaaagctcaatattagaagactttaggaataagatgacccttttaatagcatattgctgagcttttactaaacacctattattgtgttattatttgtgttatttttctaggtaggattcataaaaatgctgttatctgtcctgacaagagcagagggaagagtgtatgtttgaaccatctttatattaacagcacaataaaattcacggcttatagtttccaaaatattgccatgctcattctatgaactgattccataaacaagtctgttgctacctacttcctcatacctctagctccaccgctggctcttcccctcctttcctaggccaggcccatttctctccaactgttcttacagttgtgacctccttccccaactccatccattttctcattgcagccagggtgacttcccaacatgcaataactctgtctcctgtatggcccgcctcgtgttaatacagctctctactacaatacagtgaatcagttttttctgtgcggcaggcaggaagaacctgttgggcaattacagtgccaggtacacagttggtgcttaatatatacttattgaacaaaagggtgcatgaattaatatataaatatgtcaaaaatagcttcctggctgggcatggtggctcacgcctgtaatccctgcactttgggaggctgaggtgggcagatcacctgaggtcaggaatttgagaccagcctggctaatatagtgaaaccccatctctactaaaaatacaaaaattagctgggcatggtggtgggtgcctgtaatcctagctactcaggaggatgaggcaggagaattgcttgaacccaggaggcagaggttgcagtgaaccgaggtcacgccactacactccagcttgggcaacaaagcaagactctatctccaaaaaaaaacaaaaaacaaaaaaaagcttcctgaggtgggcaaagaaaatgctatgatttctagtctactaacccacaaccagcagaccaggggttttgctgaatgtcacgcaacttctatgaacaggagaagccttagaacccaagatttaaacctcttaagattggtgagtttccttccacatcttcttagatcagagcaacatttacttccacttttctaccttggatgtatgtttctcccagagtgaaagaaggacactggaaataattctaccctctcctgtggagacagcatcaaagttgtcaggagaccaaattcatgtaacatgtgatcagtcaatgagttatctctactgtttagggacagcatcaacaatgacacactcattccaatgcatcatttttgtatgtctgcaatgcagtgtaccaagtctgtgctttaaaatcatgtttttaaaagttgtcactcttttctttcttaaagttgtcattcttgtctcacttgtaagacttttgcaagtgtcgtttcttctgcttgaaattcagcctccctattgtatattttggcttttgagtatttttacatcttatcacatcagtgtcaatgtcttaacaaagcacatcagccagagggtgagtagttgagcatctattcagagtcaatgccatgcccactgttgcaaagaatgtgagaaatactgagatagctttaccatcaaatattggactgcccaggagtggaagctaactaatttctaagtaatttctcaaccagagatctataagaaaaagaaaaaaatgaccaattattgaacacatttgcaaaggtcttacaagtgagacaagaatgacaacttttaaaaacatgatttttaagcacagacttggtacactgcattgcagacacacaaaaatgatgcattggaatgagtgcctcattgttgatgctcttcctaagcagtagaggtaactcattgactaatcacatggtacgtgaatttggtctcctgacaactttgatgctgttttcacaggacagggcagaatgaccagttagaattccctttcattggcttggcatggtggctcatgcctgtaatcccagtactttgggaggctgaggcaggcagaccacttgaggtcaggagttcaagaccagcctggccaacatggtgaaaccctgtctctactaaaaatataaaaattagccaggcgtggtggcatatgcttgtaatcccagctactcaggaggctgaggcaggagaatcacttgaatccaggaggtagaggttgcagtgagccaagatcgtgccactgcactccagcctgggtgacagagtgagactcctctgtctcaaaaaaaaaaaagaaaagaaaagaaaaaaagaatatccttccaccacaaccaccactatagacttgatgtgacgagggcccttcccagtgatgagaggaggactcaggtctataagagaaatgggtttcacaggaggcacagcaggacttggtgatgagctgcaggtgcagagctgaaggacagggaaggtctccgttgtctgtcaggctgcaagctctgtgacagcaggaactgagtcatttctactgaccattgcattcccagtacctggcccaggcccactgcataaggggcactcaatatatattttccaatgaagaagtgattaagtagagattatggatgagaggggtcccagagggctcttatgttctaaatatgtgtaatgggaaaaatggtggtgctatttactgggaagtagaatctgggactggaattgaaatggagctggctttggaggagaaatgacaaggtacacgtaagacttaatctggtgatgtcagtttatctgtgtaaccaggacttctagtctccaaacaaggtagacaagagggagataacaagtgaaagaatagaataatcagagtaacacttgaatgaaagtcaggaaacccaagtttcatttctgtcttagccaccaatttacttcacttttctggatgtttgctcatctatacaataagaaggttatatcaaacaggtgctaaggaccactttaggactagaattctagattgtagaggattctatgctaggccgggctatggtgagtgatgctcaagatgaaccttcagaagtaggtgatggatgagttagacaggtgagtgtaatggtgaccaatagcaagctcaaactcacacatggtgggaccatggacagttccctcccctggctgtttcttctaggcagagagcatcatggaagccctgaaggctacagatcatctaggccaggatttttccataaagtatgttctagaggtgaggtgttaatggatgtttatacacacttaaatgaggttctatgctcaaatacattgaaaaacactatgttaaaaggcttctttttactggactttaaaaatagcccttaatatgctcattttccctctaggatgctgatatactggatacacttcctttaaaaaaatgaaagatattgtaatcaggcaaatctcagcatgcaggatggggcagctgactccccgcaggcttgctgagagcccttgatgactcttgtcagtgcagtgagatggctcttggtggagtcactgaggatgaagatcaggagagaaaaccacatactgtctcctggagaccaagctcctctcaaaggctaaaggaagcttccgtcattctggtgtgcacatctgcccctgtatcccaagaagagatctgagcacgtgggtgttccggcttccaaacatactgggctcccactggtgagatgatattagctacttacttatattcacctccacacccatgtccttctcactgccaaactgcctctttgctcatttctggttctgtgggcatttgtatttttgtagcatgaagtaatgaggactctgaggacttccactttccagagccaggattaatttaaaagttttgtcagcaggcagcaaattccaaaggttactgtccacttgcattcagctggaggcatgctcagaaagcattcttttgtgcctttagcatgtgtggcaggggcgctggttgaggctggacatttacttgctgtttgattgctgactgtgtcactggttcctgatgatttttggcatgggataaatgctgttagtcagaagcaaaacttcctctgtgagagctatttgttaaatccaatcaacaagcattggtcaggcacttattgaagtggatccctgctaatttgtccctctcccactgtatgcaattccaatagctacttatcataattcccatagaactctgagaggggagaaagcctatggatacaagattttctctctgaaagtgaaaattgcatttttagagacaagcagctgtgacatcctgggtgggacacagagggtgggtggaggactgagagaggaaatgatatgcatgccctgaaatggtgtctgatgttgctcccgaatagtgagaggatttgtattagacatggctcctactcacaaactgtggtctccctgacatgatagcattgtctggttcatctgtgtcccctagccccaccacatagtaggtcaatcatttttttttttttttttttttttttgagacagaatcttactctgttgcccaggctggagtacagtggcgccatctgggctcactgcaagctccacttcccaggttcacgccattctcctgcctcaacctcccgagtagctgggactacaggcacccgccaccacgccaggctaatttttttttttttttttttgtatttttagtagagatggggtttcaccgtgttagccaggatggtcttgatctcctgacctcgtgatccgcccacctcggcctcccaaagtgctgggattacgggcgtgagccactgcgcctggcctggaggtcaacaaatatttaaagcacctatagctaaaccaacagttagtaattaccactcctcacatagtctatgccaggcccagtgctgatgatgtgcatattaagcacacctcctccttgattttcatcatgaccctaagcagtagatattggcatcattctttctgtgatacaagttaggaaagaagggccaagagacctgatgtcacctgctggggatgcaacagctgtagacttcgtgatccgcccgcctcggcctcccaaagtgctgggattacagagcctgagcagagcccaggtgtctgagcacagcccaggtctctgagcacaaggtatgtgctctggaccacaggctttagggagggaaggggagcaggaaatgtcgacacatagggttgggggcaggggtaagtctctccctcaacctaggttagaggtcactagcaggaacacaatggccagtgggaatttctgtcatgaggcatacatctgactgagtccctgtcctcagcctgccttcctgcccctttgcagactgtctgctcatcctgggtcccttgggcatgctgcacacctttccccacgtgatattcgtgcttaggcagccgaggctgtgagacacagtgtagtgttacactctgccttgatttgtcacaggagatagtgtcccttctggagctcaggggcaagatcttcccagaaggaaagctatcaaccacatgcctgttggaaatactgatgaatgtgttcattcaactttgatgtagtatttttaaaagtcaattattttcagcagtgaatatcaaagcaaaatttaacaaagctaagattgctacattcagctttaatacttgtcagctggcgaatatctctttaattacacaagcacaaatccagcaactcattttactctgctgaaaatacaataatgacaatcaaaaaattctcacttccattttcactgagtttatatgagggtatgaggtcattcaaactttgccaaaagatgtacgtactgtcgatgggtccccctgcctttgagaaatgtcctcccaattgtctttcagttattattttcactaaaacttttagtttcacttttagtttcatcaaacaaaataatcttaaataaaaagttttattttagttctattaaaactttagttcattagaacttttaattaaggaattcccttccacaggggaaaaagtagtcaaaaatgataactaaagcccaaaagatgtaacaataaaatgattacctggaacgatcctcttgtaggtaagtctaagatataatgtggatttttcttctcttttagaaggagttggccacagcataccaatgtgaagtgttgagtttttcttaagttttatttaaattttaattcataaataacaatcgtacatatttatgtgggtacaatgtgatgtttcaatacatgtgtacattttgtaatgatcaatctgggtaattaacatatttgtcccctcaaacatttatcattgctttgtggcaagaatgttcaaagtcctcttttctagctcttttgaattatacactatattatcattaactgtagtccctttactgtgcaatagaacactagaattcttcctcccatccaactgtaactttgtatctgttaactaacatcttccttctctccctccacctccatctccatcctctggtaagcaccattgtactcctctctttctacaagatcaacttttttagattccatgtttaagtgagatcatgtggtatttgtctctctgtgcctagtttatgtcacttaacataatgtcctctaggttcattcaagttttagcaagttacaggattttattcatttttgtgactgagtagtattccattgtgtttatataccagatttttaaatccgttcatcctttgtttcctaagtgtccatcaacagatgaatagatcaaaaatggttgaatcttggctattgttaataatgcattagagtgcagacatctcttatgcagaatgatttcaattcctttgcatgtatacccagaagagtgattgctggatcacatggtaattctatttttagtattttaagaactccccatactattttccaaaatctcctaagaatttatttatttatttgtttatttagagacagagtctcgctctgtcacccaggctggagtgcagtggcgcgatatcggctcactgcaagctccgcctcccgggttcacgccattctcccgcctcaggctcccaagtagctgggactacaggcgcccgccgccgcacccggctaattttttgtatttttagtacaaacggggttttaccgtgttagccaggatggtctcgatctcctgacctcatggtccgcccgcctcggcctcccaaagtgctgggattacaggcgtgaaccaccgtgcccggcctgaatttataagaaaaccaacaatgtgtaagtgtctccttttcttcacattctcaacacttgttatctttcatctttttgataatagccaatctaacagatattatgtaaaatcttattatggttttaatttgcaattctcttatgataaatgatgttgagcatttttttttgtatatctgttgtccattcttttgagaaatgtctactcaagtcctttgctcattaaaaaaatttacatttgagggtacatgtacagatttgttacatgaatatattgcataatgctggagtttgagagttagtcaatgcagagcctaacaggtagttttccaactctttccccacccttttggagtccccagtgtttattgtttccatttttatgtccgtgtgtgcccattgtttagctcccacttgtaagtaagaataagtgatatttgattttctgtttctgcattaattcacttgaaataatggccaccagctgcatccatggtgctgcatagaacatgattttattctttctatggctgtatggtattccgtggtacatatgtaccacattttctttatctaatctactgttgatgggcatctagttttgttttcttgttattgagtagtttaagttccttgtacatttcaggtattagcttcttgtccagagaataatttgcaaataccttctcccattctgtggattgtctcttcactctgttgattgtatccttttctgtgcagaagctttttagtttgttgtatccccatttgtctatttttggttttgttgcctgtgctttcgaggtcttacccaaaaagtctttgcccagacctatgtcatggagatttttccctgttttcttctagaagtttcatagtttagtatcttacatttaactccttaattaatagagtaaaatataagggtctgatttcattcttctacatgtggatatccaatatttccattacaatttatcaaaaactttcctttctctgttgtgtgttcttggcacctttgtcaaaaatcagttggctgtagatgcataggtttatttctgggtcttctattcaagtccattggtctatttgtctgtttaaatgccactaccatgctatttggattactatagctttgtagtatattttgaagtcaagtagtttgatgcctacagttttgttctttcaaaatttctttgactttgacttttcaggacattttgaggttccacaaagttttggattattttttctatttctgtgaagaaagttattggtattttaataggaattgcattgaatctggaggttttggggagcaccatggatattttaacaatattgacttacctaatctgtaaacttgacacatctttccatttatttgtcttcttcactttctttcttcaatgtttaatagttttgagtgtagagatctttcacctcgttggataaacttattcctaagcattttttggtagctattataaataaaattgctttcttgatttcttttttagattgtatgctattagtgtatagaaatgctactgaatttgtatgttaattttgtatcctgtaactttactaaatttgttcattagtgctagtaggttttcagtggagtctttagggttttctatatataagattatgtcatctgcaaacatggaaaattaacttcatcctttccaatctctcatgcctttccatctctcatacctaagagaaagaaataaaaggcatttctcttgctctggctaagacttccagtactatgttaaatagaagtgataaaagtagacattcttgttttgttctagatcttagaggaaaagcttatagcttgtctccattcagtatgatattggctgtggggttgccatttatgatctttattgtattgaggtacattctttctatatctaatttgattagagtttttatcatgaaggatgttgagttttgccaaatgctctttctgcatctattgaaataatcatatggtttttcttcttcattctcttaatgtggtgtatcatttatagatttgcatatgttgaaatagctttgcatccattggatgaatcctatttggtcatggaaaatgatctttttaatgtgctttgggatttggtttgcttgtagagtcatgcattgcataataatgttccagttcgtgatagactacaaatatgacagtggtcccataagattataataccatatttttactgtacctttttatgtttggatacacaaatacataccattgtgttacagttacctacagtgtttatgacagcaacattctttgcatatttgtcacctaggtgcagtggactatatcgtgtagcctaaatatgtagtgagttataccatctaggtgtgtttaagtacactctatgatgttcgcatgacaatgaaatcatcgaactacatatttcttagaatatgtccttgttcttaagggatgcatgactgtattttgttgaaaatgtttgcatttatgttcatcagggatattggccaatagttttcttgtattattgtgtccttgttaggttttagtatcgaggtaatgctggcctcatagaatgagtttgaaagtattcattcatctttaatcttctgaaatagtgtgagaagaattgtattagttttacttgaaacgttttatagacttcagcagtgaattcagaattctatcaggtcctgggcctttctttgatggaagactttttatcactgattcagtctcattatgcattgttagcctattcagactttctatttcttcatgattcaatcttgggaggttgcatgggtccaaaagtttatccactcctaggttatccaatttgttggtatataattgttcataatagtctcttattatcctttgaattgctatggtattagttgtaatgtttcctttttatctctgattttatttatttgagacttctctcttttttcttagttatttagactaaagtttgccaattttgtatttgcaaataacaaattcttcatttcatttatcttttgtgtagtttttcatctgttttatttatatctgctcatatcttcattttttcactttttctcttaattttgggtttagttttttctagctttttgaagtacaatgttaggttgtttatttgaaatctcttttttttattgatatcggcatttattgctataagcttccctcctagaactgcttttactgtatcttacaggttttggtatgttgtgtttccattttcatttgtttgaagacatttttaaatttcccttttaatttcttcattgtcccattggctgctcaagagcatattgtttaattttcttgtattcataacatttctaaagttctcccctgttattaatttctagttttatactattgtggacaaaaagaaaataaatgatatgatttcagtcttcttaaatttgttaagacttgttttgtggcctaacatataatctatgctggataatgttccacgtgcagttgggaaaaatgtatattctgcagctgttgaatagaatgctctataaatatctgttaagtccattgcgtctagattgcagtttaaatccaatgtttttttgttaattttctgtctggatgatcaatccattgctgcaagtggggtgttgatgtctactgctattgttatatttcaatcagcctatcctttcaaatctgttagtatttgctttatatatagactgttcctgatctacgatgatatgacttaacaattttttgacattatgatggtgtgaaagtgattcacattcagtacactccttgactaatgatggaaagtattgtaagtaaaaaacacactttcagcttacagtatttccagtgtatgatggttttattgtaaccccattgtaagctgagaagcatttgtatttaggtcctctgatgttggatagacatatatttacaattagtatattctcttgctgaaatgactccttttattattatgcgatgaccttctttatctctttttacagtttttaatttgaattctattttatctgatgtaaatatagctacttctgctcttttttggttttcatttgcatggaagatctttttccatctcttcactttcagtctgtgtgttccgacaggtgaagtaagtctcttgtaggcagcatatatttgggtcttgtttgtttatccattagccactttatgtcttttatttggagaatttaatccatttatattcaaagtaattattgttatgtaaggacttactagtatcattttgttcattgctttctagttgtcttgtaaatcttttctttcttcctctcttactattctcctttgtggttaagtgattttctctattatcatgttttgatttcttaccttttacttttagtttatctattgtaggtttttcttttgtggttataatgaggcttacaaaaaccctcatatagatataacaggttattgtaagctgatatgaaattaactttgagtgccataaaaaagtctacgtttaaccccacccactgcattttgatcttttactgacacaatttccatctctttatactgtataccacttaacaaatcattttagttttaaaaatatttatatcttttaaccttcatactaaaggtataagtaatttaaacatcattgttacagtattagagtattctaaatttgaccatataattataggtaccagttagttttatactttcaaatgttttttgtattatgcattagtatgcttttctttcagcttgaagaactccctttaacatttcttgcaagacacatcctgtggtgatgaacttactcagattttgcttgtctgggaaaaatctttctttctccttcatttctgaagaacagctttgatggataaagtattcttggtttgaagttttgcttttttattttgtcttcagcactttgaaaatattattctattttctcctggcctgtaatatttctgctaagaaatttgctgatagtcacattgatactcttttgtatatgatacgcttcttctctgttgctgctttcagaacatatcagatttttttctttgagtttgatttttcttttttttgagacagggcatgcagtggtgtgatcatggctcactgcagcctcaacctcctgggctcaagcaatcctcccacctcagcctcccaaatagctgagactacagatgtgtgccaccatgcccaggtaatatttttatttttattttttgtagagatagagtctcactatgttgctcagtctggtcttgaattcctgggctcaaatattcctcctgctttggcctcccaaagtaataggattatagtcataagccacggcacccagccctggctttgatttttttaatttttattttttttattgtatgtcttggtacactggtcttttggttgaatttgattggagacttctgcttctcatttctgggcattggcatctatccctcaattatggaaatttccatccattatttctctaaatatgctttatggcaattttcctctttcttctctttctgaaactcctattacacacaggtttggtctcttgatgttgtcccataatttccataggctttactcattcttttgtctgtttgctcctccgactggataatttcaaatgttctgtttcactgctcgcaaattctttcttctgctagattgagtctactgtagaagttttctattaaatttttcagttcagtcattgttttccttatctccaggatttctacctggttcttttttattgttcctatttctttgtgaatcttcccactcttttgcatattattttccaaatctcactaactcttctttctgtatattcttgtagtttactgaacttctttatgaatattattctgaattctttgtcagtcatttcatagatctttatttggggaagcatccattattgcagctttttaagtttcttttggaggtggcatgattctctgattctttgtaatccttgtgcccttgtgttattgtctgtgcatttgaggaaacaggcccctcttctgacatttacagatgtcctttggccaggatagagcttccctacttagtctagcctgtgattattggaagggcctgctgatgatgaccccagacaggcagaacttgttgtgggttctctagatggctgggccactgcctttgctctgatgtcaaatggagctactggctgggttccaatgaccagtgagaccacccactggctctactatcaggcagagctgctggctgggtaccgtgatggcctctagccaggcctgtcacaagatgtatttcctggctcagcaattccagtatttgggatcttcagttggacagggctggaggttgggcttcaggcttagaaaggatcacttctctggacaggcagaacctggggttatgtttctttgagatatgcagttgaggattgtgtctttgtctatgtggagctgtggggtgggcttttgactgagttgagtagctgtttgacctcctggatcaagcatgactggcctctacatttcttaaaaatgcatggaagtaggaatttccctatctacatcaggttgttgagccaggtttttggctgtgttgagccactgcttatctttccaggtcaagccattctaggctctctgcttctctgaaatccatgaagttgggaatctccctacgtggatggggtcactggggtgggttatgaggctgagtgggaaaactagcagagtaggggctccagcaggattgtgcttcctaccatgcttctgcagacaagttgctcagctctatggggtacactgtgaggtgggctgataccttttatcaagtgctacatctggcagaaacacagaggtaccaccaagatccatgtgctggtcactttcattgtttctacctgacccctgagcaatcaagccatgctttccctagtgtttcccatgaggtgagaggacagtggacttcctgggaagtgcctcagaattctagggaggctagatgactgcctctggttctcctttccctttgtagaaattatgagcccagggaaattctctccatctggcattgtgctgactttagggagggggcaggagtggcatggtcacagtgaactcacccttctaatttgaatttgctcaattctgcctatgatgtggatgtctcaggcttttttccagattgaggttgaggttttcaaaaggaagagaaaatagaataaaatttactctaagaggatgaacgatctgatgctaactccttcctgtggttggtttactattgcagttgtcaatctagatgccttggtcagaaggatctttatgcaatttcaacatgtcctctgttctcagagctgagataaccagttttatatcttctatttcacaagaaaagtggaagaggtttgttgaagttttcaaaaggatattctcatctgtggatagttgctagttgaactttctgtggaggaggagtggagcccgatactttccattctgccatcatgctgatatcattcccaaggtgccgatttttttttttttaagacagagtcttgctctgtcacccaggctgtagtgcaatggtatgatcttggctcactgcaacctttgccgccctggttcaagtgattctcctgcctcagcctcctgagtagctgggatttacagacacctgccagcacgcctggctaatttttttttttttttttttttgtagagacagggtttcaccatgttggccaagctggtcttgaactcctgaccccaagtgatccgcctatgtcagcctcccaaagtgctgggattacaggcatgagcccagcgccaaagtgctgctcccagtgccaaagtgctgaatatttttactggcatcaccttctgagggtaaaggttctctggtcatatctgtgcagcaattatctgctttagcgggatgaagaagaaattttgatacacatatatctctgcattttaatttcagagcttatatcctattcaattcctacttcaaaatgtattttattcaagcaaatgctgccaaaatgtgttacattaatttatctttctggatggaggtgtttctaacagagcaattatatatttgcctagactaaacattcatttcatttccatcacgagcctcttccactttgcttgtgaaatagaagatgtaaaattggttatctcagttccgagaacagaggatgtgtttaaattacaaaaagatccttctgaccatggcatctagactgacaactgcaatagtaaaccaaccaggggaaggagttagcatcagatgattcatggtctcagagaaatcttttattctgtttcctctttctattataaactttctcatgaaaatgagtttactaaatcttaatgttaaatgtgccctccttctaattatctggcattttcatgacaaaaaattaacaaaatgaaacataagtcaagtatatactcttgtttcttaaaataataaggacagaaaatagtataggttgattcagtttttgagaccttttgaattacaaacagaatcatgaatagaaaaattttacataaatggtaaaataaaattagttaggggaaaaatataaaatctccatttcatagttgtcatacagttggcgaattgtttcgtaagagtaacaaaattaaactcaggaaagtagttggcagtcaatatttctctgacccctgcaagttgtgactacaataaaataaaatttgactttttctgattactgcttaaagatattgaatacaaattgaatatcatctgtctttcttaagtgatgacacttctcaaatatttaagcccagagggcatttggatgatattttagtcaggaatttaactacgtactcaaatgtaaactaaaattgtgaagaagccaaactcatacatcttctacccactttctaagtctagggcaacctaagccagaattggaggacattttaaattgggtgaggttctggaatatttatattggaagaagttcaactttttattacctgttggtaatcagaaaagctgtgggtccttcccaagctacaatgccatccacaaagtgggaagaaatgaatcctaccacagtactcagaggtagtaagtagactaaagaataaagttgcttttggcttgtttttaaccaagtctggctaattaaattaatccgctacacaggcaatttatttaacacagagtcaggcatatatttaatgatcaataaggtttagcgattgttatgaacacaatatagtatatatctcagtagctctctaggtggtttttgtttgattgattggtttggtttttgttttattttgttttctataaccagtgggttctggggaaggaggcacagttcatactcttattagtcaagacaatgctcaggtatgtggctgtaacaaatgatatcagtggcttaagccaatttcatttctcactcatacctgccaagcgtgggctggtaggaagtgtaaaggctcccctgagtttctcagagactcaggttgacagaggctccaccaccttgtgacattgccagctgacaatggcttctagggtctctgaggaaggacaaataaggtgctggagatctcacagtcttaggtgcctcaagccagagaagacacctgcaacttctcatcacagcccattggctggaagcattcacttggcttgggcatatccttttcatgttcccaggaaagagagaagaatcaggtggaagcaaactctagaagattcaaatgcagtgtaatctcccaatgaaaagattcccccaatttttcaagtgttatatcttatgagattggaatcccttcaatagcaaatatttcttttgtttcttccaagagaactatttaacttatatactgtttaggaaaggaagtgatctccttctactaattgacatggcttaattctgtggatctgggataaagctcaggcatttaaatgtctcatcgggaaggtgtttgctggatactccatttaaagggtgtcttccccataagccccttactgttgatctctttcttagcaaccgatttgcttctttcatagcaacatcacaaagtgtgactattttacttcattcgaattttaagttttgactgttttcctcatgatactgaagtttccaagaggctagcaatgatgtctgccttggttactcttttcctcttagctctttagactatgcctatcatgtagaaggaatcaatatgttatttgcccaatggatgaacaaataaatgactttttttaaacaagctttccaggtaattctgatgcaatttgtccattggccacactttgataaataaatactacagtatatttgcttgtccctttttgaaaccaataatcctgaagttaattcaattttatttgatttgattcaatccacatttacagcagcaccagagggcaggcctactactctgtcaacctcctcaaaagagaggatctagcctctctcccccaccccaacacactcactcatgcaatagtcagggctcaagcacatatactccaactcatgcaccagcatgagagctgtgaatacttgtgatttgtggctacttggcatcattctcctttcctaacagtgacatggagttttggggataggaaggctgcgctctccacacctgtacgacctactttgatgggaccatgaaggcaccatttctgtaacctcagtgcagcctcttcatccaaatgtggccacttggactcccttccctaggcctctacatcttgagctgagtaatgcgaggacagaaagaaccagccaagaccctccgttccagcactggtgtccagttgagatggcagaggagttcttcctgccttgtcaccaagacttccctgcttcacaccttggccctgtgctttttactaaacccagacttccatctttcatccattgtgcctctctctttctctctggcaggggtttctagctagccactcagtatccttctgcctcagtcaccaccctgatttaattgggagtaacaatatgctccccgaaagtgacatttccctacttcgcctgccacatgccacagttctaactgatgggacataagccagagttattgagtatattttctagtcaagtttctagacctgcctctcttgagtatttgctactcagcctaattaaggaagggaccctgggcaaggatagatgctatttctccctcccagccatggccgcataggcatgttccaacatgagaaatggaattgaaaatattaatttatgcaacagataatctgattcatcacattacaaagttgtctcattttacccaaaatactactcatttggtttctttaaatatcatgtatccctccctaactcagttacatttaaaataaaatttcaaatactttttatttcagtgctccatagtgattaagaactcagctgtggacacaggccgggctggatttgaattttgtatctgctattttccccaggcaaataatacagccatgctgagcttcaggctccttattgagaaaatgggaagaaaaattccatcactttaggaggccctagtaaggatgaaatgagataatgctcataaaatgggaaataatgctaaccatcattataatcagtattattgatcacaaaatgcaaactatacattgattcagcctgatgcatgcactgagagattccatccaacgggcaccaacaaggacagcattaatggtgattttcaagttcctatatgtattttcagaatcagacttgagaaataaagacattttaccgctactgctttcaaagctttaattctgactgctctaaaattctgcaaacatctttgtccatagaacttcctattaacagtattgtagtcctggggaaaggtaggtttattatttttcacactgaaatacaaatacaataaaatgtaccaactctaagtacatcagttcaatgagttttgacaattacataaatctgtgtaaccacaatccaaaaaagatataggacatttctatcatcctagagaattctatcgtacctctttccagttaattttctcccaaaggtaacaaatttctgatttgtacttttattgattagttttgactgttcttgaacttcatataatatgcactcttttattgtctggattctttcctgcaacacgtttgagattaacccatgttgtggatgtatgtgtcagcagttcatttgtgttgttgttgttgttgctgagttgtgtccaattgtcggggatatgaaacaatttgtttattgattctcctattaatggacatttgatttatttcccgactttgactattatgaatgtatttgtacaagtctcactgtgttcaaatgtattcatttctcttgagtaaatacccaagaggaaagttttgagtaataacatagatacatattgaaccattttaagaaacatccaagtcgttatacaaagcacacataccattttatatttccaccaggaatgtgtgtgacagttgcttccttggtcttgacagccttagctttttcccaagacattctagtgggccaagctgttcttatctttttttttttttctctttcttttgtattaatcaaatatttttattattttactttatcttttatattgacttactagctatacctttttgtatgttttttcaatgtgcatctctaacttattacagtctatcttcaaatgataatatacgaattcacaatgtaagactttataaggatatcatttcacttattccttcttgtattatgtgtccctcttgtcatacactttatttccacatgctttcactgccacaatacattgttattattttgctttaaacagttgatggtctttttttaaaaataaatatgtatgtctgggtatatatcttaaaaattttttaaagttttaaaaataaatatcagatgtttatgctctctgaagctctcttcatttctgtgtgctgacaggagcttctatgtgtatcatttcctatcaagctgaagaaattcttgtagtttaggtttgttggagacctctcagtctttatttgtttgaaaatgtctttatttcataatcatttttgacaaatagttttgctggataagaattcttatccttatatatggacaatttttctttgttgttttgttttcctttgcttcttaaaaccagagctttaaagatcttattctttgttctgacctctactgtttctaatgaaaaagcagaaacaacacagctcccatttgtattgctgttcccctgcatgtaatgctccttctgtttttttctagctgcttttaactttctttttatcttactttttagaagtttgatcataatgtgcctagatgtagtttgctttgtatttatttatctttcttgagttggtaagctttttttttattattatactttaagttttagggtacatgtacacgatgtgcaggtttttaaattaattggttcataccttccatcaattttggaaaattatcaattgtctatttatctatcatccgtctgtctgtctgtctgtctgtctgtctgtctgtctatctatctatctatctgcaaaattttctggcctattctctctctctctttctgatcctgccatgagatctctgttggactatttaatattattccacagacacgggatgctccctttcaggtgttttatttttcctttccttttctctttgtgtttcattttagaccatttctatggacctatcttgagtttcactaatcctccgatgtgctcactactgtcaaacctattgactgaatttgtcatttctgataagagtatgttttttccttgagaccatcctggctaatacggtgaaaccccgtctctactaaaagtacaaaaaattagccaggcatagtggcgggcgcctgtagtcccagctactcgggaggccgaggcaggagaatggcatgaacccgggaggcggagcttgcaatgagccgagatcctgccactgcactacagcctgggcgacagagctagactccgtctcaaaaaaaaaaaaaaaaaaaaaaaaagagtatgttttttcctttctagtatttccatttttaaaatagttttcatctctctgtttatatttagaggaaaaggtaaacacctgagtgaactgatggaggtttacatatttgtcattgttattttattttattaattaattatttttttctgagatggagtctcactctgtcacccaggctggagtgcagtggcgcaatctccgctaattgcagcatccgcctcccaggctcaagcgattcttatgccttagccccgccaagtagcggggaccacaggtgtgcaccaccacgcctggctaatttttgtatttttagtagagatggggtttcaccacgttagtcaggctggtctcggactcctggcctgaagtgatctgcctgcctcagcctcccaaagtgctgggattacaggcatgagccactgtgcctggccagttattttaaagtctttccctgagaatcccaacatctaggtcatctctgtgtttactctgtttctccgctgaccacgtgtcatattttcttttgtgtgtgtgtgtttctcataactttttattgtgtgctgaacgtttttgtagaagaacaatagagaatgaagtaaagaatattcacccacagagaagagcttctatctctgtcaggccccttgttggatgctaagtcagactaatccacagttgagctgggtccgggctaggcggcaactttaatttgattcagttcacaactggtttcaaatgtttggagggcacaatcaggactttctcttcctccaggacggaggttctaatgctggggagattctagggatcccctttatggtttcccatgaagctgccagatgttggagctttcagagattcctttgctgcttttgacgttgctgagcattcgacgtctttgcttttcagcgccacctctggctttctgcacctcagatttctctctgcccttctgccgagcttccactgttgcaggactattgtacttactaatgtacagggtgggtgggtaggttcttattttattgtgactcaaaaattttattttgcttgctttattatgatgttcttaatatgtgataaataagagaaagtgatacaagaagacagcagtgtctagaataaggaagacaagagtaaatctgaaaaatgagtccctagattcatttccacccatctccagcaccttgttgctccagaccctccctggggctcatagtttcaacctttctctctttttacattgcttcctctctgcctagaaatatattactctcttgttccaaataaatctctctctttgtgtgtgtgtgtgtgtgtgtgtgtatgtgtgtgtgtgtgtgtgtgtgtgtgtgtgagtgacagagtcttaactctgttgcccaggctagagggcagtggtgccatctcagctcactgcagcttccgcctcccaggttcaagtgattcacctgcctcagcctcctgagtagctgggattataggcacgcaccaccacacctggctaatttttgtatttttagtagagacggggtttcaccgtgttggccaggctggtctcaaactcctgacctcaggtgatccacctgccttggcctccctaagtgctgggattacaggcgtgacctaccacgtctggccccaaataaatctcttgaactatatctgctgtagttaccgtccaatctgtctctttcacctccccaaagaggagtctttacttcttcagcctctgcctgctcctcagcacacgacagtctgacttctgcccccaccagatcaggtctccataacaggtggctcttgagactaccccacaagacgaggtcttgtttctgcctgagacttctgaagaccaacttcagggggcagccacccttttgccctgccaagcccaagcacaggagatagacagcaataataccaagggtatcttgggctacatgtttcctcataaaagggccagatagcctgtaatgggaggaagccccactgctccagcagctcagatgcttgtgaggagggctggacctgttgataacttggagggggagctctggtctgtgctttgcttacacctaggtggccttccctctctgtctctccctgaaaagaacatgggcctattccaggaggctggcatggtccctgcgggatcagctggagggaggatgagacccactctcctgcttggggcttacgtccacctcactacagctgctggtgcttgtactttccacttgctgtgtacaaaggctggatgcaaatatgaaatgttaagagtaaacatataaagttggccagtcacagtggcttatgcctgtagtcccagcacttcgggaggccaaggcaggagaactgcttgaggccaggagtttgagaccagcctgggtaatagagtgagaccctgtctatattttaaaatagataatataaaaattatatagggagagatagatcatataaaattagatacacatgtatactttttttaagttaggcaaaaaagttagaaagataaaatggtgagtaaaattgtataatgaaattaatcaggccgggcgcagtggctcacacctgtaatcccagcactttcggaggccaaggcgggcagatcacttgaggtcaagagttcaagaacagcctggccaacatggtgaaaccccatctcaactaaaaatacaaaaaaaaaagattagccaggcttggtggtgagtgcctgtaatcccagctgctcagggggctgaggcaggagaattgattgaacctgggagatggaagttgtggtgagtcaagatcgtgctgctgcactccagcctagatgacaaagcaagacttcctctcaaaaaaaaaaaagagagaaaaaagaatttaatcatgtgacaaaataaaagttaaggctaagatgaccaaatggtggaaaaattgaaactactttttatgttgaacactatgagatgggctcaatacaagttcattgactgttcattcacaagcctggccccacgagagctctcatttccttcactgactctgacttgatctaattcaggattcatgtcctacaaacttctaggctggtgcgaaaggcgatcttggttattttgaagactcaacccactctgcctccaggtcctgacaaggctctgggactgtcttcaatgccacggacggggataaggggagtaaggtgggaggggtagtcattataattttctttttacagtggcccccttcagttgtagggctctctactgaccctgggccactgtgggataagggtctctttgttgaagctgggagccctgtccttggatcctgtctatctggacaccttcagaccattcccctcagctcccactgcccctgtgggccctgcttttacaggacccagaggtttctttctttctttctttttcatagacaaggccttgctctgtcacctagactagagtgcagtgatgtgatcacagctcactgcagcctcaaaacctcctggggttaaatgatcctcccccctcagcctcccaagtagctaagactaaaggcacaccccaccatgcctggctaatttttaaattatctgtagagacagggtctcactatgttgcctagactggtctcaaattcctggggtcaagtgatcctcctaccttggcctcccaaagcggtgtgattacaggtgtgagctgctgcacctgactgaaaggcctcttaatatcaatccctttctgcctttatccttcaagacttccttccacctggtgtcgccttcagagttgccccacctaaccccttcagtggtcttggacctctagaaacaacacccaggacagaaaatgttttgttggcagcttttttctctctggccatagatgggtcaagaaacacagagtttatcatctgcttaaaagggttggggtcaggggtgggaggaaagaacgggtaaataagggagaaggaatctatattaatcttttcaaatattctccagctgtgtgcattatggtccatataatagcagatggtcattaaagctaataacacgggaagatgttcacgatttataaactgtaaagagcaggtcaaatgagtatatggaccatgagggcatttctgatatctataaatatatgcagacagaaatgatagggaggaaaaccactcattttctataagtaataggagaacagattcatcttcctttttgatgtatctgtgtgtgtgtttttttttaacttttccatagtgaacctgctttagttgtgtgagcaaacagaacaaatgagaacagctagacagatatattagggatcaaagagaaaatagccttacgatattcagtctctttcttctgtgccccccacacagtctttttaggaaaagatgcaggaggctgggcctggctggcagaatggctgtccccaacggacctatgtcctgtgggcccaccaaggctctgggcacttgcatagatgatttctgcctactttggaaaacatctctgcacccctgagactctgcagtgaggttttccctgtgcacaaggcccggtggggtgtgagtgggagtagactccgtctcccccagtggtgaggacttatgcgctgagtcagctgaattgtaaaaaataaatgtgtggcagccagcatttggcttcatgcatgtttaaaatcagcctgtggctagcctttgccacctgggcagtgagcttgcttggggcttgcagcaggaagcctgctacacagctactcctccacttcacctggtgatctcaaaaagctacgcagggaagcaccagctcctgcccagcaaacacccttttttctgctaaaaacaaaatgagcgctggaaatcataggcaaatctttcttatgctgtgccttggagcaggagctacgaatgagtggaatccatccaccttccagacgccttagctatctgcaatgcccccctcaggagacaaagcccacgcagtccctctctttggacgtccactcatttgcctgcagctccatcaaattcagctccccagattacatttcaaatgatggagcatttcagagtgctctctgcaaactgaaccaggctttgtaaatgtgagagaagattgtggttgacatccatcattcagggggtgcattaccaatttccaagattctctgtgtttcagttgaatgttgtgctgctgtgctgcaccctggcctctgaccacagacatcatggcccgtgggaagttctgatgggaaatatttcacccagaaatgtcggggcctctgcagcctttatcttggagaaaagtgcaaagagggcagcagctcacttgtagtttgtgtttatagtttaggacatctgtgatctctcagcattgattccttttactttaaatcctgtcctatgcctaatgagtcattttcaagcagaaatctgcacagtgtgtgatatggttgcccactgtataataaccatgggttagagtctaggaatcattgtagctttaaggtctttgttaagaatgcaaaaacggaaatgaaaattaactccatagtagggcagctggtctcagcaaattcagttgttaaaaagaaagaagtggattcataatggattcctcagtcagccgggaatttaacaattacttctggaatgtttaagattgagaatttctgcagattttcaaaggaagttctgatagttatatcatgggctccactttatacatcactctgagttcaccctgggtaagtaagcatggtgtctacagttctgtgtatgagatggtccagatacgatcttctgccccaccagtttttgacaggactccctggagcagctagaatctgtgagaataaactgagcatcaccagactacatttttactgcagtcacactaggtctggctatataggtaaagaaagcattcaggtgtcttcatgtgttcagaacaagggcccccatcttgggcaaattccaggctctcacattcttcatacgtcccaccatacatttagcatcttttcttggaacttgatttgttaagttccaaatttcaggtgctcaacctgtgcccattgaaaatcacgtggtaaatttaaaacagcttattttctaacatagctttgggcctgccagagcccattatgattctgcttgtggctacaccaactcatattacagatcaagtcattttcaccaaagcactccttgtacaatcagagggaatggtggcacacagctgcctgggaagggcttagccatcatcttaatattatgggctgttggtagcagatcactctactgagccacagataagatcattttagtgacatttgtggtaaacatcctctcgtgggtgacaagcctcaaatcaaacctatcacttagtctgatgaaggcaggacaaagcagtggggaagagaacacattaaaacaggcattcagtgatgagcttgtaaaggtcaagaaacctaggacaatgagaagggagtgctggcaatgatgggctggctggggacacttgctgttttgcaaactgattactcagaggcattagtgatgcagaatgcctaccaagcaacttctgaaatagcaaaagccccttcctggtcatataccactaaggggatttttttttcgcctattagaggcaattgaattaatgtttccatttggggtaggacaaaggagagagaatgagaaacaatcagatagaacctatttgacttttttcataaaattgtttctattttgcagtttatgaccaaaggaaaaaatatatatgtccttaatgtgtctagcaagaaaataaatccagtacagaaattttttaaactttctgaaatcagtttccagagggtgattttaacaaagcaacaacaataataataataatagtccacttagtaccttgaggacctaaatgagctaatacatgcagaatgctttattaaactctaaaacaccattagaatgtgaaggcatcttactaagccagaggcatgccttcttcttcaacgtgcttcggtgtatactaagaaacaagcaaaaggtttttatgtttttcaagaaagtacactggcgtttctgcacaggcagtttatatttgtgtgtttgtttcctgaacacagaacttcactctgacatgactctagtggttaattccaagtcactcccacacgggtagaaaatcacagagcactggcctccgtctttgggtttcatgagcaggtgactgtgtccgcgtatagcagcggttttcaaccaggaacaaatttgtccacggggacacagcaagatctggagacatctttcatggccacagcttgggggtgggggtgctactggcatggagtgggcagaggctaggggtgctgctaaacaacctactttgcaaagggcacccccacaacatggagttatccagtccaaagtgtcaatagtgccaagatgaagaaaccctatcttaaaacatgaagttttttattccagtcaccggcctcacaaagaagcagagcacaggaggatcaaacctcacctgagagcagcctggttcactgtgctgtgacagagtaagagccaagaacaatgttgtggggaaaaacaaacacgaagatcaataagagcccttcagctgacaggtgtgacaagccaagccagccagcagggagtgagaaggcaccaacattacttaagagagatgccagcttcagaggaatagatgtgcacagggagcttattgtggccaagaaggccctctgagccggagggcacagcattccctgagctgggggaacaatcattggcatgtggcacaaagtggaagggggtgagatgtcaaaaagccaaaatgggggcagagagtggatattcccttttaatagagtatctgatgcattcgcaggaagaagaggagactatttcaaaagaaagaagttacagtcagcgtagcaagttctgcattttagggctaaaaatatttcttctaggagaagctgcaaagttcatcaaagggggaagttgtaggcatgaagtactgtagagatacctcagcagctgtggaatctcagctgaatcttgaaataatagtaagttttacaaaggagaatgttgaatgtgatcttcagtcactcatttgataaataacgtttatccatctcctgagcctcaatatcctcatttataaggtggagagtgttggacgatttgattcagaaaacctgttgtgagcatcgaccttatacaaaggaggttatgaaggatgcataaacaagttagaccctctctctgcacttaccgggcttaaatctacatgatcttaaagatcccagctcctaaaagtccctggggaagtaaaactcccttatgattctatggtaaaacactctaggcaatttggaattcattagttcagatgtttagtccttaagaaattggaaatctagaacttgcaaaaaggggaagaaatggcaatccaaatccaatagtaatagagagtgaaataacgaatgtcgaccaacagaaagcaaagaataggctgttattgttgcaagagtgatgtgcaaagtgatgtgcagacagatcccattgttaagagctcagacattcaaggtactgcacccagcagccctcagtgaaatgttcccttatgtagcaaaaggtctgtgcaatcaccacacagaatcggatggttggtctgaaactgtaatcacctgtcaagatggaaaggacttatttattcttttaactttggcttttgccctctgagctgtaaggtctgtgtactcttccaactattcctagagcctgaaagccaatgtcagtgaaaaagataatgggaatttagcatcagaaatgagtgaacgacgttgggagctcctgtttttgttaaaacaaggtgaatcacaggtggtccaggagacctgcagtcaatccccttgataggcctcttagcactcatcacaagattggtgagttttcccttctatgagagacaaattgaaatagtaaattgtgaccattgtctagatcttaagtaagtctcgccaggacctgtgaatacctttctctgaagtataaatttctcattattctaccaaagacttgtgacgtttctatgagaaatctttgcccctaaattgagccagttgtttgccaggaaaaatagagcaggacttttcttttaagtgccttcaatgaagtaatgaagttgtctttacgtcatgctggccaggagcaccataaccctttgtccattctctaaaaaggtgaatcagcccaattcttctgggccatgtaaaaaaattgacctgactagcaaagggctggaacctttgcaactgtctctagaagttcaattatatagtgtttatttaaaaaacaaagagcagcagaataatcctttgccagttctctaggtttcctagtgccatggaacttccttctccttgcatgtttaaaaagaaaagaaaaaaagtaaactcacctccgggaaggaagtcagctctgattttatcaagtgcctgatacaagagataaaaattcaaagcttctttaggctgggatttccaaaggcctgggtcagggccttaacacccttgaacctcctcccctttgctccatcatagtgtctgcacatagaagatgcagaatgcattgaggggtttttttgtttggtttggtttggtttggtttagtttggtttggtgtggtttggtgtggtttggttcggttttaataataggaaatgtctggggaaagggatgaaagcctgtagagaaaatagttgtctgttatccatactaggtacatagtgaaaagccatgagataacgtgttatatgtggaaaacttcaagtctctaggaagtgtctaaagaaggattgagtgatgtgtcatgatttctaatgacagttggtcagataatgatttatttcaattgtagattttaatatgtctctgtaagactcttctcccaaccggagtaacactagaaggcctttaaggttccttataactctgggattttatggttgttcaaggcctgataattaatgtgaagtttacagtgatgtttaatgaaagcgaatatgttttaaattccatctacaaattatataaatattaaaacaaataccaagatagaagacttaaagacagtcatatcaaaaattatattaaatgcaaatggctaagcattctagttaaaaagcagagatcatcaagtggatttaaaaaaataaattacatgttgatgacaagaaacatatttcaattacgtctaagtttgaaaatatgttacgcaaacactaagcattagaaagctggtgtggctatattaatatcatataaagtagactttaaaaaaacagtattggcagacataaagaagaacatttcttactgctaagagaatcaactcttcaagatcaaatgaaagctctcactgaagcaagatgactgagtgggaactcttcagtgaattccaaagcaaacagcatttttaagcacaatgcattagaacgaatatatattcaattgcttaatcttgaaagtgaatttgcactgtctgtaattcttatatgactagacgacatattgtcttggtaacaaggaattctttcaacaaaagagtataaataagcaaagaatgttttttagttcatttcactctgaatgtgacccctatgatagatataaaccaaaaataaaattttaagtcccacgaccaactgagtggaccccccccttttagccagaggacccaactaaacctggaaaactagttcagatcatgccaggaagaagagtggtcagacatacctcaattactctcttcccttgtggttaagacacacaactgaccagcattaacattaaaacacaggtcctaaaactgacagaacagactttttgtaacaataagataccaaattccaacctgactctagtatagcatcacatgatagtgggaccttgaaagaaaccaaagtattttactccaaaatatatttctttgacatattttgaaatggccctgccaagctgtttcttgtggaggaaatttacattctgtagagaatccccgttccttaccaggcccttttctaatcctgaggagattagctgagagcctagcactttttaaaggtctgaataggaaacacttgctatctattgcctctgggcgtggccacctttgagaattcatctacataataagaaccctgatctccacaactccttattttaacccagacacttctttctattgattccaggtctttagataataactcttttgaccaattgccaatcagaaaatctttgaatctgcctatgacctgtaacctccccccaacccccgctttgagttgtcccacctcatttgtattgattgatgtcttaggtttctctaaaatatataaaataaggctataacacaattgcctttggcacatgttctcaggacctcctgaggctgaggctgtgttacaggttgtgatccataaccttggcaaaataaacttctaaattgattgagatctgtctcagacactttttggtttacatagagaagtaaataattgaaatgaatgaactattgctcatctcagaaggaagactttgatttagtctctgtgtgtggtagaggagatgggttctccctgcagtctagagatacttaaagaggcagaaaatatcagagagaaagaattccctctccctaatccaaacatggaagatgagaataagcagaatgcacttaggggattgctcaaatctgatattttccagcctaatttatatgattttatggaggattaatagacatttttctcaaaaaaagaaagttaatgaagttttctagaacaacaacaaaacccagagtagctaaggtagaaaagaatgcagcccaggaggagattctaatagacccacacaggcaggacaagtgagagctcaggacagagaatgcagaagcagaagagagagatggaaccttagagctaaggagaaagcagagaaagtgaaagtgtcagaaggtgaaagaggttctaagagagaaaaggctagtcatggtcaaagttaggcagggagcatgagaccacagtctgaccacatttacaagaaacttcaaagccttcaccagctcaggattgatgaggaaaataaaggagtggtatgacccagtggaaaaaaaacccagactgacacctaaacccaagtgtcaccaggtatattggcttcctgtgactattgtaacaaatgaccacaaactggtttaagacaacagaaatatattctgtcctagttctggaggccagaagtcccaaatcaatgtattggtaaccttggttccatttggaggtggaatccattccatacctctctcctaacgtctgaaggctgtcagcaatctttggcgttctttcctttacaaatgtacctccctaatctctgcctttatcttcatatggtcctcttctctgtccctctgtattgcaaatattcctctcccatctcttataaggatgccaggcattgggttcaaggcccacccgaaatctaagatgatctcattttgagatccttattttaattatatctgcaaagaccctttttcagaataagatcataattcgaaattccatgaatttggatggttgaggggatattattcaatccaccataccaattaactccaaggtgaaaggaattgatccaaactacattacactccaggggtctcaaatttgaaggtgcatgtgatcatctggggattcagcagctctgggaggtagctgacaatctgcacttctacaggttctcaggatgccagtgcttctggtctggaccataccgagtagcaaagatttagttgtctatgtggaaaggtatacaattagttggctttgcttaacataactcccagtagagctggtatggccacagggtgtttggaaaacaatttaaaatgcttatgggtgaaaagtaagaaataaagataaatctgagtgtgagccaaactgttttccctgggtgagaaacagcaggtggggagacagctgtgtgatctctgctgtgcccttcaatcttcctaaaaattactagactgacacacaccttttgctagtgagtcacatggaaagcttgaaagcacagagttttgagaccagattggtgtagagaggaacaaatgtctatgaggcaaaagtccctgagagtttgcagaaattgagagagaggaggtattagggctcatgtgatttgtgatattgaaggcttaaacctttaataagtaaaagaaatatctgagaaggaggaaagcatctgcggtatctaggtaatatctgctaagatcccacagaaatggccctctgtgtggcagaatataggcaattctgcctctagcttcatcacagtttagagtcttttatctgtaagtcagaaaagaggtagcatgaaaacatggactttaagtagtcatttgaaagaatggactttgtagtggacagtgtagcttgagtctcaatattacaaaatatttcaaaatcaatatcccatctcaattatcagaagggatattgcagtcacctagccaatttttagacttggttcaatccaagaaatcttacaaaattaattttccttcttaaaataaagcacttttcacagagaaggttgtggggtagggaaatgaggggttgattgtcgaaatgataacactaaaggcctcattttactctggcgatgttgaacttcaactgagcttgttatcctggaaaatggtgacaattaagaaagctactccccctgcccaattcccttatgctctggaactggcctactgcagggaaccatccttccccatatgacttaggcaaaaatcatggatgacccccttgttcacccatggcaaagccaggcagacaccctgcagattttcattctttggccccgtaaatgattagctgaactgtctgtgatcaatccagacaaaatctttgcaaaccaatctttggtgaagattctctccttgccccagatccctgaattttgacctcctcttagcctgagccagcacacatctccccactaatggactctcccaaggaatagactgacctctgggtaagacattctgtgatccactgaccaattatgtcagccttacatcccccttcccacacttggctctttccagatttgcttactcctccctaggaaaggaaagccctttactggctgaccttggagatgcttgtagatgtcgtggtcagagcattttctctattgcaatggtcccctgatcctcctgttatgccctttgctgtaatccttccaataaagtttctccttatacagatccggattttttttttttcacagcaagagaaataaagggaaacttgtgcatgggtcattgtttccctaatgattttgagttagttaagtcagtgcaatctttctccccctgggttcctgaaatgagcctttgatcctaatccaagagccccctgaggttagcggtggcaaagtcaagagagcatggagctggaaggcaggacacctggtctgtgttcccacatccaccaattacaagaaactgtgtggctgtgggcaagtcccaaggcatccgggacctcagcagtaataataccttaaagaaaatcttgagtcttttctttcagttctgacagctgtaacgttgggattgactggagttttctgaccagtaataccctgaactctaacagcagttttggtccgaatctttcacctagagtcatatcaataagttctgctgctgtttaactgttctctgtgtggtggtgtgtgcatgagtgtgtgtgtgtgtgtgtgtgtgtgtgtgtgtgtgtgtgtgtgtgtgtctttgcctatgtgtgtatgtgatggccttaggaggccggaagtgtctatggtgttctgaacggtgcatttgattttccttcttccagccaaagccttcagctaagttgatttgctttcttctggctcctttgcttatggtgatgaatagatatgggtgtgttacataaccatatccactattaatgtggatctatagtgaagttctctatgattttcccagtgtgcttagtgtgtgagaagcttctatttttcttatttacatcccaacattgtccacaaagtgtctacacatatttcagtgaaatgtcagagcaaaagcctcttttaagcaaaagagataaaatgaccaggccaactagtttttaaaatgtaggttttccagtttaatttaatgtaatttattttttagtacaggaaccttcagacaaacaaattcatctgttggggcctgtcaggatcacagaacagaagacagtatcacctctttgcctatgaggcacaagtctctgagagtttgcaggtatttggagagaggaggggcccattgcatcaggggcccattacaatagagaaaattgggacagggttgaagggtgggaatagtcctcatcttgcctctcacaccctccatggctcccaaggggccaccatagtgtgaccattgctgctctaggccagtcactcattttggcagggaagctgaaactcagacaaagtttctcatccatggccatgcagccggtgaggacagggctggggttctcggccttggacaacctccctccctccaaggaactcccaccttcgctcagctcacctttgtcacatggtccccccaccccccgccccactggaaattagtaaaatagtagttatttccagggatgttttccttatgtgggctcccaacctcattcccttttggactgaattattctggaaggaaagaatgaagggagggagggagggagggagagaggcaagaaagccaatcagtcagccaaaaattcagctatctgtggctcccgaacatttttaagttaagaaatatgacagtggtgcttgctatctgctgattgacattatacattatttattttagggcagagcagtcagttttaaagctggagttttgttttagagaaaataaatcctgtttcaaaattatcatgacctgtccaaaaaataccagagcctagatatgtaagaatctgaatacaaatttgagctctaaatgacatcattagtagtgtaaccctgcaggccaccattaattggtggcaagacatacatcactgacaggagattatgaagtgaagaaaaggcaaatattttgcagcccagtggattaaagaaatctatcaggctgacgtaatgctgtgctcaagagagatcagaagccctaactatttaagcttctcgtatttggctcaaatgtgctggttttacaaaatggtcacacaaaattcactattgcttccaaaacccgattctccatcagcttcttggtgcttcctgcttcccatgtagttagtttgggaccttggaaccagtgtcagccaatgggctctcacaggaaatggcaggtgttacttccgatctgaggcattgaagagcatgagtctccgtgccctctcttcctgaggtgctctggaagttctgcgtaagtgaagaccacagagataaagtgccattagggttcaatctatcaacatgacttctcactgtagatgttgatgtggtttgcctggctgagaaatgtttatcaggttcctcaacagttgagttacttaggttactgtttttctccctccctttccatgttctgtgctttgaaaggaaatcactagattccgtccacaattaaggactgagcagttttatttctcaaaggtggagcaaccacataaattacttggagttcttcttcatgggaaatttctctcttctccctcaattatttattaattcgatcatttatttgtgtcagtatagacttgtgaatatttatgtaatactttgggctataatctaatactgtcttatttatgtagctagttttgctaaaattcttagctttagccattgagagctctttcagttggcttctgtgtccctttgacataccccttaattgtggggtgttttgtttgtttttgagcttttccctacattttggcatgataagagatgttccaggctcatctcgtctatttactgcctcagtcctaccatcagcatttctccatggagccctggttcctttaattgaagaatagttttagaatccaagatctggccaggcgcggtggctcatgcctgtaaatctcagcactttgggaggtcgaggccggcagatcacaaggtcaggagatcgagaccatcctggctaacacggtgaaaccccgtttctactaaaaatacaaaaaattagccgggcgtgatggcgggcgcctgtagtcccagctactccggaggctgaggcaggagaatggcgtgaacccgggaggtggagcttgcagtgagccgagatcgcgccactgcactccagcctgggcgacagagcgagatttcgtttcaaaaaaaaaaaaaagaatccaagatctggagttaggtatgtgatatggggtttggctctgtatccccacccaaatctcaccttcaattgtgataatccccacgtgtcatgggagggacctggtgggaggtaactgaatcatggggccagtttttcccgtgctgtcttgtgatagtgaataagtctcacaagatctgatggtttgataaaggggaggtctcctgcacaagctctctcttgctttctgccctgtaagatgtaacttgctcctattcaccttccaccatgattgtgaggcctccccagccatgtggaactgggagtcaattaaacctctttcctttataaattacccagtcttggtgtgtttttattagcaacgtgagaacggactaatacaacatgcttgttgctactgaggtatcattgcttctagactctgtcagctaacagagcagggaaacatctacatgtatgtaacccatgagtatatacatatagtatctataatatttctatgtaatgcttctttagttttaattgtttggttttaaaaaataacttgctgaaatggatgtttaaattcttgattttaaaactttatctttttaatgtctgtattaagggttatgaaatctctaagcataccattagctgtatcctacacattttatatgcatgtttaattactataccatacaaaatactttataatttttattgtgatttcttctgtgacccatgggctatttagaattacatttttcaattttctaatgtatgcagcttttatagttatgtattttataattaatttatagttttatagcttaattgtattaaattgtattatactcagagaacatactcaatgattgcaatcatttgaaattgttagatatttgctttatgatacaacttattgtcaattttggtaaacattttgtgtgtgcttgaaaacaaatatgcattctgtggttcttcaatgcagtgttctatgtgtgcatattaatcttgttttccaaagatgttattgaaatattctaaattcttactgaatttttatctgcttgttctatttgttatcaacagttatattaatttctctcttgtaagggtgggcttgtctttttctctgtggctctgtcaagttttgcattatattttgtgagactgtgctattaggtatatgcaaattgtgaatagttatagcttcctgatgaattgaagcataatattacaaaatgtcttttttgtcatttgtaatgctttttggtcttaaagtttgccttatctgatatgaatatagttttctttttatagtgtttgaattgcatatcttttattttcattcttttcgtcaacttatattttatttgttcacacatttttatatttcatttgcttacccattactgagcttttctcctttcctattctgacagtatttttcttttaatcgggtcatttacccatttatataaaatatatttaggtttaaccctaccatcttattcaatgctatttgtcctgtctgttttatgttctcttttctctcctttctcactttcttttagattaattgggaatttttattattccatcttccccctttttagcttccatattacacacctttaaacaattcttttaatgtatatcctagaattacagaccgtgggacaaattcagcccatcacctgttcttgtatggcctataagaatatctcatggcatctgaaaatttaattaaattcaaacgtcattgcttataagtaaagttttattagaacttttgttgtcttttacaactgcataatctgtatatatcaaagattttccagaacaggaaactaaagcacaatatagaaaataattgaatagaaattataaaaattctgataggcttgtacaaatcctaatttcagatatttctattaatcaaatgatcttttttgttccattgatcacccttataataaatgatgttatgcattatacattatacattaaatattgcatactaattatgttactttaatacataaacatgtgccaaaaaactccactttagtttttgagtttcaggagattaattttgaaaataggatttacatgctcaaaagtatgcaaatgaatagatgaatctaaccaactaacttgagctaaagaaaaaaaatgatgttgatttcatatgttagcactccaaataacccatgaacactgtattgtaagccttcctgggccttaacccaaaacaaacatggatacgaatttcaagataatttggggtgtattcagcaatccttaaagcagagtaacttgtgggtcagatacactttgcctttacattgtgttaagtcttcctgtgtttgttgccagcatgtttaaattgggatgttttatatggaacaaaatctacatttctgccttctcttagaacacgggcagaagtgagccagcatatctcacatagcaatactgggttgaagcttagtagatgttgtcctctgtattgggtcttagggctgccatagcaaagtaccacaaactgggtggtttaaataacagaaatgtatcatctcagctctggaggctagaagtcccagatcaacatgttggcagagctggttcctcccgctggctgtgagggagaatctggtctatgcctctctcctagcttctgatgctttcctggcaatccttggaattccttggcttgtagttgcatcccgtcaacctttgcattcatggttcacctggcattatccctgtgtgcatgcctgtgtccacatttcccccttttattttattttttatttatttttgagatggagtctcactctgttgtccaggctggagtgcatcggtgcagtctcggctcactgcaccctccacctcctgggttcaagtgattcttctgcctcaacctcctgagtaggtgggattgtaggcatgtgccaccatgcctggctaatttttgtattcttagtagagacagggtttccccatgttggccaggctggtctcggactcctgacttcaagtgatctgcctgctttggcctcccaaagtgcgggaattagaggcgtgaaccaccttgcctggcctacatttcccctttttataaggacaccagtcatattggctaaggagtccacccccctctaccatgacctcatcataagtaattacatttgcaacaaccctattttctttttttttatttttttattttttatttttattttttattattatactttaagttttagggtacatgtgcacaatgtgcaagtttgttacatatgtatacatgtgccatgttggtgtgctgcacccattaactcgtcatttagcattaggtatatctcctaatgctatccctcccccctccccccaccccacaacagtccccggtgtgtgatgttccccttcctgtgtccatatcttctcattgttcaattcccacctatgagtgagaacatgcggtgtttggttttttgtccttgcgatagtttgctgagaatgatggtttccagtttcatccatgtccctgcaaaggacatgaactcttcattttttatggctgcatagtattccatggtgtatatgtgccacattttcttaatccagtctatcgttgttggacatttgggttggttgcaagtctttgctattgtgaatagtgccgcaataaacatacgtgtgcatgtgtctttacagcagcatgatttataatcctttgggtatatacccagtaatgggatggctgggtcaaatggtatttctagttctagatccctgaggaatcgccacactgatttccacaatggttgaactagtttacagtcccaccaacagtgtaaaagtgttcctatttctccacatcctctctagcacctgttgtttcctgactttttaatgatcgccattctaactggtgtgagatggtatctcactgtggttttgatttgcatttctctgatggccagtgatgaggagcattttttcatgtgtttttttggctgcataaatgtcttcttttgagaagtgtctgttcatatcctttgcccactttttgatggggtgcaacaaccctattttcaaataaagccacattcttaggtattgggaatgagaacttcaacatataaatttgaattgacacaattcaatccttaacaccccttttagaagggacatgcattccctcattccccacaattgccatttgatagagtattcattcctggcccactaagatatttaagtttgtgatccttgtcctaaatcccataggcttaggaggctgtatacctgacaggtagacctaaatattaggaaatcataagatcataggatgtcagagaagggaagaacctctgagattaactgttgtcaccctcttgccctattgcagaggggcaaatctaaaaaatgctctcactggtcttttccaaaatcgttcccgtaatagtacctaagattcttattatttacctaagattaaaaaaatccattgcatcaaatttatttgaaaagggagataagtttgacaaaactgtcttttcagttccacaacacggcatacaaatccctttccttataacttttctcagaaactggcttgtggaatttggtttatcctgtagggccttagtattattttttgtttgtttgtttattagagtttttgcactggatgctctgttccttagaaaataaagaggctttccaagtaaatagggccattgtgtacaaattagagttcaggaaggatgcttctcaatggttcagctgtttcataggctacttaacatacagcatgggtaaacatgagttcccatgtacaaagggtttttctaaatttatagcttccaaacagccattaattttgctgccatatgggtcacaagaggcaggctgataaatctttcatccgcagtggattatgttttcccatatgtatgtttattttcagaatccatgtgtatttcagctagggtgcagctgatcttctacaaaaactctgcaagttcataagaaggaatcaataatatactgtacccgcctgctcttgataaactctgactccttaggtattcagaagagaatccagggagatcctgattctgcatatcatcccatattacaaatgactataaaagttggtgaataataatgcttgacctttaagaagccagcagttttcaaccaagtcagtcaatagtgacgaggccttaatccaaagccattatgaaactccaatattccccccaacctcagaagtttgtctttttattctagaactacattgggagtaaatgatttttcatcattatttaataatagcctaaatcactgccttaaggtatttgccaatttagatctgttacatggtaaatattaaatcacatagttttctgctcaacatattcatcactgactataatttgcatggcataacttgaatgtaatttcaaataatttggtacaataaatataatgagaattagattatacctgcctaaaggacagcacgattcatataattgctaatgtactgattcttccatgtattttgacattcatattaggtggctctctttttttgttattaataatgaatttaaaatggcttgcagttcaaatttgatagttttccaagtgctttcatgttctttgtttcaagatttttcaaaatgaataggaactgtaggaaatagtttatgttatttccattgtctagaagaatctgaggatcaagccagttagtgacttgtctatgggatacaatctataaggacagagctgggctcaggcttaggttttgtgccaagtgcaatgttctttcttctttttttttttttttttttttttttttttgagagggagtctcgctctgtcgcccaggctggagtgcagtggcgcgatctcgactcactgcaagctccgcctcccgggttcacgccattctcctgcctcagcctcccgtgtagctgggactacaggcgcgcgccaccacgcccggctaatttttgtatttttagtagagacggggtttcaccgtgttagccaggatggtctcgatctcctgacatgttctttcttctatactttgttgcttctgaaaatattgtgcttgggtatttgttttttaccctgtagttttaacaagccccactcgaaagcactctaaaaccctggcatgcactgtgtttgcagtccctgttgtactgtttcaaagtaacccattctattgtgtgctgagatttactctatgataactctaactcatacaaactagtagctgggatattacctccaagggccactggtcgccaaagacttatgtactctgtccttgatcaagctgagagtttgatattgagttccagtgagaaagaagctaccctttctttatctgtagctcaggacacttccaaattgtcttgctcatctctgtacctttcctctgcagcttcttcaaaaggataaattaaattcctgcaagaacatctttaaataaactatacttgtattggcacccttgcatttatgtagaaattaaaggaagacatatttttattacaaaaataacttcttaataatagctgggtatgaactaattgctttcaaggctttgcacatggtggcaggaattattacattaaatgtacactgtggcttttggcttgggcatacttggatgagggctcagccaccaggagatccccacagttctcatctttccagatagatgaacttgatgcctcctttgcattgagtatgagaatggtataggccctcccccaataaactggtaggatttgcatttagcaatatttaacaataaaaactatgtttactgagctttgctgtgccaagcactgggctaggtgctttctatgtaataatgcacggactctgatgcaaaactaccttaatttgaatccttccccatctactgactagatatttaaccatattgagttgcttaactttgttatgcctcagtttctgcatctgtaaaatgagaataaggagagtacctactttaggtgttacggaagtgaatgagttcttaatgtccagtactaagaacagtataggtatgcaatcagaacagaagaaagggtagttattgttgttataataatgataaggaggaggatgctgaactctaaccaactgagagttaaaaagtatattttcttttattgactttattctttaaccccaacttcaggaaactgaaggcttggacaatatttccatgactcattcaaagtcagatgtcaaacagctagtaaatggctgagcttggagaggaacaggtttctttgtctatgactaacacgttaattgattaaatcatccaatccactggccaaactagtcaaacagccagcaggtttatgatatagaggtgaggggaatgagcttgatggtgttataggatggacagtggctttggaatcagaaaatcttgtcctgaatcagccttcactaactcaagtcagttgacttctccaagtttctattatttcatctataaaatgattcccaatctaacccattcaagatgggtgttcagagaagcaaagaaatatcatatttgagagaattttgtaaatcaaactgccataaattgtgccatttattaatgtttgatattttacaaaatgatttttacttgttttacacagttgttaattaaaatgaccaaatcacttggttattgcttgtaatatatgtggaatccaacagtttttttaacctacaagtacatgaatcagccttgaaaacaagcacgatgattaatattgagtgtcaacttgattggattgaaggatgcaaagtatttgttcctgggtgtgtctgtgagggtgctgacaaaggagattaacatttgagtcagtggactgggagaggcagacccacccccaagctgagtgggcaccatctaatcagctgccagcgtggctaaaataaagtaggcagaagaaagtggaaggagagagatttgccgtgtcttctgcccttcatctttcctccatgttggatactcttaagttcttcagcttttggattcttggacttacaccagtgatttgctaggggctctcgggctttcagccagactgaaggctgcaccatcagcttccctatgttagaggttttgagactcagtctggattccttgctcctcagcttgcagatgccctattgtgggatctcaccttgtgatcatgtgagtcaactctcctaataaactaccctttatatatatatgtgtgtgtgtgtgtgtgtgtatgtgtgtatatatatatatatatattctattacttcccttcatatatataaatatatataaaaatatatataaatatatataaatatgtataaatatatataaatatatataaatatatataaatatatataaatatatataagtatatataaatatatatataaatatatataaatatatataaatatataaatatatataaatatataaatatataaatatatataaatatatataccaatatataaatatataaatatatataaatatatataaatatataaatatataaaaatatatataaattatacatatataaatataaaaatatataaatatatatataaatatatataaatatatataaatatataaatatatatataaatatatataaatatataaaaatatataaatatatataaatatatataaatatatataaatatatataaatatataaatatatataaatatatataaatatataaatatatataaatatatataaatatataaatatatataaatatatataaatatataaatatatataaatatatataaatatataaatatatataaatataaatatataaatatatatataaatatatataaatatataaatatatatataaatatatataaatatataaatatatatataaatatatataaatatataaatatatatataaatatatataaatatataaatatatatataaatatatataaatatataaatatatatataaatatataaatatatatataaatatatataaatatataaatatatataaaaatatatataaatatataaatatgtatataaatatatataaatatatatatatataatatactactactctccttcagatagatagataaatagatagatagatagatatcctattagttctgttctgtccccttagagaaccctgaccaatacaacgttgggaaatgtcctaactcataaaaatggagaccctttctctctttctcccaggaaatgtacagtttacattcatgctttgattcatactttgattgattcattcatccattcattcattcattcacttttcttttttctatgtgccaggcattatgatgggtaatagaatgaataacgtacaatccttgcccttagtaggttaagcagcctcataaacacatcattataatccattgcgttaaacgtagtgctaggtaattgatctgggaaggaaattcatagaagacttcccggaagaagtgacatctaaattgagtcttgaagaaaaaaaataagttattagcagctaaatacatggatctcctttgtgaccctccaagggcagatggcaagacttggtggtgatggatggacttcactgtgaatttcaggtctgaaatgactgaagaaacttgatgacttggctgagaatgtccttcaataatctgctatatgcatagggcttctctattgggtgtctttgggcagatgtttgcaaacctggcttatttaatgtatgaagtttctacaatggaccgtgtttgccttaaaaaaggaaatgattctttactcttctcaaatggtcataaagaagcaactcatgtttatgtaatgcagctcagtgctgaggctgaagataagagtgaatttcgatggagctcttccaagcactaaaacaaaatgaaggaaataagatacgattagaccagaattcatggaagtgagtcaaatatacatctccacctacaaagaaatagtctcattatcgctttaaaagatttttatgtgggaacatcatgtgcgtattgtttcataattactctttaacatgcagtaaaaataattttgcatgcaccagtttgagtgtttattggcttccctaaaagcaaaggccttgaggtactaattgggacagaggcgggaggagaacagggtcagagaagagacccaaggaatgtcaaaatcagtcatttgctcctaagtggtaggaaacagagacatttttggttccaagttgcttgtttgggcctagttagaaaagttggttaaactctgggcatttgcaggttgagagctatttgtttatgtgaactagaaaaaagtatctttcaggaccaaaggtattgggatgggttcagtggagagggtggatgtactttgggctcagagcttaatattgatcctatagatcaggggtccccaacaccaggccaaggacccataccagtccgtggcctgctagggacctggccacacagcagaaggtcagcagtaggccagtgagcattactgcctgagctctgcctcctgtcaatcagcagcagcattagattctcctaagagcgggaaccctattgtgaactgcacatgctagggatctaagttgcacgcttcttatgataatctaatgcctgatgatcggaggtggaacagtttcatcccaaaagcattccccgtcatccatggaaaaattatcttccatgaaactgatcccaaagcgttttgggaccactgcagatgcctggggatacctgacatccgattgcataacaaacttcatcctctgaatattcataaccatgagtagtgtttgcattatagtaagtggtgtgtggacaaatactacaaccattataaataaactgtggtagtaattgtagtaataatacctgctttgaattaaggaggtgtgccatttgcctggtattttagatgtgccatctagtggtcagaaggagcattttcagattattaaagtcgctctagtactcagagacacttgcaatattctgagtactgattatttcacggtaagtatccactatgtttcttcctccagggaaataattcatcatttttggtaatgtaagtctgaagcttttttgaaatcctttcgtctgtgtaaagctagtttccatctcatcctcttctataaaataagatactctctatttgctaaagacaatttaaactgggtctcaggggaggagccagaacataccaacaggtgtgggcaaaaggacaggtgtgggcaaagggacagaaaaggtggcttggccagattgtgacacttgtcgttgtcacagctaaaatgtttgaggtttggcatttaggggacactggaatgtcagcagtaaagtgatgggtcagggctgagatgcaaaaaggtagcttggtgtcgagcaatgtgaggccagaggcaggacacctggatgatgggtgtgacggtggcccagccaagacacagacatggcctgaatcagacacagagttggtgatggggagggctgggggatgcagcaacatgacccgtgggaagtgggacatggctacaggcagtctgcaggccagtctggcaccactgcatcctgacacccggcacatggcaggtgtggagcagccaggagggagagcccctgagcccctgcctgatcagctcctccctccctcctttcctccctacctccctcccttccttcctccctcccttcctttcttcctcccttccttccttcctttctttctttcattccttccttctttctttcttttttttttggagtctcaccctgttgcccaggctggagtgcagtggtgcaatctcagctcactgcaacctctacctcccaggtcgtgattctcctgtctcagcctcccgagaagctgggagtacaggtgcccaccaccatgcccagataattttttttgtatttttagtagagacagggtttcaccatgttggccatactggtctcgaactcctgacctcaaatgatccaccagcctcagcctcccaaagtgctgggattacaggtgtgagccaccatgcctggctagctctgttttcttaatgagaaaaggatctgcccaggaggagtggagtggcacaccgtcaggggcttggagacagaaaggaagggaataagaagaaaatcaaaagtatctcaaattgtactgaagcactgcttgggctaaaaaccaccagcgatgtgggcatctattcagcaaggttgtgccattctccctgtgccagagcagagggacaggataaagtttgtgcaaggccagagagggagaagacaatactgtcatgtccatcagccctgtccttggatcatcaactgttaactgcagtctagctccgtgaggcttggtagctttgtggttaagacccatcccacctctgctgcccgtggggccatccttaacctctctcagcctcagtttcctcacctgagaagcagggatcagaacataacctatcccccatgcaatgtagttgcaattcggtggggtagttcatacaaagtgcctggccacgagcctagcgcattgctggtgctaagttgatggtagctattactttctgcagaaatgagtatttctgtgcacacttcatatatggcctacaaagaactcactgcatcattccagaatttagctgttgccctgccacttgaatctttgagactaagaactaatggatgatggttctagttctgccacttctcccaccttttttgggtttttgactcacacacacacacaatgagaaggagaactctcccactctgaatatttaggcatgccacatttcgttttatttattcactattctcggtagccggatatttttgcactgaggccatctataaaatcaaaaaaatgaaatccaatcttggctaactttgtagttaattaacacatttctttaggctctttatgaaggaaaaaagaaacaaataacttttcacttctttctgcatgtgcctgtatggatgagtagaaggaattactgtaattaatgctggattttaaaataccagtatggggagatagctagcatcttccaaataaggagatgagtcagagcctcagagatgctatggtgtttagataaatgtgagttattaggtaaccaggaaaaatacattacagaaggcaacacatagggcaatgaagctgcaagccagcacgtaaattgcgagccacagtcctgagtgctctggtggatagcaggtttgtaactctatacaaaacctatgttttcctacctaagaaagggcagagggttttgtccagtaagatctctacccttcaggacttccaggtactgtttgatttccatttttctgactcaaggtggtcttcccgggggccatgctttgggaaaagcttgtatctctaaattcacttgatctcctcttgctgattcctgtagcatcctggagaagtaagagttgaagaacttcctagacttcacagagctctggtctgggggcctctctccatttgttttgttgttaaggccaattttaagaacaatcaaacagaaggttctggagaggggaaaaaacaaattgaaaaggtacaagctaaagaacttaatacaagagaaagtgaaggatgtgggggaaggactagaaataaatcctaggaaagctacaattcatcaggtttgaagtaagtgcattttctagtggctcatggatcactggctcatgaaagaagaaacaaagagagatgtaaaacctggagactgacccagcaaactcattagccatcaagctgcctatagccttgcctgcaggaggaatgggagcaggacgagggctctgagtcagacagggaatgaagctacaccttagtcgggaggctccgatccagtgatgaccaacccttattccattatcacctccctatggagtctcttaagacattgtttatctaaccacccctccttgtgataccacagatacaccatagagctctctatgtgctgtggccttttagagggccacaaactattgtaatctctaagattttcacccccaagaaacaatttttatcccctgggggagtgatgttgcccctaggtacttactgtatgcctggccctggtgtgtattatttcatgtaatccactattcccatttgacatataaaacttagaagggttgaataacttgttctaggacaaagaggatttcaacccagggagtcaatgtcagctctgccctcttaacaactatgcttctgttcaagatcacaacccgccctgctcgtaaccaccatactgtcctgctccttatttggagaggttggacagtctcaactgggatgcagaaataacatccctgtaggcaggactcatgggatcatgacaggtgccaaaggggtcccctcatataagcaccttccactgaggtaaaagcaatgagtgtgaaaacagatttaaaatctagtgccttgttaaaaagtcctgttttagaccattacaagacagaaatctctgactccattttcctctctctagagttctgtattacaaactgcccagcatggaagcacatttctaatctaaatgatctctacagattttaccaaggtgaggagcccaatgtggatcctttcatcctaatgcagtcttctgtgaaccattcctgatagttacccatactctgcctgaacattttccatgtcattccgtctttcctcatggaaagacacctcccttcacctctttttattttaatcaggcagggtataacctacatgaagtaagttataccattctttttgtttgttttgtttgtttgtttgtttgtttgttttgagacagagtctcgctctgtagcccaggctggagtgcagtggtgcaatcttggctcactgcaacctctgcctgctgggttcaagcaattctcctgccttagcctcccaagtagctgggattacaggcacctcccaccatgcctggctaactttttgtatttttcgtagagacagggtttgttggccaggctggtttcaaattcctgacctcaagtgatccgcccgcctcagcctcccaaagtgctaggattacagatgtgagccatcgtgctttcttaagtgtacaactcaatgacttttagcatgtgcatgattccgtgaactgatgtttgtcatcatatacattcacttctcgtaggcctatacttaggaatgggatagctgagtaataagtaatgtttagctttagtgtcaaacgtcaaacaattttctacagtgatcagaccaaattacactcccgtcagcaatgtgtgcaaatgttccagttggtccacatccttgtcagcatctgatattgtctttgtaagcttaaccattctggtgggtgtgtagttctatctggttgagattttaatttatttttcctattaagtaatgctattgagcatgtttatatgctttttagccatctgatatcttctttcatgagatacttgtgaaagtctttggcccatttttaaatttggtgttttgtcctttttttatgattcctaggaacttttatatacactaaaaaatttcctattagctaggaaatattatttaaggccatacatggtggctcatgcctgtaatcccagaactttgggaggctgagataggaggatagcttgatgctgagaatttgagatcaacctgggaaacatagaaccaactttacaaaaaaattttttagagaaagaagtattatttaaaattgaaagctgctatcatgtcttgctccctctgccccaatttggaaatcagatcatgtttgtaaaggcaaaccatcatgttcaggggtggaatgtgcctcttgctgccagatactaaattatcttgttggactataaatgagaagtttgcccttttgtgggaaagtaagggcacatggtttatattagtatttcaacataatataagacacttactttacgtcatagccactacctcttcctgatgctctggtctagattctggcaggtagaaacgaaagcttaaggggaaaaattaccatttttatagttagcacttatgggccaagaagttattcaagttattcattttaatataactgatttttaagggcctatagtaataatggtcattgatcaccttctctgtgccagactcctggctaggcatattgtgaactttatcccatttaattttcacaaaagtcctacaaggtaaagatgaggaaacagacccacagagaagttagaaatgtgtccaaggtcataagctaataaaggaagagccaggattcaaacccatgttcaaagtccatgtctcccaaagaaaaaattacacttttacatcattgtgaaggttgtaagttttctgtagatgagaaagaagtttaaaaattatccccattctgtttttatcttgttctatgaacttccctttccaacaaagcagcttggagtttgtgtgccacagttggcacttaggactctcatgaatttccaagtcgattctgagggcaatggcgccgtgtgcaaatgtttgtttaaagacatgctgtgcggtggcaggacccagcctgctcaggcagcagggggaatcagcacggaggcagtgatcacaccaggtatcagctcctgagtgagcctgcctgtctgtccctcccttcaggggctgtgcataaaggcatttctctccagcaaacatgcacatcatcctgtcattttgagctagaatcttcctcccaacttgttatcattatcaaaaagcaagttctgtaccttcagactctttccctaagggaaatgagactcaaagaagggttactgatatcaaaatttggggctctcattaaactatggttccctctgtcttccgcagtagagaagaattcgttcagagcagtaatgcacagggtagaaatggaaggtctcaataatggtattcaaatgactgatggggaaatttcaaaatatttccaacgtttctcttaagattgaacctgatttttcactacaggggaatatacatgctgagtccaggttatgctcatgaaaagttacccagagcaatctgtgtcttgtccacagtgcacagatctctttaacctgatgggatgtgaaaatcatgacaattgaaatagcatcacaactttctcatgttgatgaatagatggcccagggtatacctttgacttagtctatttttagctctaataactatttcttgctgcatagcattccttatggtttcttctgggctacacagtaaaaataattctggacatggagtcagaaggcctgggtataagtcctcgtgtgactatcacccccatcttacctctgcaacatcacctcctgcaactctgtctccacacaccctgcaccagcccctgggtctcctccctccacactggcccccctacctagaacaggggtccccaacccccaggccatggaccagtaccagtccgtggcctgttaggaaccaggctgcaccaggaggtgagcaacaagagagcaagggaagcttcgtctacatttccagccactccctatcacttgcattaccacctgaactctgcctcctgtcagattagtggcagcattagattctcataggagtagcaccctaatgtgaactgcacatgcaagagatctaggttgcatgctccttttgagaatctaatgcctggtgatctgtcgctgtctcccatcacccccagatgggaccgtctagttgcaggaaaacaagctcagagctcccactgattctgcattatagtgagttgtataattacttcattatatattacaatgtaataataatagaaataaagtacacaataaatatagtgcacttgaatcatcccaaaaccatgccctctgtcaaccccggtccatggaaaagttgtcttccatgaaaccagtccctggtgccaaaaaggttggggaccactggtctagaatacccttccttcagatacctgatgttttgctccaacgtcaccttctcaatgagagctccctgaccaccctgattaaagtatttctctgcctctaccttccatattcggacctcgtatcacgttctacttattatcttcaaaatctctctgcaatttatttctctgtgttgtctatcgccctctctagaatgggatctataaaatctcttaccaaaagcaatatatatacttagttcttaatctataaattttaatattttgatacgataagttctcctctcatcaataagatgcactatctgttttgttcatatctcaagtacctagaagaatgcctggctcgtagaaggtattcagtacatagttgtttgggttgttgctgttttcattttattttgatcccttatcagcatggagtctttaaataaatccatttctctctcagagcctgagcttttaaaatttataaatgaggagaatagttagaccaacaaagttggatttttaggaaaattagataaaatagtgtgtacaaaaattatacataatattggtgagaagagtatttgttgtagtaaattatgggaatttataggttaagaattaagtgtatataatgcatttggttagagatcttctagaggtagatgtattgagagcattttgtactttatcttccactggtagaaataagatgtgtaaaggagcatatcacatccaccatgacattgggagacacagacatgataaggaggcagaggctggggggtgggcacaagatggtggaagccaaccatgaggatcagaaggttctactaaaactagacttctcagctaccactcctggttacccctgttatggcgatccgcttctaatgtcattatgagaaacacacacacacacacacacacacacacacacacacacacacaaaatgaggtacatagtaatcagggtccgagcatcccacacgtggtgtgagagctccatgttgagaaaaagatgaatgaaaattgggagggatttgaggagaggtccttggctgggatcacatgggaaagggtattttacagttaacagaagggccaccctaagactgtctagggcaaggttctttctcctgctgttgtattatgtgcagtgtagataacattcacaaaaccaccttgccccacctgtcctgttagttgccctcatgcatggaaggagctctcgccagaaaatagcgagctcagtctattggtggctttgtcagcaatgcgtaggctccagagtcaaggtcaggaatgcccggtgggaacaggcagatgagtaaataaaaaggctctgtaaactatgaaggggtgtccagatgtcaatttttatgttttccccagctgcttctattccttttactgtgatgcgttaggtccattaaataatggcatatcaaaacaagaatgacccgtagagattgtctgatcattcatctgttcaacacacaatttctgcgcatccattctgtgtcagacttaggactcagcactggttagacaagaaataagtgtcattgccctcaaggaattcagttttctaggagataacgagcaaaaaaatggaagacagtggggcatctactatgacagagccatacatgagatgctgtagagcagagaaaagggatgtttaagtcagatgggtagggggtttctggatggaaagtcagtgggaatgggactgttttgaagaccgagtaagagttgcccgggcagagaaagaaaagaagacatttcaggcagaaggatggaggagtgaggaaggtataaaaaatcttggtttgttaaaggaactgccagtaatttggactagctggaatgaggtaaacatgacaaagtgtccaaataataaatcaagacaggttggcaaaatacagtcgattaaagatcttgtgtcttaagcaaatgactcggagcttgatcatggaaacaaaggtgagccaaggaagtattttaaggtgaaaaatatgagactgtgttggtttatacaaaggttattcagcctgagacatagattcgggagtcaacttgggtaggaaggagcaatttaggcaattaactggagaaggtctggacaaagacggtagttataacaatgggtttggagatgagcagacaaaatcatgagctatttaccaaataggcctaggcttttgtacactctgggtttccataaggaaggattttttcttaagcacacacctggactcttacaccgtttgcattctcttccttcttgagggaggtggagtgacattgaattggtgaatttggaaagaataactgggcatgctcagttcagctcagcttagccattttcccttgggagcgagcctgtctacaagaatacaagtactccatttcttcatgccctaaatcttacctggacagccaatccacttgggatgccctgtcgtgctgctgcgattgcatggatgaccctaacaaattttgaggctcagtatttgcaagccttcttggtccacagatctaaagccatgtcttctactgagcctctctagggagaaaaggtaacattttgatgtcatctcctgctttttgtttctttctcaattttctccgacctgtgatctggaagagtgccattgggtggcagtccttgaagaacccagaactagcaatgaataaaagaggtggtcaatgagagaccagacctaaatatgactccccatttcttgctgtttgggtttttccctctcctcagttttcctggggaaagatgggaagtcattactctggattggagatacagggggaggaaagggtttggggaagaagatggtgattttaggttcggtcacagtgacttcagtgaataccaaccaagtagctatgccccttcccccttcccctcccttatgttaggtacacccctcctctgtgcacctatgcttgtatctcccattatacacatcagaagatgtacctgcagttacctacatacctgtcatgtattttgtctttgagcttcccaagggtatgatctgtgttttaaaatttcttcactgtaggtcccatcttatctgagccccagaagttagtcagccatgcttgttgaatgaatgaataaattcacttaaccacaccaacatgtcagttcctatgtgtttcctcaccctggagtatttggtaatacaaggatcatacatatgcagaaaaggcttcatcagaggaagtgtgtctcctctggcatcagcagcttcctcccctagtctctcttctctttcaatcaaaccctaatcctccctacccagtgtctaccctccaaaggtttgaaatcagagtccacagttaaatgagaatcttgccacagtttccaactcatgttgacccagaagtgcagctctgagccctgctgtagctgttgtcagcaatcccctggaagctgtcagtgggctgcagtctgtgcttacagagtgatcccccaaagagatgcagattgtgtagatacagctggcaggggctgacgctgggaaagactgtgctctgcagggagggcatcatcagctaattgcttctaccctctggggcatggagaaatgcaggagcagatccggaatgacagcgtgaatgagccccaagcatctagagtagagggaagcctgtctagagtgttcctgacaggcttgagtcaaaagcactagatcgtatttccaagaaagggagactttttttttatttgaaatgtaatagacatgcagaacagtgcctagaaacatatgcacagttcactcgtcacaaataaaatgcctttgcaactacactttgcaactacagagataatattttctgcaatgccccctgcaaaacaatatttgcaactacagagatattttctgcaatgccccctgcaaaacagtattgcctgccgtcccctcaacatttgtgtgctatttcctagtcgtatccaatttgttgattatcatggtaaccattttattggccttctttataattttaacaccttcccatgcatctctaaacaaatttgctaatttggttgttttagaacttgatatggagtcctaccattatcattttttgacatgtcttccacttgacatcatctttgtgaaattcattcatgtagctgtgtataattgtagtgtactcttctgattgctgtactgttacactatgtaaatatgaccgcttatccattctaccctctacgggttgatggacattcaagttgtttgcattttgctctggaatcattatcctggtatatttatgtataagtttctgtggtaaggtatttgtctggagatagaggtcctgagtcaataggtaaggtctgcatatcctcaaattgaatagaaatgccaaattcttttccaaattggacatacctaatcatagtcccaccattaggagtttgcagacatataaaggcaccctacaattctaactgcaggatcccaaggtaactcgcactggctgcaaacagggagctcctgcaagtccttggagcttgcctcaaacagggagctcatgcaagtccttggagcttgcctcatacatgaaacgtggcattttgtctcttgcttttagattttaaccgtttccctctccgaggatggaagaacatcacatattatttgttagtcaaagtatcactcagctaacctggaaaggcagagggcaatttaataacatatagatgcttttccttctaaagttgtacatacagaagtatatttgtaacaagaaggtcaatagaaaattgaatgcctaaaataataccgtagcttctcttttgagctcaattgatttgctccatatacgtctgctgaaaaacaaaggttttaaacaatatatgctattcagggtctgaattaaacatctgttggtgttctctagttgtaatagggtaacataagcaaaaaacaaaaaaaacaaaaaaaaaacaaaagagtatatcctaagaaattcagcattagtctattcagggaatttttccaagagaaggaatagctttgttttgaccctttttacaaaacatcatcagaaccaaaggtcttacacgttagaagagttttcatttcattacttttttcagccttacaaacaaagcagtacttatctactaattgtctcaccttcacctcagtgtccccaatacctagcataagccttgacaataacaggagctcaaaaacatttgaatagatggagttcttgtacacttgagatgaggaaactttaccaaaatcaagaaacatattttgttaaaaatcttgtcctctaagactcaatcccatccaattaccgcctcacatgaaaaaaaaatgttgtaggtctcaagaaatcaggccaggttatttttgtaaagaaacattaattcaagacctaatgatggccctttgaaatatcagttattaaattctgttaagcaaaggcataaacgagattcaaagcctcccactgccttttcccaatatgttctagtaagagcttttctgtgtgattccgaaagttattgtttggaagctcatgatactactgagtccccccagagtacaaaacagcttttgaagtttaagtccagactagagggggtatcacaatggaggcttaaccaactgtaatgagaagctgacaacaatgaaagaaatatctgctgggagggcaataaatcctctccccttaataaatgtctgacaggaaaggaactcatgacgtctcagtgctgtgagcttacaaattaaatcagaggagatgacttgttgattgatactgcaggtaatcatataattaaccagtcatgggctgataatgagatacttttggctaattagaggaagaccaatgaatttaattcagatgaaatgctgcaaataaaagccatttagagaaaagggcaggcaactggatagatggaaggaaatgacagtggagagtggaagttataccattctggttaacaaatcatccacttattcagtgatccaggctcaaacaccagaggcgtggaaacttccctgagatgggtttgtaatccaaaatctaacatccagaagagaaaaataagtagtgggaacattttatttaaatattattccatttcatttaaaatgttaaataataaaatttgtaggcgcctattgatttggactaggctgctgcactgggcccaacagaccaaaccaatatggagtcactcatgctaaatgaaactaattaacttaggagtgcacttgggtaaacagctgggctttagttggttacagcagctgagcttcagtcagtcaattgcaggcagccagctgattcaaataaggcaagatgccgagctgtaaccaattaagctgtctctatatctcacttccattttctgtcagtaaatactgtctaatcactttgctggctggagttttttgaacctgctgtagttctgagggctgcccaattcttgaatcatgaataaaagccaactaagatctttaaagttgtaattttttgtcttttgacagtaatctgaaatctaatgctcaggggggaaaaaaagtagtggaagccatatcccaataatgtctttatattttctcctcagcaaccccttaagtgtgagttgagtatagaatagttagattttctttgggagccattggaaacaagactttaaattgaagatagatttcagtcccagagggggcttatttgatccaaagggatataatctaagtgattacacttcctatacgtatttgagaatacactttttatttcaaagacaagtaaggcaacaccctcctcccagcttattcttataacccctgatatggctaggctttgtgcccccacccgaatctcatcttgaaatgtagtccccataatccccacatgtcatgggagagaccaggtggaggtaattgaatcatgggggcagtttctcccatgctgttctcgtgatagtgagctctcacgagatctgatggttttataaggggctcttccccagctctgctcagcacttcttcttcctgccaccttgtgaagaaagcacgttgcttcccatttgccttctgccatgattgtaaatttcccagagccttccccagccatgctgaactgtgagtcaattaaacctctttcctttataaatcattcactcttaggaagttctatatagctgtatgaaaacagataatacaacccctttcctcttgtcaaaatacacgctatccttctgaacctactctccctatgcgccagtaagaccaaaagagaactacagccatgaggcattaggaagtgggcaatgaaaaccacttaggacatctctgcttctctatttttccgattgaccctttctctgttacactcttcccccttctcccctgcctcctcacttcctctttcttccttcaaccgtaataaatccacacgaaagaattcaacatgcttcttagtttccagcatatgatcatcgtcaagtgatgcggagcctttatttcttgtaacattttctctgagttgactcctttaaaccacacactccctctcctttactgaataggtgctcagtctactcaatctctatgtgtatgtatattattaaaaagcatattggatagatttttatatgctgcaatttacataaatatatggtgctataaattttgtttcttgctttttttcattccacaatgtgttgttgagatttagtcttgtagttatgtaaatttagttcattacttctgattgctgcttcaagttctatcatatggccttttatttgctgaattgcatgaatatctagtatgttctcgattgtaacctcttaagcattttaggcattgaaaacgtgttatctctcaccacctcttagctttgctatgatgtcccttaagcagaagactttcattttgatgtgcagtccatcattctcattacagccttgttttatgatcttgcttcagaacaaggttacaaaaatacttcttaccttttctcttgtcagctttaaacacttaccttttatacttatattttcatccatttgtaattttttatattttatatttatatatttatatattatatataatatagttttatattttatatagttgtatatatacatataaatgtatatattgtgtgtatatatgtatataaaaatatatattttatatatatacatacacacacacacacacacacacacacaaatctccataaaatgaaccagatttctcaacatcattagctacataatccattctttccccatacatgcgtggaatcgttttcattacatagcaagtctgcatggattcatggatttctctcaaggctattctgttgtctattactgtgctttagtattcattctttattactgtagcattgcaatatgtgtgatagttggtaaggtaatttcttccactttgtttttctgtttcaaaatgatcttgtccatttgtgaggttttattcctcaatttaaatgttggcgtcagtttgtcaagttctatcaaatgaccaccaggattttgcttggaattgtactgaattcacagattaactcggaaagaactgatacttttgataggttatgcaattcgtgatcatagtatatattcccacttatttagctctcctttaatataccttaatagagttctgatatttttctcatgaaggaccttgtatattatttattaattactggatactttagcattggagctattataggtgatgtcttattttctattatattttctaattgatgactatttaaacaaatgttattgatttatgtatgttgatattttttaattggaaacttcactaaactcttactaattaccagtttattctattgatttggataggactcaaatgtgaataagctttatggatgagcaagtcatctataaataatgacttttgttttttattttcttctaacttttattttaagttcaggggtacaaatgcaggtttgttacataggtaaagttgtgtcatgggggtttgttgtgcagattatttcatcactcgggtattaagccgagtacacagttatttttcctgatcttctccctcctcccagcctccacccattgaaaggcaccagcgtgtgttgtttccttctatgtgtccatgtgttctcatcatttagctcccacttataagtaaaaacatgtggtatttggttttctggtcctgtgttgttttgctaaggataatggcctccagctccatccacactcctgcaaaggacatgacctcattattttttgtgactgcatagaattccatggtatatatgtacgccctatctttttctttatccagtctatcattggtgggcttttaggttgattccatgtctttgctattgtgaatagcgctgcaatgaacatacacatgcatgtgtctttataacagaatgatttatattcctttgggtatggtatgtcccccgtagtaggattactgggtcaaatggtatttctgactttaggtctttgaagaatctccatgttgtcttccacaatggtcgaactaatttacactctcaccattagtgtgtaagtgttcctttttctccacaacctcgccagcatctattatttttttaaaagtcaaaaattagtgacctttaaagttttcctcttttcctcacttctggtctaattctatatccttatttactcttcattttgtaaaaatgatttaactgatgagtttagaagaaactaggcatatgtagctcagtcctttctgtgtatcccatttgggagctcacctgcccaagaactccttcacaccatcagctatgcagtgaggtcagcctaattgtctgtctgtgccaacagcagggtaaatctctaaaattcagaggtaaaatgactgcaaatccaccagactggctgatccaagcccattcttcaatatcagcttcatcagttataaggtaatgttttatttccatctaccttactcacatgtctttgtctgtttttttctgacttgatgtggtataaagatggtgttatttattatccccttaacacctgcacaccttctgatcgttatacctctgctatgatgggaacatttatgccccttcaaaattcatgttgaaacataatctctaatgcaaagtattaagaggagaggcctttaggaggtgactaggtcatgagggctcttcccttgtgaatgagatttagtatcttataaaagaggccagacacagcatttggcccctttctgcctttgacctccaagcatgtgaggacaaagcctccacagtgccatcttggaagtagagaccaaaccctcaccacgcaccaaactctgatctttgttggattttttttcccctgttttcagaaacgtgtccatgccttctagattttcttttttttttttttttttttttttttgagatggagtctcgctctgtcgcccaggctggagtgcagtggcacaatctcggctcactgcaggctctgcctcctgggttcacgccattctcctgcctcagccttccgagtagctgggactacaggcgcctgccactgcgcccggctaattttttgtacttttaatagagatggggtttcaccatggtctcgatctcctgacctcgtgatctgcccgcctcggcctcccaaagtgctgggattacaggcgtgagccactgcacccggcctatgccttctagattttcaaatttatcactgcttttgttcatagtatttttttgaaatcaaatatttcttttaggacagtttcgaaattacaaaaatttacaaagatagtacagagagctcccataaagcccattcccagtttcccctagtagtaaatcttccattagtgtggtacatttgctacattaatgaaccaatgttaatacattattttagagtctacagtttattctgactttcttggttttcatctaatacacttttttctgttctaggatcccatgatcccatagtacatttagttatgtcttcttaggctcttcttagcagggacaggttctcatatttgccttgttttggatgacttagacagttttttggggttttttttgttgttgttgttgtttgttttttttctgagacagaatctcaccctgtcgcccaggctggagtgcaatggtgcgatctcggctcactgcaacctctgcctcacggattcaagtgattctccctgcttgttaagtttttatagaatgtcattcagttggatctgtctgatgtttttctcatcattagacaggaattatgtatttggggaaagctgcatctcacaaatgcacagataaagtgccattttcatcatatcatataaagtgtacacaataccaacatcactcatcactgttgaggttgaccttgatcactgactgagggtgggttgcccagctgtctctactgtgaagtgatgctttttatccccctttccatagtgtgcactttttggaagtgaggagtattccacctcaaggacagagtatctacatacattatttggaattcttctgcatgggagatttgtctattctcctccacttatttatatcaatatggactggtgtttatttattttatattttgagtgctgtgtttttgttcaaatcttacagttatattggtagatattttcaccttcaaattctgttggatgcttactttgcatcttctcccctttttccttgattaatatagccagaaatttgtcttattagtcttcaaagaaccaactttattaattacctaaattgcttctttctgttctcattaatttctgtccttatccttattgttacattccttcttgtttctttttattgactttgctgctttttatctaccctttagagttgaatgctaaacttttttgtagtaacctttttgttgttgctctctgttatatgtaatgaaaggtttaaatttccctctaaatatcgctttagctgcatctcacaaatttaaaatgtggcaccttcattatcactcacctttaagtgaatgcaatttgtctgatgatttcttccttaaccaatgaatgcttatctcaccccttccctcaacataggacaaattttttagttatacaagttattcatttctaattttgttgcattataagaaaatataatattggtttttgattctttggaacttattaaggcttcttttgtgttttacatgatactatttgttatttttccaagaatgctaagaatatagctttttatacacagtccagattatttatcatattaattcagatttatctctttgtttatattttctgcatgatctgtcacttattaaaaatgttgtcttataatctccagctctagttgctgatctatacatgctctctgttgctttattcagttgcatattttaaggtgcattttgattcacaattataatctctcctagctcctttcacaatgtataactttcctctttaactcacgtgatgttttccccttttaatttaattttgtctaatgtgaacattgttatacaagagtttgttgttaatatctgtacaagctatactttcaatttttctgtatttttgttatatatatctcctgggagcaacatatttttaaatctcactttttaaaatccaacagcacttaagcagttccttttccctctttcttgtctcccactgaataaatcatgtgttcttcttgaacagttaacttcttatttctattcatttaatggtttctccttataaaattcccattaagttgtaacattaatttgtaatttttataataactaaatttatactcattgagagtgtttactttgtattgtcatggctatgctttggtttttgtaagaaggaagtacaggaggtcattgcacatctaagcaacaataaaacttatctactcacccatacttcctatacctcatttttctctcctgaattaatctcttctctttgctagagtatttctttcaaatatgttcttgaagtaggaaacaatttttaggccctgtcaacctgaaaatatctttatctcacaatcatatttaaataaaaacttaactggttacaaagttctaggttcaaaaatgtctatgttcagcattgaaaaaatattatttcactgtcttcttgcataaagcattactgttctatttcttcctggaacatgcattgaatcaatgctgatacttttctgtcttccatgtctctcaatgttaattttattctcttcatctcattaacccttcctggtactctctgggacaattcctcaacttgaaattccaggttactagtttagtctttggaagtatccattcagtttttcaacacatctactgagtttttcatttctatacttatatttttcatgcccaggatctcccattgtttcttatctgtaactacttgttcttacttcgtgttcaaatatcactccttcccttttaaaagatatttactaggcttattttaagtgtctctagtagatatttcttgatatactgcctttcagggtgtgtgtgctccaaagaagtcttattaaacaactcctaaatccgcacccccaaaccttgcatgtcccttgggaatttcagttgacacggagagtaatgtatacctgaaggagaatcaaaatcttagactgtgagtttaggggtggggagtatgctttaagctgcacagcttcagatgtttctatcaggaatcaaccacttccagtttgctttctcctacctctccctaccctgtacctcctgagacctcaccctcagagagccccggtaacttctctcttccaactgctcctctctgctttggggttggagaggtaaggaggaaattttcaggggctggccagcttccccacacttattctcactccagagggtctccagctctgtgccgatgttggctaactgctctgatacattctgatttggggaggtgctttgccactcaaacaataggagatcaatagcccactgaggtcagggtaagagagataaaaggtacactcagccagcattccaagcacgtatcccatctatggccctgggcttctcctgatataggctatcatcttcctatcacacaggaatttaactatctttcatcttcccatgggtttttcatggttttggtgttaagtgcggggatccatccacatgtcttctgtttctttccctaaaatctcctaagttggatttgaggaagggaggcaatggcttatgttaattttccatgttgtccagaattgaaattttttctaaagattgtgagtgttgatgattatgggaaccatgaggcctatagccccattaaatgcacaatgcctagcacatagtaggttctcactaaacactgcttcaataaactggtaaatttattcaaagatattttagatgatatgtaatgtcatgttctgtattttaactttttatagttatactttgcttgaaaaaaattacattgttttggctggcctaaaaagggagagtgattgcattttaatagcttaatcacaaagaaagccccaaaacagagtaaatagtgcaggcagatacaaggctaggatagatttccaattacattgacatttttctttctgatacctaagcttctctggctttgaaatccattttcaggctgcatataatcatgttaatactgtgagactttcagcatttattagtgctgttattttcatctatacagctccttcttcagacgaactgaatatgttttacaagagcctacagaacagacatcaattctttgagtctcatgagaaggtggaaaacactgaagaacgaatgattaaccactctttctactatttattacttcttaaagaagaaatcagaaaggaaaagagagaaggagaaaaggaaaggaaatcagagagaaggaaagaaagggaaggaaaaacacacaaaaggaagacagcctgccctcacctcttctcagttgtcttctttcccttgagtttctgctctgtcctaacctgctgttctgcccctgggtgcctggccctggacttctctttttatttcaaatgggctcttgtggctactctataatctccatgttcacctctgtgaagtcttaatgtgtatttcacaatggcaatcctgggctcttttccctgtcttctaaccacccccttcctgctattgtctcaacaaaactgtcgcctttgttgagaaatttggaaatgtccaccagaagctttatcttatcctcctctttacgatggaaaattcttctctgcacattcaaccatcctttctccctacagctgcaggggttcctttctagctccttcattgccatctcctcctcttcttctctcttctgttgctgccttggatgcctctttcttacttttcctcctcctatttctctttgtaaatcagtattttatctattgatcacttaatgggtacttagcactgtgtgaagctaagtatttcataaattacctcacttaaaggtcacaatatcccaatgaaatatatagtattactacccctgttttacaagagatgcttttaaggtttagagaaatcaagtaacttgtcaaaggttgcacagcttataaccagtagatttcattagctccttccccttggccttcaaacatgaacatgttttggctattcaactaagaaaataaatgaattgcctctcttgaggcatagttctatccctccttttagttgttagtttacttgtcaagcaaataactacctatgttcctattttctcagcatcaaaacctgccttatatctttgcattctgacttcttcattctgccattctgccattgttagagtgacctctccaaagtcaccagtggccaccttctctctgaacaaatgacctttataattcttttccttgacccctctgtagctgttgatgctattgataatcctgcctttgaatttcacctgctggccaacgtggcttactatgcaaatttgtgcggtcagtcagatgtgctgttagataatgcagttgtgaacacatgggtgagccactaatggatgcaccccaagcccgtggccagaaattctcattttctttgagggtcaggaggcataaattatcttcaggatgggaaggatattttatagatacagggctatttttgcaggagaacaaatgatttacctcttctgaataatgcagaatcatgtgtggtgaccctatgtgcataaaactcttacatcttgagggtctaggtaacaaggtaataattgtatttgcaacaaaatataagtaaccctgatgaaactacaaggatatggggtcttgagggaattaggtgggagtagagttgggaggagtgtttttcatttttattgaatggtttggtagaaaatgaatctcccggggatattttatatgtaactttgccaaagagtctcctaattactctcgtagaagtatgtgtgaatatcacagagtatttattttctctgatgatttcacagtttctaaaatgaaagaagtagctcaaacaaaatagttacagatgttattcctctgccacatagtttggaaaaagtggggtctctggttgactggaaacatgaatgcatgtgatttaacacacccaagagaatgaggttggtgaattttttaatggagaatatacttaacatttacatagaaatttacagcatccaaactacattcacacttattatccccactgccttctttcagctctttggataaaatggggattctgggccgggcacggtggctcatgcctgtaatcccagtactttggaaggccgagacaggaagatcacaaggtcaggagatcgagaccatcctggctaacacagtgaaaccccatctctactgaaaatgcaaaaagaaattagctggcgtggtggctggtacctgtagtcccagctacttgggaggctgaggcaggagaatggcgtgaacctgggaggcagagcttgcagtgagccgagatcgtgccactgcactccagcctgggcgacagagcgagattccatcatgaaaaaaaaaaaaaaaaagggggagattctgatcccagtttacagatcaggaaataaaagtcctgacagttgatactgcttgaccaagtctccattaggccaagggttcacaaccaggtccctgcccccagccagggctaagttccatcttcctccagcccgttgtgtgcagatgattagtgaattaaggggagtgggagtgggctgccgcaagagggcctggcacaggcatgcaggcaagcatggtggctcagttcacaaatattaatgaaactgtatggaggaagaaaatttacttccccaaaagataaaagcctattcagttgctgtcagagggcagcattattctgctaaaaggacaaatttgagcatgattcattcttggcagctccattactaagggcagtgggtgtttccacgtgaaaccagctgaattttctactgagatggactctccaagttgctggatgaagtattaatgtgcactgcggaagctcaaagagcatttaggtattgcctatgaacttctggttagaacaccaaaatccagagtgaggaagtcatctaacaatgttataaaaatgtaagaggaatggaaatttctatccctctgaagcaaaaacatgtgtggagaagaacttcagggatgccagtccagccacagatccctgagtgtcaccccctccacctttgcactccctgccacacacacagaaatgcatatacacaacacatgcacacgcatgggcttgggccccagcagccatacttctgttatgtgaccctgacctctcagccataggtgcttacaacaggtgtggacatgtggacacctgacccaagctgcaccactcaattcctctctctccagaattaaagtcaagagaaaaagcaaatgggaaaatattgctgagtaatgtggatgtcaagtctctagaagaaaaatccacaaccttgggccctagaggttcctacttcattcttcctttttcctgatcactgggttatttggctttttctttgacttttggagctactgcctcaggatccttccagcaaattttgcctgagcttaagctaatttgaagtgggtttgtgacatttgcaaccaaaagaatttcaactaagctatgagacagcccccaggcaactgataaataccctctcctaatgctgcttcatcctgtctattatagatttaataattagctggttaaattatcaatttatgcaagtaactatcacaagttgaaacacttatttttaaaagctatctctttttttggaaagtttgatggctcttaaatagctattagaaaatatactttaaagttaaataagttacatatgtctctgtacacatatatacgcagagacactaatattggaaagttaattgaattgtcaattgtgtaatatgaaattttaagtttaaagttcgtttttagttttgtcaattataaaatactgtttacttgttgcagaaaatttgaaattgtgttagttttgtcccacacattataccacagggctttacttatagtttatctgatcctaatcacaatctataaggtaatcactatccctgtttaaagacaagaaactgtatgttgtatagtgtgtgtgtgtgtgtgagagagagagagagagagagagagagaagaggagagaagagagagagagagagaacccaaatcattaaatcaaacaagtttatagcacagactaaccgtaaaacatatggaaaaggataatgattactataaagcaattcataatacctatcatcattgggagcaaatgcatgcagaaaaagcttactttggagaacctattcagatttatgctctgcagccaacataaatatgaaaaaaagtctatacatttccactgcatttggcaaaaataagtaagagtgagggatgccctggatacacttgctgagtcacacttgccactgaggcaggcaggagggagcatagcatcatggaaaataatcattcgtaggcagctttgatgtgaacgtggtttgcatggtttaaggaggtatgctcttgtcaacaataccacagcttccatgtcaaaaggcaggtctctcctaagaacattaagcatgtacttatctcctctaagacgtgagcagattctattttacacacccgtgtggaagtcagcggggtattttaagggctccctcagttattaaattgacatttaggaggggtgcagtggctcacacctgtaattctagcactttgggaggccgaggtgggcagatcacgaggtcaggagttcgagaccagcctgaccaacatggtgaaatcccgtctctactaaaaatacaaaaattagctgggcatggtggcatgcacctataatcccagctactcaggaggctgaggcaggagaattgcttgaacccaggaggtggatgttgcagtgagctgagatcatgccactgcactcgagcctgggcgacagagcaagactccatctcaaaaaaaaaaaaagattaaaaataatttcacaagtaatctatttttactagaaaagtttgaacttacaactagcaaaaataataaactcttctattgatatctggatgaatgtcctttcatacttttctaaatatctatataaacacactatatttcatgaaaatgaggtgaaaaatgcctgctttattttacataacaatatatcgtcagcattttgtcattgtagggaaacagttctccatgagcctctcacgtttctgcacatcttgtgagcagaggcattctccacctatttttctgtctatcttttcacagatatttatatagtgaacaggtgtggaagattggggtagcgtctcccttcagaacaatggcagatgtgttcattgttaactataaaagatttgggtttcctaagcttggagttcctgttctgtaatacagccactgatggcagtgctagtgttacctggccctttcctgtaactcggtggtaattaggacttgagaaactggcaggaaaaaggatcctgaaattctggctcctgatattgctgtgagtattagagacctttgttcctgacccaggagtcttgtgtcttctttcatgaagctatagcagagttgttaactcacaagttgggtaaaatctcagactccctgtggttctagacaattatattgctaaactatttttcaacatcatcattcttgatagctgtattttgacaagtgcactccgatgtctttatctaattccctgtcggattcttaaactgttttcatggtcttgcccttgaatataatatttgcatacaacatattcatacaacatattcatcccttataaataacttttctagatgaagatttaaggaacttttgctcttgatgaactgcatattaaataccatttcagattttctgggtatttaacaattaatttctattgactgctcctctgtcagtggtcctgaaggtcaggctcattgaggggatggatgggtcaacccatgacagatgatgggatggctcaagtgtcagaggccagtcatcctagggttagctgtgaaaatagaaggcaaaaggtcagaaatccaaaaggatgatatagctcaaaaacctcacaaatacgttctcaccctaatattccacctctacaatttcacgtttagttgttgccaagtgcatgcacatgagacaaaacaaagccaaggccaaagcctggctaattcagctggtaatagacagtgaaccacttataggtttagacagttattatttttatatagacagtgaagaggggggccagttccccatgatctttcccaaacaccaaactgagcaaccctgaaatggaagggatcagatgactacaccatgagctggggcacttgcagattttggctgaacagtttcgtgttctgcagctctacttttggagtgggggaaacagggcagaaagcgccaaaccttgtcagcaccctggagaccttgagaaactgattcatgacaacctctcaaggagagagggagatgagtgggagatggcttcacagcagctcctacaagcctcatgtccttggaggagcacaggcattgtgccaagccattcaagaggtagcttctctggttaggtgcaagtcaccagggcaccatggtggagccattgccccacacttacctttttatcctattctctcacatttcctccaacctctgcccacacactattgcctgctgctgcacattctccagacatacaccccacacacctgcagctgtgccttggttgcaggtgagcttttaactggggccgtttgcctccatctcataccacctagcaaagtcccagctacctccaagctgagcttggtgccttaatatatttaatgatgatgacatcccaagagccagcagggtgggtatagtatactcattttacagaaaaggaggggagttgttagggaacttgctcagggctctccagtagcagagccaagattcaactcctttgatcctttgcaggatgcagcacaaagcctagctcatagcaagttagaataaaatgtctggagagtcacatcaaatgaattgcagcaagggggcatcaagaggaactgaatccacagtcttggataatcagatctaatggtgggtgccagagcaagtgacagtcaaggtacatgagggatggggcactatcagagtcagagctaattcggcctgaatcctgggccttgtacagtctggtcttgaaggggcagggcccagcgctggtagagctggggactagctgtgctattggaaggttgtgtttgaggagagaggatttgagcatagaaggggcattagcaggtttggggttcatcctgatgttccctagcttctcccttctctctggagtccctcctccccctggcctgtctttagcccttttagttccaatcactttatcctttcagcctggccgagctctcccgctggtctcattctcctctaaccagacctggggttgtcggctgcttttggaattcaccattaggagatgaagaggcagccacaggttgactgagcaagcgtcattgtctatttgaagtttcaaaggtatctctgaaaataaacacagttttctgcaagagtgaaatggcatctgtggtagaattggaaagacagttgtcattttgcttggagttcctcttctatagatggcagctgggcctttcaaagtcaagggtgacagtctgcacatggcttctccccagcactgtactggctggtgggggtggggtgcaatacaagagaaataaacttccccggtttgctgctctgactgaggcctccttcccccaccccctcatcagccaggatgcaggactccctatctgggtatcttccacattgaaaattgtgctgtgttgagataacatggcacagagattcaacccacaggggttttggggttaggcaggcatagctataagcctcagcactgcccctctacagcagcttttgtaatgttgagcaagtgactttgcctctcagagcctccatttcctcatgtgtaaatggggataagaggatctgcctcctaggatgatagggatggatttagtgaaatagtgcatgtcaagagcttatgagtgtgtggccacagcaggaattcattactgttgctctatgactgttatcaaagctgtggcccacatgtacacccggctaatggctaatgtgaggtaggctgtgatgcctgctacaatgaagctgtgattgtaactatagcccacacccatatccctgggtcccacacatgtggattcaaccaactacagatcaaaaatattagaaaaaaataaaagtagcaatacaacaaaaatacatataagaaaacccagtataacaactatttacgtagtatttaggtattgtaagtaatctagagatgatttaaagtatacagaaggaagtgtgtagattctatctaaatactatgccactttgtatcagagacttgagcatccatggattttggtgtctgatggtggggagtcctgaaaccaatcccccatgagtattggggatgactgtatcattattgggccatcttctcccttggggaaaccagatctccaccagcattaataaggcaattgctgtgccagagaccattaatattgagaatctcatgttttcatgttacaacatcatatttaaggatgtataagagttctttatcactggcaataaactctaaagataaatgagccagagccaccaaggaataaaaactctccatctttgactgtacacgcccaaggatgacgctgttacccttagatctaagccataggcctgaacacaggcaaacagctgttggttaatggccctggagatctggagggctgaacagaaactccccaaatgataacgttctggggagtcatagcactgatgcattcactaggcatctacctctgatctggaggaagtccatgctgcttcaaattcagagactgtgccctaggcatcgttttgattttcctcctctccaccccactctatgctgtgaaactgagattaattgaactgctaaaatgatgaagttatatataccagctaattttccaatggtcagcatgaccttttatagaagtgtgttcagcatttgaaaatgtatattttttcaacatcttaccataaaatacatatcagaaagtaaagttttaaatgattttcttttatactggcaaactaggaagtatgagatgttcatttgccgcagagttagcaaatacataaccaattatgaagtctgagaatatcacagttgacttaagcagcaaatagtcgtgcctatgtaattccatttaactggttactcagctcttttttgaaaggcattatttagcttgttagggaacctcaaagggaatcagttttattaagcaactagacaattagaccttggagtatttaaaaagattacaggcagacaaatagtactgcaaactggcctgtgaaatacattcaagaactccatagacagaaataaagatttacagaagtcctttttcctattgtgttctttctaattacctttttaattgtggtttttctaattgagattgttttttccaatgtaagatatctactgcataaatatatgcatattatcttcataatacttgtattacagataagctaaaagaagaaaatgacccatttcaagaaataaccaatatcaattctttgctctaaactttccagaggcctgtatagtacagccagatagccaaaagcctaggggccagagtccgagtgactggatttatagcctagttttatcacttattgactctgatcttgaaaattcacttgaacttcgtttgattccattttcttatctgtacaattgggattttaaattgtaccttctgtacagcattttgggatgatcaaatgagatagtatgtgtaaagtcttaaatcaatggctggtatttggtaagtcttcaataaatattagctattttatatatcttatatagacagtgtataatgaaaatgggattttattgtatgttctgtttttatagttcactttttttttttttttttttttgagacgagtctcactctgtcgcccaggctggagtgcagtggcacaatctttgctcactgcaagctccgcctccggggttcacaccattctcctgcctcagcctcccgagtagctgggactacaggcacccaccaccacacccgacacacccgactaattttttggtatttttagtagagacggggtttcaccgtgttagccaggatggtctcaatctactgaccttgtgatccgcctgtctcggcctcccaaagtgctgggattacagatgtgagccaccgcgcccggcctatggttcactttttatttactggcatattgtgaagatttttctatataaatagatgcacatctctttattatttttaatagctatataatattgcatcatctgctgcttgataaattaccaggtaggaggctaagcagagccatggtttaggccccacccttccttgctagagctcagtgagggcaaagcttcctgccctaccccaggtcacccctgatgtgccacagtgagtatttttaccttggttcaaaccctgtgaccgagttctctgcattcatgggctcctttacagtagcagaatgcccagctagcagaggcactggggattcccaccatcgaaggctgctcagggaagagagcctctttctttgcttctaataaaccagcatctctgccatttgcataacttctggagaagggccaatacattttgggaagatgcttgttttcttgcagaggcagctgaaactcatttgaataaccaagtcaaatcaattcagaagaagccagctcagcatgaaagcaaggattatcattcttgttcctgccatatccctccaagtagcacagtgaaccaactgcagaatcatagactccgtgctttaggatgtgcaaggtgacctggtcctcctttacaggtaagcgagtggaggcatgaccccaggtcacatgaaaagtaaggggcagaacaggggaaaactcaggtatttggacttcatgttcagagttcttcccactccactctactaccttctactctctctcatccaagagagattgaaagtgactgcaggtgcagacttttgtgagaggatataattaaagcgctactgttgatctcttttgttcccacttggtcaggacatcttggggaaaattagggtggacagagctacatgggttagggaggaatagagtgcaaggtaacatcaatgaaaacgagttgctaaaaagagaaaatgatgttactgattcaatcctctaagtggctaactcaacaacagcaaatatgctgtgtgtgtccaccactggggcatcctatcgaagagtttgatgcatggagagacaaagttcagttcttggcaggatgagaggaaacattgtgctgatctaatatggaatccattctcagctctagcatttgcccccaaggaccgcatagatgtatgatgttccctgaattatcttttcaaaatgcaagtctaggcttgtggttccctgccttaaaccctgtcagtggctctccattgtcttctgagtgacctactgacccctcagcaggaatctttgggggtgagagcagcaaggaaggggtaggatgattatgagaggtaggatgagcttcttaattacacatttctcgaggtctagagccctccagtaatggtacctggcagaaaacagccttgccctgcagagttgtctagaagtggatgacaaaacccagcggggccaggcccagagtactggtcctaccttgacggcaggacctcagccttatagatttctgcagggtcaacccagagaacatagatgcatggaatagaccaaagcagttatttgctttcccccgacaaggcccttagtgtctgcggctcaccccatctaatggacttggagttcgagacagctgttgaccctgtcacttttccagtttgatatttagttatcagtgtgctcagcccttatcttttagatatttgacattcaaaccccagttgggactcttgtacatcagctggctaggaaacattttgggtaattggatggtggcactacctgccagctaccagttggattcgggtgctgtctttcaacatcagtgtgtacttatgcagtttattgcattttaaaattgttatataaaaatcagtaaaaatgaaaactgaaggtctgatattaatggtaagaattagtggccttataaatgcattcaattgaggcaaagatgaaaagcaatagcacgttaacagtctttgattttgaagaacatgcaccaaacagaaggcaatatattgacaacataatttttctatgccttaaagatagggctagttagaattttcataatttgtctctcagagatcagaagtcttcttctaaaatatattatctattttcagttttcacactactgactgatgttcagaaggaaggtcttgacgtcaagcatctcctgccacaaggaaaactttagggggaaatgtgagcaaagtgcagagggtgaggctcatgagaggggtggacaggtgaggaggcagtgctgagttctgaaggccgccctgatgctgagattccatagctggggctaccctcatgacccctaaaactctcttatcactaaataccaaaggactgtcccctgaggactgatggaccagatacacagtgttaaaataaaaactttaaataaattaaatataacagagtttaactgagcaagaaaaagaaaaagattcacgaatcaggcagccatcagaatcacagcagattcagagagattctagcacttgccacatggtcagagcaaatttatggacagaggggaaaaaaaggagcctgcagaaaacaacagtgaggtccagaaacagctggattggttatggctctgcgttagcctcctttgcacatggtttgaacagttggctgcctgtgagtggctcaagcatggctgctgggattggctgagactctgctagcttacagaagcatactcctgcgttagttttcggtttgcctgcctactatgttaggttacagttcctccataagaactcaagtatgagagtacagaggctttctcagaccagatcttagtttgactttacagtgatgctgggcttggtgtgagatgtggggaaaaggcacgggctaagagtttaagaagaggtggcttgaagccagtaatatgctcttggatggaaacagctttttactttcactcaggggcgaagacaactggaccacgggctataaagaactgtgctctacagaaatgggacagaaatgcctactgagggcctagagtgcctagtacattagcgttcattacatgttgaggggtccccttttgtcaagtagaggaagcagaagttggtcacattatgttaatatatctgtgtcagtcgtgtagttatcaaatgccccttgctgttctctctaatcttttcactactctcattggggaaaggagatgaagggaaccgacatttgcaggtggggctgctgcatatgattatggagagactatgtgaatgacacccttggcattgcacagtgcacaacctatgcagctgtacaggatgatcctggctgttgtttgcctcctgttgttatagcaggtagctagttttgcatgaaaagggcaggatggggttccctcccactgcatcaggaaggtcaggcgaccatcaggcaatatggtcaggcggttgttacactgtttctctaaaatggtaattggtcgcagccagcactagggaaaggcagtctcccaatagacagaaaaaaacctgaaactggtgatcagcagtttcccgataagatctcaggagttgggtgagtgggctcaagcatgtacactaagaggcaaaatggcggagtttaactggtatatgaccttctcagagcattcatctggtgagggaggaatgcctcaggtgagcatcacacaactccaggaaatggttgtagcggctcctcccaagtgctagcaggccactgtgcatgcaggtatcccacatcaagggaaaaatcaggggagaagagaggcaagctccaagaagtatgccaatattataaaaccctgagtcaaaggtcaaactggacacttgatctctcaagttggctgcttggccctcttgcaagtgtattttccttcctttcattcctgctctaaagctttttaataaactttcactcctgctgtaaaacttgcctcgttctctcactctgcctcatgccccttcagctgaattctttcttctgaagagggaagaacaggttgctgcagacccatacagatttgctgccagtaacactatgtttatagtactgtgctagatcttcctattatcacatcaaattgcactcctaaaagccctgggaggtgggattatccccacttgtcactaaagaaataatgagttggaaaagttgaaggatgtcccaagatcacaaaactaggactagaatgaaaactgtagtctgactcagccagctctttctcttttcttttaaaaaaaagaaaaatctctttcttttaaattatactttaagttctagggtacatgtgcacaatgtgcaggttagttacatatgtgtacatgtgccgtgttggtttgctgcacccattaactcgtcatttacatattcacaggtgaattctatcagaggtacaaagatgagctggtaccatttcttctgaaactattccaatcaatagaaaaagagggaatcctccctaactcattttatgaggccagcatcatcctgataccaaagcctggcagacacacaacaaaaagaattttagaccaatatccctgatgaccatcaatgcgaaaaatcctcaataaaatactggcaaaccgaatccagcagcacatcagctagctctttcagtcatcccagagagtttggagctgaatgcacctatgtgcaaatgaaccatccacctaagagtgcaaaacctgtgcaatacacagaagccctgcgttccctcactgcatgatgctttctgtgtctggcattggctcccagagactggctctctggaagttcgaggaggaattacagctttagcaggagcctgggttcttcaatccagaatctatgcactgaatcgtaaactctcatttgaatttgatctcctgcattagctccagaatctattccttctcttcttccttgatacttcttttcatctttttatgtgaaggatgggagtccctgcattatttaatgctcagtgtccttcacagctggggcagcaattctaacattgagctataaaacatcagaagagaaaaaaggaaagtctgcccctgttacaggaaaggggtcccaatccagaccccaagagagggttcttggatcttgcctaagaatttacggagagtccacagtgcaaagcgaaagcaagtttattaagaaagtaaagtggtgaaaggacagctactcgatggacaaagcagggtgttccctaaagtaagagggggaatgtgtccaccctagttacagtgcttgtttatatacaggataaaaaagattgggccgggtgcagtggctcacgcctgtaatctcagcactttgggaggccggggctggtggatcatgaggtcaggagatcaagaccattctggccatcatggtgaaaccttgtctctactaaaaatacaaaatattagccaggcatggtggtaggcacctatggccccagctacttgggaggctgaggcaggagaattgcttgaacccaggaggcagaggctgcagtgagccgagatggcgccactgcactccagcctgtgtgacagagcgagacttcatctcaaataataataataataataataataataataataatagggagatctgctctgttataagggtttgtgataaaggactaattttcttaattactgtatttcgcaagaatcaatactatctttaaagcaaaactagaaatgcgtttgttctcaagatattgggatatcaggacacttccaagtctgggtgtgtttagcaaacattgtcaatctattcccctaaccgtaaacatctagaggctagaaatacctcagtttctgagaaggcagcccagcaaatcccagcctcattttcctagccctcattcaagatggagtcactctggttcaaatgcctctgacacccctaatcaaaaaggaagagactgctgatgatgcctttaggacaaaggcacagaactggaaggaacctgcagagaggagctgccagcccctaccttctctcccacagaaagatgtgctcaggtcagagaaggatattttggttatcaaggggagatgaggcatgagagagagagagagagacaaatagacagacagagaaacaaatagaaaatgattataaggctgtggttagaaattccatggctcaatggaccaggcagccacacaagtgagtaaagtaggtggtagaatccatggcaaaatggagatgtcatgctctaaaggggctgtacctactcatagacccaaccagttgtggccaagtacttatcccatgtactaggatgtactaggactggttttaagaaaatctaagcttttgaattttaaagaataattataatagctaccacttgtgaagcactcaaggctgagggcagagcatggagaatctatttgggaataagaggaagatcagaagtgagtggagacaaaggagctatgaagagtagcaaacaaacagaaaatcacatccatggagacagcagtggaagggagggaggtgaccatctgcagtggcacctggcagagaggtggagacccaggatggacaaggaaaggctggtgaacatagtgtgcaggatggcttcggtgacctcccagggactaatttcagcagagggacagagatcaaaacagactacaaggagcgggcaagtgggtgggtggaagaaagcagatgcaggtggcactactcgtttcaaaagtttggccaaactccttagaattctgagttttgtattccatccccattagtaccattagtttcagtggctactttcaattagttctccacgcaggcatctgcagccttttccttcccactgttcaagcctattatcagaaagaaaaaaggaagcaactcagttgggatcttctttttaaatgttcatcaaagaaagaaaatcagcaaaactgctgagtttattctaagcacagcagtgtagagtccaaccaccaaatttatttccacctgaatctctaatgagggagggagaggtgaaactgtcattcttcagtgcaaatttcttcagatttacctgtagatggggaaactgccaggcctcccttaggactgcatttttttggtgacagccattcctccaagacacaagaaccctcttatgcaagtcttttgctcaaggtctccctcttggtcttcctaaaacttgcttggaactgcagtgcagcctgagactcctgcccaacccctcttctgtccttctgtcattcacaggtgtcagagtggcacagccatttgagagcgctcgcagttgcctccacatcacaggtgtgtgtgtcacaggtggtgtgaccaccaacactgacttctaaaatgttaatccaactgcccccttttttttttttgagatagaatctcactctgtcacccaggctggagtgcagtggcactgtctcagctcagtacaacctctgcctcctggattcaagcaattctcctgcctcagcctccctagtagctgggactacaggcacacaccaccacgtccagctaatttttgtatttttaggagagacggggtttcaacatgttggccaggctggtcttgaactcctgacctcatggtccaccggcctcaacctcccaaagtgctgcgattacaggcatgagccactgctcccggccccctgacacttttaaggaaaacaattgtacctctagtttaacattttgatgtagtacaggcttctgcaactgagcacttgtaaatgccttatatttagttgtaatgccatttggggcactaggtatggtgcgtcatatgaaaagaggccttacgttatagagtccaaaggatagcgcaaatgtgttccagtttcctgatccttccatagagactccaacctgggcacacacatgggcattccctttctttccagtcaccttccctgacctcacaatcatgattatttgagctcttttttcaccctagggctcctggctgcatcccagaagtgtgtgtggcatcttcaggttctgagcatcactgtaggctcagttctggagaggaagtggcaggcacttagctgaagaaagcctcacttccttcggatttttcagacttgagctttaagaggacaaacagcccctcctctagctaaatttgccagctttaactcatatgcttttatgccaacctaccaaagatttttttttccatctttttattaaccttgccaaacattcccaggagctctgcctggagtgatggaggtagggggaaagggagaaaaaacggaaaacaaacccatctcatcacaagtataaagctctaagcgtcaggagataacgaactaaagttatataatttatttaaatattcttccacctgagagagagcttaaaacccctaagagtcttttctgaactacacagaggggagtggaagaaaagatgttccgatttaattcctacattataatgaaagcaattgtcctgtgtgtatcattatttttccattatcttaatgcatcagttaatgaaaattttcagagcccattcacatggctacagtagctgagaagttagattgcatcctccaccctgtgggtacagatgcagctgcactgcacatgggttgtcttccacacatcaaaatctcaccagtgctaaccctaagttgggctgcatatgccagcctaagggtacaaagcagcttccatttcatccagatggatttctctcccccattaccttccatttgcagcatcactgtagacatagcccattcagaaggtaccctctgtgttgatgatagcagattcatagctcttgggcaccacaggcactcggggatcccagacacttcgggcatgacacacaactttgggacaataacttcctctgtatgagaagaaacaatatttttaatgtgtaaagagttcagactttatccactgcctgcatataacaatttcagaattgccagctttgcttttcctgtacttccccctcttttccttatttttgagggcagaaagggcaaaagcttatgcaaagcctgatgagaaaagagatgggagagaagaatgtatttcccaggcagcttcatggggagcaggaggatgaaactggtcaaatgggtcatgataggaaaacaagacactcaggtggcagggacaggaccatctggatgagagagagtatactcatggcgtaggagtgagaaatctctgactaattgggggtggcagagaacagaacaagagaagttataaagatttggtgtagattttgctcttggatcccccatgaatttttgagaaagacctaagtaaaattaaatccccttcatgggttgcagttcttcaaatgtgatactcttctgaaactggcccactgggtcttagctttacgggcaggatattttgtttcttggccactctgtgcccatctaccatccaagcaccaggactaatgtgaaggggcaacaatgtagaattacaggctttcaaaggatgaagtcacattagagataatcgactctagcctcatatctaattcaggaaacttcctagtgctcccttgcctcgtctctggttaaaggattccaataatatgaatttcaggtccaatgtagaggcagtgtaggtgtggtttccagacatttacaatggttaaactcctgttccctgagtgttaggtctgtcacctggaaaagagtcacaacagtccctttctagaatgtcaatgaggggaataaagaacagaatggatgcagatatgctccagaaagaacaatgcagattctaatcatcgtgagtacggcctcctgactcagtggcctggattgagtctacatgttgaccaaatatctggtcagtttagtgaggtccagtgtggaaacatccataaaataagtgatctactggagttttggttttaaagctctggtgacatgctaatacccagctgtgctcaattaacaatgagaaagcatgttcaaaagactatctacaccaggtggatagagaaccttggaaaaccaacacttttccaatcaaaattatttcattcgtagaactttttagtagctatttcaaatatcctttcatttaatgagcttggtatctgaataagaatatatcataggaaatgggagtcttagaaaatctgacactaaagtagaaaaaaaattgaaagaaaaatattccaaaataagagtggaggaattcaggacagcttatttttcttccgtgttgaaaattctctacaataatgctataataccttaaaaataacaatcgtgttataataatactaagcacaatttaacgggtagctttatgtatgttcttaggttaattatttcacctttcactacttcagtttcttcatcttcacagcaaggggattcaaatagatgctacataaggacctttcttataacaactctattgtgtgaaaatttcacttacatgcaatagatgtcaccccattcaaaaatctttcagcttcacagtagattatttttccgtaggaaaaacacatcttttgttaacgattatatgcatcttgcctcagaaacaataaatacaagaatgacagacgttttacgtctcagaaatttttcactaatacaagagcaaataatacaagaatgatagacattttgcatttcggaaatctttgactaatataatacaagggctatgacactgtgactttggccatgagaggatgggtgttatacatcacatttacacctggtttacccagtgaaaactggcaagtctcagacgagttagtgccctttgagtccatcccttttgtagtgcataagcttcaccgccattcgcagcatacacaacctgagtgctcacctgacccagggcagctaccattgcctgagttgactgcccagcccgataagccattaggtagacaagaatgtggtggatatgcatagcagtgcctttgaaatttgcatcctccttaaaatcaagctacatctcatatgcaaaatataaaattaaaagaaattcatgaatgcaaacactactgggtctaattttaaagtataatttaaataaaatagagtattaactacacattggaaaggaagaattttaagaaaaatctatacgagtatttaaaatgttggatttttgctgggtgacacagtgataaaaatccaatatttggtgccagacagactaactttctaggtttgatgctaagtatttagcacctctgagtttcagtcacttcattggtagcatgggcatgtggtaggttcctttctccttccttggataacctgagttatctttaattctgtggtatagtttataaaatgttggaaatattttatacagatccacatttcctttcaaagtttcttggtacgtgtgatagcaatacatctccatctcactgtgccctccttgcctattgatgaaaggaattgggaagaaaggctacagtttcttatcattgtgattactaatttgctaaagcattaaattaatagcagatcccaggtcctaatcctccagttccataaagggataaaggcatgtctattgtaccaccagctatgtatgctgttgtcttgttgcttcttgaaaatgaagctatttcttatgtgcataaataatctacttttttaatttttattttttgatgagtcttgctttgtcacccaggctggagtgcagtggtacaatcttggctcactgcaacctccgcctcccgggttgaagcgattcttctgcctcagcctccccagtagctgggattacaggtgcacaccatcacgcctgactaatttttgtatttttagtagagatggggtttcaccatgttggccaggctggtcacgaacccctgacctcaagtgatccacctgcctcagcctcccaaagtgccgggattacaggtgtgagacactgtgcccggccaataacccacttttgagactggaattttatagatgcacatgcgagactatgcggcataatttaatacatattgttttattgtggggataggaaaaacaaaagatatatttgtaaaattctacagtaaaaatgcagtgctagcactcagatcttcataaatgatagcatctgtcgccatcactgcttgttgcctctccagcagctgtcccccgcctatactcccctgctgggggaacctggatcaatgacaaacagaagctcaaaaggttagaaactcactttccagttgctcttgagccactggcagccatgacacctagttttatccagagacattggtggaaataccttgggggatcttcttggaaagattttcctcctggagagatatgggctagagctctaccccatcttgcttttggacctttggaaaactcagaaaatagcagaggcaataacctggtatccagacataactgagttactgaaccaaccccaataatcaactgcttctgaacttattatttggaaggaaaaatagtccttattgcttaaactgcttttagcctgcttttgggtactctactccttgcagttgaaaacatccctccgactgcctctcccactgttccactctggctctgagcctgcctacctcttgcttttatcctggtgtgatctctggcacacccaagcatactgccagaaaaaaaatgacacaaagttggccttttctcaatccctttgaatgcactgctcccacatgtcctgatgagagacgtgagaccctgaaatcaaattcccttaggagcctcagggaaagggactgaaaagggcagagcgggaaggaggggcaggcacaggtgggttggtgacactgaagtggcctaggcagctatcacatgccctggaggagccgcagggcacatgagctgcccctgaccccagcaggaaccacgggctgtgagctgcagcccctctagttccagaggtgacctttacaggctaaggctgagttgtccaattgtctgaatcctaagagatggtggctgagagaaatgccattggcaattgccatccacagggctgcagagagatggcggaagtttcagggagtccctgcagcagggagaagcaattctacagcctctgccttgattaatgatgctctgtagggcactgtggaaacactggcaagggttctacgaaggactgggctactaaggaactgctgagttgccagctgaggcaccttgctgctcaaatgtccccagctctctgcatcctcctctcgtgattcacccttgacatctgtgcagtagagaaggaacatatttctctgttatattcacccctcactgtagacggaaaatagcttcccctcaccaggagactgtctctagagagtgaagcccgcaaatctagagttgatccaactgtgaaggacctaaagttctagtcccaccttcagatggcaagcagtagatgccacctgggcaaagatgcttatgcctgcagagatcagcaggcaagtcccatgcaggtaaatcacagactggctactttcactaagacatgaagctcttcaaactttgggcagcagagcaggatgctttgtttataaacattggcaatctcgagttttctgaaaagcttggaatggctcacaagccttcaataaattccagtttctccaattctttgtgctcaagtgtactgacacagcacaaaatgaagtggaaatgtagcaagagatggtcgagttggtgacaaccagctgatatcactaacttgtctattgacgtcactaatatcaaaccatggctaagtttccccagagctgtgcccatgtaagcattgcagtaataatcataacagcaaatatgatgggatgtgccagacaccaggctcatgtgcttgtcgccgtttaatcctcatgaccctatgcaataagaatttccttttttttttttttttgagacagagtctcgctctgttgcccaggctggagtgcggtggcacgatcttagctcacttcaacctccgcctcccaagttcaagcaattatcctgcctcagcctccagagtagctgggattacaggtgcccacgaccgtgcctggctaatttttttgtatttttagtagagacggggtttcatcatgttggccaggctggtttcgaactcctgacctgaagtgatccacccacctcagcctcccagagtgctgggattacaggcatgagccaccgtgcctggccaggaatttactttctgtgtagcattggcaagttacttattcccttgaagctgataagtaacagagccaggactcaaatatgtgtctggtggagtccaggacctgggctttagaccacggtgctgtcccatgtcctctgaactggccctgggaagctccaccttgcgctccactcatcctcacagtgtctttcccctgacatgttgcttttaggaaggtggctaattaataggctccgttatttttcaggtgatttgaaagggcagttgcagacccattaaaggtcagcaagttcatggaagccagggtgactcaacgatgacttgcaatggtgcagcatgagagcatctgtctagcagtgaagtgggtccagggccaagctcacactgctgctggctctgccctcctgtttctatggtatacagcagactggcattacacttgcccaataaaacagggacattcctaattaatatcccaacaacactttacttagagtgtgtgtgtgtgtgtatgtgtgttatagggtgtgtgagtgtagttagagagaatgtgtgcgtattctgtggtattatagcataaatgatttgcatcatataaatgaaagggaacatcactactcttctgaacacagcgattccttatggcatcccatcactggcaagaattatgcttaagggttaatctatagcttctaagtcaataaagccatgtgaattaagcctacatcacaaggctttttttcctgataccaaccttcatggctggccatagactatagaattggattctggctaagaggacagttaaaactcaagtcatagaccttcccagaaagggaaatttgattcaagaattgaaaaatcaattgtgaatacttttaataagtaaaacaagacacctgaaggcctaatatgtactaccttagtgtttgttagggcagcgttctaagcttgcaaaagaacatgtgagaattttagaaataaccctggaatcaaactgaactttataggtttgaactacttttaaggggagggctgtgtgcacgagtgtgtgtgcctgtgtgtatgtgcctgtgtgtgcctacatgtgtgtgcctgtgtgtgtgcgcctgtgtgtgcctgcgtgagtgtgcctgtgtgtgtgtgtgtatgtgtgtgtgtgttggggacagtaaagaggatactccaggctgttagtgcagagacaattttcaaataaatttaattttcttttgtgcgctgccttacagaaaagacccatgtaaatgaaacattttgaggatccaagtgcttacttagaaaaatacaataaaacaactttaaaggagcctatgagaccgaaccttttgtaactcaatagtttgactaggaattcctattccttctgcatttgagcaccacaagccaattatttatcataaaactttctaggtggtcctcagtataaaagttgagaaagcatgtcacaaaacacacatgagcacttaaaacctttaaaaacagccaccttattctgtctttccttctgattaaacaacatcaacatgaccgcattttacttaactaagacaaaagatgtgaaaactccatttactaagcgagagagcgatgtactctaaatcattagcaattataaagagtacacatatttcattatgagagattggctatacatttattttctaacccatccattagtgagaaatattggccgcacatattagtggttgtgttggacgaatgatttatatttaaaatctcattttcacttctcagaagcactttggaagtaagtgttttgttcatgctgagcactgtggatggtttgcacctcctgtgactgcttcaggcagcttcgccaggctgagcgagcacaggaaccacgtgctatgcacacttgaaacactccaggtttcctccctatgcagacaacaacagccatgggaacttccctctcctctgtatcaacagaagtatagtggaaagcagaacccagctgttacgggtcaaactgtgtcccccaagaattcatatgtgggagccctaatgcccaggaccttgaaatgtaactgtatttggtgatagtgtctttaaagaggcgattaagttaaaatgaggactttagggtgagctctgatccactcagacttgtgtccttatgagaagatgaaatttggacacaaaaggaggtatgaaggatttgtgtacacagggcaacaaccatgtgaggacacagcaaaaaggcggctgtctacaagccacggagaggggcctcggaggaaaccaaccctgccaacaccttgatcttggacttctagcctccagagtgatgagaaagttaatttttgttgttcaagtcacccagtctgtggcactttatggctaccctagcaaagtaagacatctgcttgcttattcattgggcaaagatagatctagcattatgctgatgattctcaaaacatggcaagccttggaggtttaatgtcagctttgctcccattccagtaaaggagagccatcttctgtgagtaacgatttcaccaagaacttaaaattttgagagatgtctgacccatgtgattatagtaaatgaccaagtcttcagttaataatgctagcaacaatcatcaccagcatttattggatgcttatgatgtgccaggctctgtactgcacattctatgtgtgttatctggtcatcatccttgcaatcatattaggctgatatcattgttaatccagctttacagaaaaaggattctatcttgcccatggttacataactaggaagcccaacttggacccaggtaactcgtgtctggagcttatggttttaacctctaagctatattcactggtgatgttagtggccttacaatgcaagcatttgaaaatgaagtgatagccttattttttcctccaaacaagtgactatgatgataggggaccacattcttttgtgagcagggtctgctttctctctactcttctatcttgcccaccttccagagtttatccacctcctgcaggaagccttctggccctaccctatctgatgtggtttggctgtgtccccaccaaaatctcatcttgaattgtaactcccacaattcccaagtgttgtgtgaagaacatggtgggatgtaattgaatcatgggagtaggtctttcctgtgctgttctcatgatagtaagtctcacaagatctgatggttttaaaaatgggagtttccctgcacaagctctctctttgcctgccgccatccacctaagatgtgacttgctcttcttgccttccaccatgattatgaggcctccccagccatgtggaactgtaagtccattaaacccctttcttttgtaaattgcccagtctcagggagcatgaaaatatactagcacaccatccaaagggctccttcactcctacattgcttattgatgaaattcttcatttggtacttggtataaactgaccttatgttctcatgcacatttgtcatgtcttaccaacttctattcaataaatggatgtcagtattatgtgacagatattctgggaggtcaccttctgtggctttcatttgttagaaggaggttgctttgtagaggtcagtgtgtggagataagctggttcaattgatcccaataggagatcacctgaggttacctggacaaggatctggatgaccaggggctcccctcttccccaatagagcataggaggttgaacagcctgtaaacagccagcctctaaacccagactgccagggcccgagtgggtgagcatgtccctcaagggcaaagctgctgtcactcttgctgtatatggagggacccaccgttagtgtcagatgaacaaatcagttttctctcacatgccaactatgatcagtcacatagaggtttgcattgagaaacttacagtctgagatgcaggaaaagggttatccagaatcactgagaagcactttttaaaaataagagtgcttaggcccccccagcccagactgattgaactagaaactcctggaggagctgcccaggtggttctaacatacagacagggagagagctggagagaatcccagccctcatggtgattacacctggggagtgaattggttggttctgtgaagtgagagccacacagtaggtcatcaatatcagttcctatcccccttcttttgtagcccccctagttatctactaggcacataatagaaactgagtaaatactgcgggttaatggacatgtcagctcaaataagagcagagctttgccacgatgggcaagccgaacaccctgggggagtagagtgaccaacttaccctgattttaaaactgaaagtcccaggcaaatcagagtggttggtcatcctactggaagaagaagtgaggttcctacagcatctctgcctcccacctaaatcactgagattcaaaactgggagaccctcaaactcacctggggtgagggctgtccacattcctagctgccacttcactgtgacctaggacatccacccaaggggaagataagatatgtctccagcagtaagaggagttaggcatgttagcaccagatgagataggtaaaaaaaacaaaaaaaacaaaaaaaacaaaaaaacaaccaggggaaaacctgccacccagacctcaatattaaatttgacttgtaactcctatctgcgaaagctactgcctgattatagaagtgtcacatatatggttttgttttgttgtgttttggcaatgaatttatattagagtcacccaagactcctctgatgccctgcatggggacataccttcaagtgccgttttacagacattttcagctattttcagccataggtaaaaatttcaaaagacaattttggcagctataaaggacacttctgggcaattggggaaactcgaatatatatatggacaattagatgatattcattcaggtgtgatcacggtggcattgattagatagaaaaatgtccttattttttagaggtacatactgaaattttagggatgatatgttgtctgtaatttacttcataataattcagagaagaaaattggtaaatattaagacaaaaacaaaccatagtaatggaggatttgtatgtagaaggtgtttccccaactccacatggtgaaatatgatgaggtgatgaaggttttttttttttctttttttgaaggagtctctctctgtcaccaggctggagtgccgtggtgcgatctcagctcactgcaatatccacctcccaggttcaagcaattcccctgcctcagcctcccaagtagctgggactacaggcgtgcaccaccatgtctggctaattttttgtattttagtagagacggggtttcaccatgttggccaggatggtctcgatctcctgacttcatgatctgcccacctcagcctcccaaagtgctgggattacaggcgtgagccaccacacctggtcaatgaaagttcttaatgatgaggttggtcagtgaagagattgttagtgttcatcccatttactattaggggataagaaaatgggtaattctttttattttattttatcttattttactttaagttctgggatacatgtgcagaatgtgcaggtttgttacataggtatacgtgtgccatggtggttttctgcacctattaacccatcatctaggctccctccccatcccccccacaccccacaacaggtcccatgtgtgttgttcccctcaaaaatgggtgattcttaattttcctaatctctcaccccaaaaaatggttttaatgctaaagtctttgcaatttttttgaagcctgaagatttctaaggccggcctgctacaagaagtgcatctgagtgagcacaggttggggagctagagggagctgggcccccacactatcgttatggctgtgggaccttaagcaggtggcagaacttcatggaaactcaggctccgtctttgcaaagctgggatgggaccacatgaaatgctatggatgcagagctggcctgggacaggttagataatcaatgaatgaagattctcttgctgggatggaggaaggaaaaaaaaatgtaattttttttttcaatgtaaagcaaagaaagagacctgactaccaagtttagcaccaaccttccacgcctgtgggatagatgtattaatacactgaattaatagttactggaacccaaagctgtcccaggaactatgcatcacaggaagtagccctgtgacatttacattataaaaattatttcttaaagttaaatcaacataggcagatttctattattaattagcccaacctagatttctatacaaaggaaattgaacttaatataagttggattcatgttttcccatttccaaccttaagtataatggaaattactccatttatcgaacagatactatgggccaaacacatcactagatgctattaattttcatcttcagcacaccctaatgaagtggatattactacacaattataccccacttagcagaagtaacgcatatcagataggtgaaatctcatgcccaaaagccataactgaaagacaacactgccagcacgatgacgagaggcactatgaccttgccatcccaccgactgttccccttctggccctgctacctacaagccatagactgctctgggtctcagttgtcttccttggtaacatgagaatgatgatgggaatgagcccatgggatcctgaggattaaatgagctagtgtgttcatccatgcaaagcatttagaacagcttctggcatgtggtcagtgttccgggagatgaggctaatggatttaacaagtaaaatctggccagcagaccctttatgttgccttcatagtgaataaactggtggctcctatcatcactctccaatgggtgcaaaaataccgttagatagaaggattaagtgctggtgtttgacagcacaatagggcgactacggttaacaatagtttattgtatatttcaaaatacctagaagatttggaatgttcccaacacacacaaaaataatacatgtttgaggtgatggatctcacgattaccctgagttcatcattacacattgtatgcatgttttaaaatatcacatgtaccccataaatgtgtacaattattatatagcaatagaaagagagggctagaaaaattcaagtcttattcctcttgttatgctgttcagtagggctgaggctggcccgttcctggccttctggccccaaaggtcattattcagccacagcacaccctctggttggcttcatcactggctttctctgcatattagagtgatccagacctgctatgccttactggctgtactgcagaaatgctttctatgctctgactataaggttgttaaatccttaaagcttgttagggcagggcttcaaaactcttgcttggggttaatggtgtcttgtgatgcagagagcaagctgcctcacatgttaagaggaaatttctgtggctgagaatatcttgaaagacagagtttagccaggaactcttgaggataaacaagctttgatatattacattgtgtgcacataaatgaacattggtcccctttcagatacattccagccatactaagatggatgaacttaggttggtctagggttggtgcgtttcttaaaatgtttctgtgtttgtgcacagcacaagggttccaagctgagttggaatataggatgcgagggaagtggtgcattgcattgtcacaaaacagaggaaatgattcaaagaaacaaaaagagaagtatttcaaaagtaaaaaggggaatttcttccagccacagacataaatagaagaaacagttcattcattcactcactcgcctattcgttcaacaaatgctcatgggcttcttgtgtcaggcactgtgcaaggtgtgaagatagattaatgagcagcacttggttcctgcactcaggactcccactctggagcgagaaggcatccatcattgattatgtttggccttgggtaccacctctgtgtgctggacctgctttcagccctgaggggatggaatagggcctaatcttttcccaccctcagggctggtagttgtatcttccttggagctgatgagatggtttgagaccttcctcagagtagagacaagactgtcagccccttatatccccactcctgctgctttgcagtgcttctgcccatctcctccttgctgaaaaatgttgtggggaattgcaagacaggccaaccctaataattcatattctccttcttcctctccttccctccctctaaagaaatgaattacatatcccataagcatatataattaaagaaaattaaatctaatgtatccctaacccatcatgttcatgtttatatactctctgtgcttattactggctattaatactcctattgatcttagcttagaccaggaattcgagggtggagattttagttgctgttgtaattgacataaacatccttctgcctacctattagatgactaaaatccaatcaagtgattagcatttactgtgaacctgctacgtgtcctgcactcagtactatgaacaacatggaagaaagataggcacgttgttctgacccactagccacgtgcccagccagtagccccaggctgaggatgagctagcactcaattagaacaagcccagagcatcacctccctttctatcccaactcaatcctcttgggccctctcaccctccactttctgaagaatccctgatccaaagcaggacattttgacacagctgtgttgatatggctattttgctttgaggtatgttttatgacatagttgcaatgtgtattaccaagaattatgcacagcaaacacttctaatctttttctctcccgttcccacccccacttcatctgggagacatttatttttctgcattgtctaaactgcttttgaagtattgtcttctatttagtggtgttttcttcaaaatctgttagaaaggaattagtctttatggatatgttcctgacttccaaaaagtctttataaattaggttaatgctattaaatataacttacatatactgctgggtactgaggatgattagaagtgtatttgaagcttccctctgcgatttggggaagagagtaagtgcttctttttaggagactgaaaggcaaatggcactgcggagacaggaggatggggaaggccagcttcttttggcgggtcacaggggtaggtcgagatggtttggatttggggaacttctgattttgtaggagtagcagaaacttctggcactcactgacatgtggccttgaccaagtccctcaacttctcagagcctcagttttcttatctgtaaaatgggcatgacagtgtccactgaaacaaggtgacatcggagagaataaagaataaagtatttaaagctttatgggaacagcctgaaaagaagctggactgaacttggcttagtctcacctcacctgggttaacactgtcccatcccggtgtcatttgaggctggataattcagaaatccaacatgcttcatgtagaaatattgcctgggtctctcactgagaccatgggatcagtccacatccctgtaggtgaggttgaggtccccactgtcagtcaccttaagggaggttggtctggaaattgaagactcagaagagcagcctttgatggggatgaaaagaaggaaatgaaaaccaccaccttcaccctctccatcaacccaaggtctcttgcacatatccaggaacttccaggtggccggggcaccagggaattccctggagaggcaggctgggttgctctaattccctttcttttctcaaatccttcagtgatgtctcttgcctggtttaactgaggagtgtaactgtgagggacaacaggaaacaattttccccgatgactattcctgctatgcctcatagagccctccttcctggctttgtagagacctcctaaatgtcagacactttccttgaagtcacttcatctgggtaataagatgtggtcctgcccatttttgaaggtcaggctcagacttaagtgaaaactgccccaagtccagccaggtctgggaggaggggaggagccacagattacttctttatgcatgggcccctcctcctggccctagggttggttgggtaggagagctgggtgaggggctggagaacagacttgtctctggtgactgccctgctgtggctgctctctcctgggaggcatctctggtggtttagcttattttctaggccccactagagggtctcagtttctagttgctctcccagacctgggtccttcctatgtgacttggcctcatcttcgcccagctgctggtggccgcacacccactctcctctgatgttggagtggggtctcctgcaagtcagcagtgaccagtcatgcccatctctcagaaactcgcacttcaatggggcagcccctgccccctatactgggccgaacatcagtttacccccctccccccaacactgggctggacatcagctcatatccctccccaacacacagggctggacatcggctcatcccccaccccacacacacacactggactgtgcatcagctcatccccccgacacacacatactggtctggacatcagttcatcccccccccccccacacacacactgggctggacatcagctcacccccctcccacaacacacacactgggctggacatcagctcaccccctccccccacacacactgggctgggcatcagctcaccccctccccccacacacactggactggacatcagatcacccccctccctaacacactgggctggacatcggctcatcccctccctccacacacactggactggacatcagctcacccccctccctcacacaacacacactggactggacatcagctcacccccctcccacaacacacacactggaatggacatcagctcattgccctgcccccacacacactgggctggacatcagctcatccccctcccccccacacacacactgggctggacatcagctcacccccctcccccacacatactgagctgggcatcagctcatctcttcccagcgtagctcctcctcaagtggtggggaagagttcagcagcccagggactgagtgggaaatggagcattagttttctcttctcatagccagtcacagccttgatccccttagaagggcttctaatcaggggagcagcaggaagccaagcgaggccctccttatcctctccacaaagcagaggaagctgcacccccttgctccaggcatccttggagacagagggcatgctactgaaaagccacctccccataagctccaaagggagctgaactgcccacagctcactaattttgctgttggttatttttctattgaggtataattcacgttccataagatccatgatttttaagtgtacagttcagtgggttttaggacattcacaaggtcgtgcaaccatcacaaccatctgatttcagaacattttcatcaccccagaaagaaaccccaaagccattaacactcgcttcccatctcctgatctctccaggccttggcaatcactaacctactttctgtctctaagggtttgcctattctggacatttcatactaatggaatcctaggataagtggcctttggtgtccggcgtgtttcacttaggttaatatacttgaggttcatccacattggagcatgtatgagtacttcattcctttttatggctaaataatattcccttgtgtggagagaccacaatttatttactcattcattaattgatggatatttgagttgtttgtttcaaacttagatcttgggccactttgaaacctttattaggaaaaactctggatcttcacaccactattttattggctaacgttacaaccgaggttgttttgtggtaggcagatgaaagagtggaggaggtgtggggagagcaggtccctctcctctgctgggtctgtgcaatgccagtgaggctgcccttcatggaagcagctgagacagcagagccaaggccccagagcagttatgggcagcagaaagtgttttgtgtgggagcaaaatagaggctggaacaagtggtgtgtgaataagccagtcctctggggaggggaaaagccctgctttgcagcatttgctaatttccatggtataaatactctcattgtggccaatttcaagctacaaactaggtgacgctgaacacagacttgggagaaatatacaccatggggttggtacaaccagttccaggacaccactgggctggaactcagcttcctgcacatggatgagaaagcagctccctagggacctctgggaagcagctggagactctcagagggggtcagtttccagcaataaggcacctagcatctgcccaatgtgtgtttccctccccgatcttgttccaaaataccagtcacttttttttttttttgagacggaatttcgctcttgttgcccaggctggagtgcaatggcatgatctcggctcactgcaacctccacctcccaggttcaagtgattctcctgcctcagcctcccaggtagctaggattacaggcacccacaaccatgcccagctaattttttgtatttttattagagacggggtttcaccacgttggccaggctggtcttgaactcctgacctcaggtgatcccccacctcggcctcccaaagtgctgggattacaagcaccagtcacctctttgaattaggcagcaaaaccagagcattcctgggcaactagcctttggttactctaatgcttcctcatcatgtagggtcacgtaaaaagcccttctactcactgcaagtccctgactaccctaccagtggaggaatgtggattgatgaagtgtttggtcatagctgaaatacaaccctcttggagcttctttggaaatataataagggaaatgatagatcggcattaaataaagaatattgtataatagttcacaatcctatgataatagttcataggaatagaaaatgacaagtgttgaaattggaaaaagtctgattcttaatgtctacacctgtacagtccagtatggcagccactcacatgtggctgttaaacaaccgaaatgtgactagaacacattgagaggtgctataatatacacaccgcatctcgagtgtttgtttagtaaattaaaaaaatgtaaaatatctcagtaagttttataatgattacattttgaaatatatttttgctattttggataaaataaaactaaatcatttaatttcacttgctttttactttttaaattttaaaatttacattttaaattgcatgtgtgacttacattctgtttctattggatagcacaatactagatactattggacacctcttaatcaatttaaacaacaggagctacatttattaggttttactatgtgtccaacaccaaatgaaactatttatgtatataattttatttaatcctttcaactttttgataggactcgttatccctgtgttataaaggagaaaactgaaggtcagagaagttaagtaacttatccatgttcacacaaggagtcttaattcaaatcagtctttggctcaaaagtctgtgctgtgatgctttttgctaaagcaaatgaaggatttcctaatctctaatagacatataggttaatgggaaagacaatttgttagcagtctgtttgttttggtaactgtatattttgataggatttcaaatttagagaaaaattgtaagaatagtacaaggaactcacatgtacatggtccagactcaccatctgtctataggctagggatagagagagagaaaaagaggatttttcccctcaaaccatttgggagtaagttgcagacatcaggtccatatactccaagtactgatgtgtgtgtgcttccttagaacaaagacattctcttatttagtcacaatccaatgttcaaaattaggaattttaacagtgatataataccatttcccaatgatagtccatattcagatttcatcagttgtcccagtaatgtccttttcagctactttcccccattggttcagagtccagtccaggataatgcattagatttagttgtcacgtctccttaatctcctttaatctagaacagttcctcagcttggtgtgctgcttgactctgatatttttaaagaatgcaacccattattttgtagaatgttctttagtatagtttatctggattcctttaggatcagaatcaggttttgcactttcagcaagaatattacaaagtgttcctggtctcactcagcacatatttgctagctgcttttaaatattgtttatgagactttagcataaaagtaagaaataagtctttcaaaaacatttctagatttggtccaaatatttctagaaattggtccaaatattcctgtgcaaaacaagtgtaaatgttaggtgtaaaatatagataatgataaatatggattataataattataacatggctatattttcatattttcctgaccctgtatagaaaacaattatttttaattcagtctagcaatttgaaagaaagattagaatatatgagttggcgatggatagataggaaaagagagtgagtataaggtcatttaaccactaaagatggtttaatttcaaggcacctgttgtttagagtaaaataatttctttgttctcttttctcgttcttttcacttcaattcatatgataagtgctttgattagagtcatcaaactgccattgccagatccactgctatgctgcaagaagatggtgtttgttcagagttagcagcaaactcttataatctcatttcattcaaatgatgtttttattgcaagatgtaacaccagcaacctaaactgtctctgacagtctcatatttttcttgtttaagaaacagctgtcaaaaggatctgtgtgagctaagcaactgacaaattacaggaaaattatatttttaatcaatcacttgcctaaagtcatggaatgtggtttatagttatccagatataacgccatttagaaaccttttctttcatcatagggcatctagtaatttttatggttttcttcttatcctgtggccaaaaaaaaggatgtctaagacaaatgcactttaaatataaagatatagactgaaaggaaaagtatagaaaaacatataccatgcaaaatgtgagcttaataaacacgatgtggtgtggctatattaataccagtcaaaataaatttcaaggcaaggactatgaatagagataaagcacatttaataatgacaaaagggtcaattcatcagaatacatgacgacaaaagatgtatgtgaccttcaaaatatacaaaatatatagagaaattcaaaatccacaaagaaaaaaatggcagtgttagagaaatagaagtaattggagattttaacacctcttgttcaataactgacagaaaaaatgggacaaaaagatgggtaaggatatagatttgactatcaacaaacttgacccaattggcatttactgaacagtggtagaatacacattcactttttaagaacacacagaacattcaccaagaggctatatactaggttctaaaatgtctcaataaatttcaaaatattggctccctctccccctccccctctttgcatggtttccctctgatgcccagccgaggctggactgtactgccgccatctggactcactgcaaccccccctgcctgattctcctgcctcagcctgccgagtgcctgggattgcaagcgcgcaccgccacgcctgactggttttcgtatttttttggtggagacggggtttcgcagtgctggcccggctggtctccagctcctgaccgcgagtgatctgccagccttggcctcctgaggtgctgggattgcagacggagtctcactcactcagtgctcagtggtgcccaggctggagtgcagtggcgtgatctcggctcgctacaacctccacctcccagccgcctgccttggcctcccaaagcgccgagatggcagcctctgcccggccaccaccccatctaggaagtgaggagcgtctctgcctggctgcccattgtctgggatgtgaggagcccctctgcccggccgcccagtctgggaagtgaggagcgcctcttcctggccgtcatcccgtctaggaagtgaggagcgtctctgcccggcagcccatcgtctgggatgtggggagcgcctctgccccgccgccccgtctgagatgtgaagagcgcctctgtccagccgcgaccccgtctgagaactgaggagtgtctctgccccgccgccacgccgtctgggaggtgaggagcgtctgtgaccagccgccccgtctgagaagtgaggagcccctccgcccggcagccgccccgtccgggaggtggggggggcagcccccgcccggccagccgccccgtctgggaggttggggggcgcctctgcccggccaccccgtctgggaggtgtacccaatagctcattgagaacgggccatgatgacatgacgatggtggttttgtcgaatagaaaagggggaaatgtggggaaaagaaagagagatcaggattgttactatgtctgtgtagaaagaagtagacataggagactccattttgttctgtactaagaaaaattcttctgccttgggatgctgttaatctataaccttacccccaaccccgtgctctctgaaacatgtgctgtgtccactaagggttaaatggattaagggcggtgcaagatgtgctttgttaaacagatgcttgaaggcagcttgctcgttaagagtcatcaccactccctaatctcaaggacccagggacacaaacactgcggaaggcagcagggccctctgcctaggaaaaccagagacctttgttcacatgtttatctgctgaccttccctccactattgtcctatgaccctgccaaatccccctctctgagaaacacccaagaatgatcaataaatactaaaaaaataaaaaaataaaaataaaaataatttcaaaatattgaaatctttaaaagcttatttagaaccataaaattaaattagaaatcaataacaataaagtatctaggaagtctccaaaggcttaaaaattaaactacccccttgtaaaaaatgcacaggtcaaagaggaaattataagcattaagaaaatattttatacagaaaagtgattttaaaacacatatcaaaaattcagagattctgctaaagcactgacttaagagagatgtatagcttcgaaaccacctttgcaaaattatgatagaaagaaaaatctgacatggctgattccatctcacttctaacctcacaggctagctgtttttgctaattcctgggcatgggccaagctaactttgggagaaatttggtttatattttaaataacaatagcccttccctaaaactaaactgaccttgtaaaactaatgaaaggtcatcaggttaggagaatgagaggggctggaattctgctacaatgtaaagtaggtaaacaattacagccattttcccggaggtcacaagatttgcaacttccccaattactcctgcagataacattactattgtagaacccaagtttggctttttgaagtgtcttttcagggttttgcacttctaacaaccagatggccccatttggacctgtgacttaaccagttctgtggccccacctagaagccaactcagctcatgaggaccatatttcataccaccatcattgcatccccaaccaattagcagcacctatagcctagccccctgcccaccaaactatctttgaagaacccctaacctccaagccttcagtgagattgatttgagtaataacttcgtctctcacctggtgtggctagtctcatgttaattaaactctttttttatggcaatgccttgagtctccgtgaactgattttgtttgtgcaagaagaacccatcgggcagttacagatttaaatctgaaatcactgacttgaaatatttcttcttttaaaatatgttttcacattatgaaactaagaaaacatgggtgaattaaactcaaaataagtttaagggaagaaagaaagatcagcagaaatcaaagaagtagaaaacagataaataagagaaaattagcaaggacaatagttacttttgtgaataaaatggtaacattgataaccccacaacaagacttcacctgagggttgatcagagaatctgagccaatatgagtgatacagaatatggtaggaatctgacctcatgcaattgtgctgtaaaccagaaataaaactctaagcctctcagccaactgatggatgttcctcttggccaagggcattccaaagcaaacccgaaaaactatttaatgcaaggatggaaaggagtgggggtcagacatgcctcattgtaacctcttccctgtggaattcaggcacaactgatcagcattaacattaaaacagagattctaagactgagagaacaaactgtttgtagcaataagataccaaattccaacctgactctagtatagtattgcatgacaagtagcaggccctgaaagaaatcagtcttttgtcccaaaatatacttatttgatatattttgaaatggtcttgcaaagctgtctcttgtgggggaaatttacattctatagagaatcccctgttctttccaggtctttttctgatcctgaagaggttggctgagagtctagcaccttttgagggtctgaatagaaaacacttgccatctattgcctctaagggcggccacctaggagacttcatctacataagaaccctgttttccacagtcctttatcttaacccaaacactcctttctattgattccaggtcttcagataaccaattgccaatcagaaaatctttgaatccacctatgacccgaaagccctcccactttgagttgcctgcctttccaaactaatgaacaccttatatgtattgattgatgtctgtctgtaacttctgtccctctaaaatgtttaaaatcaaactgtaaaacaaccactttggggacatgttttcaggacctcctggggctgtgtcacaagccttggtcactcatatttggctcagaataaacctccttaaatagtttatagcatttgactcctacgttgacaggggtaactggttaaacagtctatgtgaaacaagtgctttggtgtccaaagcctatagagccaccagtcaggaacaaaacctggactagaagtgggagaaatccaggataaactggagcctcggaggacccactaggattcaggggcacaagctggaacgtgcataggcctttcactgcctctgagcgtccaacttcaatgtctcaagtgagctgctggtgctcttgttgtacagctgcataggtggctcaaccagggttgagaaaagctggaggcagaagcccagaaatgaggggagctgtagacctggctcttgcccccacatatatgatgaaccaccaaagaaccagcaatgtgcaggagctcagccacgccttcccatacatccactggctgccactttattctactgtgaaccccaaatatctgaaagaggtctcagttaattttgaaagtttattttgccaaggttgaggacacatgcccatgacacagcctcaggaggtcctgacaacatgtgcccaaggtggtcagagcacagtttggttttatacattttagggagacatgagacatcaatcaacatatgtaagatgaacattggttctgtctggaaaggtgggacaagtccaagtggagagggggtttctaggccataggtcaataagaaagaaatggttgcaatcttttgagtttctgattagcctctccaaaggaggcaatcagatacatatttatctcagtgagcagaggggtgactttgaatagaatgggaggcaggattgccctaagcagttctcagcttgatttttcccttcaacttagtgatttgggggccccaagatattttcctttcacactgtcttgcacatctcacataaatttctcttggggacaaccctgactcagaaccaaacagagaagggaattctgagaaaggtagtttttgctttagcatgttgacacaatacctatccacactgattgagaaaacaaagaaaatacaaattaccaaaatcaggattgaaagaggtgatatcactatagattttataaacatttatgaaaaacaagccctggctcattcattgctcaccttcagaatttcctggttgtgtgtgctcctgggagaaagaaagtttacattaaaaaagaaaaagacatccaattacctatccttcttgtttccttgctgagttaaatatgcctatgtattaaagcaaaaatttaaacaatcgatcaattagagtattaggatgtactttgctaaaggattcttcaggcagcagaacatggacaagtttcatggtaggttatttcactgacaagctcaagggcaagaacggtgaaatttaaaatcattagcctctgcgcattaaagattggtgagaaatgaggacaacatttcagaaatgaaaattatatgcccacaatactttcaagcagaattaaacacaatcttaagacccacttattgccggaagtgaacattctttgcacatgctccagctcccttgtttccttacaatacagattctttgccttttgtagtcaggattaaaggacataacatccctcactatgcagagcgttgtgcaaatagtgatcatgagaaaggagcctgtgagttaggtttctgctttatttgcccatacaaagagaacagagccttctagagtagctttcccattgtctcattatttgtcatacaactcagcacacactggaagacaatcacaaggtgggcacacagaggtttgatcgaggtcctgttactcaaagctcccctttgcctctatctctattgccaatgaggaaatgtatctgatcaattaactcacactagcatacagaggtgccttttcagatcagagtatttctaaaaagatatctggagccgagcatggtggttcatgcctgtaatcccagcactttgtgaggccaaggtgggtggatcatgaggtcaggagttcaagaccagcctggccaacatggtgaaacgcggtctctactaaaaatacaaaaattagccaggcacagtggcaggcatctgtaatcccagctacttgggaggctgaggcaggagaatcgtttgaacctgggaggtagaggttgcagtgagccaagatcgtgccactgcactctagcctgggcgacagagcaagactctgtctcaaaaaataaaaatacaaaaagatacctggagaaatcaactacaatatggatttataatggtgggatatcaagcactggtgaggctgagttagaagagatttggctactatgggaggaatttttagactctgcttgaatcctttctccctctctctgcttccttcattgtttcgtggaaatctagaaagtgccaactacctcataagcaggtgggttaatgcctgccttgactggatgtttgatctcattagccgacagtttcctttttcatcatttccaacagcgccattgtttatgaccccagatagacctgggatgctagttaccagcctgatcatgtccactgtcacatttcatgtcttctgtcagaatttatgatgtagcatcctttggaggtcactaaaaacatcttcagaggaaagagcttctgtgaatccactgagtcataaaaccgtctcctagagaggagtatttctcatggatcagaagctgtctggaagagcagcttgcaggaaggaagagttaaatgagacagtcggttgcgcaaacacttgagtgagaaagcagtgagagcgattcgatgagctttttcttcccctaaaattaattacaattttaaaggctggcagcttgattttatattgcaactttcttcaattaaatctacattttttctatcttacttcatgtcatctcactaattggttgcagcatctacttgtgctaccaccaaactgtctttgcttaaaagaagctgttttactaaaagaaaattaaaaatgtaaatgtatcctatcttatattgcctcttccttttctgccagaagagagggggaaataactgatcagtgaaatcctaagaggcacaaactggagttacatttttgcaatgtgcgggacagcgccatgaagctacaatgtgtctggtaccctgggttcattctcatccagtcaatgcatattgagcacccactgtatgccaggccctggtctagatgctttggggtctaagcaggatcattcaagtgtccataagagcttcctccagcttcccaggcatggcagaatcattagcacactcaaaactctgtttctggtggcctttccccaaaccgttaaaatcatggcaatgtcaagtgaacaattatttccttattttccttcaataaatgctggtagctattgtattaccacctcctccactaacatccattttgaaaataatggcaattcagtaaaaagcttagaaagcaaaacaaagtaaaattattctgtttcattaaacaacattaaaagactgggttcaaaatagggtctgtgttatactcagctgactctgacgaccaagtcagcagggaagtccctccaatttcttaccatctgtgggtgctagaagggcttgcaaacctgctgtgtgtaaaaggtggcagtcaaagaagcctcttaaaacaagaaagggatttgaaatggctgtgtccaactggttgtcaatctggattccaggggccctagaggttcaaggtgatgcctccagaccactaggaggagctgttgagggtggtcaaggggccaacagactgcaacctccagttccccaccccaacttcaacccaaagggtatccctttcacctgtcttacctaccagtgtcccttgggacaatccatgaaagaaaagagctctacagaagaaaagggctctacagccttaaaaataaggaaacccactggcctatgacctgctgtagcatgctagagggcaatgctgatgacgtattctctttgggactcaaatagtttgaaacagcgaacgttttgatgaatgacgaagtaaaagctgggttggccaacactgtactgttacagatgatgcttgctcctctcctgcagttctgcacactcctccacccaacatcaagtgcctggggaagccaagccagcgtagcacagcccccagatacttcaacattcaaacttcagacattcaagtccacatttccatgcaatcctgcataatgtaagcaaatttagcttgcttaaaaatagatactcccaaggttgggtaatgcacggccttttttgctgtaaaccaagatgcagcagatggagaccttaaccattattctttttgctccttctttttctcagttcatgacacagtaaaggatgatttcagagaaaagttaataagaatatgcatctaatgaggattgcaaaatgttcactttgcagtgatggataaagccattttggagtcaatcctaaaaagccaagactcctgggtgtcagtcaggatggagcgatgcacagaacctagaggggaagcagtccaaccccccagcagatgcatgagtttatgcagaaatttgaaacaaggctgccatttattaggtatttatcatgagccaggacctctgtaaatagcatctctaattctcaaaacaaccttttaagttaagtattttcattttacagataggaaactgaggttcagagaagtagtattatgtccaagccgccaagctagtaagtgacagaatcaggttgcaaatcagatctgcctgattgttctcttcctgcttcccacactaccccactgtttgcacatctccagtgacagggaactcactgcctcccaagccacatgtgtgctgaatagcgctaaggaataaaaagcactttgtgttgaaatgaaacccactgcctgttactgctacacctagaacctgcatctgccctttggagccacacaaagtccatcaaagagggcttccacaagacagccttccaaggaatttgaagaaagattgtggagctcaatttctcttctctaggttaagcctcctggggctggggtgtagggctcaggatgtgggtcctggaaccagactgctggggttcaagtctctgctcagtgacctactgggtgaacgagatgaatttcaaattttcttttactcagtttcatcttatactctgtctcatccataaaatggtgtgaaagcaataacatctacttttttgtgtttatgagaattcaataatttatagaaagcacttgccatacagcttgcaaacagcaggagcttaataagtgacaatgataatcagtactcatggcttccagctgtgtaacaatcctgctgtttctcctcttgaccttttcttattgatgtaggggcctcttgaatgtgatgaggaaacagaacggaaaactccaggacaggcctgagcagcttgtaagagaagagcatcatcgcctttattctaaatgtgatgcttgttttaacgtaggctaaggggagttattagtttgggctatagccacattatactggtaactcgtattaaacttggagttaacagaaaccccctgatatttttattccaccctccatgccatcctaactcaagggccctctgaagtctaaagctgaaaggtggcttactcgaattgagtggtgggtaaatgggggttggttatgcataatctgtttttcagacatttgaaattctccatattttttaaatgagggatttaaagatttccaggacttagtctgggccaacttagtgatgattgaatgaaatttattgaatggacagatggaaagatcgatctggtaagtccatggatgtgaaaactgaggatctgagattttaagtaatcttcctgggtctcataaccagccagaattaggcatcagtcttcaagcctggggaaagaaactggcatttattgctttttgtaccagacccctcgccaggggctttacctgccttttctcatttaatctttacaaccaacttatgccgacaaaaccaaggtccagacgtcacccagcaatgaatggcagggctcagctccaaacccaagccaccagaccacacactgcctctctccagctctgtgtcgacgggtagttctatatgcaaagctatctatattgttttaaggataacaagtaacattaagcaactatctgctggctcctcttctatgtgccttatttctttcaactcactaatcctgatagcaacaccataagatgtgaggcagggaaaatgtaaatgtcttgctcaagttcatcgttaataagtagaaggactgagatgtgaactggatggtctagtctacggactgtatatttaacaaccacagcctattgattcttgtctatcaacctggaatccagaaatacatgcctcatgtaggcaccctccagaattctttgtcctccctttctcgtgtatgtctctttccctagacccttacctcctttcctcctaccccatcataaatggttgcttcatttgaaatgatctaacacaaaaattggtgaaatgattatcaaatttgcagagtactcaggttgatgtgtgtcaaacacatttattatgcaaccaaagatgccgattctggcttgttttctcaattctcagctctaaaagcttgacaaggaacattactagaaaaacacatgctctgtagttaagatggatgaaactgcagtttgtgttgattttggtaagacagctagttaagaacatgtttaattacctgatcccaggggttgtgtttgaattaaccagatgttggttcctctctgtactggaagatgttctcaacggattcttattgatgataggaggatcaatgggtaagtgtgcttcaaagtaattaataatgcatgtttaggttagagaattcaatagcttaagagaataaaatattttaattcctatatcatcaacagcagttatttgcaacaaaggacgactttgtcccccaggggatatttggcaacacctagagactttttggttgtcacaactggggtgagaggtgctactggcatctactgagtagaggccacagcttctcctaaacatttacagtgctcaggacagctccccacagaaagaattatctggctcaaaatgttaatagagtggaggctgaggaacacttatctataacaataccaaaataatacaaatagtaatgagagaaaaggtattgatttcacgatacagaaaatgattcataataatagattgacattggtccccaccatcacatcaactctattaaaatgaatgataatggttataatttagttaaaggtcacactgaagcagagttatcagtatccaatgaaaacatttctagccctctttttctgtagaaattgttccacaacagccagtttttctgggattcacaaattcagggataacatgtaacacatgggcttagcattaacataactacagaaggagaattggcttataaacctgaagacaggctcagcacggtggctcacacctgtgatcctagcactttgggaggacaaggcaagcagatcacctgagatcaggagttcaagaccagcctggctaatatggtgaaaccttgtctcttctaaaaatacaaaaattacccagcgtggtggcgcatacctgtaatcccagctacccaggaggctgaggcaggagaattgctggaacccaggagacggaggctggctgcagtgagctgagatcgcactactgcactccagcctgggtgacagaatgagactccgtctcaaaaaaaaaaaaacaaaaacaaaaaaaaacctgaatgcaaacgaaggttcaagtgaaggtgtcacctgcttgggtaagtcatataagtcccatgcctgggtttccctaatcttataatgaaagtaatagaaaacttcctgaggcattaagatgattatattaaataaagcatatcagccccttaataagaagaaaacactatcctacagaaggttttattagaagaatcgttattacaagtaaaaacagacacctcaaacagccatagaaattgcctgataattctaaattctaataacaaaccctaaaatagttatgccctagtcaattcaatcaaagacttagtcattcttttctaataaaacatgattgtttgaattaaatgctcttaataatatcccagaattagataatggcagtgcacctggagatttctctattatcaacagaatagcatctctttgagaagcagaaatggttgagtgagttctgaaatgagactagaaaaaacaaaaatagatatggggaaaaagaacaatgtataaaacaatctttcaattaagactaaacagaaaaaagaggcatataggccaaaatctggggcagagaacactcttcccttatggttttatgacattagacaagtttttcagtttcaagaggacaggcacatgattttagtaaaaggaaggctgtattgaataactaaaggcgtgaaaatagaaggacaaacaatttttaaaataaaaaaggcaaacataatgccctaaagcatatccttggttaaataatttatttttccgagttgcatggaacaagagcaggttaaactgtacccttctgtaaaattaagtagaactctctatataagggtatcaggagcagagggcccccttttaatctgtgaagtgatgcactttaaaaattccatgcagtgctggcccaaggctaaattttcatatcaaacacaatgaaattcaggaggaacttataccaaattaattttctcaaagcatacattgatttgctcacttcctacactccgtgcaaactcaaaagccagctgaggctctgtaaagagtgtaagttcagaccctcctcctgccagtttccctcccattccctctgttggctgtcacacctgctattatgcacaactccctccctgaattagggccctggatcccctgctttcctctttccaaggctgcttttgctgctgcttttccccaggaggaatactcacatttggatcctagccagctcagccgccacccctccaggaagcctccctgacttccccagctggaaggctgccagcagcccatcctgcagcccttcccaacagctcacctatcacactttttgtattctagattattttgttcctggacccaacaccatgctaagcaggagaggaagaaggaaagaagggagggaagccctggcttcagcatcctttgagcacttgctgcttgcttgcccagcatttccccaacatccttgctcttccaactcttgcataatcctggggagtcagcacactccacttacagaggagaaaactgaggctcagggaggtcccctgctctttcccccactctatgtggccacagcttctccaatctgcctggggcaccccaccagtgatgtgttgcttactgtaggctgcctggacacttttggtgcgaatgctagaaaaatgaattccactgacagacctcagcattacttagtgggagccaaggaggccagttgctttaagcactcctggagcattgcctcaggccactggataattctgggcaagctgatagccactgccccagccccaaacgccctgggtcccctatcggaaatagattccctcacaccaagccgatgcctgggctgcccacacactgctatgcagagtaacagggtgacaggccgtagcattcatggctgccactgtataaatattcctagcatggaaaagcagtcttagactcatggtggctttttaggattatatttacatcaaacgcagccactaacttcgggaacatcttgacaacccacctctctccttcctctctggggtagctcttgtaaccctcccctttgctctctctgtgccagccccattggcctctttgtgtcccacaaatgcactgagcatacttgagcctagggctttgcagtgactgttccctctgctagaacactcttcctttgcacatccatatgaccagattccctttatctcttccaagagttggctcatgtgtcgccttcctgactggggcaccgttctgaaaattgtaatcacttctcacccaagcacaccctccatactcccaagccccatacctgttatgtttcttgtctctgtagcattcaccactgtactaatattctatttatattctaactttatttttttcttatttcttgtctccacccactctttccccaaagagcaggcacttttgtcaaatttatctcacttttctatcttaagtccacagcagagtgtctggggcatagcagcactcatgttcaataagtacttgttgagtgaataaaccttagaacatttccctggtattatggttcgaatgtatgtcaccctaaaattcatatgttggaatctaagacccaatgtgtgagtattaagaagtggggcctttagaaggcaatgaagccatccctcatgaatgagaccagtaccttataaaagggccccagggaaccatctaggtcctttttgcctttctgcctccagacatgtaaggatgcggcaaaggccctcgccagatgctgaatgcggatgccgtcatcttggacttcctagcttccagaacggtgagaaatacatttctattgtttataaattactcagtccatggaatgctgttgtagcagcacaaatgaactaagagacctggcagattacagacctcattttaattttaaaaacagaaattaggatgagctaatatattaatttcctctgactgctctaacaaattaccataactttgatagcttaaaacaacccgaatttattatcttacagttctggagatcagagtttgatatgggtcaaacgaggctaaaatcagggtctcatctggcttcattttgtcctggaggctctggaggagactctgtttccttgccttttccagctccgagaggctgcctgtattcctgtaattcctcgtaattatgttgagcctactcagataatctaggaaaatctcctcatctcaagatccttaattcaatgacatctgcaaagtctcttttgccatgaaaagaaatatatattgataggttttggggattagggcacggataactttgggggaggcagattattctacaggtaaaaactttttgccatttacataatctttaaaaaaagatttgattaattatgcaaatgtttacaacatacagaggaagtacaaaaaatgatgtctttcaccaaaagcaaacagctaacatttgtcatatatgtttggctcacaacttttggaaataaaacgttgcaaatacagctaaatccccaactcatttctcatttccttccttcttacctttcctcaacagtatccactattaaggctaatgggaattattgtgatgaatgtatttttaccatttctactgctaggactcagaaaacaataccctgaaatgcagacctcagaagcagcttcagaggcaaaagtttttctccgaccttctcctgctctcctgtctctcagttccattctcccctgaggctaggcagagaaattagaatctctcttccccaaggcaggtcatagaaaccagaacccctcttcccaaagccagccataaaacttaaaaatgttactttaacttttcctccacctgtctgtgtaaaaacggaccatgaagaaattatctgacctacgttatttgactgtaggtcttaagagccccattcgagagagggttctgccccacgcccagaaggaaggagtgcatgctctgagaggctgagaagaatctagacagacgggccttgctggatttcctcactcagtcagctattagcattagatcataccttttctgtccaatcatatttctacatggttgttgaacttaagcataaaaatggacaatttcccctgtagctttgagtctctgttctgaaggctcccgtgtatacactaaataatacactaaataaatatgtatgtccattctcttattaatctccctcttgtcagtgattttcagtaaacctttagaaggtaaaggagaattttcccttggccctgatactacaacaatagtatatacactattgtgtgttttttaaatttagataaatggtgaaatactgttcatttcttttgctgtttgcttttatgttttggaaatgtacctacgttggtaccatactgatctacttccagcctccactttattcagagacctcagattatttatctatttttctactgatgggtagtttccacttacatgctatgaaataacagagctgcactgacacccgtggatatgtcccttttgtgcaaatgtggatttctctaaaggagaatgtactgagagatgctacatcactctctgaagtggccacttggaccaattagcatctccagtgatggtacagcgtgcccattcctctacgtcctcaccaacactaggtatgagcatgcttattaatggtcctaagctgacgtaagtgatgtgtgtgtatgtcactgctgtttcattttgaaatgtgcttatttgtgtgagaggttgagaatattttcatgttgacggatcatgaaatattccccctcaaggaatttcctatttatattattttccccatctttctattgagtttgtcttttaaatagggattctttttacattctggttactgatattttgttaattacatggattgtaaaatctgttcttatcttttcatgttttttcctgcttcttggcaagtgagtttatactgttaattagaaaactttatcacactttttatttgtgacttgtacttttcctatcatgaaaaaaggttttcttcaaatcggttcctattctgttctcataaagatatttgcccatgttttcttctaacagttctatagttttgtttttgacattcatatttttacattatagaattatttttaatatgatggcagataatgatcaaatgttatcttcttctgaaaatgtgctagaattacttgtttggtctattaccttctgctaattttaaagctgcctctgtcatataccaagcttgcatctatatgtggctcagtgtccaggctgcctgacatcccaggacaatgctgcactgatttactctctacagctccatggtaagtgatatggttaggctatgtgtcaccacccaaatctcatcttgaattataatccccataatccccatgtgtcaagggagagacaagatggaggtaattggctcatgggggcagtttctcccaagctgttgtcatgatattcaatgagttctcatgaaatctgatggtttttgtaagtgtttggtagttcctcctgcattcattctccttcctgctgtcttgtgaagaaggtgccttgcttccccttcaccctctgccatgattgtaagtttcctgaggcttcctcagacatgctgaactgtgagttaattaaaccattttcctttataaattacccagtctctggcagtctttataccagtgtgaaaatgaactaacacagtaagctttgctatctaataagaaaaattttgttccccatcccagctttctcccttaccacacatatggccacttcctttaaatttgtctgggaattttttcactctttactcttacatatggctttaggatcagcttgtccaattctgaaaaaagtcttgttaggacttttattagactaacaatgaaagtgcagaagtgatatgtcttctttataatattaaatcttcctgccaatgaactggtttttatatatctttctaaatatttcagtaaagtttttttttttaaattttgttgtatctgcaaatgtctgttacaaatatcaagtttagtgttttttaaaattacattttataattaatagttcctaggaaataagaacagtattcatttttatattgatctatgcagtcaccattagaactgtcctatttctcagtagcttttctgtagctccactggaaatttttgtgtcaacaaaattttgtctataataacagcaaaataaaataacagcaattttgtttctgtctttttaagtcttatacattttatttatttttcttattttactgcactgatttaaaatctttttttttcaatgttgaatagaagcagtgatgaaagcaaggaaaattttattcctaacttcagagggaatatatgcaatgttgcactcttcaggtatgatatttctgtacattttagcagagactcttcatcaggtaatgctgttcttttctatttttagattgctgttcttttaatgaatggatgttgaattttggggaaaaaaacaactttttttttttccttttacatttgagatgcagagcagtagcgtccttagagaataaactctggagtcaatgcctggaccttaatgaacagtggatgacatgttattttcttttttcttcttttaacttttattttaagctcaggggtacaagtgcaggttttttacataggtaaagttgtgtcatgggggtttgttgtacagattattttgtcacccaggtattaagcctggtactcattgtttttcctcatcctctccctcctcccatcctctaccctccaacaagccccagtgtgtgttgttcccctctatgtgtacatgagttctcatcatttggttcccacttgtaagtgagaacatgcagtgtttggttttctgttcctatattagtttgctaaggataatggcctccagctccacctatgttcctgcaaaggacatgatctcattttttatggcttcatagtattccatgatgtatatgtaccacatttcctttatccattctgtcattgatgggcatttaggttgatttcatgactttgttgttatgaatagtgctgcaatgaacatacacatgcatgtgtctttatgatagaacaatttacattctttggggtatatacccagcaatgggattgctgggtcaaatgttattgctgacattaggtctttgaggaagtgccacacggttttccactatggttaaactaatttacactcacaccaacagtgtatatgtgttcctgacagattcttttcaagggcatgcagttctcacacttgttggtgtcagcacttcttacagtcttaagattgaagattacaaagagcttttgttcttgtggattatgtatctatcaatgtttatcatgttacaaattaaagctgatattgtaaaatattgattcattttaatacaacaataataaactcaatccatgttaagtaacatatttttgtatgaaaagtatcatattctccagaacaaaatgaaatggagtctgtctgttgagtgacatattaaactcatcccacctatcttcaagcctaatactacttcttaccttccagccttcaagcgattgtaatcgtatgttatacttccacctatgttataaaccacacaatatattattatttttgctttaagcagtaatttttaaaaataatttgtaaaaataacaaaaagctatttaaatatagctacatatatgcaagcccaaatctgacttcaagctttgatgtggggggaactttttagcttatttattcacttatgcattagtcatgattgctgcatctgcagaaactcacgtgaaaataatgtgctaaattgtcaaatgtttggggtggcttctactgttggaccatacacaaccttcacatttcagatattcttactttagggactattgagcaagcagagaagaaagccttactatgcactgtttttattaattctcttccaattgctttcttttcctgcccttccagttgtagttaaacagcggggagaacagagttgtcctgctggggcagtggttcacagctccatggggcccctaggtgtgtgcgacttactatcattgtccagcattctctctctgcctcaggtcctgcaccctaagcctggccaaagctggaagcaggtgaaaggagagttgaggtggtcaaaagaagcatagagatgccctacttccacctccctggcatcttcagtccgtaggactgagggcacttccaaacagcctgcctttcccagagtcctctctccttgtccatcagaacaatcagcagaacagagatcttggaagcataatgatatactttttcttcctctttccctcttccctccctcctcaccttcctccctcccatcccttccctttctttccgtcccctcctctcccctttcttttcccttccctttcttttctccctttcttcttcttctttttttttttttttttttaagacagagtctcgccctgtcacccaggctggagtgcagtggcacgatcttggctattgcagcctctgcctcctggtttcaagcgattctcctgcctcagcctcccgcatagctggaattacgagtgtgcaccaccatgcccagctaatttttgtatttttagtagagacagtagatgttggccaggctggtcttgaactactgaccacaagtgatctgcctgtctccaccttgcaaagtgctgggattacaggcatgagccacagcacctggccccttctttctttccttccttccttccttccttccttccttccttccttccttcttcttctcttctctctctctctttcattctttcttttttctttctttctccctccctccctctctcccttcctttcttcctctcaatgaacatagtattttgaatactatagtagactaaatagtgccccccccaccaaaggtccatgttgtaatacctggaacctgtgaatatgttaccttacatggcaaagggcacttactttgcagatatgataaagagggactcagaaggtgtcagagtcaaggaagacaatatgacaacaagccaagaggggtttgaagatgctactttgctggctttgaaaggggccagagccagagaatccaaggaatgcagctctagcagctggaaaggccacagttctcccctagagcctctggagggagcgcagccctgccagcaccgtaggttcagcccggatgcaccatttcagacttcggacctccagaactataagagaatatattgtgctattttaaaccttaaagtttgtggtcatttgttccagcagcaacaggaaactaatttgagcaccaagcactgtatctgatataaccaaagcttcaaaggagggtgcaggcccaggagtcgtgtggccactgccaggagagctaaagccataagagtgagtggggaaggggaagagttccaggagccatgaacggattactcaagcagggatgcacattgtatataaaagaaagacatgaagtacagttacagaagagagattggggcattgtcacttcacagaaggcaatggggagtgtcaagagattgattttccctccttttccctgggctgtaatttctccctctttcttggctattcataaacagatggcaatggaccccatgagtggagctttaagccaaaatgcccaaatccatagagacagaaagtaggttggtgattgccagggacgggctggaagggagccgggggaaaatgaggagtgactgctaagaggtagagggtttcttttgggggctgtgaacatgttccagaattaaacagtgatggttgcacaactctgtgaaaatactaaaaacccactaaattgtacattttgaaggggtgacttttaaggtatgtgaattatatttcaatacaaataaaataagtagatagatagataaaagcccactccttgagtggctttcattcaatgcagcagaaccaaagagcagccagcgccctccaagcctaatgtgctccttctcaccacgcagctcttggccacctcgcttcctgcctctctcagttgattccctgtgactctatccctgcatggaggagagacaagtgaaaatgaaagacagatgaatgtgtcaagttgagagctctttacatgatgaaggtgtttctgcttcattgcatgaaacagaacatagagcggtgataaaacccagccagatcctttgggttgacttccaaccgcaggtggtggttactcattaggaaagagcgaacactgtaatgacttcaaaactaaggagtgcaaagccaaatattcactaataatcactcatcaaggagaacagatggcacacgttgaacactcctgaaaatgaaagcccttggctgcaggggtgaatgtccaggacccacagaaaatatcaagtcagatacctcttgaagcactgatgggaaggtgcagctggactccctggaactctgaagctgaggtcagagatgactctgcttctgtccaactccttaatcacatttctacaaggcactaagcatctccatttttctgtctgtagaataggtatcttggttgccatacaccaacttttctgatgttttaattaaaactaggaaaactgtcttttaggattgggctgctagcaatacggaaaggagcacaaatttctgggtaatggagagaaaatctattctagttcaagtatttggagttcctataaatcttactctatatacaattgttgcttgagaaatagtattaccaatagaccgcaaacaatatgctttttaatcaactgtgtctcatctgagctgtgatacatctttggccttatgaaaagagaatgtttatttaataagagcagctgctgtaatttttcaaaatcatacctttttctgaaattattcccctgctcacaaatggtagtgacttttgtgaaagagtttattttgattattctattagctggatcagtaatcagaaaacttgctttgagggaattgtttccagatcatgtcatatcacacagggaccccttgggagtcatctacataagctttctaaaacctaacttttaaacagcagcaacagtcaaacacagtggatgtggcgggaccattctcttatgataaggttttgtacttctaaaataggtttcctactcaaagttcggaccataattaatcagtcctggttggagacttataccaaaactgcaatatatgtgtgttttaagcatgatttaaacataacttttcttttctttttttagagacagagtctcgctctgtttcccaggctggagcgcagtggcatgatcacagctcacggcagccttgacctcctgggctcaagcaatcttcccaccttagccttctgagtagctgggaccacaggcacatgccaccaagcctggctaatttttttatttttttgtagatgaagggtcttgctatgttgaccaggctggtcttgaactcctgggctcaagcgatcctcccacttcagcctcccaaagtgctgggactacagacgtgagccactgcacccggcctaaacatagttttccaagcacactatggtcattatctttaatttatgggagaattaaagagttgaaatgactcttcactcttttgaagtggtagcaactaaaaaacatagtagttttttagttttggcagtagttatggcagagagattggaaccactggatgctggacttccagggcatgatggctcactcgataggtgaggatttgccacccatggagaagggggcctcaggtacaagtgccccacaggccatcccctctgcactctgatatctcaggtagacacctcaccttacctccctcaggtcttcctttccaagagtcaccactctgtccacactccacctttcatttccttcttcctccttccacatttgtcccatagcccaaatctgagctctcttctctttgaaacttctctccatttccatcaatgcttagtgaacatctgcagggtgtcagaagtttaaaaagtgacattcatctaagaacccaggaacagccaaatttatgtgtccctggccagcctttcctttgaagttcctgagaaacccatacagcagaaagtcaccaagaattagacatttttgggttactattttggcattgtctccaactaagttgtcctggtcagcttgggactgaggaagtttccagggacatgggactttcagcttgaaaaccaagacagtctcaggcaaattggggaaaattgatcactgttgcggattcaattctgtgtccacccccacctcaaaattcatatgctgaagccccaactcccaatacctaagactttatttggaaatagggtcactgcagatgtaatttgttaagatggggtcatactagagtagggtgggcccctcatccaagatgactggtgtccttataaaaaggtgagatttggatgcagacaagcacatggggagaaggctacatgaagatgaaggcggaggtcagggttatgcagcaccagttaaggagcaccagcgattgctggcagaccaccagaggcccggggacaagcatgggcagattctccctcacagccctcagaaggaactaactttgctgacagcttggtctttagcaaaaatctggactcatataacaattatgttggaaggtcacagatatgggaagggttcgggtaaaatttgaggagtaaggtgatgctgaaaccacggagagggaacgaggtcacttaaagctttcccaggcttcaagaggccttgcatggatagtaggaacccatgtctcattcccaggaagcacactgggattgggactgtggatgggaccttggtaggacttcctatgaaatgagttaggagtaagcctcctaggcccagaaaagaccccacatgaagcctgccaaggagtccctgccactatccgccctcagggcactgagctgtacttcttaaataaagaatatgagccacagactagaggagccttctgtaaatgtcctggactctgccatattttcttttctttcttttctttttgttttttttttttttgagacagagtctcgctctgtcacccaggctggagtgcagtggcccaatctcggctcactgcaagctccgcctcctgggttcatgccattctcctgcctcagcctccctagtagctgggactacaggcacccgccaccacgcccggctaattttttgtattttttagtaaagacggggtttcaccgtgttagccaggatggtctcgatctcctgaccttgtgatccacccgccccggcctcccaaagtgctggaattacaggcgtgagccaccgcacccggccgactctgccatattttctaggcttgcatacaactcagaagcagagaaggaaaacccctagcttatgaccaagacgaagtttccagtgagtctggttggtgggagctcagaacagattaaagttgatttagaaaaataaaaacactctgacatttttcatgtgcacagatgtagggtaagactcatacccactacccattcattgattcagacaagatatgcttttaactctgcaagctgaggtccaacaggctgatgtctctaggctcatttcttgtccaagcttccctgccttagctgagcagcagttgctacagagagagacacgtcttccccaaccccaatcagaaagtcaattgaggagattcctgaagtgctatagccgtgctgtgaagggtggcgggagattaggcagagatgggagtgggataaaaaggaaacagagaaaccttctgtgctgtgaatggttggggagaggtgaagcagggatgggaatgggatgaaaagaaaacagagaagcccaaatggatgggagacaagaggaagacagacaatgtacagtccagccctgcagaggcctctgggcccctctagaactccaggaggccccctcagctccatggtttgcattcctgccccagcgattcctggctttcatttagaaccctgggtgtgtattagtttgaatcatagcccacagcttgctgcactgtcaaatttgtgtctgccaacagaaaggaatgtatttcagccagcaagagagggaactcaggatttgtggcaaggaaaaatggaatgcagtagaggagaaaactccattagaaattctctgaggagccaggatcattcgtcttcctcttctggttgtcagtgggccactctctgcctacagctgccaccatctctctaaaggaaagaaacacagcatgcttatttgcctctgctagttgtagaatcagacagatcgttgataaagccctgcgtcaacctctcaacctaaccttttactttatcagtatcctgtcctctagatgggagatgggagtgggagcccaatccttttcttttcttttttcttttcttctcttcttttttttcttttttctttttttttgagacagagtttcggtcttgttgcccaggctagagtgcaatggtgcgagctcggctcactgcaacctccgcctcccgagttcaagtgattctcctgcctcagcctcccgagtagctgggattacatgcatgcaccaccacacccagctaattttgtatttttattagaaatggggtttctccatgttgatcaggctggtctcgaactcctgacctcaggtgatccacctgccttggcctcccaaagtgctggggttacatacgtgagccaccgcacctggcccaacccgctccttatcaaaaaacttcaccccgttgtggcctctttatccttcacgtgtgtgtcctgtccactagtccgtctttccatgattggtttgcacacggccacttcagacctccctactgcccaatgtatctactgttatcttcctaaaactcatgagctttaaccaggaaattggactttgaattcaaaataagtaaaacaattagaagaccagaagtacagggagtgctctattttacttcttgctgtttgtgtttatttccccagagacagagcactacggaagggagccccattcccaagcatggtgtccaatacactggtgagtcttggcagattatgaggcaggtcacagacaattgctatcgtgaattaaaatctgtgaataaatctctttataataaagtagggagtatccaagagtatccttataataaaattacatctactcatttccatttggatatgccctcttgagtggaagaaggggatggagtacagttggcacacacctcagtcacctaactaccaaattatggttgttaaatatggctgtaataaaaaaatttcaagcttttcttgaaatctagttatacccatggggatgtatttaacacgtgataccacttgcctcttcttttgacagaaagaataactgggctcagtaatgcacctagagactcagattccagacctgcccacttgctttactatccaaaacaaccatgacacatgacttctctggcggggtgttggccaagacaaactgaactatagaagatccttgacttgccaacgttcaaatgatgaactttcaaaaatagcgaaactggctgcagagcaaaagcttttcagctctgcacaacaccaacagatggcgctaagtgtcacccttgtggagagcagagggacctcggaagggcctttggaaatctaatctggttttgagttcttggtgggaaaatgcacctttaagttgggggagtttgaagacgttgccaagacacgtgctgcagcatttgatcttttctgccgcactggcttctgcaattaacatgctttcaccagtgaaactcaggttgcggggagagcattcttccaggttcatgcctgttgtcatggagtaattataattcatgtctccgttcacagtgtcctggtttgtagaataaaatatctggtccacccacccagtgggatctttgagaatccattcattttagagtcagcatctgtggctggttccaagactgtaatttgcttccttggcaaatgccacactacatcaaaagggggcaaaagagtatgattgctctatttttacttagaatccaagtggtaatttatggaatacaggggttctcaacctcagcactattgacgttggagctggataattctttggtggttgtgggggaggggcgagggcgggagtcctgtgctttgcaagatgtttagcagcacctctggcctccacttgctagatgccagcaacacctccccactctctcccaatttgtgacaaccaaatacgtttccagacattgtcaaatgtctttaggaggcaaaaccatccctgtatgagaaccaccattttagtgctttgtacaagtaggattcagtgtacaaacctgagtcgattctacctcggacagtgatggtacctggaatagcacccaaaatcagggagtgagaaacgcttacctttagcatttgaaagaatgagctggtggtgatgagctcaagatttagagtcagacaggtttaggtttgaatgtggccctgtcactttgtaactgtataagcttgtgcaagttacttgatttttttgaacctcagtttcctcatctataaaataacagtaatacctgcctcttcaggtggttaacacttaaatcagttcaatgatgtaaaccacttagtacacagcatacactatgtagtgtgagctactaccgtcattattatatgcaacatcatctcttctcagatttctataattagccttggttattatttcggttatttacttcctcatcagagtctttctttagttgtcagcaatttttgaaccctctttaacaatagtcagcacttgtttttttgcaagaaatgattctaaaacagtttgcaaatttctacataagaaattgatgcaataataacagcagcagcagtaatttctataggattactgagatagagctatcatcgtggccaggcttgcttctatgtctaaattccagacattcttgatcttaaagggcttctattaccagaattcagaagcactgaatcaaaattcagaagagaatgttctagattaggaatcaaagtgccttgacaatgagattgtacagtctggctcatttctatggttccttggagattcaccctctccatgagaaaagaggccatttgcaattctgcctgattccagagcccttttatttgtttactgggtactcatgccagagaaaaaaggcagcttccagatccatgcaaatcacattgcattagtgcttatatttacagataaacagctccattaagcactggaaaagccttcttatacttggacaaccaggtgaaaatatataaattgaatttcacactcatggcacaaattcatccttacaatacagtcccccaaagcacttcaagtgattttgtgtgaagagtttctgagatgaaatggtaagatatgactgctctgagggagggggcaatagggagaggagttacttcattagcattgtcagctttgtcacaaggtgacattatgaaagaatttagcctctttgtagaccattaagggaataaatacatattgtaatctaattggcaaaactgcaaaaaggccccatctggataacccaccactttcattatgatgtgcttatgaaagatatttgaaagtcaaatatctgaattttgaagaagaagaaaaaaaaaggtttggcctactccttgtttagagagaagatatagataacattccaaacaatggtttgtatcggtgctgctgagctcaaggcccaggcaatgaggtgggtgtggtaagggtctcctcaggccgatttagagcctagactgaaggtggcttctagttacctggactcaggtatctgtctcttcccagggctgctgtctttcctgctgggacagggagaatagaggacaggcaactcttaatagtaaacatccctcagagattcattaggagtctatagcagggatggcagagtccatcagaactgagcagattctcagccaactacctgcacccccaccccacacacatggggggtccatggagaggatctctaacctgctgcctgccagcaagccctagcattactcactaggagatgttaggcaagttaccttattttaccaagtctcagtttcctcatctgtaaaatgcggattcctgcgcatagtgggctgtgagaattaaatgggatgacaaatgtgaagccctgagcacagcacctggcttatgggagtgtcccttacccctcctcctttctaacataggagaaggtagagattctcaattcctctttcaacagcaataacaataacaggccaccacagtctacaaatttctgtatgtcacgggattcataagaaattgagaagtacatttctttcgaggacaaacacactcaattttttttactgtatttctagtatatatagagaaaagcaaaaaatacaactccaagagacctcggtagtagtctctcctctccctgtaatgtgttgtgtgaccattgatattcccttgatcagtctgattcctggttacctggacaaggtgatcttcacagtgaattctagctgtgatgtttgctgactgattctcctacatagtcaaggctctgtagagtgagcctttcagggattgtctgtgaaccctttccttcctccagaaacatttccccatccacatggctatatgagatctctggctttccctggccaaacagggttcttccaagtatctgatccaaatgagtgagttcaagttcttcttcatgagttgttctggaattgagaaagagctataggaagcaatgagatatagctgaaaacctgctgacagtcaccttgccagccatctggtgaaaaatagtctgcagcaagagagaaaaaagccaacactgagagagaagcagaaaggagagatgcagggagagtctagtctgtacttgactccctagttctgattgtctcacctgtgcccctctcctttctgaagttttcctttcttggattctgtgagccaaagaattctctttttgttaaagctactttgagttcgttctctgtcccctgcaaccaaaaattctgatttggagcatctttttatgtgatctaagcatccctatactcatctaagatggcatggtttttaatattttattaaacctactgttatgctacccttgaaattcagcttctgttgcaacaagcttttatcgcaagggaaaacagggagttcctccatggtatataatcctgtcctctccaggtcccacagatatcctctctgtgagggcccaaaaaagaggaacatgccacagagtaagccaacaccagccagggaggatggagaggcagagctggctggggtccccctgaatctgctgctgttagaattttctgtcagtgtggagtttattaagagtggatctaactttcagaggagagtgcaaattttctctcaagccagttttaaaacatttaggcagagtaaaaagtcaaaaaagactttaggctctgaagtcctgcattctagcctgacacaggagggtttccctggtggctcagctcttacatgaagctctgtttttttgtgtgaaacatcaaaaactcaatgtttctcagaaagttctgaaaagaatcttatttcccaggcaacagcttttcacttgctgtcttccccctgggcctccacaaattaatcatgagtataaataaaagcactactcaagtcggtgactgcggccctgccctgcctgttgggatagcaatggagaaatcaagaacagagtgaggtcctaagaaaagcagtggagcaactcaaggctgagtgtccagactatagctgggcggctgcaatgctggtcaaaaacagggcctgccaagctctgatgctgcaggaacacatgggagcttgccttcacaggcaatgcctcctgacttcgcaggagctggatgcttcctgctttcagaggagcccgatgcatcctgataggaggcagatgtgccttttgcatctgatgccatccactgacaaggagtgtggactgttcactggctcttattaaagaatgcctcagacactgcttataccaatattttacaccacagttcaacttttgaagggtgtattgttttcagtgtcaaagtaggtcaatctggatgctttaagctgcagtaacagaaaaccaactcaaattgattaaacaatttggggatccattgcttaacaaagaggacatcaaaagatagggttagctttggtttaattggcagaatcaggctcatgatataatcaagaccgaggttctttccaggactctcctctgctatccagcctcaactgcatcctaaagcatcctcttggtcatagagtggcttctagcagcaaccaggcctattcccttgttcacatccaataggagaaagggtgagtttcttatggaaaactttcagggaggcaaataagtatgtttccagaaatttccagcaaaatgcttctcatgtctcatcaacgagctgcatatcacatgccaattcctgaaccaacccctgataaagaaggaggaataccccttggacccatcaggaataatcagtcaggctctagggagccaagggaggtatgtggattatttgggaaagggtagatagcagaatcaagtctggtttctattagacacgagatgggaaatacatggctagacaggcatccaatcatactaactagcttaaagtctgaatagcccacttacctatttaggttgcagcttctacacaaatacactttgcaatacagttcttcaactcccacctccatattcctcacctcataagaagcagcaggagccttcatcaggagagacaggataggaaagttgctcgggttgttctgagaatccttggctgggttttctcttgcagacccttaatgtagtacggtaaagtcttcatctagacaagggcatttgcaacatcttgacatcaagtgtactgactagaaccacagttcccacactccagggtgcagaagaatcttgggatgggggatcagctttgttcaaaatgcagatctctgtgccccaatcctagacattctgactcattgggtttggatgagactcaggaatccgtattgaacaaatccagcgtgagattgggatgcgggttttctttggatcacacagagaaacaatggccatgagccatgtgtcgtagtaggttggactccccacaagcatgcccagagacaagggtctttcatgacagtgattaactagaaagtgttccggaaaaacagttaggaaatggaaaatgggaccggaaagggaaggaagacaagtcaggctgcaatattagtgaagtcccatggaggtgaacctatggcttggttccacagagaagctctggaaacagtggaggacagtgttgttccagtcagcagagaagggagctggaatagttatactccacctcaccctgtaaacttcagtcattggttaatcactgcagggttctagcagctgggagtagaaagcctttatcaggagccattgtccacaaaaatggtaaaggtgtcggataggaggtatgggcaggacacctacattgtctgctcctcatattgtaagtatattcaatcacttcaaaaattttatatgtgaattatatctcaacaaagtgttattcaaacgatagattttaagagatatactgaagaactctatactctgagctccacagtggaccatgaaaccacacaacatacaaaggatgcagattgtcacactacatgcaggccagactcaggagcaggataccatgttcaacactgactcatagtacttcaaatcagctatgtggtctcctcatagtttaataaaattacacgaatatggtcaggcacggtggctcatgcctgtaatcccagcactttgggaggctgaggagggcagatcacttgaggtcaggagtttgaggctagcctggccaacatggtgaaacctgtctctaataaaaataccaaaattagctgggcatggtggtgtttgcctgtaatcccagctactcgggaggctgaggtaggagaatcacttgaacccgggaggcagagcctgcagtgagcctagattatgccactgcctccagcctaggagacagagtgagactccatctcagaaacaaaaaaaattaaatgaatatttgaaaaaaatgtatatatggacagtagcacttaggaactccctgtttttccctgaggtaagagcttgttgcaacagaagctgaatttcaagggtaacataatagtagagacaaatgctcatataatgaattcaacaaaatcatggttgcctactggagattagagatacaaagatgcctgagacaggtttctgtttgcaaggagcttagaatttcatttattcatccatttaacaaacatttgttgaacacctataatgtgcctatcactgacctagtccctggagaatatccatgaatacaagagacaggttctcttataattgaagtggagagacactcagcaaagaggtgcatgatgaagagataaacaaacttacactaaagtgccagtagtgatgagttacggagagaaaatggcaggtgagggggcttgacttccaaacgatgggagacctctttgagcaagtgtgtccttaatgttgtcaaagcctatagataaaagtcaactgggggggggtcaaaatggcagataggaggcaggactaacttgcagctctcactgagacggacagagcagcatgtggagactcacatcgtgaacttttgctccaagaactaccgcaggaacataccaggaaagctgagagaatccacaaatgctttgagggaggtggaatgctgctgcaggctccacgggacagctgaggaactgtgagtgggcttgccgtctcagctgggaggcttatagcccgcggcaagttttcagccctgttcactggctgcccggaaataaactcggtgctgttgcaggggcacagtgggagtgagaccagccttttggtacttggcataccaaaccccatcttagcacctgcctcagagaaacacaacctacaacaggcatcaaagaaaacttcctggaggaaatgtttcttcaggcaagttctgaaagactgataggagaattaggcagaagaatgagagaaggagacatagcatgtgctagttaataaaagttcaattccactttcatctggggctcccttgttctgtgttgaaggctgtttcttgctagcgtacaggagaaaatgtagtttactcattctgttaatggatattgagatggtatcacaaggaggctcaggggagagatacatggatagatctctgtgcctggactcagactttgagaatatttgtgactcatgagatttcccctcaaaaggtagccactgtgcagatgtcagtcagccctcttccttggccagcgcagagcttgctcatgaagcagaggctgtgcgtgggctccacaacatggacttctctctaaagatcgccttggcagtgccatgggactgtacaatttgatggcagcgacaaccaaacctaaaaccccaatatggtgtaataatctggcagtagcttggtcataccaggtgcttttcaccatggaagggcagagcttttccctcactggaataggccctcttacctggacttagatgtgttgcttctgcccatgacgcttttgccagcaccatcctccatgacttactggatacatcatggtagcccacacagcatcccttctgttctagaaacttccttcattgtgaaaaaagtgtccctaggaggcactgggctaaggagccccattatcccatccacaaccttgcgttttgctagattaaataaattggagcaaggtgtactgttaggttgaaccatatgaaaatgatgatattcaaccattttctgacctataaaaatgacaatttcatatgactcaatccaataactagtggggtttcggtgaggctctcctaggagagcagactactgcatcttgagtcatgagaggtaataaaactgctaggcaggagtgatatttagaagcataaatataggaagaagcatacatgagcccccaaatgaacagaccatggtagatatttctcatttttcacacagagaatccagacatattttctatgttgtgagaatgtcaagctcatgacctagcacagccaagcagatgcttctgtctgggactttgaactcaaaggagtgaggcagtcagaggcgtgtgcgtgcgtgtgtgtgtgtgtgtgtgtgtgtgtgtgtgttggctgctgtggattaaagagttcagtgatgcaggggtgagtcttacaggagggaggagcaggatgttcaggggcagcaaggccagcagcagtgagtgtccagctgggagcagtgggatcttgagcatattcccagtgcagtttcaatcggtcatgcctcacctccttttcactcctgctcaaacctagttttccagtcttcccattgagtgtactagcttctaaaccctcttacaatgaatctttttttctggttatattaaccagagtagtttctgttgtttgtaactcaaaacatttataaatacactatcttttggccagaggttttacactgctttctagataatggtatttaatcagattttttttcttttcttttttcttttttttagacagaatcttgccttctcacccaggctggagtgcagtggtgcaatgttggctcactgcaacatctgcctcctgggttcaagcgattctcctgcctcagcctcccgattagctgggattataggtgtgtaccactgtgcccggctaatttttgtattattagtagagacggtgttttgccatgttggccaggctggtctcgaacttctgacctcaagtgatccacccgctttggcctcccaaagtgctgagattataggcgcgagccaccgcacctggccctaatcagtttcttgacagtaaaagaatgcacctgtaaagtaaaccaagtaaacagtgggcaacgaggaggagggcaggtgtattccttttattcactcctctttagttattggttttttcatatgtttttaaaaaaattattgtgatagcaatttgtatttgttggaaaaatcactcattttatttagactttcaaatttataatatacaagtatgcatggtactttaaaaattttgtgttttcattgctgtaacatcttcatatttctaataatgttcatttatttaactgttttttaaaaagatttgccaaagggtaatcaatttattgtagcagttttcaacagagtgatttgatttattaactatactttctttttatactcaacttcttttgccttcattacatccctctacttggcaggagaaatttgtttcttttctaacatcccactaaaattattaatatggtgatttttttctctttcttcttttgtagcaataaaagcatttaagttaattaatctggttcagttcaacaaacatgtatagtgtgcctactatgtaagacagtcacagagccagagggcacaagataaataagacatgaatatgtgtccccaggaggtctaaagaagggaacaggcagatgaaaagatacatttaaaatgatagaaatataatagttacctttagataagattaatagttatttttttcttctatacatttttgttgttactaatatttcaatggtactttttctttttttttgagatagagttccctttgtcacacaggctggagtgcagtggcacaatcatagctcactgcagtcctcgaactcctgagctcaggtgatcctcccgcctcagcctcctgagtagctaggactacaggtgcttaccaccatgcctggcaatgttttttttttttttctttttagtagagattaagtcttgctatgttgcctaggctcgtctcaaactactgagctcaagcaatcctcccaacctcatcctcccaaattgttgggattacaggcgtgagccactgcatcctgctccatgatacatttttgaaaatttaccaacatttcattcatgaatacatactaaagtcagaaaaataaggaaaatgtacttttttaaaagaaagaatatgacagcattaaaactagtggtattaagcctcaaaatctggagattctagaaagacctctgggttttcatggaggaaaagtgtcaaagaaagacaaaaggatgttccaggcaaaagaagcagtatcaacagggacccagcaatgggagaaaagcagcattgtgctggttgaatgtgagccccctgaagcctgtctccacatgtgctgactgcactgccatatccccgccaactgttgattagtacatgtactacagttgggcctgcagtgctagacttaacagatgccccatgaatatgtgcaaacttgaatgaagatggatggggtaggggtagagcaccatttcccacgaggccattgggagcccttgtgacttttagaaatgaaagaaaattttactgcacccagctctgtgttttagaagaataggatgtccctttctacaattatgcaagaattctagtggtttttcccttttaaaaatgtaagtgaaatttaagcctgattcctacagagaattaatttttataaccactatattctgccatgaggagggttaattactgttttccttctctactttctattgaaactatccatgcaaatgaaaaaaaaatgtgaggaacttggcacaaagcaaagccagctatgacttatctaattaatttgactggaaacccctgggtattacaggtcctcctcaaaagaccatccttcaaaggtaggagccaaattctcagtaattggcttgttctgcaaccacccagctatgtttatcttgagaaagatatgtgggtctggtcgctgtctccagccacctgcacccagcctcccacctgctgagctacgtcatggtacccagggaccagtgaaggcaaggtaaggctgggaagcccaggctccctgcaggccagagagtggagcagggtgagggggaaagagggataatgccttcagcaccttccaaacctggctccagatttggaaacacctgaaacttcagataaagtttatttatttatttattttggcctatagtcagacgtgttattgcaaatatagaacactatattgttaaaggacagtctggcattcaggcaatgaaggacacgctaaatgaaaggtcagtatacttaattccattaaaaatgttaaatttctgtatgtcaaaaaattcagaaaataaaagacatgataaattaggaaaatattgcaaatgcttgtatccaattattgaatggaaagagaagagtaaaaatagtactttatataatgacctcaatttcataaaaataatacatacatacattttaaaggaagacggtcaaaagaagacattcttgctagtgataatataattaatttttgtgtttatgcatttctgagacctgtattttcaacaagtatttattcttaaatatagacatttttaaaagtaaaaaaatagttctacttacttctgcgaattatcttgaggaaataattaaaccaaccagaagtatacagatgcctactctaactttattattataaaattggaagtaacttaaatgttaggtcatagtggaagacctaaatgagtattgtatatgcactctaacaaatatgataaaatcattcaaatggtaattatgatgattacataaagattataaatatgattatgatagactgttcgaagaaaaaaattaacaagatatgtgcatattatgtaaatatgtaaaatttatcatttggacaagaactagggggaaatgtgtaaatataaaaataatcacattagcaaatgaagattatggatgcatttttctctttttttaaaaaaagttattatattattgtttatgtttcaaaagagtaggatgagattgtcctgaggcacttccattataggttagaatgccatgagcccttgctctgtccagtgctggcatccaggcttctcagttcagtctgtccacacttgtatcagtccatttgtgttgccacaaaggaatacctgagactgggtaatttacaaagaggtgtcttttggctcgtagttctgcagtgccatatacaagcatggcaccaatgtctgcttggcttttggtgagagcctcaggaacttacaatcatggcagaaggtgaaggagagcagtgtgtcacatggcgagagggggagtaagagaaggggagtaagagacaaaagggaggaggtggcaggatttttaaacaaccagctctcccctgaactaatagaaggagaactcatgaccaccgggagagcaccaagccattcacaaaggatccacccccacgatccaaacacttcccacctggcctctcccccaacactgaggatcacatttcaacaagagatttggaggggacaaacacccaaaccacatcaacactcaaggctgttttagagaagactctgatttacaagttaatattatcctgagtagaaacacaagtatgatactcagagatccaaagaaacagtggtaaactggcatttatttttaattgcaacaattggaggattctgagaaagaccagctaaaattatgaaatccttaaacttgttaaagcatctcacaaactatttccaccaaggttcagcttgttaagaatgataaatcaatagaattattttttcctccagaaatcatgatcacacaccagacacaaccttgttagtttaatgtaatgtatgaaatgctcttccatgagcacaatgttcagacattgtttatttggactaacaaaactctgatgaagaaatcaaataagaaagtcctgtagctcattttttctttaaaaacagccaatcactggaaaaacacacattgacagaatctatgtagtcccaggaatgagacatgctgggatccactcatggctgagggagcagggctcaggcctcatacagagagcaggccagaggtttagcaaaatgacctggagttcagggctgggctctgtcctcatgaccacagtaaaagcactgactgagcgcctgccccctgcctctgttacatatgtgacctcatttaatcatcacaacaactttcccaggtgggttactattagctccattgttcaggtgaggaaattgaagctcagcaaggcaaggttgcttttctaagagcacacagcaagtgatggaccccctgggtctggcacccaaatcacctagcgcctcacctggtgtttctccctctacattatattaactacaatgtaacaattagtgacttaatcttggtaccttacctatatgacttcatttaatgattatgaagtaccattatgtattatttttatcctctaaactttcctaaagttacagagctaggaggtggcagagatagggtaggactcctgtctgtctatctgcctaaaactgcaaagccctcactgtttccagcaatacccagctgcctctccttgtaccaagggtgttagaagagcatatccccaacacagcctgctcaggataaatgcattttatcatgactgctcttctcagaaacatgctacagtctaaaaaaccttaatcaccatgtcataaagtgcagtgactaatccattgtactgtgattatcacccataatatgtagagacataaaaagagattaataatgaaggtagtcaaataatacataggactgatgattatccacaacaaagtaaggagtgagtggaacgtgtttaaggagaaaagtcgatgccggatctgagctgtcagtttagtgctctccctactcagccagtcacccactctgctggtgactttgtcttccatgttactgggtgatgtttctttaaaatgtcttgctgtgcaaagtatgcactcctggtccctattcaacccccatgagaacgtcacaaacactcctaaatctcacatgaagcagctttatatcctggacagagccctggcttggaagtgagaaaacctggccaaggttcgtttctgtcctcagctagctatgtgatcgtgagcaagtcacttaatctttctaaggctgagttccttcatttacaaaatggggttggtgatacccaaaataaggctgacaaaataaggttcgctggaaattcaaatgctttgggttaaataatacaggattagctgatttaaagtaccaatgttataaggaaaataatctaacaaatgcagtaaaggtcttggcacattttgatgctagagttggtgggagttggaacagccaagcactaggaaagagttctgagtcgagaccaggactggaaagggaggctcggtgcaggtcaaaccaggaggaaactggaggcaacatcatactgaaaggtacacaagttgtagcccccctcctttaaaacttaactcctgcagtcaccagaggcaagccctgagcagcatctgcctaagtaagcgtctgtgacttgcagagtggtcgtcctggcccacagctcttggagagcactgggtggggcacgcctggcagctcaaacagctgagtctttcactgagtgtgaagacagcctgatcctttaaaaagagtggagttaacccctcctctaggtcaatctcagcagtaattttccaaatgctgcatgatgcattcatgttatgaccccctaaagctcttgttttagttctagagctagtctaagactatttaccactggttttttgaatctctgtgtgtcatacttgcattttcacttagagtaagaccaacctgtaaatcaaagtctgccctcgggcgcggtggctcacatctgtaatcccagcactttgggaggccaaggcgggcggatcacgaggtcaggagatggagaccatcctaactaacacggtgaaacccagtctctactaaaaatacaaaaaattagccgggcgtggtggtgggcacctgtagtcccagctactcgggaggctgaggcaggagaatggcgcgaacccgggaggtggagcttgcagtgagcagagttcacgccaccacactccagcctgggcgacagagcgagactccatctcagaaaaacaacaacaacaacaaaaaaaaacaaagtctgccctaaaacagccttgagtgtggaccgactgaattgagaggcctgggtaccagcaacagccaaagcaggggttcatagagccctcacctatcctgaaagtgcctcaggacaatctcatcctactctttggaaacataaagaataatacagcaactttttttaaaaagagaaaactggctgcagttgtggtgtcctggtgactcatgcagcaaattcaactccatctttacccaaatccttattatttcttctcctgcaagccactccttaaagagaaaatataaatatcgctcttcagattcaagatggtatagcttagatgggttagtgttgttattgaaaataggaggcctcagccgggcagagtggctcacacctgtaattctagcactttgagaggccgaggcgggctgatcacttgaggccaggagattgagactggcctggccaacatggtgaaacctgtctctaccaaaaatacgaaaaaataggcttcgtggctcatgcctgtaatcccagctactcaggaggctgagacacgagaatcacttgaacccaggaggcagaggttgtagtgagccaagaccatgccaatgcactccagcctgggtgacagagtgagaccctgtctcaaaaaagaaagaaagaaaataggaggctagattcatgctccagcactgtcagcaaataataaggtactataggaagctaggtgctgttttgagctcttttaatatgttatctaatttagtgtttttcatcatccaggaatagttactctcctccccacaaataacagaaggagaaaaggaggcttaatgaggtcaagtaatctgcccaaagtcccaacaaacaccctcctgttactaatgctaaccttccatgactctccagcgctagaataaaatccagtgtgaggggttaagaagtgaaacaggcttagctcacatagaaagtccttagctcatctcctagcacatggttaaatgctcaacaaatgatatctggcattagcaatagaagggcatttgaaagcctttaaagaaacacacagaatgcatggattttatggacttgtgcacagagaagcccgtggtgctagaagataccatgtaggactgtcaccagtgtgcctcaagttgctcattatcttgccatttcacataaaataaaacagaaatgcaaataaaagctacacaaataatgaaacatatataaaagaaaattttccctttgactcatccaatttttcctgggagtaatgcaccttgtgcttagatacacaattctcattgtcagagttgttttccctttgctttccacaatcagaccacaatcagaccacatccaggccagtgcttggttttggaaataagaccttgaccacagccctttgcctcactgggaatgtgttgctcagctaagtggctcaaagtccatgctgccacctacagaatgtgagaacattttggcaaattatatatctgacaagagactcaaacaggcactatggctcctgcctgtaatcccagctactcaggatgctgaggcagaaggatcctttgagcccaggagtgtgaggctacagtgagctatgatcacaccactgcactccagcctgggtgacagtgagaccttgtcttaaaaaaaaaaaaaaagaaagaaaaagaaaaaaagagactgtttctagaatatatgaagaactcttataactcaatagtgaaaagacagatacctcaatataaaaataagcaaaggatctgaatatttattcaaagaagatataaatggccaataagcacttgaaaagatgctcagcatcattagccatcagaagaatgcatatcaaaactacaacgagaactacttcacacccaccaggatggctattataaagaagacagataataatgagtgttggccaggatttggagagattggaatacttacacactgctaacagaaatgcaatacggtgcagtctctggaaaacagtctggcagtttcctcaaaaagttaaatatagagtttttatatgagccagcaattgtactactaggtatatacccaagagaattgaaaacatatattcacacaaaaaatatgtacaggaatgtccatagcaacacatttgaaatagctagaaagcagaaacaaaccaaatgcctatcagctgatgactgaataaataaaagatggtatatccatataatgaaatattactcagcagtgaaaaggaataaagtactgatagatgatacaacatggacaaattttgaaaatgttatggtaagcggaagaagccaggcataaaatactacatgctttatggttcccttcatatgaactgtccagaacaggcaaatgtatatggacagaaagtagatgagcagttgctagagttgagggatggcaagtaggggaaatggtgagcaactgctaatgggtacagggtttcttttagaagtgataaaatgtcctgaaattgattatggtgatggttgctaaactctgtgaatataccaaaacacagcaaattatacatattagatggatgaattgtatggtatgtgaattatgtcttagtgaagctgttgtttttttttaaatctcacgcttcccaggcagctggagtttcttctaactgggctgtggagtacatgacatggaaggcaatgtggttaaaggcatgcgtttcagaatcagactcccctgggttccaacgctggctctgccttttattgtctgtataaacttgggcaactctgtgaacttgtgaaaatatttgtcataatatagtctttgtgactttgtgcagatgaaatgagatgatgcaggtaaaaggtttatcacagtattcaacttgcaagtgcttaaaaggaagctactgacttcatcacctacgtgaacttggaaagtttacttatgaagtaagtcatttattctgttacatattatttctgtcttcttccatttcttgtgtttccaccaccaaatcaaaataggaatcagaagttcgcatgcatttatctctactgacttcaaaagaagagggtaaaaaagttgtcctagtttagggatgcaaatgatttagcagtggcaggatgccctgagtgcgcattaccaggctttggagtttatgtcatcaggcatggggcgaaatggtagcttttgaggcataaaagaggagcataagttctgtcctattaaagagatcaattgtccagtgtgtccaatattctgtcttccactctggccaagacagatgcttcagagaaggacataaaatccattaacatacttaattacacactcttgtattatgggagatacattactgtcccaaacccagcctgtccttgcctaaatatccaacatccattatcttcaaggtagcttacagatttaaactaattaatctctttttctccaagaggctttttcttaccagggggatgagagggctggttacctgctgcctgcccccatctgtgagctactgcgctgatgcctgattgtcaccttgtgcctgtttgaccttatgctcagtgggcatttggaactcctgcaccatcaatcatttgttgaagaccaactgtatgccaggaaaggtgccagacattggggcaaaaggaagactaggattttgttcctttatgagaggaactctaagtctactatggtatatataatttttcctatattatgattacttaaaaatgtgttggcctcccctttgagacagatatatctgaagataataataatgtaaggtgtaactattgaaattgctcagaacagcaaagtgacttctcagaggtcactatgcaacacttccattttcatttattggccagaaatttagtctcatggctgggtctagttgtaaagggagttgggggaatgtactcatttaatggagggacaaggtgcctagatataaactcaagttctatccctaagaaaaaaaggagagaatgaatttggggagtcaattagcaatcttctcatgggaggcatcaaagatttttaataagagagtgataaatttagatgtgtggttttgggcacatctggtggcccccaaagcatcagtaggttagggtgtggggtaaggaaaggtaagacaacaagggaaggggagggaagctgcagcaaaacatgatcaactaaaagccaaaacatgatcattggtttgaacaactaagaggatatgaggtgacctttgagaaagctgttttacaagaatggtaagctagacacaaaaacctgtgatgaaaaatcaccaatatgttgtcccttttgttgatcaaggagctaactgtcaggcctctgagcccaggccaggccatcgcatcccctgtgacttgcacgtatacatccagatggcctaaagtaactgaagatccacaaaagaagtaaaaacagccttaactgatgacattccaccattgtgatttgttcctgccccactctaactgatcaatgtactttgtaatctcccccacccttaagaaggtactttgtagtctcccccacccttaagaaggttctttgtaattctccccacccttgagaatgtactttgtgagatccacccctacccaccagagaacaaccccctttgactgtaattttccattaccttcccaaatcctataaaacggccccacccctatctcccttcgctgactctcttttcggacttagcccacctgcacccatgtgaaataaacagctttattgctcacacaaagcctgtttggtggtctcttcacaccgacgcacatggaatttggtgccatgactcggatcgggggacctcccttgggagatcaatcccgtcctcctgctctttgctccgtgagaaagatccacctacaacctcaggtcctcagaccgaccagcccaagaaacatctcaccaatttcaaatccagtaagcagcatctttttactctcttctccaacctccctcactatccctcaaccgctttctcctttcaatcttggcgctacacttcaatctctcccttctcttaatttcaattcattttctgatagagacaaaagagacacgttttatccgtggacccaaaactccggcgccagtcacagactgggaaggcagccttcccttggtgtttaatcattgcagggacgcctctctgattacatacccacgtttcaagggtgtcagacaatgcagggacgcctgccttggtccttcacccttagcggcaagtcccgctttcctggggcaggggcaagtacccctcaaccccttctccttcacccttagcggcaagtcccgctttcctagggggcaagaaccccccaattgcttatttctgcaccccaacctcttatctctgcgccccaatcccttatttccgcaccctgacctcttatttctgtgccccaaccccttctctgcttttctggagggcaagaactccccaccccttctccgtgtctctactcttttttctgggcttgcctccttcactatgggtaagcttccaccttccattcctccttcttgtcccttagcctgtgttctcaaaaacttaaaacctcttcaactcacacctgacctaaaacctaaatgctttattttcttctacaatgccgcttgaccccaatacaaactcgacagtagttccaaatagccggaaaatggcactttcaatttttccatcctacaagatctaaataattcttgtcgtaaaatgggcaaatggtctgaggtgcctgacgtccaggcattcttttacacatcagtcccttcctagtctctgtgcccagtgcaactcgtcccaaatcttccttctttccctccagcctgtcccctcagtcccaaccccaagcgtcgctgagtctttctaatcctccttttctacagacccatctgacctctcccctcctcgccagcccaagctaggtcccaattcttcctcagcctccactcctccaccctgtaatctttttatcgcctcccctcctcacacctggtccggcttacagtttcattctgtgactagccctcccccacctgcccagcaatttattcttaaaaacgtggctggagctaaaggcatagtcaaggttaatgctcctttttctttatcccaaatcagacagcgtttaggctttttcatcaaatataaaaacccagcccagttcatggctcgttcagcagcaaccctgagacgctttacagccctagaccctaaaaggtcaaaaggccatcttattctcaatatacattttattacccaatctgctcccgacattaaataaaactccaaaaattaaattccggccctcaaaccccacaacaggatttaattaacctcggcttcaaggtgtacaataatagaaaaaagttgcaattccttgcctccactgtgagacaaaccccagccgcatctccagcacacagaacttccaaacgcctgaactgcagtggccaggcattcctccagaacctcctcccccaggagcttgctacaagtgccagaaatctgaccaccaggccaaggaatgcctgcagcccaggattcctcctaagccgtgtcccatctgtgcgggaccccactggaaattggactgttcaactcacctggcagccactcccagagcccctggaactctggcccaaggctctctgactgactccttctcggcttagcggctgaagactgatgctgcccgatcgcctcggaagccccgtagaccatcacggacgccgaggtttgggtaactctcacagtggaaggtaagtccgtccccttcttaatcaatatggaggctacccactccacattaccttctattcaagggcctgtttcccttgcctccataactgttgggggtattgacagccaggcttctaaacctcttaaaactccccaactctggtgccaacttagacaatactcctttaagcactcctttttagttatccccacctgcccagttcccttattaggctgagacactttaactaaattatctgcttccctgactattcctggactacagctacatctcattgccgcccttcttcccaatccaaagcctcctttgcgtcctcctcttatatccccccaccttaacccacaagtataagatacctctactccctccttggcgaccgatcatgcacccctttccatctcattaaaacctaatcacccttaccccgctcaatgtcaagatcccatcgcacagcacgctttaaaaggattaaagcctgttatcactcgcctgctacagcatggtctttcaaagcctataaactctccttaccattcccccattttacctgtcctaaaaccagacaagacttacaggttagttcaggatctgcgccttatcaaccaaattgttttgcctatccaccccatggtgccaaacccatatactctcctatcctcaatacctccctctactacccgttattctgttctagatctcaaacatgctttctttactattcctttgcacccgtcatcccagcctctctttgctttcacttagactgaccctgacacccattaggctcagcaaattacctgggctgtactgccacaaggcttcacagacagcccccattacttcagtcaagcccaaatttcatcctcatctgttacctatctcggcataattctcataaaaacacacgtgctttccctgctgatcgtgtccgattaatctcccaaacctcaatcccttacaaaacaacaactcctttccttcctaggcatggttagtgcggtcagaattcttacacaacagccaggaccgcaccctgtagcctttctgtccaaacaacttgaccttactgttttagcctagccctcatgtctgcgtgcagcggctgccgctgctttaatacttttagaggccctaaaaatcacaaactatgctcaactcactctctacatttctcataacttccaaaatctattttcttcctcatacctgacacatatactttctgctccccggctccttcagctgtactcactctttaagtcccacaattaccattgttcctggcccggacttcaatctggcctcccacattattcctgataccgcacctgacccccatgactgtatctctctgatctacctgatattcaccccatttccccatatttccttctttactgttcctcaccctgatcacgcttgatttattgatggcagttccaccaggcctaatcgccacataccagcaaaggcaggctatgctatagtacaagccactagcccgcctctcagaacctctcatttcctttccatcgtggaaatctgtcctcaaggaaataacttctcagtgttccatctgctattctactactcctcaaggattattcaggccccctcccttccctacacatcaagctcgaggatttgcccccacccaggactggcaaattagctttactcaacatgcccgagtcaggaaactaaaatacctcttagtccaaatagacacttccactgaataagtaaaggcctttcctacagcgtctgagaaggccaccacagtcatttctttccttctgtcagacataattcctcagtttagccttccacctctatacagtctgataacagaccagcctttattagtcaaatcagccaagcagtttttcaggctcttagtaggtgtcagtgaaacctttatatcccttacaggcctccgtcttcaagaaaagtagaacggactaaaggtcttttaaaaagacagctcaccaagctcagccaccaacttaaaaaggactggacaatacttttaccactttcgcttctcagaattcaggcctgtcctcagaatgctacaaggtacatcccatttaagctcctgtatagacgctcctttttattaggccccagtctcatttgacaccagaccaacttagactgtgccccaaaaaacttgtcatccctatcttttgtagtcatactcctattcaccattctcaactactcatacatgccctgctcttgtttacactgccggtttacactgtttctccaagccatcacagctgatatctcctggtgctatccccaaactgccactctaaactcttgaagtaaataaataatctttgctggcaggactatgctgaatctccttaggcactctctaatcagatgtcctatgtcctcccaattcttagaccttttatacctgtttttctccttctcttattccatttagtttctcaattcatccaaaaccgtatccaggccgtcaccaatcattctatacgacaaatgtttcttcttacatccccacaatatcaccccttaccacaagacctcccttcagcttaatctctcccactgtaggttcccacgccacccctaatcccacttgaagcagccctgagaaacatcacccattctctctccataccaccccccaaaaattttcgccgcctcaacacttcaacactattttgttttgtcttattaatataagaaggcaggaatgtcacgcctctgagcccaggccaggccatcgcatcccgtgacttgcatgtatacatccagatggcctaaagtaactgaagatccacaaaagaagtacaaacagccttaactgatgacattcaaccactgtgatttgttcctgccccaccctaactgatcaatgtactttgtaatctcccccacccttaagaaggttctttgtaattctccccacccttgagaatgtactttgtgagatccacccctgcccaccagagaacaaccccctttgactaattttccattaccttcccaaatcctataaaacagccccacccctatctcccttcgctgactcttttcggacttagcccacctgcacccatgtgaaataaacagctttattgctcacataaagcctgtttggtggtctcttcacacggacgcgcatgaaactaacaatgtattggggagagaaacacacatctgcaaatatcattgctgaaaagaaatcattgcattaagtgctatagttaaagcgtataaacccaacactgaacacaaaggagggaaggactgggtctgacctggagagcagcagaggagaaagtgcgaaatgaaaggtacccagcaacagacaaagggtcacacttggccccagacatagtgcttcttcctcaagtgcgaagggagtattgcaaacaccagatatgcagtgttatctgtatttggaaattgtttatattcaggccattcacttcattcagtctggcaatttcattcaattaatctcattcatttcttaattaatctcattcattattctctgtaaactccacgagagcggagactttgtgtcttcttcatcggtagatcccccatgcctactggcactagtagttgccctaaattcacttatcaaaggcagcaagaataactgggactcttctctcttgcttttcacgatttccagcagggcacaaaggcctacagtccccacctgaaaaaaacagacttgactggaggcagcgcctcttcttccaaatacagccccagctgacgcagattagcacaaccgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggtgaggacgccgagcttccaggtcgccaggatcggccaggaatgtgtgagggggaagggggaaggacaagaggtttcaccccctggttagtttggcctcgctaaggcagggagccgccctcacgcaatgagcttgctttcagttggtggatttttgttgttacaaaagtgataatagccccgtgtgggaaattcccccatgcaaatacatttcccctctttctcgcgtatttctctgctgttttctctgcacctcgcccttttgccgttccattcctctctcttttcctctcctccagcttccaggcttctctctctccaccattaattccctgtgcactttctctttcccatcctgtcttttctttttcgttgtcttgtattcctgttgtctttcaacaatgtgccagaccctgtgctaggcgcctgttctttcacctgtccttttcacctcttttcgggctcctcctgtgtagaacattcctgccttcaacaggtcgtctttattactctctcctttcactataaattactactgcagctctgaaaactactcattagacaaatgtaaagcaaaattctgtggctgtgggatgttgttaggaggactgaaacgtcttgtgcagtgtttgtcgttttatttagttggaaggactaggattagtcgcagtatccccaggcacattgtggatactaaggattagaaatcggataagcgaaagacgtatgcctacaagaacagtcagagggcacaagttcctttttatgtcctcgggtctctattttcatatcttttagaactttttttatccgaatgaaaagtgaatttcaacaagcattttaagcttagccagatcttttatttaagtgggataatgataaatactggcctttgggtttaaatgattttattaatggtggtacatatgaattagacttatcatttatttaggcttggcaagaaagaagtcgtcctgctttgttctgtacttaaactttaacattactgttttgctaggggctggcaaggtttaattgcttatggatgtcattcacttgtggtagtgattgattccattactgcccaaactcttcaagttttagaaaagcataaagctgatgttgtaaaggtaagtaaaatcccactttgacgctaacatgttgtctagtctaaagtttaatactgtgtatcactaagctctcattaagtcttacgtgtaagtgttgaatagcttttaaatataacaacctatttggggtagcctagaattttcatatatatgacttaatgtcaatacagggtgagttattaaatgctagttgttagatcattttaaggcagatgaaagttctaccatttacaagaccactcagtcattccttagttttgagcacttaccatatgctatggatatggagatgaaagccctcagataattctccatcttataaggaagactcacagcgtgatagtgtgataagtgagacttgcgtaacacgctgtgagaaaacagaggagctgcatattgcctggttgtgaggagagtcacagaagtctacagtttcaagactagtagacagtagttagccaagtaaaaaattgacaaggagcattgcagggaaaagcaagaatatacacagaagtaagtagcgtgccataaagatggctaaagatgggacacttgtaggagtgatgaaataagaggcagccagagagattcagctgtctgtcctgaagttttgtaagattacgaaggagtttggattttttttttttttagacagaatctcactctgtcgcccaggctggagtgcagtggcatgatctcggctcactgtaagctccacatcctgggttcacgccattctcctgcctcagcctcctgagtagctgggactacaggcacccaccaccatgcccagctaattttttgtatttttagtagagaccgggtttcaccatgttagccaggatggtctcgagctcctgacctcgtgatccacccgccttggcctcccaaagtgctgggattacaggtgtgagtcaccgcgcccagcaggaatttggatttttgagtaggagattgatgtgaccatattcgcgtcttagaaaaactctggcagcagtggaggatctgctgaagaaatgcaagactggaggcagtaagatcatttaggagatttctgcagtaattttggtgggaaattctaagggcctaaaataaagctggggcatggagaagtcatgtttaagagcagcaaagaggtaaacctgatagcctttatagtgatcagtataaaggagagtaagagaatagagtgactccaaggtttcttttggtgtaattgaatgacagtgtttccagttatcagaggtaagcatctgtgaagtcagtgaatttttaagttttcaacatgcaaaatctgagatgcctgtaatatattgcattatagtgatccgggctttaggagataggtcaggattagagatagagatttggagtctttttcttttttaaataatagctttattgagatactcataccataaaatgtactgacttaaaatgcacaattctgtggcttttagtatatccacagttaatgcagccacaattacaatgaacttttttacctcaaaaagaaaccctatatccactagcagtcatattccatttcccccatttccctcatcctttggcaaccactgacctactttctgtgtctgtagactggcccattctggggattttatataaattgaatcatataatttgtggtcttttgtgcatgacttctttcacttaggataatgttttcatggttcatctgcgttgtagcatatatcaatactctgttactgatgaataatattccactgtaaggatgtatcacatttattttattgatggacatttggatattttgtactttttgcctgttacgaataatgctgctttgcacattcatgtgcaagttttgtgtgaacctgtgttttcatttcccttgagtatgtttctaggggtggaattactgactcatatggtaactctgtttaactttttgaggaactgctggactgttttccaaattaacattctcattagtagtgtatgaggagtctaatttgtccaaatcctcaccaacgcttgctgttctctgttcttttgattataaccatcctaatgggtatgaattgattctcattgtggctttggtttgcatttccctgatggctaaaggtgtggagtatcttttcatgtgcttattggccatttgtatatcttctttggagaaatgtctatgcaggtcctttgcccattttaaaattgtattatttatctttttataattgagtcgtaagatttctttgtatacagtagtcctcccttatccagaagggaaatgttccaagaccccagtggaagcctgaaaccctggatagtactgaaccctatatatattgtgctttttctcatacatacttacttatgataaagtttataaaccaaaccctgtatatactgttttgtctcatacatacttacctatgatcaagtttataaattaggcataataagagattaacaacaataactaataataataaaggagaacaattataacaatacatcagcattactactcttgcactttgggggcattataaagtaaaataagggttacttgaacatagcactgagatatcacaacagttgatctgataatcagtatggctactgagggcaggtggtgtatacagcatggatgttctggacaaagggatgatttatgattaaggcaggatggaacaggacagtgggagatttcatcatgctattcagaaaagcgcataatttatgaattgtttatttttagacttttttgtgtcatatgtttggattgatacatgatttgcaaatattttctctcaatttgtgggttgtctttttactttcttggtggtgtcttttgaagaacaaaactttttcattttgatgtagtccaatttattattttgtattgttgttgcttgtactttttgtgccatatccaagaaaccattgctttctccaatatcaagaagatatatacctttgtttttttcttagaattttagagctttagcttttaatccattttgagttaatttttatatatgatgtgaaatagggaaaaatactattaatttttgtttattgatcatatcctgtaatctagctaacttcacttagtagatctatttaatagtaattttgggtaaattttttttaagtagacagtcatgtcactgcaagtgactgcagtttaatgttttcattgataatctgtgtgtcttctatttttcttgccatgttgcattggctaggacctctactacaatgaatgggagagtagtgagaggatactcttgtcctgttcctgagcttagggggaaagtattcagtctttcatcaagtctgatgtaaggtatagggtgttttgggaaaaatatatttaccttctctttccctctctgtttcctttcccctacactgccccttggcatttctggagcttttatttctttatgtaggtccaagtttcagtctggtattatattcccatcgactgaagaatttactgtaagttcttaaagtgcctgtctaatattggttgattctcttagcttttatttctctgagaaagtatttcacctttgttttcgaaagataattttcaaaggatatagaattctgggtttataatttttttttctagtagtactttacaaatatcattccattggccaggcatggtggctcacacctgtaatcccaacactctgggaggccgaggtggatggatcacctggggtcaggagtttgagactagcctggccaacaaggcaaaacctcatctctactaaaaatacaaaaattagccaggcgtggtggtacacacctgtaatcccagctacttgggaggctgaggcaggagaacagcttaaacctgggaggtggaggttgcagtgagctgagatagtgccactgcactccagcctcggcaacagaataagactctgtctccaaaaaaaaaaaaaaaaaaaaatccctccactatcttcaagcttacatagtttctgatgaaaaatttttgtttttgtttctctgcattatatcttttttcctccgattatcttcaagatttccttaaccttggttttcaatagtttgattattaaaatatatatatatatggcttggagtttacctaaatggaattcaacatatacatatacaaatatatacacatatacaaacatatatatacacatagagacagtcaattcttgttatttgtggtagctatattctgtaaagttgttgtatacactgaattagtgaatactgaaactttgtttgctcctaggggttaggttcttgtgaggctctggtcacaacattttcatcaactgatcaatagataaccttgctttatatgtgtttccgtttaaagacatattaatatgtcagttgatctattaacattgaactcatagccaacaacacatgcctgagcaaagattatcacatatatatatatgtatgtattttttgcaagacacatcacaacttctcatacttagaaacggtaggcagtatgcttggggacctatttaaacagtgaagtcaccagcaaaaggaacaaaaatgtgaaaaatgtggtactaaataaatcatgagatgaacacttgttttgccattggaaaagctaaagcaagaattcttgtttgacttcagctgggaacacacatgtatgttcggtgacatttttttcaccattctgcacttgtccacaaaagcactgcaagtattgattttgaggttgcaaattatagtgagtaggtaaattgacaaatacagaatctataaataactagaatggactgtgtacacatatatacactatacatattctattcatacacattctatacctatgaacttaaacatatacacatacaaatatgcatacacacatacatatgcatatatacacatacctcatttaaaaatttttgcctgagcaaaagatctattacaggaaaaccttaaggcctgttcacgctcattttcagaaaacgttgtttccatctttttcatgaatactactgcaattggttggcttactttcctaccttagcattatatatgagtgtatttatatctgtacacatatataggtatatacatttatatgtatttatagatttgtggtatttaaatctacttattaaacagaccttggacactgtactaagtctgagaatagaaatgcaaacaaagaccacatggtgtgccctatggaacttacagttgatggactcatgaataggcaaaaagaatgtaaataaaataagtacaaattgtgtagtagtaaatgctttgaagaaaataagcaggatactgagaagagaggggtggtagtgaccagggaaggcctgactcctagtgaggactatgaaatttttcccttattctgtcagtattcattgttcaagaatttaatcagatttgccctggagttcatgtgttttttattttaaaaattctattgttaatcatgttgctataggcatgaagcatttttttttttttagagaaaaacttaatgttttgtgaaagagagagacagctagagttttttgtttgactttgccttctcctgactttccctctgcaaggtttttgtgtttctaagttgtcttcttttagttaggagactagaatacagaaaaacattctgctaaatatgattttaggtattttgtcataaattagatcttaggaaaactgattttcaaggcatcctggggttttaacctaaatttcccaaaatattaaggctgtgaatcatttttcatcacaggatctttgtgatgtgtcaaagaaaacaattttgtaactgcagttaaagatatctaccaaagtaacacaaatgctgccttcaaaatgaaaaccagttttctgtttattcttgctaaatgtttatgtaatataaatgtagtatgggttctggttgatgttttgtgaaaattatgttctgtttcatccagcgcaagtatttacttgatctgatttcttcttgatacaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccagggtgaggaaagtctgctcagctaagtgtgtatattgatacacttactcttggagtggttttttggttttgggggttttcccccattcatttaattttatcaattccaagttagctcttgattgtgttttgcctattctgctgatctaaatctggctttctgtccttactaatacacttctaggcatatttcttcaaatctcaactgatttgtgctttggtaaaactcattaattgcaatatcagcctcattcaagcatgataagaaaaagtaagtggtacaatcttgtaatctaagctacaatataaggaaaattggccactgctgttaggaactagccatcagtgcttactctacattaagtaatttgttcattatcagagatgaacaaaattttattctcattttcatatagattgcttgtttgttcgtttcatgttactgacctaaaaccagtacggtattctttttttttttctttttttttttttgagatggagtgtcgctctgttgcccaggctggagtacagtggcgctatctcggctcactgcaaactctgcctcctgggttcacgccattctcctgcctcagcctcccgagtagctgggaccacaggcacacaccaccacacccagctaattttttgtatttttagtagagacggggttttaccatgttagccaggatggtctcgatctcctgacttcgtgatccacctgcctcgtcctcccaaagtgctgggattacaggcgtgaaccactgcgccctgcccagtacagtattctttagacttaagtcctccagtggctctcttgactgaatgaattttttaaatgactatttaaaaaatatttattaaatacttactgtgtactaggtactgaactagatctttgcatattctgtttattttttgaaaaaccatgaagaactgtaaagttccattaagtaattccacagaaacattaggaaagtctgacatcttggttgtggctaagagagtttcatattgattttatagttttaagtaatgattagggcaaattgccttttattttctttgaagtaatatttcagattacttcaaaatttttaccttgagagtttaaccagacaacttatttttatatagaattagttttttctctggaatattgatacacacacacacacacacacacacgtcacatttggggctggtggttaagtttttaaagattatattttaaaaactaaatatcaaggacaagttagccaaggactttggagagtgtggtttctgaattttgcctttctttatcgggtctttccagatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaacttgtgagtaacagttgcttgtggaaaatgagttaagtgagatatttataatatagtaatgctatgtgcatgagatatacacacacattatacatctataatgttaaaatgactgagcgaagtggagaagcatgtctagtccatatatctgcagctcctaatacacatactcaatcataagttcatatcattgcaaatatgataaaaaattaaatcagcaagctacaccttcactgtgttgaatttgtgaatagtattagactagccagggacagagagttactttgacactccagacttaattagttcttctaagaacatttaaataacttgaatcaagggtttcattcagtctgtggccaagttaagttcttgctttttaataaattgtcctaattcacgccattcattttgagtgccataaacagatgcatgtaaagaagaaataagcctaagcaagttttttcttgcagagatagtttttgctaatatgcttttaatgttttcctgagctaatgatctaaaaatgagatgtgctttaggtatttttgtggctaaattgtttagaaactatttaatcatccaacagatatttcttgagctattgctactcttctgggaaccaagatgtctcagaacccaaaaggcaggagccttcacagagtttgcattctagtgagaagaagtcatatcataaactgtgaccacaatgaattaataaattctagtgtagtaagaggtgacaggtgatataaaggcaggataaaggggatgcagaagaatgggggatgagggcatgcaagttgtatgagataaagtggtcaaagtaggcttcactttgataatgatcagaaatgtgaaggaggtaagggaattagctatggtaaggaatgtttttcctggatttgaatgactcaaaattgttttacccatcaacttttattgaggggtgtgtgtgtgtctgcacgtgttaaaggaggaagagaaaggcagacaaaattgaaattataataacatgggaaatgtggctgtgtaaatacactacagggtgcttaggcttttatgtatgtaaatgtttgtatatggacgtgtgcatacatacactcacttggtcaccagtttacttactcacataggtgcagtgctggggaaacacctaggagggctggcccagttggcagagtcagggaaggagggcatcacaaaagaaggaagcaaaggggaccttgaaggatgagttctggaacctgaaaaggcaacaaggctttcagctaacttgattgcatcagctctttacatctctgtaatttggttgatgaaagcattgtgtgttccagagtgtcagttgacctaacatctttgatttactcatattgaatgtgctagggttgtcataactcttgaatgcatcctttttccctgtgtttagagcagccttgctaagggctgggacccagggtagtaaggtttttctgctcatgtcttccagtattaggcccattgttgagggagattattttttcagtcataaaaaggcataatttgtattgctaaatatggtgctccctccttgactatttttgtttcatgtacacttagtaagtcactgtgggcccactactgttttctaaatattaagggaaaagaatattccttaatcatcttaaggttcgatctgatgcttgagaagaaaaagggaatatatttagactgagtagctcaggataaaaatttggtatcatcaaataaaatatatgaacttagctaattgtgatatgcagagcctcttaagtatggttttttgtttttttaagttatgggatatgttaaagtttttttgtttgtttgttttttgtttttgtttttgttttttttttttgagatggaatcttgctctgtcacccgggttggagtgcagtggcactatctcggctcactgcaacctccacctcccagttcaagcgattctcctgcctcactctcctgagttgctgggattacaggtgtgtgccaccacgcctggctaatttttgtatttttggtagagacggggtttcaccatgttgatcaggctggtctcgaactcctgacttcatgatctgcctgcctctgcctcccaaagtgctgggataataaggaaagatttttaatgaaagtccgtgccctgaatttatttagaagaacaaacacttgttctttctgccaataaccttatgttatctttttaatataagacataatatagaatgccaagcttggaggcctctgatgaattgtaatggaccacctgtttctcttcaacttagagaacattcccattatgttatgaatgcataacattgccagttatatattattaaaattatcactatattgctctcaaaattgtattggaataaaactgtatgctaaacttcattaaactttaatcagagttttgcttttctcaatatagtgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctaggtaagttacaagtgtaaaattaacattcatctacttatctggtatgaaagcatcatttttggagatgtacaaagactgatgtttttcttcatctcactttttctcatttctaattttgaatttattagaggaaaaaaatatttatttttgtcccctgccctaagaggagattcagcatttaacattgcctttgtttccactagctgtgctaaacttccccactgacttttatagattaaaatttttgaattctgatttttacttgtgaaaatcgcaatgatcctaaagttcaggcaattgaatgcattaaaaatttgggcacaaaagctggatactcattttaaatacattttcctgacttaggtgctgtgcattctcattcagcagtaaaatcggagtgtttttcttatgcaggtgaagatgtctcccatcctggttaagagccaaggctccgggggaagctttagctatgagactgagaaacttctttaatcttactcaaatttctctctcccagtctctaaaataaggctttaaagtatttcatagggttgttttaaagatcaatagatccaataatgtaagtaaagcatgtaatgtcattgatacatagtaatttatttagaagatgtcggctgttattaagaaattacaactgaataaaagtttattttaagtaatttgatgtattcaaaataggtttctttctttttcctatagcaataatctgtatattattgctttggcaggcttttttgtttgttttggcattcattttcagatagcctttatttttaatatgccaagattactctctctaggcttggtgagtaactacttgaaaaatatgtggtaaaaatataaattgctctacaaatacattttgcacttgtgtgtaagtatcacttctatatattaagccataggctggttaagttcactagttaatttatctctcaccctgtgccaaaatgacttaagattacttcttaagtatcttaagagaactttctattttttatgtattccctctcataaacaagaaattatttggcagtctgaatagttttataagttatgttttatatttcttaagttttctctcatatgaattatatgtatatcttgagtattggggaaatacattatttcttcaagtagaaccgctctgggtgctttcacatctattaattcctggactcttactacaattctggcagtagtaatattcccattttacaaataaggaaaactgagtcccacaccaatttaaataaagttactcaagctcacccaactaggacatggcagtcgggattttaatgcaataaaaattcctctttctagtcttgtgaactaactttattttaaatttcaaagccttttaataaaattatgtttgtaaaatgaaatgtaaaatgaaaatagtacataattgtatgtctattcctattgaaatatatttaatatagaaaaggtcattgaatgtatgcaacaatcacaaattattaaaatgatttttcagaccctaacaatctcttaaaatccttatagtttcacctgttttatttacacacaagaaaatgctgcaatataagtgaaactttgtttcaaaaaagatttaagacagcttaaaagtgaatgaaggcagccaaggggaagttacttgcccaaagccatacagatagtccagtaactcctggtccaggggccctaattaccctaaatgttgatgtttttcatcctgagtcttgattttaacagtttgcctagtacttttaatgacaaagtaaaagtaaaataaaactgtcttatgcatgccagctattattatattatcatttaccatgtcttgtgtaatattaataacttaatattctactacttaatatttcaaaaacttagaaacactgacatttctacccatcctatacaatattattagcatttggattttggtacatagtagagatctaagttttggatgccaacccatgttggtcacttcagggaatagttgtacatttttattgtcaatttttatgtgtaaagtacaaaattaaatcttttattaggtctgatataaatgaagtctttgacccaagtgaatgtttacttttttcagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtatctacaattcataaattatattccccaaaattattaagaatgttatattaaaagaaggccataatcttgcataagtcttgtcttcagttctccactttctcttttcaatttatcaaaagactagcaacactattttagattgttttttttgtctgcacttttgattggtttgatttaccctagaaattgtgactgatcctgagatatttattgaactatttaagtcacatgggtaaagacaaattattttaggattataaatggatattttaaatgtacatttagttttaaagtttgggatttgtctatttttttttcttttgcccatattatctaaatatgagtttgagtttcacagtatatactttattaatctattgtgttttaaaaaataaatatatcatctatttaaaggtaataccctgctttcagcgtgatggtttattttgtctacatgaaaatggttgtataactttacgtgttcgaagatcttataataacatttttaccacttcaaatgaggaaccaggtgagtttctgtctcacaataatgttatatttttcttcaaaattattttataaagcttgatgtggcaaataccagccaaggtatatagttaatgatactccttgctttgaggaagtttaaaatatggttataataagaggcataaaaagtataagcccaagattaatctcttgatgttaaaacagtgcacctcctgtatacatcaaagagagtaaaattttgtgtttcttgatcatatccatgagccaagtagatattattttttggaattttttttttttttcagtacaagtccaaccttgtgtgcctttattattatacccccttgacttgttggctgtaagaacttccattgtaaagtgacagaggttattaagtctcagttgtcaagtcagtcttatcttggagaatggaaataatgtttttgtgaaattatatactgtgtaaagatcaaagtgattttcacatcttttggaaagtacagttattttcaggcttatagactactacaaattatgatggaaatttattcattaattatatatcactgttgatcctttttcaaagtatcgtctttattttaaaatattgaaaaaagatatcttgattatagttgttattttggaaattaaacttagtacagtcattaagtaaattatatttggaaaaaatttagtagtaattgtaaaaagtgaagccatgcttgacattgcattcatgaaggagtgatgcccaaatttagttgaggttttatttaaattgaaacaaacagtagtggtatcgatatggctgctttctgatatttaaaacaattttatgtgaagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacaggtaaatgaatcaacaggatcatggttttgttttttgtttcctgtttccttttataaaaaatttccataatcataaaaataggagggctggttttctataaaaatatttttaaggtaataattaaggctttagattattagggaattatgtaaatctgctagagctatttcacctatgggtaagatgaatgaataatataaaaatagatagaatgccataatctggacttaatactttgaattcctaatacgtaatgcagattttaagtatgtaaaaccttctaattattatgtctttgcagtagttctggtgtgtcacctttatattcaccagtgtctttctgtggaattcctgtaggagtgctacagaataaactcccagacctttccttagataacatgattggtaagcttttttcccctctaactccatgttaagtattctttctgaagggcaaaattaatagaatcactcacttgtaattattttaaagtcaaaaaagttaatacttgagaaaactagaacatggaatcattctttcctaaataaatcagaggggtttaaaatacttaggtagaaaagtgcctgaagtagcacgggtttgcattatagttgttagaaatagaaaacgttcattcgtgagagactgatgtaaatgaaagcaatgacattaggcatctggattttggacctagagccgatgctgagctatgccatgccaactcagggccttgctgtttgctggttcctcagcttggaatgaagtacatgcttcctttctgtctgctactcctaattcaaaattcaactcagatgttgttttctttaatctcccaagtctaatttaaatgctcttcttttgtttttcctaacagttatcagcatattttaattgtgggtttttttcttctgtttcatctcatcaattgtaagcatcacaagggtggtacagtgtttgattctattttgtctttcccagcactcagcacagtaccttgtgcatgcctgttttgtagtaaatatttactgaaggaataaagtaactgagcagtattagaaaagattattttaactttttgacatgaattatttttatgttggggattctttcaaaaaatcatttttggagataaagtgttcaaagttatttaattatgaggccagtatgtattaaaggaagaatgagagtttgtgatttcaaattttatgctacttgaaattataaggctttgtaaatatgccaagcaatttggacatctaatttttttacagttgtggctatggtttataaaggattttctgttttattatttattctaccataatataattgaaaacgatattatttaggagggtttttttgttgttgttgaaacgctaaataagtgatgcactagaaagagcattggccaggcgcagtgactcacgcctgtaatcccaacacttttggaggccgaggcgggaggatcacttgaggtcaggagttcgagaccagcctggccaacatagtgaaaccctgtctctactaaaaatataagaattagccaggtgcagtggcatgtgcttgtggtcccagctacttagggggctgaggcaggagaatcgcttgaacctgggaggcggtggaggttgcagtgagccgagattgcaccactgcactccaacctgggcaacagagcgagactcgatctcaaaaacaaaaaaaaagcattacattattaattacattaattagatcacatttattgggtacttcatactgtgttaagtgctgtgctaaatattctacatattaccttggtacagctttgcaatgtaagtaatattatctccatttgatacatatgagaactgaggcccagagagattaaaactttaaaccacacagtcacacagtcacacaatggaagagcccaagtgtgacccgggtaatcctggctccagagcctgctccttagcaatggcctccagtcctgacagctccactgtcatcttgggtaagaccatcattcatctctaggcctcagttttttcacgatttctgccagttatgaaatccttttgttcagtgatacttactattatatctaaaattatttctctccactatctattctaccagacataaatccatatgaggaagcctggacacatgttttgcaaaatttattttatcagtaacacaattttttgagttaattcaccttgtctactcttaatatgaaaacttaaagtgaaaagaattataaacacacacaagaacagcactaatcagttatatggagcccataggagtttgaaattttatgctgtttaggtatctaagtgatataaattacaggttttttttttttttttttttttgagacggagtcttgctctgtcgcccaggctggaatgcagtggcgcgatctcggctcactgcaagctccgcctcccgggttcacgccattctcctgcctcagcctcccgcgtagctgggactacaggcgcccgccaccacgcccggctaatttttttgtgtttttttagtagagacggggtttcactgtgttagccaggatggtctcgatctcctgacctcgtgatccgcccgcctcggcctcccaaagtgctgggattacaggcgtgagccaccgcgcccggccaaattacagtttttaagagacaaatggatacggattgtatagcagttcttgacaatgtagttgattttaaagtgttaaataaagcttcgtacttgaaaacattttaatttaaacttttaattaaacttttaatttgaaattcactgtgttcttagtgaaaattcaaagcaattcaggtaaataaagaggctgatttatattcactggataaatgctgatacttattaaggcctaatttgccctacattgtgaattgcctcttatgaaaaatacttgaagaaaaatgtggcattccctggatgtcaactcaaagccaacatatgtatgtgtggcacttacatgttaagcttcccattccttcatatttcatcttttttattttattttattttttttgagatggagtctcgctctgtcaccaggctggagtgcggtggcgcaatctcggctcattgcaacctccacctcccgagttcaagcgattctcctgcctcagccccatgagtagctgggattacaggtgtgcgccaccacacccagctaatttttgtatttttagtagagacagggtttcaccatgttgaccaggatggtctcaatcttctgacctcgtgatccggttgcctcggcctcccaaagttctgggattacaggcgtgagccaccacactcggcctccatctttttttaaccaaagttatgtagagagattgatattgagtatgtggctaatcctaagggatcattttaataggattaaaatgctattttttctatatattttgtggattttaaaataacattattaaaacaactttacagcttcaaaaggttgtatttatcacccactcttagtaattatttatacttttcctttcacactatatacatgtttgtgtttatgtgtgtgtagacatgtatgtatatactcatgcatattctttctatttttggcaagttaatcccaatattctgtagtggtttataggaaggaaatttgtatacctttttaatgaacagtcttgatttcattgtactgtttagatttagcttttgttagaatgatttttattggagtcatctttttagtttgagacttgctaacctaagtacgaatggtatatgtgaaaataatgccattgaagtcttaactattgacagtgatggtgtatatattatacacgtgatttatgaatatatatatttgtatttgttttatatttacttataaaacattttgtaattacactgacacattaaggtttcttattagaaattatgaataagttatttaaatctgtttttcatgaataccaattttgtatgtactttacagagtacatcagattgaaaagtaaccctttcaaaaggcagtaaaatgagaaaaatgtggtacagtagttcactctgcagaaactgttctctaatgcaagttctcttgctttgttctgaagcctgtgtagtgctttaataccaggaacattgactgaaacagtgtttcttagaagacataggtccctgcattctggatagcaggactcgggagtaatctatcctttgaggtgttagttgatgcaatttaagtcctatagccaggtacagagtcattgtgtccttaataactacagccactaaagtactacattaactacattatacttttagacctgaagagcatttctactgaaaattttctttagctttttaagatcagcatacactgtagttaatatatttgttatttttattacaaatcagggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtgagtatttgacctggtctttttttttttaactcactttataagatgtttaggttttctagtttctagaagatcctttattctttttgaggatgctttaaaaggagatagagactaagtgaaactgtaaatactcatcctggaacttaaaaaaaaaaaaatttctgtccttttattccaactgtcttatattgaattggaatgctgagtcttcatccacctgagactggacagtcgagtctctgacgctgtccattcatctcggaaataccaggaggctcatccctgcagtgctgaatcccaggctccttgtctgtaattggaccaccccagtctttatgtcatgtcagttttcgttgggtctttattgactaaaaatatagtcagggttaatagcttaataatagcagggttcttcttttgccaagagttatatattaaatattatttaaagtggctatggtccctataaattaagatttgccttttggtgtgaaattgtgtatttgtatgttataggtagaaaaatttatctgggttccaacttgctgtcacattgatttcatagtaatgtgatgaacctaattttctttacagcatagagaaaaaaacaaaatttagtttgctattaagtacacattattaaaatacatttctccaaaacttctgaaaaacagtgtatttgtttgaaactcaacatttcttcttaagatgctatcggctggcttctggctttctcccccagtctattaacatgtgatttgtggtgaaaacctcaccatatttattctgtggccaacatggctgacttctcagtgttaaagactcatttgggtattactgtttggtagtacccttctgtttttttctgtgcctatcttttgaaagcgatttgatttttatgattcaattgtctatatatgtgtcccgatttatataatgcagataaatgtttaatttttgctttagaaactgttgattaatatttcaccactaatagattttaattaggattcatcagtgtgcttcatatgtgcatgtatgtattatgtcagtgttcctgatttgtcagttaggattttgtcaatttcttggggaaaactacttcttgggatagctatgtaataagagctatggcaaggtctgagctttccattgtagaataagctgtattggtatgtagtgaatatcatttactgaatttagtataacaaagtaaaaatataagtacctaaaagtttgtctagaggtgtcactaagaaagataaataagagttcagctatggaattaattctccttgtggtgcccctagtgcattagatcataggttcagcattgttaaaactttcagattgcagaaatcattggattattatgaagttctgttaattgaaaaattttagtaatttagttattttctcagtgccaaaaggtattattatgaaatagatgataaatgtaaacaactgtacaatgtgtttttctagaatagttttgcaaaagatttctggagttttattcagcaaataagataatattggaatttgcccagcatttttacttccactctgttgctttgcatgaattcattaatctttaaatcatgtgcagtgcaaaagtgattgtccatatagactgttcacttttcttgcttaacttataaaaacactatagagactgaagctttactttctcatgtatgtccgtgtcctttacatttaaactttagacatactacctgagaccatgaaaagctttagaataatacctgtaaactattaattatagtgatgacagaatactaatagttaaccaagtgcttactttgtgccaattactgtgcttagtgctttatgtttccccatttaatctccaacaactagattttctactcttcccattttaaagagatgaaaacacagatttagtgtgggcaagtaattcatccaagagtataaggaagagccagggcttaagcccaggtttctttaattgcagaaaccacagttaaccattatactttactctcttgtcaggatttatttaataaaagagacaaaacaaaaagaaaactttggaaagaaaaatggataaccctggttagtgagctctgctagattgcttatttgaggaccagctataataaaccttctgagtctcaaaaagtataaattcccatgtgtataaaagcttaggaaagtgtttcttcaaattgtatgtgtattaatgtaagttttaaggtctttctgtgaaaaatctattcctggaattaggcaaggcttttgagcacgtgaggttaggcccattttttttataaggaagtggaccagagaaattcattcttctttgtgtgtttgtttaaacacatagtttgggtttcttttataaaagataaatgtgttaagtgattaaagtcttgagaaaagacttttcttgcaaagtgctggaactcccactgaattaatgctcttccatgatgtcattttgaaaggtacaagtaatggttctgtcctggtgtaccatctcaccagtggtctgctacacaaagagttaagcatccactcatgtgaagtcaagtaagtatgtcattgtgatgatgacatcacaaacatcatatcagaaaaaaaattctcatagacttttctacattgagtactctgtaatatctgcagtggtgattatttgaaaagtttgaataatattcatgtccaactaatggctatgttaatcaaggatgataactaattctttgctgtgtaaagaacataagcagtagagaatgttttctcttttattaggttggtgcaaaagtaattgcggtttttgcagttttttttttttttttgttgttgttgttgttgtttgttttgttttgttttgttttttttaaatggcaaaaaacacagctatttttgtaccaactaatattgttgcacctcatttatttctcctaagggccaggctgttttctcactggatatccttacgttgccttgttcaggtttattttatttatttattttgctcaaaattattattttttattattttaaaattttttttactttaagttcctggatacatgtgcagaatgcgtgcatttgttacatagttatacatgtgccttggtggtttgctgcacctgtcaacccatcacctaggttttaagctccacatgcattagctatttgtcctgatgctctccctcccctcacatgcccccgccaacaggccctagtgtgtgttgttcccctccctgtgtccatgtgttctcattgttcaactcccacttatgagtgagaacatacagtgtttggtttttctgttcctgtgttagtttgctgaggatgatggcttccagctccatccatatccctgcaaaggacatgatctccctttttatgactgcatagtattccatggtgtgtatgtaccacatttcctctttctttttttttctttaattttactttaagttctgggatacatgtgcagaatgtgcaggtttgttacatagatatacatgtgccttggtggtttgctgcacctgtcaacccgtcatctaggttttaagccccacatgcattaggtatttctcctaatgctctccctccccttgcccctcaatccccgataggccccagtgtgtgatgttcctctcgctgtgtctatgtgttctcatcgttcaactcccacttatgagtgagaacatgcagtgtttggttttctgttcctctgttagtctgctgagaatgatggcttccagtttcatccatgtccctgcaaaggacatgaactcattcttttttatggctgcgtatttttcatttctataacgatccatcagtaggactgcttatgacaaattcaaataaagtcattttaattgttaatttgtcttatttattctttgtttaaacatcatcagaacgctgcatagcatttatttgatttttaggacatgatctgcttatgagttctgtgtatgcagagctgtccgagggaaagctaaattgacggaaaagtgcttcttgctttctgttccaaaatgcctacctgtgctgtccatagcattatttcgctgaatgcaaggctattttccttttgtgtcctatcagtgatagatcgtagagttacatatataaaatatgaatttccacttttttgtttgttttttgatacagtcttactctgtcacccaggctagagtgcaatggcgcgatctcagctcactacaatctccgcctcctggtttcaggtgattcttatgcctcagcctcttgagtagctaggactacaggcacgtgccaccatgcccagctaaattttgtatttttagtagagacggggtttcaccatgttggccaggctgatgttgaactcctcacctcaagtgatccatccacctcagcctcccaaagtgctgggattacaggcatgagccaccacccccagccagtttccagtttttttttatgatctttcagtgaaagcataagaagtcattttctgttttctgtacattaaataattgtaggtcttgtgtataaaaattctcagtgaacccttagcaaacacattatcctgagtacatgcattttcttaatggagaagggttaaccttttttttctttttttttttttttttgagttggagtttcgctcttgttgcccaggctagagtggaatggcgctatcttagctcactgcaacctctgtctcccgggttcaagcaattctcctgcctcatcctcccaagtagctgggattacaggtgtatgccaccacgcccagctaatttttgtattttttagtagagacaagatttcaccatgttggtcaggccggtcttgaattcctgacctcagatgatctacctgcctctgcctcccaaagtgctgggattacaggcgtgagccaccgcgccaggccaggttaaccttttaagtatcacagcttctgattgtgatggaaatctctgaaaagtttgcattgtcttactgtttcaagtgcattgttgtgtggtgcagcccaggtgactgtttattgccaccttacgctgttcctatacagcatctccccagatacatttacgtggaataataatgtctttaaaagctttgggcttttgaggtgcagtgacacaggtatctgtttggactctttcaggctgttattcatctcttctcttctgttgcagtgtctgtagcttgccattctggcacttctagtagtctctgcttacactgctgaatcttctctctctctctttcccatctcctcttctctcgacatttcctttcaccctgccttgtgtgtctggtgtttccttttatggtcagcactaaccaatcgaaactctccatttaatcactacttattctagggattatgttaactattaatacttcacacgtatcatttcattgaatccccactacaatcgtatggggcaggtattgtatttccagtctacagagtaagaaactgaaaattacagagtaatctgtgaaggagctagatggaattcactctgggcctttgaagcctcagaacctgaactcttcacttatacttacagtgcatgtgctgcatctcctgctaaaatacgcacataggttagtaggaatcatgttggcagtaaaattaaaatgttggctgagccaagatttgtgctaagaatttcacacatgcttctgaaaaatcaaacatgttgtcttttcaaacacagaaagttttaatagctaattaatcagagaggtattaattttaagtaaggtttattatcctggattagtcaggttatagatgtcactaaatacttgacttatacatgttaagataatatttatggttgagtaacattgaaattgattataagtgttacttgggatactaactctgagggatatactacttatcagataaatgtgaatgatcatacaaagatactccatttttatatgaatttttcctcttcattgccattttgaaaataatttgtattttatattcagagatactgcccaagagaacactaaaatcctgctttgtgtttcagttaatgcaattttagtattataatcaaaagccattaagaaaatttcacagaaatacaaaaattagctgggcgtggtagcatacacctgtaggctcagccatttgggagcctgaggtgggaggatctcttgaacctgggaggcagaggttgcagtaagttgagattgtgtcactgcactccagcttgggtgacagtgagaccctgtctcaaaaaacacaaaacaaaacaaaacaaaactttcacgatgtattataaaaatgtctgaatttattagcagtaaactcaaaacattttagattttcatgtccaaataaggttaacttttagaaagttgtttttctaccttttattaagtgtgtttttaaaaaatcataatctaaagcacttgaaggttgtatatactgtgccggggactcatgacagcagatagcacaaagtgtgtgtgtttttaaaaccatgatgttttaacttgtgatgctttatgaatatctgttgaatatcttctctatgcttataaacagagaaagcctttgaagcttataatgcaatggaagatacttagaagtaaacaaaatagagaggtatatgtagattttcttaggtcattagtttgtgtctttgtctggtaggctgaaactactgtcatatgactctctccctggccagattttaatagtcatactaatactgatgtgaatcctgataattaaactatcttgtcattacatttgtagataaagttttggttagaaatgattttgtatgtgttaggtatggtaatacagtctcaaataaaaggtcatgttaagataaaaggtcatgcttactttttaattaatttgtgtaataaaatttaggtctttggaaaacttatttttcaaataaatgaacctttcaaataaaaaagagaattagtttaacctttatctcatttcctattataggggtattgaatggacaagtttgactagttttctttcttttgctacctcaacaccaaacaatatgggattagtgagaaatgaacttcaactggttgatcttccaacaggtttgtttttaaagatccaaataggtttgtcatattgaataaacatgttgccatttataaaacatgtttgaaagtacttctttcaccttggaatttttttttatatttcatgcttatatatttattcttttattctctaataattgccctagaaaggcctcatcattgtttacatggaaatgttgttggcacaaatacatggtaaaatggaggaccattagcctgaacagacagattcattaaaaaataggataccggttctacttttaagtgcattgttatatgtaaccaactttaaaagatcgatttaaaaataactctgtcaatggactttattagagtctgtgctggaaattttggcttttataggaaacacttagaaaatttataggttaaggattgtttttaaatgctcaaatttaaaacttgtaatagtctctggctgaatgaatagagaaacttaatttgggattttgaagattctacagtaggaaacgtcccaataaggtaactttttcagaattgaaagcctaaacccagtgaatttcaaaataaagaatttgaaaatataataaggaaagagtttcaaattattttctggtgtatgcagtagtttcaaagaggtttttttaaaaataaaattgtgatgagtttctttaaaatggtatagcaacacgaatcatatgtagatgatcttaaccaatgagagcatgtgtatgtatgtgtaaaatgaattaaatcaaataaatggttgtaaatcaagtaagttgtaaataaatgaagtacatggttgcttttttatgttctccatatgtattttcaagctctcaaagatccagttgttcttacttctcagggtatgttgctgaacttccaggaatcattcccgtctttagtccagtgttgctgctctagtctcattggaagtgacctgtccactgactctcatccccaagttcctaatttgccagcagaatggtactggccctgtgtctagtgatcccagggataaaatgctgttgtctagtatcattgacttaaaaaaaagaaaaaaaatccctgttttatttgttttggtcagctcaagttcaggactgttagataacttaaaatctgctttgcacagatgtatttttaaggaacaaacatctacagtaacagttacagatttccttaagtgggatatttgagttcatagatggtagacttttatagcctgggcttctaaggagggcagcagactagtgcagtcaggacaggacatgggctgtttggggtataataatagtgagtatagtgagattccacatgatggaatctcaacaaagagtaggaaggcgtttaggccttcagttgtccttgaattgagtatgttctctcttttgtttaatgtagataaaaatctaacacaagatactaaaacatacaaggtagaatttatactttttttattcacagaaaatcatgtaacttcctttgcgggtaactcattctttcacagcatacatgaacaccgtagttattccctagtttccagtttataaagatgttttgagaggaacatgttcaaaatatttaactagtattttgcacatgggacaagaagatcttaaatacatgtttcaagagtttttcccccactagttagtatttggaaacatgggaatgtttgtattaaatattactttaaataagtagttttcgcaccagacaattgctgtaccataaatatcttaaaacttaacattgtttttttaaatttctaaaattgaattatagaattcaagaaactgtgtgacaaatgaaaatgcctttttacaaaataaatatctgaatatgtgatatattattgatcattagtttgtaacacttttaagaatattctttgaacttacattattagaaacagcttagaaggaactgggcgccgtggctcacacctgtaatcccagtgctttgggaggctgaggcagatggatcactagaggttaggagatcgagaccagcctggccaacatggtgaaaccccatctctactaggagtacaaaaatgagctggcgtggtggcgagcgcctgtaatcccagctactcgggatgctaaggcaagaaaatcacttgaacctgggaggcggaggttgcagtgagccaagattgcgccattgcactccagcctgggtaacaaagtgagaccatctcaaaaaaaaaaacccgaaaaaacagaaacagattagaagcaaatggaagaatgaataggagaacagagggtaggatgggtaggactgatcaaattacattggcgtggcttcttgtttttcatacatgttttatgcactgttctcacttttttaaatatttgcaattaaaggtaggagcattgcttttcgtggtgaaagaggcaatgatgaatctgccatcgaaatgattaaagtatctcatttgaagtaagtgtcaacctaaaaaaaaatctatggtgttatcacaatgaaatctcgtggatttttttaatctttaagaaaatgggaatgtgctggaatgcatatggaatctttttagtgatagcaaatggtgatatgcagcccaaagaaaatattttgattacaaaattaagttgctatcacttttaattctctacttctaaaaagatgaagtaacttttgcatgaatcgttatttactttcggataaagttcttatgtacttctatctaagcatggagttactgagtgaaagaactcattttctttatgtataatttaaactcattttgcttccagaaattgagtttttttgtttcaggggaaaataacatgtaaagcagtattattaaaaatagaaactgaatgaaaatcaatcaaaattacaaagaaagagtaagctttctaaagtagttttcaaacttgttttggcttttctaagatctttgcatttccatataaattttagaatcagactatcagttttatcaaaaaatcttcctgagattttgattgggattgcattgaacccatcaatcagtgaggggaagaattggtatcttaacaagttttgtaactcatgaacatggtatgtctctccacttatttaggtcttttaaaatttcagcaatattttgtagttttcagtgtgtaagtcttacatattatttgtttattttgtgttttctttgatgcttttataaatgacatttttaaatttcaattatttattatttgtatattaaaatacagttaattttctgatattgaccttgtgccttgtgaccatgctaagcttagttattacttctagtataggtgcttttgttaattctttaggattttctatagagacagtctcgtttgctagtaaagacatctttacatcttttcgatctataggccttctttttgcttgcactaattaggacctcctgtatagtgttgattagaactgagatgtcagctacgagctgacatctttgctctgatcctggaccttatggagaaagcattcagtctttcaacattaagtatgatactagctgtagattttttgtatatttcctttatcaagttgaaaaagttttattcctagtttgctgagcctttgtattatgagtaggtgttgaatttatcaaatgctttttctgtattcattgatatcatcatatggtgtgtgtgtgttattttgtttttctttttgaagttcactaatatggtgaattacattgattgattttcagatgttaagccaacatgacattcccggaataaactctagttggtcgtgatgtattactgttttgacatattgctggatttgatttattgatatattattaagagttttatgatatattattaagagtttttatatctatgttcatgaaggatattggtgtcgtttttatgtaatatcctttgttttggtatcagggtaatactgaccttgcagaacgtgttgtaaagtattctctctcctttttttttgaatgagtttgtgtagaattgatattattcttactaaatgggaaaaatttattaggaaacccatctgaacctaaaattttctttgtggcaaagtttttaaatacaaattcagttttgtttttttttttcataaatataggactatttagattctctttttttgagctttggtaattggtgtcttccaagtaatctgtccattttgttgaagttgctgagtttattaatttattgaaataagcttgttcatcatggatctatgatcagtgattatctttcccactcctaatatcagtaaattatatcaaccaattttatttattgatcttttccaagaaactacttttgattcatttgattcttctctatgatttttccattttcaatttcattgtctgtcatgcttatcttttgttcttctgcttactttttaaatatgctctcctttttttacatagttttctaaaatagaaacttagataattgaattaagttgattctctaaaatgtaatgtaaacagttaatgctatatgagcaccagttttcctgtatcctacaatttttgttatggttatatgttttcattttaattcacattataatctttaaaaatttccatggggtgttattcagaggtatattttttaacttcaaactatttgggtgttttgccaggtatctttctgtaaatttctactttctgttggggtcacacatggtcctgagtggaagaatctcagtcctttgatacagggagtacagggatcttcctactctgtcacatttcctctatgtcagccatcatttgctgataatattttagttcctcataatgcttattgagtaatcagtgctcaaattatatttgttgaattgcactcgttgatgtcattcagtacttctttcaggcttaacagaaagtgaataaagtggcatttgttgaataccaactgtagtagaatgatagaaactttacatactttttcattgaatgtttaccataatctgtatatcaattaattgaggtacatgatgagattctcctgtcatgtgtgagaagttgagcctcaggagggttaacataagttgtggcatcagggtttgaatctatgccactctttcttccaagttggactccttgcctaattgtgtgagactgtatgttctcttacaggtcacttagagctttaccttcttatgactgttaatcatggtgctaaatggtagtttaaattgtctatatttagaatgcgtcagctgagtttttcaatttactgaactttttatttgctctaattcatggtgaaatttttgcaaaaaggggcttatttagtaattttgtttattttaggcagtatttggcagtcgtattcagagataaacccctggagctatgggatgttaggacttgtacccttcttagagagatgtccaaaaacttccctacaataactgctttggtaagttacaatttaagaatttaatagcttatttaggtatatatgtatgtggtgaatgttttgcttaagcttgaatcaaaatcattactgccaatgtcatttttttggttaaaaatgtgtgttcagagaagatgatctaaataaatggagataattcttattttcttggataaatcaacctaatatcatattagtgcaattccaattcaagtttcatttggatattttgaggaatatggtaaacatattcaaaaatgtttatgaaagaataaaggtcctaaatagctaagtcatccttgaataaagaggagtaaatgtgggaggtgtgggtggggttggcccttcctacctgatattagtacatcttacaaaaccatggaaataaaatcagtattgtattggcacaagaatagaaagtgagtcaacctaataaagagctcaggaacagacccatgaatatttggggacttaatatacagtaaagtagcacaaatcaaagaggatggacagactgtgtagtagacggtgttgggaaaactgtctcactttatggagaaaaatacttgatctctacttaataccgtatagagaagtgagtgtcacaggactaaagacctaaatgtaaaaatgtaaagctataaaattgaatataacaaaatacaaaatattgctgtgacctagaggcaggaggagacatcagaagctcaaaccaaaaggcaaaaaaaaaaaagaaacaatgcatttaattaatcaagattaatgctttttgtttgatgaagatgtcaaagttaaatacagaagacattttgggaaaacaaattttccagtgtctaaatttaactagaaactcctgcaagtcaacagtgaaaaaaagcgggaaccctagtgagaaaatgaacaaagtctgtgaagagctaatgagaggcagagaaacctaaaaggccaacaagccatataaaggaatgttcaaactcatcagttttcagagatgttcaaaccatgatatggatctaccgtttagactaacaaaaactggacagccatatagtgttaagtacgggtggaacatagggtatgggaatccttgtgcattgctggtaggaatgtagaccaatgcagccattctgtaaagcacgctggcagcacttgggcaaacacagacatcttctgtgtccgctgagctcttggtcgtaaatgaacttttgcaaggatattgactggtgtgttttgtcatgatgtgagtttggagaccatctgtgtgtttttactgagagaggagacagattaacaattggctgatgcacccatggagtattacgtagcatgcagaaacaggaggaagaggacttaaatacagtggaaagagtaagaaacaggatgaagtatatatatatatatacacacacacacacacacacacacatataaacacaatactatttaggtaaattagataataactacatgttaagaacttatacatatgcgaggatattggactaaaaggctttacaataggtggaatataaaagaatatataaataaaacaagtgattttggaggaatctatggatgataaaggaccctggttcgagaactgtgattgtcttatcgtgtgcacataagagatgggggaggagacgaggaataggcaatactatcattgaattcattattttcattttgtaagtattttataaaaacatcaaaaggtcagaccttttggaagtttgccataaaagctccaattaaaatgcattcatttagcctttctctaagtaggtaaaatctaaagaacaaatgtggattcatgtgtagtaataataaatgatactgggcagtggtgtgtgtgcccagctcttctggacgattctttgacagaaggaaacctagcacttctaggtttgtctgcatttgctttacaggagtggtcaccatctcacaacttgaagagcctgagaaagaagcaacttgcaactcgagaggccatggcccgccagaccgtagtctcagacacagagctgagtattgttgaatcatctgtgatcaggtacagtacagtgtttcttgacactgtcatttgtgccattagcatcatgtctgggaagttgacaagtatcatcggaaggtgtctatggtagcaagttggactctgcttttgaacatacttagtttcatctttcagtacatacccagattactaaaaagataattttatcatttttagtattgtactatactgtttgttataactaataacatatgcagtaatattcacccatcagcatctagtagtaaatgtgctcattccgagtgcccttctactccatacacttcagcttctgaaattcaaatgaacatagcatagacatacagatagatcatattatcatttatacacaccaaagaaaatgtgttgggaatcctaaatttgtgtatcatccccatccataccaatcttacagataaaaggcttcagagataatgttgggtcactgtacagcctcccttctgttgagcacagttctatagccaaaatctctatgaattttatttttcttgtgttaagtttagatcaccatttctctctgtgcagggtaaacttcctctgatgttgtggctgttaaggagtgattcatgtttacccataattagctgggcaaatattagtttcagacttttaaaaaaatagttttggacctcctcttaatgcgtctgtactttgggcaagttaattaattatgagtatcactctaggggaaaaaaaaacatctttatcatatgtttcactatcccaaagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatgtgagtacaaccttgattaaatcttcatcaagaagattttgttttgttggttccatatccagtgaaggcatagttaagttggaaacttcagaaaagcctaatgtaaataaactttatttaaggagatattatcgattaaacttgttccatactgctagagaataacgctgtaactattttgattaaatgtttactgtgtgctactcatttttatccctgtaataatccatgaggagttatctccattttacccataacaaaactgtgggagaataagtaactttcccaaagttatccagcttactcatatggcagagcagtgttttaaactcaggcctgtctgacttcagtatctgtcttctttccatttcaggcattaccctgaaggatttgacttacaatctagtattatttttggataatagtaatcaggttgtaagtgtaatagtattattaacatttactaacttacatatattcttatggccttgtggaatctgtaactaaagttttgccattaatcatttgtgtcagcatgcatctcatagatagtttttaatagatggatcatgaaaatgtttatgttaattaatgcaggctattataatggttaaatgaaggcatgaggggattttttaaaataggtatatttattttaaattgctatctaaaaatggaatgctctagtagaatgccaacccccataattttataggtggctttggggtctcataaagttacaatctagatgttggctgtggctacagtcttttgaagtgtaatgggacagaaggatctatttccaagttggctgcctcacaggctattgcacattaatgctggctgttgacgagggaccttagttcttcatgtcgatctttccataaggctgcttgagtgtcctcacgacatgacaactggcctcccctagagtaagtgatctgataaagcaagaaggaagttgcagagtctattatgacctggtttcagaagtctcttcaaaggcaacttcttaattaaacattctattttatggctaggaaagtagatatcttaaaatgttgcttcatattatatacagaatttcatttctttaatatttttttttattaatggactttattataatattgatttttaaatccagtttttgttttgtttcttgactattaccagagtttttacggtattcagtgtgtgtgctagtccactaatggtcaattattcaaaccactagagttttcttactttttaccatggataccatttgaatttttatgttgtacaataaatgcaaaaataaaatttcttttaataaatagagaagtaattgagcagtaatattatttaatagctaacatgtattgactatttactgcatggcaggcattgctttaaggcctttgcctttataaatttattaatactagcaacaactcaagtttcatgaacttaccctactttatggacaataaatccaagacagaaaggttaagtaaacatgcctcaaatcacataccagtttcaagctgggattcaagcccaggcagtgtgactgcagagcccaggctgctgagccctccatgataccacctctgagcatctattagaactgcaagttcctttcttcctccaagttagattgactacagcagcatttcattcttatgttgtgcttctatatgtaacttctgagcaaagctttctgtgaatttaaactgcatatgcctttagtaaacagcatctcttcaccttcatgattccacaatgttccaaaacgtgtcagtgaagctctggatccttttttcaatagaaaaatcacggcacaattagttataaaagagctttaagtttcccttggaatggatttagttatccttttgcagtgagagataagtttgagttggctctctggaaaaccttccctttacttctctgtttttcttactttaatttcccccttttttttttgaggtatttgttcctcaaaagacatcccctctctttaaatctagttccagtaactacttaatgtctatgaagttgaaatctcctatttcttcatagttgaaattgataggcaatgtagctctttgttagtgtctaaagtctgttttaggatttgatgactaaaagcatactaaagcacagccctttaaattaagttttattaaaatatttattataatgtcttatacagcatagtgaaatttatatttgtttgttgctgttgttttctagggaagtatgggtagtattacctgcatcgcttggaaaggtgatacattagtgcttggagatatggatggaaatttaaatttctgggacttgaaaggcagagtatccaggtataagccaagaatgaaatcttgttatttcattaaaaaaaagaaatgaaatctttttgttttgttttgttgagatggtgtcttgctctgtcgcccaggctggagtgcagtggtgcaatctcggctcactgcaagctctgactcccgggttcatgccattctcctgcctcagccacccgagtagctgggactacaggcacccaccaccacgcccggctaatttttttgtatttttttagtagagacgggatttcaccatgttagccaggatggtctcgatctcctgacctcgtgatccgcccacctcggcctcccaaagtgctgggattacaggcaggagccagcacacccggccaaaaaatgacatcttgatatggttccattagaggcttgtgacttggcaagaaggatcagtaaactcgtggaggtgtagcttggacccttgggtcccttcacctaaacttgggaggatgggccttgagccaagcattcttaggagatagttatctgcaagtggcccctgcagaagtcttagctgaccttaaagggcaggccctttctgtcagatgtggcccccagtcccagcaagtaaagggttctcccatcatcagacctgttagaaatggaaatagtgagagatgttagacatagcttctggtgaccagatctcactctacattgtattgatgtttttgtttctttgtcttcagaggaatacccacacaccgaagttgggtgaggaagattcgttttgctcctggtaaaggaaatcaaaaattaatagcaatgtacaatgatggagctgaagtgtgggatactaaagaggtaggccctctccatgaggataaaacgtaaataaattgttagccataggaactgtgctttgttaaaaaacttctttctgatttagaaatgaaaagtacttaatgagttcgtcaagtttcccataacaaattattttctttactttacagtatttgtgttctaaaggtaacaactcaagatttatttatttatttatttatttatttttattttttattttgatatggagtttcactcttgtcgcccaggctggagtgcaatggcgcgatctcgacttattgcagcctccacctcctgggttcaagtgactctcctgcctcagcctccctagtagctgggattataggcatgtgccaccacgcccggctaatgttttgtatttttagtagagacagggtttcgccatgttgggcaggctggtctcaaactcctgacctgaggtgatctgcccgcctcagcctcctaaagtcctgggattataggcgtcagccaccgcgcccagccgatttatttattttttaatattatcactgtctctgagacctttaaaatgctgcctatttgtggaagatagattgccagaggctgttcagttctaaacttgaactgggcctttgccacagactgtcttccttgaccatttaatctagaataataaagatcttccttttctgtctggaagtgatgcccaaattcactcttgaaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccggtatggaatcctaatgatagggggctttgaaacctgtctttactttgccacaagctcttgtattttggggagagagctgctgcttctgtttcatttcagtcttattttcttagaatctgagtttaagaaaatatattaacttgaagcttgagtgtttttactgctgagatgctgcaatctttgtaactatagatgtcaatcattctcaattcaggttttttaagtgccccttttgactcttttctttggtttgttaacaagataaaagatgtttatgtttataaaaatggcttactcagaatttaggcaaactcatcagaggacataaatctagtgataaggctgctggctttttaataatggccttatgtcttttgcaaccatatatcattgaaaagtcactttagaaagtgttctgagtattatgaattttgatgccaatctgtgactagtaaaatgaccagtcaagcaaattagcagattgcagtatcttgctctgttttgtatggttgttttgacattgctttttaccagaataaaaagcattttagtagaatatactccatatatgacttctaaaaaaaaaaagaatgggacaattgtgaatgcatccatttatcagtttaaaaggcagcttttggctgatgcaatacagtgttcatccttggaagatacttgatcctacttggagtggaggagggaacttcttgcctgagtattctcccagcaaaactttggtgcacactctaggctgatatgtagaaaatttcatgagacttttctgaacctttgtagagtcaatatttggcacttcagacacagtaaggttttaaaaacctggtttttcactttgtgttcatgcttgaggcactactgagttgctgctaatgttagcagggctgcctttaacttagttaggtatgctttggtttttgtcactgcccacccctgcccactgcatttgggcaccaccacttcttactatgtaactgactgccatcaggtgaagccagaattcaagacctacattcccatgtctgtccttgtgtcgtttgccagctctggggaagcaccaggatggcctcctaggaaagggcaagcattggtattcattttaaacctaaaggtattgaggacattgaaggaacttcaagggtggtttttgaaaaaattggttactaattctagataaagaagtgtggaactgctatctaaatgtttgaagagcttttccttcacttttaatataaaatttgaatctaaaaagctccaaagtcaaggtgtagcttgttcttaaattaaactgactacagaaatggagtccattgtattaacccatgttcaataccatacttgaacatctggcctgtggccagattttagatcacatgtttcttttaaaatttttctgatttttttttatattcttttcaatctctaatgttacagcctcagccagaaagagaaaactaaatagcaattgggaaaggtcatgcaattgtgtattcattccacaaattgaacttcaaattcagaacaacccttaataaatgttaaagaatgaaaactatggtagtgtaaatgtggagtgaggaaaaagacatctgtgtgttcacctccagattcatggccgatttggtcttgaggaaaaaaagtttgaggtagtatatttctattctgaggaattagaagtatatttggggcttactgacatgggataaaaataaaataggtcctaacattggtgtttcctatgttttcttcaattctccttgaaaacaagtagagaacgtaaaatattgattcacatctgtacattttcttagagcagcttagataggccacttcttcctccaataaagagggggcagtcagacaaattagaagattagaattcctgtttttgagttggagaacctttcttatcggctgcctaatatgtcagggacacaaagagccatcaaaataaatcttaatagtctttttagcagcatctaaaaggaatgcaagaatatgagactgtttaatagcattctggtatcatgcagtttccacaccctttaaatagtattgacttgatatcagggactgttcaacctaatttcctccccagtgttttttttttttaattttattattattatactttaagttttagggtacatgtgcacaacgtgcaggtttgttacatatgtatacatgtgccatgttggtgtgctgcacccattaactcatcatttagcattaggtatatctcctaatgctatccctcccccctccctccaccccacaacagtcccaggtgtgtgatgttccccttcctgtgtccatgtgttctcattgttcaattcccatctgtgagtgagaacatgcggtgtttggttttttgtccttttgatagtttgctgagaatgatgatttccagcttcatccatgtccctacaaatgacatgaactcatcattctttatggctgcatagtattccatggtgtatatgtgccacattttcttaatccagtctatgattgttggacatttaggttggttccaagtctttgctattgtgaatagtgccgtaataaacatacatgtgcatgtgtctttatagtagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgagttgcatttctctgatggccagtgatgatgagcattttttcatgtgttttttggctgcataaatgtcttcttttgagaagtgtctgttcatatccttcgcccactttttgatggggttgtttgtttttttcttgtaaatttgtttgagttcattgtagattctggatattagcccttcgtcagatgagtaggttgcaaaatttttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaatgaatttttgtataaggtgtaaggaagggatccagtttcagctttctacatatggctagccagttttcccctccccagtgttaaaggccactgctaagcacatttttcctaagtaagcatatatagaaagaagctttctgaaatcagatttctgcacaaacctttcctcttcatctgccacagctttccacagtcattttcggtaatcttggggcattcagaaatgtctcacaatgacttgccgatgtggggaggtctggggatgctaaacaacctggaacgatctggcgcaatgaagaattgtcctgccccaaacgccagtagtgttccttagctctctttttcaccgttcattgaatcacactgaacaaaatcacaaaatatggtcctttccttcccagacttccagctcaccttaatgttgccatttccaagtggtggaggaataacttttttctactgattttcttcttggctctttgcttactgattttctgcattcctgtcatgtaggtagctaaaaacctgggtgttatgattcatacctcacataactttagcccagatggagcagaatccgtgacaaacagcaatgatgctaactgcttttgcattctaattgtgtaattttcagaggtgaatgagctcttgcatgtgagtttctccagatgtgagatgatctcctattactttttcatggctgatctttacctttcagaagaaagatttcaattcatttgagggagggaagtagttaagggtcactttcagtttgttcatgctcattgggatgctgtcaacaatattttgcttttggagaaataacatatttgttttaaaaaataaggtatttccctccttttattcagacttggtaaatgttgtcttgcttgcatgatgtaaacactcgatgctgccttctacgtggattctcttgtatcttttcgtttgttcattgattaagaaattaccacacagcatgagaactttccctgaaccattccaagattattatgtatagttaatttttttccctgacatttaccatttccaaacatactgtgatataataccaacaactatctacatgaatctacctaaaacatatacatatgctatctaaaatatgaatggggctgacttgagaattatatagattgtcgtctatgaaggatgaatagaaagaaagttaagtaagctagccacctgcatccctttcagtgttaagtgttcagtgcttctgtaggtagttagataagcctcatttttccaagatgcaatccttcctttatagcccagatgtaaaagaaaagatgactaagtggaaattaaaaaaaaaaattcaaagcaaaagaaaatctttaataagaataaacgaaagtgttcaataagcaaagccaaatacaaatgattacctggaggaaagtaattcacaagtcacagactgtctacagaggggcaaaacagataaacaaatgatgcttcaacatatgaaatgatactcaactttatttataataagaaaaatatttgacctcctactggtaaggataaaagaagaaaataattttaaaaagtaaatttttaaaaagagaaaaatacaaattaaaattgtttcttacctatcagattcaaaagcttgaaaatatactctgttggcaaggctatgaggaaacaagcactctcatccattgctaacagtaagatccctataggaaggaatttggcaatatctaacagagctacatgcacatttacctttttacccagcaatcccagcgctaagaatttatcttaagatgtacattcataccctgtgaccaaaatgcacacaaagttattcatagcaaaattttgaaaaaagccgaactgcttagccgtaggagattggttgaataaatctggggacatctgcagaatggagtaatctatgcagctgtaaaatagtgaggaatagctctgtgacctgatgtagagtgatatccaggatatgtgtaagtgaaaaatgcaagtgtaaaagagcacgtatagcctgcttgtgtacaaaggcggattttatacataggttcatgcacacgtttgcttactaaaacacacaccacacatacacagaataatccagaaaccaatgagaatagttagaagatgtagatggaaaaatggagagtatggggatagcagtgaaacttctctatctttgttatacagtttcaagttttgaaccatttatatattttatatattaaaaatacacagtgaaaacaagagtgaagaaaaagcaaaccctaaaattgaatgcaagacacagttgaaccaaactgtgtaacaacaatattggtaacataaccacacacacacacaaaaacagttcaaataactaaaacacagaacttcccattcactgcacacctttagtggtttatattctaaggacagaattgctaaggaatgttgaactttaccggggtagttgatggtgacactagtaattctgaagctgttttgtgcatgttgtagtctggaacacattagtaaccaaattgcagttttggggagccaagatctgtgctgatagaaagggagatatggatgggaaatggcggtggtgggaagaaacattccaggggtggatttgggttggtaaaaaatcatgacttcttgaacatgtatgttccctggctctgctcacagagagttttcttgcaatgacactcaatggcagtgagcgcacatagcacccagattttactttgcaagttccatttccaggctaaaaggagccagagctctttggacaaaaagtttatttcaggacagaggcacaaaaggtgcaagatgggtctggggcatcttgtggtgccagaattcaagtaaggaattgaaaaaccaaggaggacctgacataagaggcttctcctgtcaaactgggggtagtctgagcatcacgaaaactaatggtggtattgatgtaagtgcagaataccaaagaaaccctcactccatagtaatagtcacagtaaggaaacgggaagtgggcaagaagcaaaagctcaggtggacagaagaatgccagctgacaaatgcggaaagaataagattagaaaatcaccactttgcagccccgatacaataattaattgtatacacaagcaaggatcacttgtggatgtcaaatcactgagtaaaaggatgtttgagaataggaaattcaatctgacaatatttcctccacatattacttactaattaattatacagtggagaaggtgccctgataagagctctggtgaataccccttatctagatgatcagatttagtgtttcctgtaaccagacagctaacatgttccttctgatgcaatgcagtgaaaagtacacagcatcctttgttcagactctgtcaaaaatgtttaacccgaatctgataatcagaaaacagacaagttagaacgtagggcattctccacagcagctgaccaggactcttcaaaaatgaaaaggtcacataaggccaaaaccaaaaaggaagaggaccattctagattggaatagactaaagagacatgacaatgcagtgtaccagccttgactggacccgatttttaaaaataatacagctgccaggacatttggggaataacaagggacttttgaatttggactgcattttaagtgattttactgaatcaatattaaaattcttgggtgtaaaaaaaaagtattattaaaaatatttccaatcactttctggcttttaaattgaaaaatccacataaaatattttgtgtataatttaatttttatttaactacatagaataaagttttctaaagcagagttttccaatagaaacataatgtgagccacataggtaagcttaaattctagtatccacattttaaaaagtaaaaagagatgaaattgattttaattaaaattttatttaagccaatatatccaaagttttatttcaacatataatcagtattaaaagttactagtgagacattttacttttttaaaattattcattcttcaaaattctgtcagtattttacatttattgtaaaatgaattgccctcaaaatttataggacaaattttcagcacaaacagttaagctctatttagattttataaaattttcagttgaaaaagtaggcatgtattcaagttgtttcaaacatatttaaaagttatccaatgactgaatcaataatcactttttaagtttaaattagacaaacattcatttccttcattatactagccatatgttaagtgactatcatattggatatcatactggataattgcacagtccagagttgatgtggatcactgatacgatttggctctgtgtctccacccaaatctcatgtcaaattgtaatctccacaggtcaggggaggcagctggtagggggtgattggatcatgggggcagatttcccccttactgttctcacgatagtaagtgagttcttaggagatctgatggcttaaaagtgtggcacttgccccctcgctggctctctcctgctgccatgtaagatgtgccttgcttccccttcaccttctgccatgattgtaagtttgcctccccagccatacggaactgttgagtcaattaaacctcttctctttataaattaccctgtctcaggtagttctttacagcagcatgaaaacagacaaatacagtcacttaaataagccaacaccatgtataagtttgtgtcattttacataattgtgtctattcaagggatccatggataaagcctcttcaggattctggaggggagttggtagtaaggccaagttgtaaaagccagggcacccctagaaatttggagctaaggtcgagtccgatagagtgtagggtggtcagagcagagctgctgggcattgcagcctttaggtcttctgcttctttgcactgaaacatgttgacaactaggcaaatcttgcttgttagtgttctaagtaagccagctgctggatgtgggggatgctagggcctagagtctaagaagatagcccctgtgttcaacagctacctttataagtgagacctgggaatgctagtgatcacaggtggcatgatcccttcagtgacatactcaaggttgataggccatgttagttgaatagtctcggaaaaacaaaagtacatacaggtaaatatatttatttttaatatttaaaaataatgaactttgttgctatttgttgaatcattgcattgaatcctttattcaagtagtaccagagttgtataccacacaggatacttaaattttaaaggggaaaagaaggccgggtgtggtagctcatgcctataatcccaggactttgggaggccaaggtgggcagatcacctgaggtcaggagtttgagaccagtctggccaacatggtgaaaccccatctctactaaaaatgcaaaaattagccaggcatggtggcaggtgcttgtaatcccagttacttcggaggctgaggcaggagaatcgcttgaacccgggaggcggaggttgctgtgagccgagatcgcaccaccgcactccagcctaggtgacagagcgaggctttgtctcaaaaaaaaaataaaataaaaaatcaaaaaagggggaaaagaaaaatatgttaatcagatttgaatgcagagactctctctgctcttggcttgtgtttcctaagcggtgactacattgaatatactctcagttgttccagatttacctgttgctctctgctgactgctctgtaaatggtttatagctgaagcttcactgtagtataaaacttcattttatttttaaaaacctttctttgttgtctagagcctgtgtggtgcccctatctccttgttccaagggcctctcttgccttgaaagccttcttattacaccagccttggaatggacagtattctttggacatttctcatgtgtaagtttttcacttttctttttctttcataatttacttggggttgaaagacacccatgaaagtcagccatggcctgtactccagcatttaaagggaatggagcctttaaagccgagagaaggcagagacactacagaattgccaggctgcctctgggttctcgggcctttgtggaagtgtgggtcagtgaggagctgtgagggcgtgtattgctctcaggtggctgtgtgcttgtcttatggtctgaacatggatgtgtcgtgatgatgaaaaggatgcgtgtgaagagggcaatggaaggcaggagaatttggagccgggcacgttctttttaaaagcagcatcattagcttcagggatatactgtgtcttaaaaatctcaatatttgcctcattgcaaaaaaatattcacagaaactattagtgtttattaattaaattcacaaatattactgaactcctgccatgtgcagcacggatggaggatttaaaaataatgccaggaagtgtctgttctccaagcactgtctcctcagaatattcattctgcagagctctaaatgagcagattcctttagtaacattgttaagttcttcattaaaaggaatctaaacctgatagattttaaagcctgcttataaatttcctggtttcttgaaagccaaggagactttctttactcattttcttgtttttgactcaataagataaaagcagatattaaagttgattggtggggtcctgagtagattgttgttattttggtctataaccaggtttctaaccaagaactacgaagaaggttatctctatattaacacaacttttttcaggtgaagaaatacgtggttttaagtgaagagataatgaactcattcaaaattttttctttacagtgactatccagaaaatgaagaaataaagaatctcctccaagaacagttgaattcattgtctaagtaagcactccatgtttcattagaagataggaatatgagaaagaaaaatgcaattcaactttaaatgcaattcaaaattaaaataagttacgttttagaaaatattagtggcccaagaagagaccattctgtttagaggtttgcttcccgttagagtctgtgttttgcagaaaaagtacttattcagtagttacagtgacagagcatctgtcttcaccaagttcatgagcaccagctgctctgatctcacatcaaggcaggactagatgcatagtgggagcatccttgtagctcagcttgcctctactacaaacctccatgaagcctcacagcgggagacgaatcgcagggtgattctgggtctgcttcccgcttctaaaatgagttctctgtgtcaggtgctggtgtgcacaggtctggctaagaaattaatgtgctccctagagccaagggcatttaacagaatgtactgggaataagaaaggaaaaaatatgggtctacaaggagttcttggggaaagcgtaacacatttttgcaatctagaatctgttacatataattatagtatttaacaaattaagcatgatattttattgacggaaaattcaaaataattagttttttctatgcaaagattaacatttatgtttaaatgggaaactatagatttaaagaatgtcttcctttctgatttgtgaatattcagtattttactattttagaaatacgaacttataaaagcacaagccattcttccttagatactttatttttggaatagtttcagaataaattacgaatgtcatcttctttaaagtatttactgttcttgatgattttttcaacaatggcattcttgttccagtagttaggcagctaatactttcaaaaactgttgtaagcctataaaccagaaatgagagcgctgcagctccctgtggtggctgaaagctgctgcttctccaagccttgagaacactctcagcccccttcaacttttataatttcagggtcatggtaaagtaccttgtcttgtgtaaattctaaacatgttatttgactggaatttttcatttcaagagtatattgatcaacccccatgctttattgtttgattgaaaacttttgtctcacttttgtccggatttcttccacagtgacataaagaaactgttgcttgatccagaattcactctcttgcagaggtgcctgcttgtttcaaggtaatattgtttgatgtattctgtataagagacaggatttcaagttaactcatttcttttaagggtttttagttagaaacacttagattttagaaaaatgtatcagttcatcctttagatttaacttaaaataattttgacagtagtaataacaaatagggaaaaatcaaattgcattttaaatgtgagatctaggccttctctctggaaagcacttcctcctacagctttttaaaatatgtgttttaaaatatcagatacaggtatatttaaatataccaataaattatatttagaagcgataacctctatatcctgacttacagtagagtttgtcacttataaaaaagactcctctccccacagaataaatagcacattactttcataccttatctagccagttatcccagaggaacttcttcctaatgtgaatcaatggcccacattgaaaggtgtgctaatggcaaaccaggtaaataattgttcttaacacagaacagaaagatgctggagtctgaaggggtcctgtgcagtcaggcccccgtattgttgaaggcccagtagcagggcaggagaacttgctgcctccccctttcaccctgtcaggccccatgccagtatcccagtggatatgtgacaacactcccttccagtccctcagtctactctaggaagccatccaggccaggtgtgctgagtgcagtcaaaactttgcttcatccttgccaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcaggtagtctgcttcacacagcaaaacctttagagctgtcatcttgattacttatatctttgtcaatatcttaaacttgggaaactttcaaactaagttactgttcagtaatagaaataagcccttgaaaattagctgggtgtggtggcacgtgcctgtagtcccagctactcaggaggctgagggaggagaatcacttgaacccaggaggcggaggttgcagtgagctgagatcacgccactgcattccagcctgggcaacagagcaagactctgtctccaaaaaaaaaaaaagaaagaaaagaaagaagccctcggtacatttgcattaaaaaaaaagcctgatcaagatttgaaaagctcatagacagttactgcgttgtttactaaacattaaaattttattattaaacaggcttgtttaatttgtcttacatttttaacttggcttcattttaattctgtcattaatttcctataaataacaaatactttatacacttggtttgaatttgctgttcacatgataatttctttaacctcctgcagaatccttcagtgcacataggtttttcatccggctctacttaagtgtcagtttctgtaggcaggcaggtatgcatccaagtgataatatctatcaacatttttgctgttcaaattcttattaaatgtttggggtgctgtaaagttgattatctagtaacctgaaaagtcaaagtagtttattaaaatgatcttattaagtacagtaaaatttaaataattccaaactcttataatccaggcttaatttttcttttttttccaattctagaaatttcagctagaaagggttaatctgcaggaagtgaaacggtcaacttatgatcatacaaggaaatgtacagaccagctactgctcttgggtcaagtatgtcagtttttataactctacatgcttcattaaattgctagttaattcgtatttcagagcaatatatctgtatgtatatatttcataatattttccccttgtatgtacctccttccctgtagacagtttaggctttctttcaaaataataccaataaacctcatgagaaaaaacatatggttaaccagcttgtaatttagacttccataatgcccagtggagcccagctatttgttttgttttgtttttgtgtctgaattgactggtacaaagctaaaataggcaattactcgagcacctagatacaccagcctctggctttatgtttgtctcaaaaaagtagtgtagcacctctgtttaatgtttgtatttgtaaacaaaatattcaattgcattttttgaaaatgagtgttttcctttagttttctaccttatgaattttaaaaagttatgttggaggaaaatgttctcataattagaaaaaccgtttctcttactagacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcaggtaaggcacacttgatatgtttgtcatctctctgaaaaatgagaccttgttcccagcaaagtatctgattagtagggacatttctttctcttttacatatgctgaagaaaaatagaaaaattattgctacctataaatcagatgaatataattgtctaaaccagaattaattgtttacacttttcagagtgaaagggggcactgttaataattgctgagataataggcataaatccaacaatcctaggcaaatcagaacaataaaacctgtgagagaactatgctctccctacttattctccagactgtattgtgcttcctaccctggttacttgagtaataacagtaaaactcttaatattatgtttcagaatttaaatcaagaatgtcttcagtaggtataaaatgggcacgactagataaggtcaaatggggatttaactttttaatgacttctcaaagaaggagctgcagtgtcacttaaggggatgcgcttttgtctttcagagggcgttcagttgctctgcctgatagataaggctgcagacgcctgccgctacctgcagacatacggcgagtggaatcgggctgcatggctggcaaaagtaggtggttccaagtttcaataggtgccctcaacattcgggatagaaagctcagtcctgaactttggacttatgacttagaaacattttttggcctgcaaagctgctttgcaaatactgtcttggaacctttatccttttcctattctttatgagtgtaaattgcattacttatttaaaaatggatcttgcattggtagcaattaagtaaaagcagctgcctcctctttctcccagagtctgagccgaaactacagtccagaggtatagccaggccctgggtcccgtaggcacagaccgttatcattattcagagtatgcagcagcttcagggcagtgtgctagtcaagcagagcatagcctgtatttcatagaaacagatctcactttaactgaattattattttttctttatagagtgcaggatgtttttgttgttaacacaggcgtctttctcaggtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacaggtaaaccgagagttcacatgggctgctcaggcctgcccgtgagcagtcacttcatgttctctcgcggttctagcaggtcatggtactcgatgtgtaaagtgaaaggagaagtatacatttcaggtttgtcaaaaaacccaaaggagaatggaactgtccgtattcattacatcttcattcggtctaggagctatgctagtttcctactaatatgctgatcagacttaacaggcacctagtaaaagggaatttaaaagtcttcagagaattggggtccattcagctttgactagagcaactgagaggaggcccagagagcagggggagaggcgacagaaggcatggtgaggtggagacatcccgtctgaaaatctggaagaggaacaaccatcactaattgtggagcatttcatttattcaaaactaagggaggtagattacggaaatatgacaaaagattacttgtcaactctggacaggggtacatgggcacttgtcatatctctgtagatttttgtgtatttaaactatttcacaattttttaaagtattaattttaaaaagcttgtgtttggagatgtgagtattcttccctccttttttcaacaaactagggcttagaaaagtgcttgtatcttaatgcagtatgcaggtttccagggaaaatgtgtaaatgtctttatacccttcgatgctgctgcccaccagtgatgtaaatcacaaagcataactcttgttttgttctgttgagcagcatgagatactttgatagagcagccttatttgtggaagcttgcctcaagtatggagcatttgaagtcactgaggacacagatatcctttgcaaggttgtttgtagtgacgaggaagaaagtgacatgcatgggttttggaatttcccttagttgtgctgcctggacaggaactatattatattgtgaaagatccatgttctgattttctgattcaccaaagccaggaaagagggagaaattagaggacaaagaatcagataagaaggtggctgcaccatgggtgtcagctttgactaggatggagggaggcaggaaggactatagaggacagggcccccaagtcttgtctgaacttaaaaagaagatgaaggaatgatttgggaaacaggtagaaggacctggtactttgaaatagtactttttcaagaccagacattccatggaataaattttatatatttatctagaaaaaatatactggaataactaaaaaagtctcacgatcacctctagtgacaatatgatatgggacaaaatacagcacttaaagagaggtgttgctcaggccagccactataatccacccatcagccagaacattttatttcttctaaatggcacttgagcaacattggtttctttgaaaagaatgaacttgagaatgcaactcccaggaccagaaaagaatgaaactgggccagtgcttgcatggtcctgctgctgctcactgcactttgcttcaaattcttacatttgctctcatttctacatggcaggtacttggttctctctctctttctccctctttctctgtgtgtgtttataatttttttttttttttaacagagaattaaaactaaactaaaaattttttttttcctttttttgaggtaaggtctcactcttctgcccagactggagtgagtggcacgatcatggctcactacagccttgacttcctgggctcaagcagtcctcccacctcatcctccccagtagctgggaccataggtccacaccattgtgcctggcttttttttttttttggtagtaacccgggtctcactatgttgcccaggctggtcttgaactcctagttcaagcagtcctctcaccttggcctcccaaagtgctgagattacaggcatgagccacccagccctgcactgaaagttttttaaaattaaactgaaggctgagcctactcaagatcatgtacctagtcactgggaaggtgactggttcagtgtatgcattttgaggatcaaagcatcagcacagagtacccaataggctgtttaaaaaaataaaaataaataaaaaaaaaccaataggacagggctttctaaaaacccaacaaccagatatagggaacattcagaaataaatatctgcccccaaactgccagcctctcagactttcaaatggaatgaggatatgcaggttaagtttctcctctcttatcattcatcttccaatcttcagttgagtgtaggttatgggaggatgttggttgggtcttctggaaggagaagctttggactcagctggtacgaaaggtaatgatggtacagactgagacatggcctactatggccgggaatcaccctctgcccgcgaaaagtctcctgtgttcatcctgtgctgcccgctgtggacaccaggtcccttccgagcagccagcagagcagacgcgactcacccttcctgcttctgggagcctgtgaagagtctcatcacagccctttttactcttcttttccttaactatggtttacagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattccatccaggcctttgtgttctctgcattgctgtgcatgaggccaggtcatgaggtggctccttaggagtcatctggtcgcccagcctctaaagcctggctgctcctgctgtatccagagaaacctgtatgtgggaatcccatgggtgcggtacagggcaggaatgacacccacaccccgggcaagtctacctctgagttcccgagtgggaatgtggcttagtgcacagcttttggagatgagggggtgagcacttccatcttttccctcctgagcctgctgggtgacacatcatacccactaagaggtacaatttttaaagagaagcatagcctctttctaccgttagaccaaccagtctgacaccctctgccaaggaactgagctccatggaaaggaaggcctgtcccaggaatatttgtccgtagctcggtgctttggcgagcagttctgtgtctggagttggttccttccggtgggttcttggtctcgctgacttcaagaatgaagccacagaccttcacggtgagtgttacagctcttaaaggtggcacggacccaaagagtgagcagcagcaagatttattgtgaagagcgaaagaacaaagcttccacagcatggaaggggacccaagcaggttgccactgctggctgggatggccagcttttattcccttatttgcccctgaccacatcctgctgattggtccattttacagagtgctgattggtgcgttcacaatcctttagctagacacagagcactgattggtgtgtttttttacggagtgctgattggtgcatttacaatcctttggctagacacagagcactgactggtgcatttttacggagtgctgattggtgcatttacaatcctttagctggacacagaatgctgattggtgcatttacaatcctttagctagacagaaacgttctccaagtccccactcaacccaggaagtccagctggcttcacctctcagttctagaagaaattcaggatccattattggtcccatacctggctcgtgtttcctgtcctttctttgcctagacacacagcagtagactttctaaaggccacatgcaaacgccactttctttacattgtttattatttgtccagatttctttattcaaccattctcttagctttggctgctataaccaaatacagagattgagtagcttaaacaacagacatttatctctcataattctagaggctggcggtccgagaccaagatgccagcagatttgttcctggtgaggaacttcctggcttgtagagcgccgccttctcgctacgtactcatgtggcctttcctctgtgtatgcacgtgaagcaagcaggctgtctgtcttccccttatataggccctaatcccatcatggggtcaacctcagcctaattacctccaaaaggctgaaccctcgagggaggagccaagatggcggaataggaacagctccggtctacagctcccagcctgagtgacgcagaagacgggtgatttctgcatttccatctgaggtaccaggttcatctcactagggagtgccagacagtcggcgcaggtcagtgggtgcgtgcaccgtgcgcgagccgaagcagggcgaggcattgcctcacctgggaagcgcaaggggtcagggagttccctttctgagtcaaagaaaggggtgacggacagcacctggaaaatcgggtcactcccacccgaatactgcgcttttccgacgggcttaaaaaatggcgcaccacgagattatatcccgcacctggctcggagggtcctaccccacggagtctccctgattgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaactaaaagacagcagtaacctctgcagacttaaatgtccctgtctgacagctttgaagagagcagtggttctcccagtacgcagctggagatctgagaacaggcagactgcctcctcaagtgggtccctgacccctgacccccgagcagcctaactgggaggcaccctccagcaggggcacactgacacctcacactgcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaatcagagcacctctcctcctccaaaggaacgcagctcctcaccagcaacggaacaaaggtggacggagaatgactttgacgagctgagagaagaaggcttcagacgatcaaattactctgagctacgggaggacactcaaaccaaaggcaaagaagttgaaaactttgaaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagtgagaaggaaagtttagagaaaaaagaataaaaagaaatgagcaaagcctccaagaaatatgggactatgtgaaaagaccaaatctacgtctgattggtgtacctgaaagtgatggggagagtggaaccaagttggaaaacactctgcaggatattatccaggagaatttccccaatctagcaagggaggccaacgttcagattcaggaaatacagagaacgccacaaagatactcctcgagaagagcaactccaagacacataattgtcagattcaccgaagttgaaatgaaggaaaaaatgttaagggcaggcagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcacaccaggcctgccctaaaagagctcctgaaggaagcgctaaacatggaaaggaacaactggtaccaaccgctgcaaaatcatgccaaaatgtaaagaccatcgggactaggaagaaactgcatcaactaacgagcaaaataaccagctaacatcataatgacagggtcaaattcacacataacactattaactttaaatgtaaatggactaaatgctccaattaaaagacacagactggcaaattggataaagagtcaagacccatcagtgtgctgtattcaggaatcccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagcattacataatggtaaagggatcaattcaacaagaagagctaactatcctaaatatatatgcacccaatacaggagcacccagattcataaagcaagtcctgagtgacctacaaagagacttagactcccacacattaataatgggagactttaacatcccactgtcaacattagacagatcaacgagacagaaagtcaacaaggatacccaggaattgaactcagctctgcaccaagtggacctaatagacatctacagaactctccaccccaaatcaacagaatatacatttttttcagcactacaccacacctattccaaaattgaccacatacttggaagtaaagctctcctcagcaaatgtaaaagaacagaaattataacaaactatctctcagaccacagtgcaatcaaactagaactcaggattaagaatctcactcaaaactgctcaactacatggaaactgaacaacctgctcctgaatgactactgggtacataacgaaatgaaggcagaaatgaagatgttctttgaaaccaacgagaataaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacacataaactctcccaagactaaaccaggaagaagttgaatctctgaatacaccaataacaggagctgaaattgtggcaataatcaatagcttaccaaccaaaaagagtccaggaccagatggattcacagccaaattctaccagaggtacaagaaggaactggtaccattccttctgaaactattccaatcaacagaaaaagagggaatcctccctaactcattttatgaggccagcatcattctgataccaaagtcgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacagacccacagctaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccaacttacaagggatgtgaaggacctcttcaagaactacaaaccgctgctcaaggaaataaaagaggatacaaacaaatggaagaacattccatgctcatgggtaggaagaatcaatattgtgaaaatggccatactgcccaaggtaatttacagattcaatgccatccccatcaagctaccaatgcctttcttcacagaattggaaaaaactactttaaagttcatatggaaccaaaaaagagcctgcatcgccaaggcaatcctaagccaaaagaacaaagctggaggcatcacactacctgacttcaaactatattacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaatacttaaatgttagacctaaaaccataaaaaccctagaagaaaacctaggcattaccattcaggacataggcatgggcaaggacttcatgtctaaaacaccaaaagcaatagcaacaaaagacaaaattgacaaatgggatctaattaaactaaagagcttctgcacagcaaaagaaactactatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccggttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacagtgatagactggattaagaaaatgtggcacatatacaccatgcaatactatgcagccataaaaaatgatgagttcatgccctttgtagggacatggatgaaattggaaaccatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtataataataaataaataaggaaaaaaaaaggctgaaccctcaaatactatcacactggacggtaaggcttcaacatgtgaattacgagacttgcgaagcagagagaaagaagaaactttataccagagtcgtgctttctgaaaaatgaaaatgctttggattaaggccaacaaataggtactaaggcattgcctgatggtgagagtgaagcagggccaggcacggcagctcggtataaacacagtgagcagacaaggcccagagcctgggtttgtgtcagtccagctggctagtgtagcagttaggactcccacggggacacagagaccaagcctggtcgagacaccactgaaaatccccttccaaacagaacaggtgatctctggtgatattcacagccacactgctgaaaactgccatactcacctccatcaagcattggaaatcaagagctgaacaagtatgaattgtttttcacatttagcctttctgaatatcttttcacgaaagatcattaagaatacgtgttgtcaacacactaatgaggtggcttcacgagctgaaacaagcagctgaaattgggaataagactgagaattacttcaggacagcagaccctggccccagtgccagcccccacagaagctgctgggcaaggcctgggcccttccctttgccacaaagcctgggtgggggtggaggagccactctggaggtggggcttcttcaggaagaaggccaggtggtgggtggtaggtgcttccccttgactggtctctgagccatttcctactgctcaccgttacctttttcctcctctgttgctaacgaaatgctctgccaaatgtggctggctgccccaccacggtcttgctctaggtttaatcattgctttggacgtagtagcaggacattttgttctttcaaaagagataacagagcagattcatacaagcctcatgtccctctcacacaggtacccgatcagaaagtctcaacatgtagacacaatgaaataagaaaacaatttctctctcatctatttgtttcctgaggcttcctcttgcctcaggatggtgttaggtttcagtgaatcctgagctctgtgactacccaggatattccattctcagcaacaggatgtgattgaagtaaagcattcaggcacaaacttgtaactgtgctgctgaaataaaagagggccacgcagggaaggcacccaagggagaatgttccaggcaacggggccgtttctctgggagcctgcatgagattattttgactgactcaaaatgacttgtgaatgaaagaacccttttaattaaaacgtaatggcagttttaatcaaggacatgttgctgccactttaaaagaaggaaggaggagctgcgcttttggaaggcacttctgaaaactgctggaatccaatgagatgtcaggtctaagaggaaatcagaagggcagacagccgccacctcgccttgcctttcctgcaagggtcctgcatgttttctttccttccatgcctgtttggtcagcacgcagcacacattcaaaataacccgggaaagccccgcttttctcccgctgagagatgatgagcgactgaggctctcacaggagtccctgtggacaatttcaggcctttctctttggtgtttggcatcatgcctaaaaatgccaaataaaaaccaccctcaccttatttttttcaagaacattgagaaatatgacttaagataaaatatgtcctaagtataagagaaagaaggacattttgggttccacaggtgacctggcatgatttttagctttcccgtcttccatatttaaagtgagcaaagccaaggacaattaaagatgctcaaattgccgggtgcagtggctcacgcctgtaatcctagcactttgggaggccgaggcaggcagcttaccagagctcaggagttcgagaccagcctcagcaacatggtgaaaccccatctctactaaaatacaaaaaaaaaaaaaaaaaaaaatagctgagtgtggtggtgtgcacctgtagtcccagctactcaggaggctgaggcaggagaattgcttgaacctggaaggcagaggttgaggtgagctgagatgggaccactgcactccagcctgggcgacagcgagactccatctctttaaaaaaaagaaaaaagaaagatgctcaaattagccgggtgtggtggcgggcacttgtattcccagctgcttgggaggctgaggcaagagaaccgcttgaacctgggaaaaggaggttgcagtgagctgaggcagaatctcttgaacctgggaaaaggaggttgcagtgagctgagattgcaccactgcactccagcctgggcaacaagagcaaaactccatctcaagaaaaaaaaaaaaagaggcaatagagacacaaaatcacttcaaaaaattaatgaatccaggagctggttttttgaaaggatcaacaaaattgatagactgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacacatacactttcccaagactaaaccaggaagaagttgaatctctgaatagaccaataacaggagctgaaattgtggcaataatcaatagtttaccaaccaaaaagagtccaggaccagatggattcacagccgaattctatcagaggtacaaggaggaactggtaccattccttctgaaactattccaatcaacagaaaaagagggaatcctccctaactcattttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacaagagccaaaacaaaaaccacatgattatctcaatagatgcagaaaaagcctttcacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcctatacaccaacaacagacaaacagagagccaaatcatgagtgaactcccattcacaattgcgtcaaagagaataaaatacctaggaatccaacttacaagggatgtgaaggacctcttcaaggagaactacaaaccgctgctcaaggaaataaaagaggatacaaacaaatggaagaacattccatgctcatgggtaggaagaatcaatatcttgaaaatggccatactgcccaaggtaatttacagattcaatgccatccccatcaagctaccaatgcctttcttcacagaattggaaaaaactactttaaagttcatatggaaccaaaaaagagcctgcatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagatatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctgctataaagacacatgcacacgtacgtttattgtggcattattcacaatagcaaagacttggaaccaacccaaatgtccaacaatgatagactggattaagaaaatgtggcacatatacaccatgcaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaagaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatctgcacatgtaccctaaaacttaaagtataattaaaaaaaaaaaagaggctctgatgggctgcttcagaaagacaggatttgaacaaatcgttgagaatttaagaacagataaaaagacaatcctcagtaatcactgccttaaaaatgtaaccagattttgggaggctgaggcgggcagatcacaaggtcaagagatcgagaccatcctggccaacatggtgaaaccctgtctctactgaaaatagaaaaacttcgctgggtgtggtggcatgtgcctacagtcccagctactcgggaggctgaggcaggaaaatcgcttgaacccaggaggcagaggttgcagtgagcctagatcgtaccactgcagtccagcctggctcatagcgagactctgtctcaaaaaccaaaaccaaaacaaaatgtaaccagaggggtcaattttcgctttgcagttagggtattttttgttttgttttgtttttgtttttgttttcagacggagctctcgctctgtagccaggctggagtgcggtggcgctatttggctcactgcaacctctgcctcccaggttcaagagattctcctgcctcagcctcccgagtagctgggactacaggggcatgccaccatgcccagctaatttttttgtattttcagtagagacagggtttcaccatgttggccaggatggtctcgatctcttgacctcgtgatctgcccgccttggcctcccaaagcgctgggattacaggcgtgagccaccacttgaagcaaggcagccgacgtgaaagcagagcgagaaaagctacacacgatgcggcctctgctgttcctgttcctgttcctggtcagtgatgttgcaggtttagggtcagcaaaccacagccggcagcccgaatccctgcctctttctagaaatatggtgttactgcaacaaaactgtgcccacctgttcattgtctgactgttttcaatgatagggttgaaaagctagaagggaatcaagtggcctgaaaagcctaaaatacttactctctgggcctttacagaaaaatagttcaataactccttctctagggtcgaaatgcttcctggtgatgaaatctcagctgtctaactgccgtattgtttacagactggtatgaggtcctttgtaatttttctgcagctaggtgcattagaacctacctccttagaaggttgttgttataagctccgtcccatctggcttcttcataggcccatgttgccatgggaatgggcccaggagactccaaggtttatccgccaggctgaccttagtcttattgagaggtgacatcgtgctggcagtcctcagagccctcgctcgctctcggcgcctcctctgcctgggctcccactttggcggcacttgaggagcccttcagcccaccgctgcactgtgggagcccctttcttggctggccaaggccggagccggctccctcagcttgcagggaggtgtggagggagaggcgcgagcgggaaccgaggctgcgcgcggcgcttgcgggccagctgaagttccgggtgggcgtgggcttggcgggccccgcacttggagcagccggccggccctgccggccccgggcaatgaggggcttagcacccgggccagcggctgcggagggtgtactgggtcccccagcagtgccagcccatcggcgctgagctcgatttctcgccaggccttagctgccttcccacggggcagggctcgggacctgcagccggccatgcctgagtctcccaccccctccatgggctcctatgcggccggagcctcccagatgagcgccgccccctgctccaaggcgcccagtcccatcgaccacccaagggctgaggagtgcgggcgcacggcacgggactggcaggcagctccacctgcagcccctttgcgggatccactgggtgaagccagctgcgctcctgagtctggtggggacgtggagaacctttatgtctagcccagggattgtaaatacaccagcaggcactctatctagctcaaggtttgtaaacacaccaatcagcaccctgtgtctagctcaggtttgtgaatgcaccaatcgacactctgtatctagctactctggtggggacttggacaacctttgtgtccacactctgtatctagttaatctagtggggtcgtgaagaacctttgtgtctagctcagggattgtaaacgcaccagtcggcgccaagtcaaaatagaccactcggctctaccaatcagcaaaatgtgggtggggccagataagagaataaaaagcaggctgcccgagccagcagtggcaacccgctggggtccccttccacactgtggaagctttgttcttttgctctttgcaataaatcttgttactgctcactctttgggtccactctgcttttatgagctgtaacacacaccgcgaaggtctgcagcttcactcctgagccagggagaccacgaacccaccagaaggaagaaactctgaacacatccaaacatcagaaggaacaaactgcagacgcgccaacttaagagctgtaacactcacggcgagggtccgcagcttcattcttcaagtcagtgagaccaagaacccaccaattccggacacattattgttgataaatctgaggtcaaaggcatcaacagatgattgaaaagtttaactccaagtgccgtttcattatcaaatatttttaagcaaatctccattttactccagatacttctgaacacgttctgctatgagatcttcactttattccaatcttttgcattctaccatcatttttaagccaaaatacttcaggcaggctagaagatgaaaaaatatttatgtcccaaataagtggcatgcactactgtcgtagaagagaatccatggggtgcagggacccacgtacctccctcttgggaagtgcatctcaggtcagggactcctacagggcccaatgactggggcttcaaataatcccacagagctgagccaggaagtagaacaataattagaagtgaaaaatggacaagtctgcaatataatccaatggagacaattcaaggaggaaattggcaaaccactatgtttgcacaggtacgttatggaaggaaaggagggaatcctaagaaacaagagatttcttaaggctgatttgtgcagacatgatgcagatcattttcttaagaactatctgcccaacaacacaattcagtcctccaggtttttacttcccagtgttcttcaaaaatgtgtatcaatgaggaatttatttgaagaacagctccttgtttgaagttgctgatctttgcctagaataggccaaggaaaatatacctcatcccgttaaggagttagaaagctgttccagcagatcatattgtagcaaacctgacataagttcatttaaatgctaaggatctgatctgagcttgtgtttctggaattgccaatgcacatttcagagggcctcagtaactgtcagccaagccttggttttgctttttgcctttggcaaacccactcaagaatggttctaaacacaaggaccagagatgtggaacagggtgaaagcagcggcgctgggaacacctgcttcccggcaatctggctgcctggccttggacaagttatcacctgagcctcacttgtaaaatggtgataatagggtctcccgataatagggtctccctccaggggtggctgagagtcagagaagggagctgcgagggcttctcaagatcaaggatctgtcagcttagctgctcctgggaaggaggctgagactcacattgtcagctttcactcactaaagagagtcttgcttgaggggcttggacaaacaggagctgggattagagtgggtgggactgggaaggagagagagaaaaaaggaaagaagcaaagattgactctccaaatctctaaaatcacccaccctacaagtgcagaaagcttgttctgagcagaaaggacttgatccggagccaggtagatcaccttctctcctggaggcagctctggaaaaaggctcttaggcttctggcagttcctcccctgagaatctcaccctctgcaggtctcctcctgcctgggaaacaaagtctctccagtccttttgctgccttatgcccctgatccctgcacccccggaccggacccccagccccatcccatccatgggaaccaccaagctccaagtacttattgagccaccaccttcttccagggactcaccacccctgtcgggggatgcagggttgcagtggagagcagccagctggggtcattgggaataccagagttggggcttggatggaaactgagtggggagggcagcagttctggggaggtgggaggagatgtaggtaagtgaagggggccagggagcagccctgcaggtagggggccggccagaggctggcagcaggagaggagacccctgcaggcagtatggacagtggggcagaagtgagcaggcgggagggcacatgccacttgagggcccggtgtgagctcagcgaggggatccagccagggtccctcctgcagaggaaccagcctcagtgtggtccgaagagccccaggagctcaagaaggtggcaaagccatggcaggcagagggaaactcagggaggggaaagaaaagatcggaactgaggggagtcctgcagcagctacagcagggaagtggttctgcagcaccgtttccagattgcagggctcgtttagaaccgtctcagcctgctggggtgggagactggagaggagctgcccacagcctccagggtgttgtcagagcttggtgcttgccctgctctgtcggcaatcagcacggttgctgtgatgacactgagctgccttggaaggagatgcacaggtaatggggacctttctcaggaatgccataaactgtgacataggcctctcctcgggactttacaaagccttagtgaaattctgaaatccaccaaatgcttaatgtgattcggtttgggggaaaagccagagaggggaactgaatgttgaatcaagattgaaacagcctcagcccacatgatgatgtgagcagccacacatttaggtccccaaaagggtcactgatagggtcacactggtctggcccaggaagggtctgtctgcatctgtgctgagagctggggcctctggagggctcagcggaaccaggtgagaccagccagcaccagcctgagtcctcagcccccgggcaccagaggccttcccacctgactctgccatgacaagtgccctgactgtctgcggtgttctagaaaggtgaccaacaggtgtaggctaattacatttcaaaaaagtttttttttttcccggcacatataacaggactagtcctctcccctcttctcatcagattccatttcctttagcaaacgcacacggtgttcgatttaagtgcaattctcagaaaacttaataactgcagtgtttaattagtctgacaacatttattgaagcgatgaatacagaaaaaagtactttcaaggaagaaaaatgatgtgtcattgttttgtgttttcttttctcaaatctgtaggcaggtatgaaaccgagcagcaatctctgtcttgaaaagctggtatttctgtttctagaacgtatgtgtgtttggggtggggtatagaatagagggatgaactgagtccttcacccactacctggtctgctcactctgcccacgcgtgtcccctcggcagccctgtgagtgcctgagctgtggctccccaggcagtgaagagctaggccctggagccagacccccagaggtgattcccagctctgccattgccatgcctcagtttccccatctgcaaaattggcttaatgacagtgcttccctcttgcagtcataaagctcttagaatacagcttggcagaaaaatgttgcctgtcactatttgtgctgtaaaagccctacctcttggccgaatggagctcagtaaaccaatgggagaaacaggtcccttctgagatctccctagatccctattcagcccctggtaggctcacaataagggctcagtgtttgtgggagtgagtatctgtgcagaaggaagatcagaatccagaggtgacagtttaaggttaacatattattttcccagcatttcaaaagaaaatgccgtgaaacactagtcccacaagatattcctgagaaaaaacaaatgggataggaaccaaatgagctgggaaaacagggcattcaatgtctcccctcagagattcccagtgcacgcttgcacttcaaaggctctgagaagtcctaccataaagacacctgcttaaatgtgtttcagccaatactagctaaactcatttgctgaggaatttccttctcccctctttgctttccctccctcccttcccttctccctccctctctccctcccttccgttcatgctgtgaatgccccatggaatccatgctggattaggagtgggcacagttgctcgagaagcacaggaacttgctgggtgtgctacagaaagcctttgttttctctctttttttttttttttttttttttttttttttttttttttgagacggagtctcactctgtcacccaggctggagtgcagtggcgcgatctccgctcactgcaagctccgcctcctgggttcactccattctcctgcctcagcctcccgagtagttgggactacaggtgcccgccaccacacccagctaattttttgtatttttagtagagacgggttttcatcgtgttaaccaggatggtctcgatctcctgacttcgtcatccgcccacctcggcctcccaaagtgctgggattacagtcgtgagccaccgcacccggcctagaaagcctttctaagcaggcaacagagcaacgatgccactctctcaataggatttctggaaggcccagcactgcagtaccagggaggatccaggggtctaagccttgtaggaggctagtacctcaaccatggagacagatggtttctttccagagcacagcctcagggctccctttcaactgatctgaccttggctgacgctaaaggatttaatgtcttttcccagagtgaaactaaatcttttctatatacgaagctgagagaccatcagacaatttttttccaagcctagaagtttcatggggaagaaaacaacaaaaacacgtaagccaaatcaaaccaaaccaaaacaaaagcaaccctgagaacagaaacacactaatgagatttctgagcctttaaaagcttctgaataattcgtgcaaccacaactttccttcttttttgtttcttaggattcccagggtaagaggactcagctttgccatggtcccttccaagtggcatcctgtctctgcttacacacctccaatgatgggctgctcactacctcccaggctgtcccttgtattactcttaacttccatcaccagaatgtgctttaggtaacagtaagatgactccagagatcccccacatcagactggttgtctagtgtaggcattgaaactctggattctgaattaggcctcctggattagaaccccagctccaccatttatgagctatgtacaagtaggcaacatgccacattcctctgtgcctcagtttactcacctgcaaaatgggggatcatacactgtacttatcccatagggttgctgagtgataacactcatatcagtgtgtggcgcatagtgctatgcaagggtttgatgctattcttttctaaattgtgatgacttgggacattcagcagcgcagtcttttctagattctccatcaagcacatacaggtctgcgcacccagcctggacatcagccctttggacttataccaggcagccatgtcccaaaggcacagccatggcaccaggaggaaaaggccagggaacgaccaggacactgggagctactctgcccatccactgtggtaagttcttgtgctgaaagctcaggtcctcaatccaaactatcctccctttagattatggcctcctggcctcattttctgattcactgaggttcattcactgagactttggacgtgaatggttgtgtagctcatcaccctcttctccttctgctggaacctatgtggctgccaataatgaaggggtgtctcttaacttcactcaccatctgctttcaagccttgggacctggtaaagaagcagtgtcccaggtggaactccccaggaccctgggaccaggaacctgttgcctcttgctggagatggccctgaggacatctggaggcactcctagtccccagagatgcttcatcccccagtccacagacccagtttcctggcagtgccctgcctgtctctctcctggggatgtacacaggtgccccactggaagcagctagagagtaggtgagggacagggggatggaaaggatattgggccaggtcaaaatacatcacagatggaaaacatccaagtgacccggatgggagagcacccatgagtgggtgtcctgctgggcatccccctaacctcagactctcagggagtgaagcttccattgagtcacccttgccaaaccatgcgccatatgatcctcagagcttcagggtagccacgatcaccccacttcacagaggagtgaactaggctcagagaggttgagaaaaccaggatgaccaaccattctggattgccccaaaaggaggagtttcctaggacaccagactttcaactaggacagtccttggcaaactgggacagttggttgtgctgcaattaagtgacaaatttgggatgcaagtcaaagccctgcctgacatcctggtctgagccacttccactctaaccagctttccagaggagggagaatttagaaggatctgatccccagtgatgctggaatcacaagtgctctcttcctgcaggagggggaagctgagttcggtcagcaaatgagacaggaaggcccagaaaccagcaggggccagaattaaaggattgtcttcttagccatgctctgttggaaagaatgcagttttcaaaacatttttaaacttttttgcgccgtggactttggacattccaagtaaatctatttgcaacactggaccaagttataccattttggtttggggtgctttcctttcatacaaaaactaccaaagaaagccattgctgcttcttctgtccttatttttctcttgaacgaatagcagatgctttaggggaaatgaaactgaacatgttggctgaaaaccaaaacatcagtctacagcatctgggctttagaaccaggattcttttcctgctaccttgggggtggctctgtttttaattacaaggccagcaaatgacagtgctcgctcctgacaatggcaccagggtcattcttcatgaggacagggtcacagtggccactactcattccaacgctggtctcagagattgtcatgctcagggccaccttccactgtttgatctactcaggaatcctggtgagatcagattcaataaataaactaaataaaccaccaatgaggtttaaataaagctgtaacactgcttgcaggcggaagcattgtgactgttaagataccataaacagtcaggatgttgcctgcacttgcagggggatgagaatttaagaaagctccagagaggttgctccgtttccttgcatttgcttcctggcccacccctactctcatctcctccttcccattttcctttcctaccctgaccaacttggatgttggccactcctagtgaggctggctgagagtcttgctgggtgtgaattagaccacgtgaaaccacttgaggtcattagaatgttaagtggagaagcaagtcccgactaacacagagtggcctgacctcactgtccagctgccagaatgagggcaaaggctcatctgaaagttcgtgaagacccagctcccatctgaacacacagggaggcacttgtgccttggagaaccaatgacatggaatatactcctgggaaaacctccctttgtggcctgggcctgtcaagcaaatggcacttttggccttcggtcatcagattgacccttatgttcattagagtcagtaggctttaagccatcagtggttgaggcagcttaactcgtatacatgagtgggattatgaatggaaatgctgtgtttgagaactgagcggctagtggcttttcataaagtcatcgcgatgcttggtgagcctcaggcccggcctctgatggaccttcccagggccatcctcccacaccctgagccacagacatgagcgtccacctgagctgacaatcaggactctggaacacctgactctcctgtagtggagtgaatagtatcccttccaaattcacctccatctggaacctcagaatgcgaccttacatgaaaatagggtcactgcagatgtaattagttaaagatcttgagatgaaatgcaatgactcctatcttcacaagaagagaagaggacacagagactcacacagagggaagaaggacatttgataatgtgggacagagattggagttgtgctgccataagccaagaaatcccaagttttgccagtcacctccagaggctaagaagaggcaaggagggtccccccactagaacctgcagagagagcctggtcctaccaaccctgatttcagacacctggtctccagaactgctagagaacagttttctattgttttaagctagcacatttgtggtcatttgttacggcagctctaggaagctaaccacctccaatgaacaaaaatgaggacccagaattcttctgggtcctcttcaagttgtagagataatccccctgcattttgcccaaaagactaagaattctaactctaccctcctgtccttctttctggctgagggtggctaggaggaggccttttgcttgtgtttgttttacttggagtccttgtcaggtaaggacccactttctaaaaagaaaaggatgtccttcagttgcacctttggacttagaaattccatttgcagccagatttacaccacaggctcagtaccttcggcctccatcaccatgttcagcagccctcccaggcttggtggcatttctttctgttgtctgctgctgatcagagggaactatgaacacccagcaagtcccaaactcatagcctggggaacgtccagcttgtcaaagacattggacccatgatggtggcttggggaaggttccagagtcagggaatctctttggctttagcgttctaactttctggagcccagaatcccttttgccaatacattccaatctgtgctccttggaactgtaatgccctgcaaaatattaataaacatttttaaagcatcatgatcaaatatgtctgggaactgccaacataaatataattaaatggctttcttactgcagaacttctcagagcctttaatatgccaaatacaagttgtacccctccaagtaaaggatgtggtatttggggattctcaagcctgttaatcataggttttcctctgtgttctgcctgcctctgcctgactgtgcttttatgaacttcagcaatgaagaaatccctcccttgcttctcttccatgctttaaggaagccactctacccttccagtttctcccataaatccatgtaactatgcagcttcctggtccagaacttttcactaggtctcgagcccccatggccagaattcacttttgaatggcataaaagatccgcccaaaatccagagccaggcaacctgtcctgctcagtgtctaccatctgtacccctcgaaatgggcctgaaacccacgtggttctgaacccacagcacaatcacagtgttgctcttgctgtctgaaacaccagctgcctggctcatctgtctgacaaacaaggacacatccttgaggctttgtgcccaccccccaatgcctccccttatctggatcaggagcccacctctgagccccacacccctgagcttaccacaagatctgcttctctacataataattgtattagccagatttctccagggggacagaaccaatagtatgtatatatgaatgaaaggggatttattctggggaactggctcacatgatcacaaggtgaagtctcactatagtctgcaagctggaaaaccagagaagctgttagcacagctcagtctaagcccaaaagcctcagagcaagggaagctgatagtgcagccccagtctgaggctgaaggcctgagagccccggaagactgctagtgcaagcccagcaaaggccgaacgatctagagtgatgtccaagagcaagaggagaaaatggcatcccactctagaagagaaagagagagaagaacgagagccagctgggtacccccctccctctgcctgctttgtcccagccaggccccagctgattgcatggtggccccacatcgaaggcaggtcttcctccctcagtccactgaatcatatcacaatcttatgtaaacccccacatagacacccaggaacaatgcttcacagccatcgaggcctccctcagtccaatccatttgacacctaacatttaccatcacgataatgtaccactcattggcctgtctgtgatgacctggatggtaagttatggacaagtcttgcccaccacaccatctccagcattttctacagtgttgaacactccaggtctccatgcacctgcttcgtgatttgacaaattggggtcctggacattcactggccatgtttttgttgttgttgttgtttgttttttgttgttgtttgtttgtttgttttgagacagtcttgctgtgtcgcccaggctggagtgcagtggcacgatctcagctcactgcagcctctgcctcctgggttccagtgattctcctgcctcagcctcctgagattacaggcgcatgccaccacgccaggttaatttttatatttttagtagagatggggtttcaccattttggccaggctggtctcaaaactcctggcctagggtgatctgcctgcctcggcctcccaaagtcctgggattacaggcgtgagccactgtgcccagcccaccagccatgtttttactggagggtaaggacaagaccatcaggtctgtaagtcacccatatttacagtctttgctccttgccttcatgtctactttgtttgacattagcacaaccacacttatttttcttttcccatgtgcttatattgttttatgttcagcctcctctatccttaacaatgtgtcccttctaagtaccaagtaactgggttcttggttttttatttgctctgtcttccaactggagatcagacaatttacatacaatggtattactaatgtggttccgtttaaatccatcatcttattatttactttcaatttttctcacctgtttgatgttccttttcccttctgtcttcttttggattagtatttttttttattattccattttccactctattatcttgttgcttatagattcttttctatatacttagtgattatgtgttggattacatcatttgtccttgacttattattaaagcctaatgtaaatctgtatttccactttccagacaagtgaaaaggaccttagaacattctagttttgtttatccctcttctggtttaggtgcaattgttattgtgtattttaattctttatgcatccaaaactccctcaagacataataattatgattctatttggtgaatacccctttaggctcgcccacattatctctcctcagaccttcctgcatctctcagctgccatttggaagcttagtgcccttctgcctgaagaacacttttctgtatttcctttggtactgttaataaattcttgcagcttttgcttgccttagctgtcttcattttgcttcattttgctttcatttcctttatggaaaatctcaagcatacagaaatggagaagataatgtaatatacctctatggacacatcacgcagtttaaacaacaatctgtcacccccctgctttacggctgttttcactggctagtctgggttgggaattattttctctcaacactttggagctattccattgtcttctagcttctgctatttctatagaaatgtcagttgtcagttttagtgacattccctttgggtatgcctgatcatttttgattgtcagacactatctatcatctatctatctatctatctatctatctatctatctatctatctatctaatctatctatagagagagagaggcagagtctcgctctgttgcccaggctggagtgcaatggtgcaatcttgggtcactgcaacctccacctcccaggttcaagcaattatcctgcctcaacctcccaagtagctgggactacaggtgtgtgccaccatgcctggctgatttttatatatatattttaatagagacgggggtttcaccatgctggccaggctggcctcaaactcctgatctcatgatctgcccacctgggcctcccaaagtgctagaattacaggtatgagccactgcaccaggtattttaaaatactaacattttaaaaattatatttaatttgagaatttggatgatgttgtcttcctccagagaggatttacttttgctttttgcaggcagctaaacattagaaaccccaggttacttaaatccaataggacctgagatgattcagaactaggcattgacctttgtgaggtttggcctatttctggtgcactttttagagtgtagccttacagagccctccaaactccttgtgtctactaaaagctccacttagattctcagcttctcagtcacctcttgtaaacccaggaaaaaacattttggccacttcttgaagatggaggtaagattccagaggccccgttgccctatctatgtggcctacaggctgcaccatgccctgctataatggccaagtaaggtatgctctccccagctcaccaaaggaaagcaagtctctgtcaaatcttccacaggttttcatgatgtttatcttccgctaatgagcaaaaggatgaaacacagtgcataacagcaagtgtggaggtgaccagtaatgttgaggtcaagggctattttttttctggatgtgtttgtggttctaatatttaagaaaataaaaacacgcagtgctgctgtctttttggctacttggctggcgtcatttggctggtttgtggggttgaatgaaatgtttacacatttctggtgtcacacaaacagagccaatgggctccttgatttgtgcagctggattggagtacgggctaggttgagatgaacccaaacttctttcttttatggatgactgtgatccacgggatctagagcaagtcagaaaatcaagtgctggtaggggtggagcaaccagagtgtgaggggatggtcaaagtgtagcacttatgcccaccctgtgtgagggggttccagggctgcaggttctcaaagaccaggatcagccatgaagctccagctgactcttggcacagaaaaattgggatccagagtgtcagatcccttgatctttcaaaagaagccagaaattcaaataactaggtgaaatagccagtttttggcttgactaaaaaaaaaaatccagtgtaagccaaacaaaatatatctctggaccaacatcagcccttgtattgacagtttgtgactttgatataataaaaataagcatagcattgtggtgcacctttcttttttttttttttttgagacagagtcttgctctgtcgcccaggctggagtgcagtggcgccatctcgactcaccgcaacctccgcctcccgggttcactccattctcctgcctcagcctcccgagtagctgggactacaggtgcccgccaccacacccagctaatttttttgtatttttagtagagacggggtttcaccgtgttagccaggatggtctcgatctcctgaccttgtgatccacccccaccttggcctcccaaagtgctgggattgcaggcgtgaaccaccgcacccggcctgtggtgcatcttttattcactatcttaagacaccaagaaaattgacatatgagcaacactttagggcatcttggtcttgctgtactacttagggcccatcctggacacacttggggcttcttgagtagtggcccagatgtttctgcctcattcccgatcacctgagttgtatgtgcgaattttgtttaaagcagtatgaccacaccaccttattcaggtggagttctgaaagctggggcctgagcatctgaggtttgaacagcagcccaagtgatttaatgtacagccagagctgagttcatttcgctctgcactcccctgtcctcctggtggagggatggtgaccaagatgggactaagcccctgatggccaccccgtttgccaaagtccccaatagcttagaaaggacgatttccgagcaacatgtctacacacatctgggcccgttttccggacctgtcacaggacaggagaaagggcatgaaatctagcaacaaaatacctggagtggtgtcctctgtcacttcctggctggattgggcacttgcctatttgacctccattttttctacttttaacaagatggtaatgctggtgctggtgagatggaagattctgcgagcagctagcaagctgtggagtgcggtgcacacatgggtgctagttttctcaggtcccctacccccagaccttggtgtgtgtccagcctcggcccctcctctgctttcccaggaaacactcccacactgcttcacacaggtcctgccatgggacccactgtcctcagggaggccctcctgcctcagtgtcaccagaacctttgcaaagggccctatcacccccagaggttgagctctggggccatgcctggtccaggacacagggctggaacgtggcttcccatgcttatcggctccaactgtggaaaggagaccttggcccttgttactgacgtcagccccttcagagaggcgagtcggccatgagcacctcagttctgcccctctgctctcctcccaggctccagcccactctggcttgccccacgtgcccccaccctgtctctgcgcctcccctctaaggctccgtctgagcagagactcactgcccccctcccttcctccttccctgagctctcagattccaatagcatgctctcctggctgttgggccatcagtatctctgcattctgtcatgattttttttttttttcacacaggaagccctagaacgctgccactgtcttcttaagtagccatattttcaggaagagaaggccctcccagtgatcggacatggtgcagggtacacttgggggccgaggaccatccccgaggggatgagaataacgtgggctctggatgcacatccctttatagctcccctttccctacttgtccctttccctgactaattaatgactccacccaccacccagccaatccaggtgcctggaagtcatcctccacacttccagcgtgggcagggggtatctcttgatcacagataagagcttgccccatctgctgccccagcccttcgaagcctccctgccatcttcagtatgatgcccccatctttgcctggcactccctcccaccagacgcttcccggggctcagcctcccagccccaccccaccccactccaggccccattcatcccaggtagcagcttctgctgctcagatgcccctctgcaccttgggtggtccaggaactcctcattcttccagaggaggcctgagcagtgagggaagcccttgaccctcgcctactgggggtacaatttgacacagattttttatagcatcatttggtgagacaaataaagtctttaaagtggctatgaaattccacttgtagacattttgcccggcaaacatgaatgggcacaaaaattcagctgcaaagatgtacttgtagcaatttgaaacaccccagtgttgcttaaagcaatcctagtgcatctatacagtggaatcctaggcgttaaaaacattaaggcacatgtaaattttgtttttcgaaccgtcacgtctgccctggacttcctcaaagcctcctaacaggcctctaggtgtccctctttgctcctttccaaatcatttgcacctggtattgggtgagaactaaaagcctgaatcatgccatcgggcagcttaaagccccataaggcatttccattgtaatgagatgagcatgtgaattccctccccaagctgtgcaccatcaaggccctgcgtgctctgtaaccaggcgcttgtctacctggggggtcccacaggaggacaccggcctcagcctgggccctgagcttgtcacacccttgtcaaacagtgcctccctcccgccacacccaccttctatcagcgcctcgggataagcctagctctgccccatctctggactttggatatgctgtccctgcatcagtcggcttccccttcctggcactcggggtaacttctctacatccttcatttctcagagaggcttcccttaacccttctgttcaaatggggttgctgctattattcctcactgtaccttgttctttctgttttcccttttccatttattacacccagtaaatctgtaaggacagcatcctgatgggctttgttgacagagtacatccagcactgaacactctgtacgcctcacacagaggaggtgctcgataaacatgtaagaatgcccctgctacattgtaatttaaaaagcaaactacaaaatagtatgatggcatatataacatagcatagtataatccaatataatacaagagtacaaggattaatattaaaaaatccagaagactcttccacaaactcttgtcagtggttaagtatacatggtgggattatagatggtttcaaatgttcaccttctctgtattatctatattttccagattttaaatacatttttatttttattgtatttatttatttgtagagacagaggtcttgcaatattgcccgggccagtctcaaactcctggcctcaagcaattctcccgcctcagctctcaaagtgttgggattacaggtatgagtcacagtgcccagactgaatcaatttttcaaaaatggtaacaatagcaattattccgcaataaaaaataaaaattttgcttaattctcattgtaaaaagactctgcccacaaatccccagcctctgtgaagtgtttcctctaagctccatctgcaccacacacctgagaaggtgaagcttgaggcatccttctctgtcccatagcacctgggactgcctccttcataagatgagtcatcaccatttcataatcctccgtctccctgcgccctcctgcctatgggagcacccagaatgtcttcttcatagccttcactcattaatgattgtgactaattaatttgagctaatccattttatgtgcaatttctggcctgctgtcttccccgggctgtaatttcaacaagggatcatctaccctaattgctagcgtagtctttataattcatagttaatgctcgatcaacagttgctaaatgaacaaatgaatgaatgaatgcaaaacaggattgtctccgaagttgaaatccctgcccttgattgtgtctgccatcagatgtgcgtccccgaaatgcagaaatcctactcgagagcagaggcatgttaccactcactggagttccatagacatcacctgaccacggagactttctaagtatttgttcctgagaagtctccgctgcaaagttccgattaagatacctgtgagcggcagggcgcggtggctcacgcctgtaatcccagcactttggcaagccgaggagggcggatcacgaggtcaggagatcgagaccatcctggctaacatggtgaaaccctgtctctaccaaaaatacaaaaaaattagccgggcatggtggcggcgcctgtagccccagctactcgggaggctgaggcaggagaatggcgtgaacccgggaggcagagcttgcggtgagtcgagattgcgccactgcactccagcctgggcgacagagcgagactccatctcaaataaataaataaataaataaataaaagaaaaaagaaaaaaaaaagatacctgtgagctgtggacatctgaatgttcacacagcactgacctttttaaacatgaaaatgaaaacgaatagtcagactcctgcatttttccatgtcttatttcagttttaaagatggacaatatgataagaaagtctgtttctcttctggatttctatttccaaagagatagcaaaggttctcaggttacttggagagtttactaggatgctgagcgctcctcacccacatagtttattattcgggaggtctgaggtgggaccccaaaagacaaattctcaggtgaggttgatgctgctggtctggcgaccacgcttggagactccgtgagccagaggactctgccccgacttgctagggaggcaggagctctggtgacctgctgtgtggcctggaggaagtcactgcccattctgagcctcggattccttgttggtaaacagcgtcttaggacgcggctctgtgatgctgtggcctgtgcgtcgcatcggcatgtctcagccggcaccgggcagcagagggcagcagagatcaggaaatggcgtcccggcaggcggcttctcccactgctgaaatgagttctctcaactgtcgctcagcactccgaaaccattagccaaagaagaaagacatttcctcatccctttgctctccaatgactaagaaaagtgaagtgatgccttacactgaaatgtatttcttaaaagttggatacttgtatcatcttgaaagcccctctacatccaggaaaactgcagcccagagaggggaggaaaagcccgcggcctcctgctggtggtaagttcaggaacacgcatgggcctttccgctccgtcccaagctgagttttacattccctcctagacgagaattggcgagtggacatgagggtagctttcttccatggtgctggggggcaggaggaaccccagggactcatggatgtgggaaggacatgagaggtttcccaagtagggccccttgcatttagagccccctctacatggagctggaaaagggagttccgtttaaatgtgtgaccctggagtccccaaacatctattcagagacagcagataaatcccagactgcacctctccagctggtcttcaagctcagaaccccctcctcgtttccaagtgtggatccatcagaatgaagggcccacacctctcccccaccgtggatttcacatttcctggtgcctctaagtcaccaggagggggcagaaaattctgcctcccaagccccacctccagggaccccattcatcaggtttgggtgcggtcctggaatccacgtgctaaacagacgctgagggtggtttgcccaaccagacctggacaatctctggcctggaggttaagcctgggtggtgaagatgaagagataggtggcaggcaacactgggaattcacagtctccgttcttggaatcatacttctcatccacggggaaaattccttggttctggtaccttccctgcaactctctccaatcatcctaacattctgggggcccaagatgagaataaaagcgaagttcccataccatgtgtcaattattaaaaagttatcaatccggggccgggcatagtggctcatgcctgtaatcctagcactttgggaggccgaggcgggtggactgcctgagttcaggagttcgagaccagcctgggcaacacagtgaaaccccgtctctagtaaaatacaaaaaaaattagccgggcatggcgccgtgcacggcgccgtgcacctgtaatccctgctacttgggaggccgaggcaggagaatcgcttgaacccaggaggtggaggttgcagtgagccaaggtcacgccattgcactccagcttgggtgacagagtaaggctccgtctcaaaaaaaaaaaaggttaccaatccaatcagttgttagaagataaaacccataatttttctaccttggtaaatacatcttcatcatcatgaaggcaaggtttgaatttagaattctgaggagttgactttcgaaaaaaggcagcacagagagccaggctgcagcctacccccttcacgcctcaccccacttggctttttagtgcacacacgtgtgtgtgtgtgtacaggtgtgtatacccactagccccacatatccacgcccccacccagttccagctgagccatcacccacagaagaatgatggacccagggagagaggcccacacaaacctggaggttggctcagggttccaggtatccgtgactctaaaaggcagggtacaggatccaggggaagcccatccccagccccagggaccccttgccctagatagggcatagcctgatgagacagagcaggccccacccctgcccaccagggctccttgctggccagtgggaggtggaggccttagagttataaggagctgtcaggttggtcccactgaagccacactggctttgggcccctgggagcctgactgtgaggcctttctgaaacctcaggtaggcctgacagacagacagggctgcaatccagggctgagcgcctgcctggagatggggctccaggagggactgggagggctgcctggaggcgggggctgttaaaatgcagctctctgggccctgcaccagcccttctgaatcagtggagctggacatctatgttttaacaagaccctccttcccaaggattctaacacaacactaaagtgtgagaagcacagcttggaaacattttgttttattcatgcagtcaacagatatccacagaacatcccctcccttggcactctcagtttcctgtcccctgcagccaacaggaagtcagctcttccccacagattctctccctcctcaagtttcaattcaatttcacctcctcaggggcaccttttccaaaatggctgccatctcccggccctcaacaccacatcccctctcctagctccttcttggcctttaccactggtgcagatgagcttcttggagtatttattttactcattgccatgcctccccctctagaatataaccccttccccagggccagggcctgatacatgggaatcattcctttactgcagtgttgctgggatataatatgcccataaacctactgagtatttgatgaatgatgaataaggccgctaccactcagcaattcattcattgcctcttcccacaatgggacaatggggcaggtgccttttggataaagagggaaggtgtaggtggcggaagcctccgagctctgaagaccctgcatggctgtctgcccgcccctccatgaaaggggcagctctcccaggaaagagaggaagagaggccaagagagctcacaaatgggtgtcttctcttgtgaggaaggattcggggctcaacacgcttcctggggctgggtctgtacaggtagaaggaagaggcccagttggctccaagcctgggccagccccagccctgcagcctggcggtgtgcaggcaccctcacttcagaacatgcttgtatgcacttgctcttctggcacgccatgaactgtttcttggctgccttgttaggagattaagctttctctaaaaagatgaaaaaaaaaatctctagcaaaggcctgactagagctgacccccgaggaggcggtggcaataactgatgggcactacatttgtctaattaatcttcttgtcaacaaagttgttctttgccggtgccagctctgacatcatcctgcaagcttgccacactggttcatatgcagttacaaaggctgcctgtgacccagcactacactccctaaccacccccaacacgctgctgcctggaaatgggtggatgagaacagagatgtcacacagctgctggcttagaaggggcaccggggaatcacagcttgaatgaaagttggataaagatctggaaggttcaggggatccccaggctggaaggagcctggtttctaaataggacaccgatgccgaccatctttttcaagttaaactttggaaagttccatttgccatgcaaactacccttgccctggatgggttgccccaagagtgacccaggaaagtttaggtggtaaagttgcaaaatcaagtggcttcagggcccaggcagagatttcactttcagtgccctgggatgaaatctctggatgtccacgaggctgacctggacttcccggattgggaggccttgtggtcaaaagccgagtccagtcctgaacaccagatctaaatgttcaagaagactgtgcagatttacaggctaaatcagagtccctggtagctgtttccgacctctgtatggggcttttagagtgaactgtggtctcatccaggcgtttcccgaccattgcatcccacacagggcctcccttctgattttatcgttagtctctctccctgttgatttcctccaagtgctcatcactgtccacactcaccctgtttatttctgctcaccgatctggctttttaatcgaggagtctgtgaataaaatctggaggaggggggtctatgaacttggacaggaaaatatttatatcattattttcactgtctgagatttaacaatttactcaattatgaaaatcggcaacaagccacagtgtattagcagtgtctgtgactttgtctccaacagaaatcacagctgtttttctatcacgtcgtagttgatgcagttatctcaaaatatcagctgggctaatcactattttgaaatgactgtagttaatagattggtctgtagatcctgttacatcctctatcaacgaagaacatatacgagtatagcaccacttaaaaatattttgataactgcatgacagtataatcggtttgtttcataatcctgtgtatcttaatttatgcttttttcaaatattctggcctcatgagactggcaagaaagactgtaagccatcttttctgttactttttctttctttctttctttcttttttttttctatttttgagacggagactctcactctgtcacccaggctggagtgcagtggtgatctcggctcactgcaacctccgcctcccgggttcaagcgattctcctgcttcagcctcccgagttctcttttctatccttagccccgaccttgggttctggcacacagtaagtgctcaagacaatattattgactgaattaatgaaggaaccactgaacaaatgaattaaataagtgaactgaacaaatgaacatgagccttaacgtggccgtgggtccacgtccatggacccacgtattctggaaggtgcagaagtttccacgaccctttgccacctgagcttctgtctgtgcgacatccacactacccaccaggagagacgggggtcttgctacctccactaagaacagtaggaacagctcagagctgaccacggcgtccccactaaacaagactccaccggcccattgccttttttgctccagccacacgggcctccggagaccagagctggagataaggggatgatcctttttttttttttatattatacttgaagttttagggtacatgtgcacaacgtgcaggtttgttacatatgtatacatgtgccatgttggtgtgctgcacccattaactcatcatttagcattaggtatatctcctaatgctatccctcccccctccccccaccccacaacagtccccagtgtgtaatgttccccttcctgtgtccgtgtgttctcattgttcaattcccacctatgagtgagaacatgcggtgtttggttttttcgtccttgtgatattttgctgagaatgatggtttccagtttcatccatgtccctacaaaggacatgaactcatcattttttatgactgcatagtattccatggtgtatatgtgccacattttcttaatccagcctatcgttgttggacatttaggttggttccaagtctttgctattgtgaatagtgccgctataaatatacgtgtgcatgtgtctttatagctgcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttttccacatcctctccagcacctgttgtttcctgactttttaatgatcgccattctaaccggtgtgagatggtatctcactgtggttttgatttgcatttctctgatgaccagtgatgatgagcattttttcatgtgttttctggctgcaaaaatgtcttcttttgagaagtgtctgttcatatccttcgcccactttttgatggggttgtttttttcttgtaaatttgttgttcattgtagattctggatattagccctttgtcagatgagtaggttgcaaaaattttctcccattctgtaggttgactgttcactctgatggtagtttcttttgctgtgcagctctttagtttaattagataaggggatgatcctaaagggacgcagtggtcccgcccatcgccgcctctacagggagggagccgcggccccgagctggccacgcgatggcgctgtgcacccggccgcggagcccctgcacgtccggctcccgctcgcgctctcggctcgagctccggactccaggctcggagcaggggttcgggctacggttcccggctccgagggaccgcggggctctctgcctgggaaggaagcttgcgggcctcctcgggcctcgctgcagcccagctaggttaatcaatcagcagccgctcagtcacccatcccttccgcatcagttgcgtggggctggggatcatgcctagggcgggaggcgtgggagcgcagggcgccccgggtccggatccggctacaggggcgaacagagcgggttctccatcccctggggtgaaatctctgggcccaggctttgagaccctctaactcgccttgcacaccctgtgtctgcagaggaggctgtagttcagaggccaagcccgctgtcagaaggcagccaggcggacttgagtcccaattcctccttcctttctaccatcattctctcttttgcaaaatggggatgataaaggtcccgaccagttggtaggattgacggagatggggcagcacagggctcctaagcacagtgccccgcgcccagtcggcaccgcgggacgcatcgtctgcagccgcgtgagctcgggcaaggcgacctggactcatctccgcagcagggacgaggtccgccctgtacttgcggcatctgcgtgtggtggaactgaccgaaacgcttgcggagctgcgcacggtgcctggcacaccgttagcaacccttcccttcccttgttctgcgcctgtcctgtgagtggacaggaggacacccagggcctccgctgcctgtccgatactagtcaccccagggcctagaggcttattccctggagatgggacccacgccaagccaaggtctcccattttctagagagaacttgggcagccgggaatgccatccttggaaggaaaggcaagagggaggtgaacattcattccaaggccgttaaacatggggagaggcactgctggaaaactgttctagtcagaaagaagctgcttagtaaacccaagaggctcagcggaaacccagccgcggtgcttgaggacgtggggaggctccagctcgctccgttccgtgtctgacgtctgccctgcgtgcgtcccaaggctgtgtccctgctcggtgtccctggcccaccggccctccggcttgtccctctgcgcggtcactggggcgtgcagacccgagccggccctccctgagtcagccagggaccccggagtgtcgataattaagagacacacgtcaagaatgtaaattcctgtggttcccagactaggaagggttcactcggtgcctcaggacaattacaagccgagggagtctgaaagagccagtgttagtgtttaaagtgttatcagtttaatgaactacttatgaagtgttaaatgcatgcaagtgtaaactgcaacatctgggtttgtgttttatttgtagacttcaaactgggcgcttggtgttttgaaaatgccaattaacggtgtaaaatcagaatttctaatgggaggaagatgtttttgtgacatctccctaaactatctcaaaatgtctttaaaacacacacacaaacattcacacacaaacaatgcagccacaaggacttaaaggattttctttttaaataaaaaaaaagcaggaatttgctgccctcttctttgttcttcactatatatatgtatatagctagtggaaagaagaatttagcatcagaggtgtcatcagcacaaatttctcagaggttgttgtaggaaatttgtcatttctacccatttcttccaggccagaaaatagatcgccttcaggaatatttactgtgctttcttgagaaaaatttccaagctaccccttgaagcaatgaagttggatttggaacaagtggaaacattataaaattgcttattttcttccaaaatttgtatttttcttccttatttcctgttaaatcagtgccactcattagcaaccatatttttgcattatatactcagcagaatttttgctccgtgactgcattccaaattaaacttttacatttccagggaaagtgtaacaaatgtctaaatcagtcagaatttaaactaatgagaggaagggaagaaaactcaactttcttcttctcgtataaaagcgattgctttttatctgtttcatgcttcggggacacttttatccctgggatcttgaaaggatcattcacaaagcaagaaggctcaggaaaacaaaaagatgtctaaattcagcgctgttgaagagttctgacaaatgctggtttcaggaaacaaaggcagacactttgaggatttcattgcaagatttggatagggctgcctgtaaccagtggccctaccgtagagctggaaggatgtcacaggtggtatggtggaattccgccatgtgatagcagcatacccaagataattcgttgataaggttgcagatagagactttaccctttgctgagtgttccttaattggcagctaccagtctcatttatgggtgcccctctgccagggtgcggtgaagagagctaagtgcaagttattgctttctggccaatagcacatgatcctcttaataaaaagagggtgaccacacatgttaatttcctgtcaacgtgacccagcaaggcccaagctgttccttcactctgtccttcttgcttctccattccaaagcaaaaggccactgtgagccgggaaaaatcaaaagatcagttttttggaagaaagttgtaaacttgacctcatagagggagacaatgttggctgttcaggtcaacaagagttatatacacaccaggtctgcagtagcctggactgtgccttttaagacatttttggtagcacaattcagcccagaatattttgagaaagaagtatattaaaagtattctatcacaatggggagaaaagggtggggggatggtattttaaagcttcaatagccaaattaaactgtgaacagaagaatcgatgtaacagaatgtctcaaccacaggccttaatagaggtaatatagacaaaaaaattagtatgtggtaaagatctgtgaggaaagagagattagtcaataaatgatgtcaagaccaatcatatggaaaaaattaaaggtaatccctataccaaaataaattccacatgcatttaacagttatatgcaaaaataacataaaaataaaagacaggtaaacttcagatcttgagagcaggactttgttgatataaaagcttaggaataggttaaaaagtaaaagattattgagtttgatgacagaaacattaaaacttctagatatcggtaacactggaaagatgtttggataaatatcagaaagaatcttatttttatgtgaaagtttattgcaaaacaatgagaaaagtgctatcctaatacagttaagttggacaaagaacacaagtaaataataaaaatacaaatattcaataaacaagatattcaaatatcaaaaacaaaataaaaattcattttgcccgtcaaattcctatacgacatgcaccgttacacattgcaggtgtgactttccactgacagaaactttctgtaattgattgagggccttaaaagtggccatatccttttgtaattttttcctatttctacaaatgctctacaatcagataaaagtacaaagacttattttcagggatgtccactttgggcattagttaaacattttgagaaataagctatataaccagtaacaagaatggctatcatccaaatgctagaataatacgcagccattaactttttaaatatttaaggatgtgggggcatgatcacgatgtcatgctaagtgcaagactttggatgtcaaaaggtacatattgaatatagcaaaacactaaaagaaaaaatccaaaagttttcagtggggttagtgagaattgtgtataattttaattatctctttttatgtgctcattttttccacaataaaatatataaatttatgatagaaaacaagttattgaaaatagcctgaccatctctgtctgatctccccacacagactctgttggcagctggtgggggcagatgtttttcccaggcggtggtgaaaatatgcttagcaggagacatggctgcgttctcacgaagtgggcctggtaccccatgagcttcttgaatgtttgttctgcactcatccaatccctcagagcagcccagtcagggaagaagagttttcaaaaccctcaaggagctgtggcctctcttgcccacagccatctgtgtatctacctctccgcaggtgcgggtcttgctcccctacctttttgtgtattgtggaagatactgtcaaattaggggtggcttagggttgggtagatgtttctgtgctctgtctaccatgattctgtgtcttggccaaagataggcgcagatagactccaccaatcccaatgcttcctagctctggactctgtcgcataaactggaaaaagaactttaaaacacgctcaggagcacaattggccttcagagccgtcccttttaaagatttactctagtgctgtatacaggggtgtgcaggagtccgcgcatgctacttgtgagaaccaattgtgtgcatctcttcccaactgttgtttatcacattagtagcttaagattggccattgtaggagttttacaccacagaaatagccgaacgctacaaatcagggtggcttttttttttttttatggagaaaaatctacagcataccaatggctatgcttaaaacaacattttattgtctctcccagtttctgtgggacaggaaattgagaggggcttgattaaatggtcctgggtctcttatgcagttacagtcagacagtgtggctggggctgggagagggggagggtgagcagctgggggttgactgggaatctctcaccctttgttgtcacgtggtttctgcatgtaggatagcttgggcttcctcacaacatggcagtcagaacagtcagagtgattctcagggctccagttagttttctgttgccatggcagagctgaattgctttatgatctggctactgaagtctgacaacattacttccactgcattctattgagtacatgtgagtcagaagcccatcctgttttaaggggagaggaattacactccacctctcaatgggtgaatggtaagtttctcaaaaagcatgtaggatgagaagtattgttttggaaaatataatctgccagagagtttaaaagtatactttgggatttgcctttcaaggctactggacatttttctagctatttggtgggtgtggctacctttccactgttgggcatatatttgatttgtgagaacagacaaaagatattgaaagccgactccagcaaacaatgcagataactctgcaggatgacaatggatccggaataggaaatgttacaatggtaacagccagctgagacctgaccaggggcccggagacatttccaagaggatggaggagcccttctcagctacatctcagaaataaatgcacagccttctaagggactactgtgaaagacaaggtgttctggactacatattacaaaagtgccatgttttactatgaaacctgtctcattgccttgtagccacattgcacttttctttggtaaccatcaaaatattttgcattgtatcaggcacatgatggaaacaaagtaaatatctgagtgactgattgatatagctaagccagtccctggttcaactaggtccttaggcattagttggacttggccaactatcaaaagagaaggtgaccctttctcatcaaaaccacttatagaaattctaatgtgtttaaactgggggactcgggatatgaatacaaatgtacatttctcttgatacacacttcttagtttatctctttctaaacttcgtaaatctatttcctgccatccttgttgacagggctcatagaggggaggggtgggaacaatggatgctactccaggtttcttcatggccttgaggtagacccagataaaccttaactggcttatttctgctcaagccactaagcgtcttcttttagttcttagaccccacttgaccaattatgaatcaaccatcaaatatttaccaaggtcctaacctattctgccactaggatagagatacacataaaagtccttatgtatctgtactttctcattaattaaagctcagaatttcccctccgtgtccccaaaactaaaacaatcttttagtaagactcatgattgtagacttattgatggttagatgggatggtggagacgtttcctgctcaccaaataccatatcccctttcccgagcatattcgccagcctccttgcagataggtggggctgtgtgactagttctggccaatgagctgagaaagaaaatgatacatggaacctctagggttctccaagaaacttccaggttgatgcatgattccaggttgggttgggatatccaagggttctcttcttccatgataatcatagaggtcatatgttcccaagaatgtagccacaagatgcaggaatcaccattagtctggctctttaagtggctatgtagagcactagctcccttgaatatcccgcagcccctggccaacccatactgggttacattaagacactaaagttttaggggtaagtagttcttgcagtatagcctcagctagcctgactaatacacatggtccacaactaaagagcaggagcaggagttggcaagggtctcatgagaggctagctgagtggtcctatatacaaagcacaccactcagctggtccaggtgtgagaagctacttggctagtgggaaaaattccacctaacttttgttttaggaaaacttaaaatgagactctcaatggccaataaaggacatttcctttggacacaataaatatttgacatttgacattattgttattatgggatatatttgtgggttcaggattatgaccatgtgtagagagtctaaaagccaatgtctgatgagctaggtgaacatttggcattctgagaatatgtaaacatcacttgtgtgtgtgtgtgtgtgtgtgtgtgtgtgtgtgtccacgtatctataaagttcagatgagttgagaatataataaatgggagtttttaatctgcatattttgtagctggcaacccaatggctctacactagaagctgatatcaaataataggagattatcataaactaagtcagaggccagaaaatcagcccccaaaggaaggccagttatatactaaaatattaggccgtgaaatatagttgttaaaagtgcattttggccaggtgcggtggctcatgcctataatcccagcactttagggggccaaggtgagcagatcacttgaggtcaggagttcgagaccagcctggccaacatggtgaaactccatctctactaaaaaatacaaaaattagccaggcttggtggtttatgcttgtcatcccagctacttgggaggctgagacatgagaattccttgaacccaggaggcagaggttgcagtgagccaggatcatgccactgcacttcagcctgggtgatggaatgagactctgttcaaaaaaaaaaaaaaaaaagtatattctttgaactctgcctgagttagaatcttggttgcacccctcttcagatgtatgaccttgggttagttatataatctctatgtgcctcagtttcctcatttgaaaaatattgatgtcatattattgttatggcgattaaaagcagtaactgcattaggattacgtttggctgttgtaatagcatacctcaaataacaatgtatctgagtcaccatgggcttctataacaaaatatcatagactgggtggtttaaacaaccgatatttatttctcacagttctggaggctgggaagtacaagatcaagtttctagcagatttagttcctggtgaggaccctcttcctggcttgcaaacttctcacatggtggaaagagagtactctaatttttcttcctcttcttatgaggacagtaatcccatgatggggtctccactctatgaccttatccaaacccaatgaccttccaaaagctcacctccaaataccatcatgttggggtttagggttttaacatatgaattttgggagacataatcattcagtctataatacagtggcttaaaaaaagaaagatttatttctcttacgcccaaagaaagaccaaagctaggcaatagtatgtggtccacggtgtcagagacccaggctccttctaagttgttgctgctccaccatcttcaacacgtctcttccacttaatgatctaagatggcaactggagttccagccatcagatcttcactccagccagcacaaaggaataagagagaaatacaaggcaaagggctcattctgtatgtctccttgactggaacttggtcccatggctgcccctaaatgagagaggcttgtaggcttgtaaatgtggtctctatacagggaagccacatgcctagcttaaaaccttgggttctttagttaaagaaaagcaggaaagcaggtatcaaagtatataatttgtagtctgcttgaaacagtgcctggtactcagtgagcagacaatgaacataaactattaactcttatcagaagtctgccatattggatggagctagtcatgcttcaagcacgtcataggcctcatcaccgtgctcagagcacttttttggctgagtttcatgctcaggatgagtaaacagactgcccttctgctttaacggagtagctacaacaattaaaacataaaaagagctaaagctggcataggaatagttagactgaatcttaggttccctgggagagaacatacctgcacctgaatgatgctaagggcattggtacactgtgctgcaaggggagccctgggggagcagttggtacaggggacatgctcctccagctagtgggagggtttcagacagatgtggccacatgcaatgccaatgagaactgctctgattcttctcaaggacatataaggtgacatgtcaatggtagcttctcttcccaagctcatgggcaagggcggagggaagaagaggaaatagaagacaaatgagacttggagaaagccttggatctgggaaaaactgccactccctaaccttgtccccaaagcctttggttgccaagactgcaggggagccactggccctaccctaggtttgcgcaacaaataagggaatggcttgtggtgttctaacctcttccatctctgactctctggttatcttcctggaagcagaggcaggagaggccatctttgccccaggttagtcagctatctcttagaggcttcaccctatgaatgttttatttttatttatttattatttttatttattttttgagacagagtttcactcttgtcacccaggctggaatgcagtggcatgatcttggctcactgcaacctccacctcccgggttcaagtgattctcctgcctcagcttcccaagtagctgggattacaggtgcctgccaccacgcccagctaatttttgcatttttagtagagacagggtctcaccatgttggccaggctggtcttgaactcctgactcaggtgattcgcctgcctcggcctcccaaagtgctgggattacaggcatgagccaccatgcccagccctatgaatgttttggatcctgtgtttctaaaccagtggttctcaaagtgtggctctggacactctagggttctccaagaaacttccagagggtttactagatcaaaactattttcatattattactaagatgttatttgtctttttcaccctcatttcctcattaagtgtacggtagtggctgtgtgtacgtaatgtcacaacagagtgaacatccacctgtcttctgttcacccagactttaaggaaatttgcaaatatataaatcaatcccactcttctcagctgatatttttgttttgaaaaatatcgttgtttttcacaaaaatgtattatttatattaacatataacaggtttattatgttattgtaaataaattaatattttactttttagaccctcatccaatgatccatcaattttttttttttgagacagagttttgctcttgttgcccaggctggagtgcattggcaccatctcggctcaccgcaacctccacctcctgggttcaagcaattctcctgcctcagcctcccaagtagctgggattacaggcacgcaccaccatgcctggctaattttgtatttttagtagacacggggtttctccatgttggtcaggctggtctcgaactcctgacctcaggtgatccgcccgcctcggcctcccaaagtactgggattacaggcgtgagccaccatgctcaacctcaagtaaatacttaaaatgttcatagttttaatttctaaatatggcaaatggcaataaacaaaatccccattttaaaaaagctcttttgggttctctgcgatcttcaggattcaaaaggggctctgagaccaaatagttttagaaccactattctaagcaaaagaattttcatacacattagtgtgcaggtacacattactgcgcatgcacacgtatgtacacttaaaagtatattgtgaccaaatatcttctcataccgctagaccaaggagtagcaaactttttctgtaaaggaccagagagcaaatgtttcaggctttttggggctgtctagtctctgtagggaccactcagccctactgtagtatcgacaaatcagacacagatgatcgctaataagtgggtgtggccatgttccaataaaattatttatgaacactgaaatttgaactttgtataactttcactttgcataatttcataaaatgttattcttctgcaaatcttcttcttcttccacataaatacatttataaatcagataacatccttgttttctactttttgacatgggaaatgtgattatccatgccacgtcactgcttttctcaatgctatcaatggcctttagattaagtgggtggtgaaggtcaagggagtcatcagaagtttgcttctctgggaaggcacatgtgagctgggtgcttatgcctcagagatgtctacgaggaacccagccaaaggcagggctaatgaaagaagaaaccgagaaattcattatgctgaactgggatccaaagtgtataacaacctctaacatttattttcccactcattcaacacacactgtatttatgcgcttactatgtaccaggcattaagagttaaaagataaaatttgaattctatttgccaaagagactttctggaaagcttttgggaaaggatgtccacgaatagaggaggtctgtaatccacaggcaagacctctgcagtctgaaagattcatacacctaagatacatacagtcattctcatcatctgtggtggttatgttcaatacaggcactctgaacaccgaattagcacgtcctgacccactgctcccaggggaaatacaaggtttggtccctgtgagcctctgatcatactgtttttgtcaacagatcaatgcataaccgtgttttatgtgtgtttctgtttaaagaccccttatttaatgtatactgttgactcactgatattgaactcagtgcccatggcactatcacttatgcatgaacaagcttatctaacgcataaactctctctataaggcaggaaagacccttcttgcgcttaggaacaccagacggcacttcagcactgtgcctaggggccattttaaacagcgaaatcatcaagaaaaaagcacaaaaatgagaaaaatgttgcactaaacagagcatgaaaggacatttgctcatagtgtgagagctgaacatgcacatacgtgttcatcactctgcgcttgtctgtgaatgaccgtgaacatgctgcaagtcttgatttgggggttacaagttaattttatcaagtagaagaatttgccaacatggaatttatgaacaatgaggatcaattatatatatttttggtgtcagagaagagctcacgatggaaccccgtacacttgtttgggaggggagttcggttgtgtgcacctaaaatctttgatgctgggagtccaactttggaaacttatctggagaaaattatcaggcaaatgagtgaatgattgtgtacaaggatgttcatttataatttaatgaaacactatgcaatcatgaaaatgcattgatgaatatttattaacatgaaaaatttatgaaatgcaaaatgaaaatacagtcaaacaatatacacatcataggcccatttttgtgattaatatattttatttacgatgtctaaaacagatatatttagtttataatccagatattttcaatttctgagtagaaaaaattctgaaattatatatattactaaggtaccatgtctgggagttgggattatagaacaatttagttttgttctttgtacttttccgtgttttctaaatttgtttacagtgaaagaactgcttctataattagaaatgtattgtttcacaatgaagatttttaaggttcttactctctgccaggcatagggctaagttccttaactcttgaatttttattaaaattgtatgaaacaatcatttatatttcactatttataataaaaatagaaaaaacctcaagattccctagcctcattcctcagatttggaaggccctcgaaggccagctccccccgacacatcttgctgccattctgggaaccggaatcagaggtggagactctggcccaagtccccactgctcagaaaagtgctgaggtctgagtctttccagccagggcagaattcctggggcttggccacagggacaggactaacagattcaggcaggaattttgtctgtctcctctatttttaaaagaaatagcccctgcctaaactgggttgagccttgtattatctggttttcttcaaagcctgagcaaagacgagctgccgctatccagttatgtgggactgtctggggaacggggtttctgggagagaaggtactctgcccagaaacaactcaattgtcagcagggcccattactgcacgaagatgagcttaacagatgtcagcccatcagcgtgagagtttctgcttgtaatttatcctttggagcattgctctatccccaacttatatttttctaacagtcaacaaatcaaaaaatgaccaaaggtgataatggggaccgagtttgggctcccaccctttccacatggcaccttccctagtaccagtctctctagtgtgatatttgacgaatccccgactttccagctttttcgttttactccattacttaaaaactgcagagtctactagatttgaggccagaggacttcgatgcaggtgccagtctgcctcatctgcctgtgtgaccttgactaagccactcatcctttctggccgttgggttacccatttggaaaatcagttcgaaaaattaggtcatgttttgatttgtcgacttaaaaaaatgcaggttgggcatacagcaatgaggtcccatcctggagattggatcatactcctgcctgcggaggcatgtgtctgtcatggcaaaacccagtgtttggattttgtgatgttgaagtacaatcagagaacaaaatgggctactcaatttcagcatcaatgagcttagctgggcggcattgctgtgggcaggagcagggggaccttccaaaaatcacaccacacaaggggtctcctgacctacacagaacaaggcattaccccctggggctggccgattggagctcctgggatcacgtggcagaattagccatggtttgtggttcttttcaagcagccaaattctctaagagtggtgtaaatgtcagtttcatgaaaatccattctaaaagccccgatcaacttttcaatcacctgctcccccttttctgcccagttctcccgagagcccgaggcgattctgagatcagagagcataattacaaatgaaccggggctctggggatggcttacagcttaattagctcccatccctgcactgtctccatggctcgcctcacgctccgctcagcgctcagctcagtcctgactgccaaagaattcagagcaggagcctcttggcttgttaacatgctctcctcggttcctcctgacactcacatctaggctgcaattaggcccaggtgaggcgacagagagtcctgagcagctctcgctgcctctgtatgtgcctccggagctggttgggggttggtgcttgtctggaccggcccgggggtgaggtacaccatggaatgtggagtggcggcggctgcagccacttgcacctgctcggcccagcccaggtcagaaggctgcgggctgcaggtgtgtttccaggggcacctgacagggcagggaccggtcattgaaggcacctggagttaaagggtgctgtctgataccagctggtgggggagaggggattgggagaggtaagggctgggatggcccctgggcagaagtcaccctgtgcagcaggagcttccctctaagcacagccatggccctagaaagggctttgggcttgtgcaacattaaaaggaagaaactacaattgtaccttgagggttcctctcaaggaaaagcgcaaacctgtaagctgatttctcggtcctcatgactccctggtggcttaaggcttgggctgtcaatgagtttccagcttgcagtgtgtgactctaccctagaggaaactctctctctcctggacaggaggaagcttagaggaagaatcttgagggcaaaaagaaaggtcattagctgggaaataacacctgtccaagaagacaaagggaggaaatagcagggccgcctgctcccaagcaggatccaccctcacgtcacctggctgccgggggggtctgcctaggcttattgaacccaagaccctacagaagggtttaagccttcctcagagacaggaagtgaaaaaacaaaactgcaataatgttaaagtgaatgtctccaaaacatagtattacctctgaaagttgaggtcactctacttcaatcattacataaaactgtgttctaatgttagccagggatgtactttaatctgtttcatataacagggagtcattcccccaaaagcaagtgcctgaggcctgtaaacctcttcacatagacctacccctcccaaaagaaacctgcaaagagacggaaggaacatgaatctgttcagtcacaaaagcaccgaggcatctcagggaccacagctccggtctggggccagccacatggctccaggaaaaaacttctctgtcaaagagatcctcagcactcccaccctcaaaactgcactcacctgctaggttcatggtcagaacctggcgaggaagccatgtggtccatgcacagagaggccggtgccacagattttggctttccttctttgggaaggatgattaagtgggagcattcgagggagagaaggagaactccatctatcttctcctatcctggatcaagaattctctgttctgcttgcactcctttactgagaagtgccctgtctgcttccctgagctctgaaccgtgctgcattgtggttatattgttagaaaaccatggcttccgtgcacacggtgaagcgagagagacaagacgctttccacatttgtatcttaaacaggcattgactgaatgcctaccatgtgcctagcaggtgctatttttgaggtgctcagaggctggcagggagataattctggcagtacaaaattccccagagcaggggaaggcaccgagtgtggagaggcctggagaatgaaggattaattctagctgaaggtagggaggcctcacagagcaggccaccaccaagccacgtctccgatgatggcaagggtgtccctggggccaggcctgaaagacggtgtggacttagtggggagggactgaggtgctaggcaggacccaggctggagaagtggattgtaattcaagggagagacccctcatactgccctgagcaattgggagagcacctcctagtctatgggagctactgaaaaagcccaactaggagacatctgtgtgtttctaggctgcagagtagaaaatggaagggacaggaaggaaaacagaggcctcatctactgactgctttttagcaacatcatcgctatgcaccagtcacagccatgacggggtcacaccgctgtttcacccttccaacgtacgcctggctttctttatagcttttgtatctaaaaaccagcagtgttttcatgaaggccagagatgggtttggatctagatccagggccagttggaaaccccaggccttgctcctcacagtgtggcctggggacagcaacatcatcagcatcacctgggagcttgtgagaaatgcagagtctcaggccccacccagacccactgcatcagatttccctagctctccagagccatgtgtgacttcctaagcattcctggaccaaaagtggccactccctggagcaatgtgacctgaaggatggacccttccgctcccaggctcaggccacagaggacagggcaggagcaaaaccagaaattccctccaggttctaagcaaggcttcagcttcagttttttgatattctaggtgggaggccagccagaaagggctcagtcagtctcaggcacacgggcatcagacacaccgtcaagaagcaaaacaacccaggaatgcaggtgagctcatgccgccaagcagcagtaattcatgctgcaacaagttacatgtgttttatagaggaggaggcctgtacaggtggagtcacgcacccgtgcctgtcagcacttacattatccatgattatccggattttcttttcatttggccccagagaaggagctgccacacaaagagttcagcagaacgaagtcactggccttactcctggatagagcagtatccacagatgtaaagaataaccagtctaactgtgtgtgtgtgtgtgtgtgtgtgtgtgtgtgtgtgtgtgtgtgtgtgtgtgtaggagacatgcgggtcagacctcagggctgctgagatatgatgtaccctaaagggaacttgcagagaagctctctaccttgccgatctgtgggtcacagcgtgagaacaactttctcatcatgtttagggccttgagcatttgaaaataataaaaaggaatagtttgaattaaaatttatggttgagtctgcctgtctgggaggagctggcttagtgggcaaggctgacgccagccaggctgcaggggctggaagaaattggacaccagcaaggctgtgaggagggatgactctcccatagacctgcgtggtgggccctctcggccagccgctcccagctctggttgcacattggatgctcctaggagagcgtttaaaaaatgctgatgactgggccacaccatagacacagtaaatctgaaccactggggttggagcccagtaactgaatgatttttaaagctctcctggtgattttaatgtgatgtcaggatgaagaatcataggctgaggccaaaggctccaggctcgaggacagcaggtgggcccttaatgtttctgctcctgggtgggtcttcccctctactaggcaggcatacaggcctcagtgggtgcaggaggggtgatttctagcattcaactccttgggaattttaccaaactgtgtatagggacggcgagtgtgaccaatctgtctgcagggctgtggagtcaattctgcagcagctgcccctgtctctgctagcctctgaatacttgctatggacacttaaaatctccaccaagatgcgtgcgcttttcatttttcagagaacgtgtacaccaatgatcttattttatcttgtgtattagttttctattgctgatgtaacaagttactgcaaaagtcatggcttgagacaacagacttaattgccttatagttccagggcactaaaatcaaggtgtcggcaggttgcattcctcctggagctttttggggagaattgggttccttcacttctctgtcttctagaggctgttgtgttcctctgctggtgattgccttcctcaaatcactctgacctctactctgtctcacatctccttctctgaccctcctgtctctgtcttccaaggacccttgtgtttacatcatgcccaccaggataatcttcccatctgaggatccttcccttagtcatatctacaaagtcccttttgccatggaaggtcacattcacatgttctggggattaggatatagacctctttgggggagccatgactccatctccatgccctgacaacagccacgtgagtcagctgtgcgttattatacccatttggcaaatgacaaaactgacatgtagccagagacctaggttttagagagcaaaggtgaaactatatgcttgttatcctccacctagttgttgccctgccctcctgtggaggtggttatttccacacacttttgttggacaggttcgtgggcacccagttactgatacaaaattactgccatcaggttgggtgtgcatcgccatgggcccaggaagccagtttctctctctgggttggtgcccatggttctggacaactctgatctcctcgactaggtctatgcacctttacacacaaatgattaccacacgcctctcctccatggcatttgtcaggattctaccactgtttatgtacctctgtcattaatctcagcctttccctttcaacggtaaactccatgaggacagaatacatacttgcttttgcactccagcaccttgtagagcacatgtgaatgtttaataaaaatgtgttaaacgaatgaatgtttgtcagcagtcgaagccttacagatgacaagcaactactcctttgccttgtagaagctgtggctgattgctttagtgttcccatctactcacttccctgtaggaagattacgcgtcccattcattggcctgtgactgtgggggctgcttcctgccccactgccaggcttggtcatgtgacttgctttggctaatggaatgtgaatgtgaatataacagaagccatgtctgcgcagctcttagagcagttccatggctttgctctgcctcttgttcttttccctttcccaagagaatacaatatccaaactataagatacttttctggcatgtgtcccagaatgagaagacattaaggaatggagccaccatgttcaccttgcagctctcaatatgcctgagattgaagctgttgttgctgtaagccaataagatttgcaggttttcgttattgcagcataacttagcaaattctgacaaatacagaagtcatcactggacagctcagggcatatccagctttccttcctccccagtggtgacccaggttacagccctggctctaccacttgcaacctgtgtgattttgagaaagtcacttcacatctttggcttcagatttttataccaatagataaaagcttcttctggcttcagaatcagcgattctggagatctagcctattattcgacacttgacttctgtccttaatgaattatctgcagatggtatatggtgccagggaagttgccccaaatttttagtatgacagttatgtattcttgggcaaacttttttatctctctttttgtttctaaaagtcttatttgtaaaagggacagttatcacacaatgtggaggtatgtcacctagctcacaatatgtactcaataaatttaggtgtcctcccctttcccttagctacttgatcagattcatcttttcaagtgtacttttttagcatcttgcatgccctaaacttgggtgctttgagggagggggtgaaaattcctggaaaaaaaatgcacagaaatgtacacagatgttcacagcagcattacttctaatagccccaaagtaaaaacaacagaaaggaatattatttagccataaaaaggaataaagtactgatttatgccacaacatagatgaaccttgaaaagattatgctagaggaaagaagtcagtcacaagtggccaaacactgtatgatcctatttacattaaatgcccagaataggtaagcccagggggatagaaagtagatctgtggttatctaatttactgggaggcagcagagtatggaggagttgagtgggagcgggagggttggtggctaatgggtatgaggtttctttctgaggtaatgaaactgttttgtggtcaaatagtggtgatgattgcacaactttgtaaatatactaaaaaccactcaattgtacactttcgtttttttaatcatgtactttaaaagtatggaacatgtggcgtgtgaatcatatcttaatattgaaaaaaacccaacaacctcagaaggacgcagagggatgagtcccaggggctgctggctcaggtggaggagcattgccacgccagcccttcttctcagccttgtcagtgttatcttgctttgttctcctcctaaatctctcttcttttcttttgatgccgcgtgctccagcaaggggaaaggtctcttgttgctttgctcagaggaaatggttaggagttttcaaagaccattttattaaaaattttaaaagaggctgggtgcgatggctcatgtctgtaatcctagctctttgggaagccgaggcgggtggaccacctgaggtcagggtttcaagaccagcctggccaacatggcaaaaccccatctctactaaaaatacaaaaattagccgggcctggtggtgcatgcctataatcccagctacttgggaggctgaggcaggagaatcacttgaacccaggaggtggaggttgtagtgagccaagatcatgccactgcattccagcctggacaacagagcaagaccctatctcaaaaaaaaaaaattaaacacatagggaataaaaatataaacacataaaagatggaagtgttttggagatcatattctgtacactgaagtagccacaagctcaggccaactctgggtcttgtgtccttcccaccccctcagccctgtctaggggaaccggccctggagtcccatgtggaagctctggacaatttcctccgttctcccttcccgttcatgctgggcctgagccctcactggtcatggtgtagtggaaatggatggcaatgggttggtggtcctctccatatagaacaccattttcttcccccacagacccagggaccaaggcactggtgagtgggggaggggggcatttatgaagactctcagttattccttccattccccattcttccccctacaagagaaggaagggtcatttccttacagcgctccaccaacacttgtcgatggacccactgcaaagcacccagaaaatcataacttcttcttgcttcacagaagactctcagcccctcactcccatcttcaatctatagtttcaaagatcaccaactcaattgttagagtatcctagcaaaatagaaataatttctctgtttttcgcttggatgattttagttttgcatgtgttttggattggttggagtcctattggccactattacatgaccaacttgagctgataggacaactctcccacatacaagagagtggacgggtagcaccttggggcccctccagagaccgtcatcaccagtggggtgggggagtgtctgcttttcctcaccagtccccacttacctccgagggtttggctggtgttatcccgagagaccttgggatatgggaacatgatttgtctacttcttcagagccttagaagcttatttacaaagccctcctggtcctgggttgaaagggcttgcagaaagacgtaagatgttctcaaaacaatccaagatccagtcaatatttataacccagggctttagctcaggtggcttcatgagactatttgagctccacttaactactgtacattgatcatctgtgggagcccttttgcctgctggctcctttatctttattatactgtgcagttgggaatacacttgactctcaaaggctcaacttgtacctttcaaaggaaaaatttccaccttatttttaagccctatcttgttcccctgcagtctgaataaacattactcaatagctggagttacttaagcatcaatcatttccatttcaaggagaaggtaaagggaacaaagatgtaacagcacaaaaagattgaaatttaacctccaccgctgggtgctttccaagcttgttcagattagttcgtcaaaaaaaaaagccccagagaactgatgttacctcaagttcactgaaattctctttctctcaaggattacacttgactatgaagcaagtcatcctggaaaccctaggcaggcaatgaactcggctagtgaacaatttgctttctctgagtggtttccacaaactttttacattcctcttatcttcaatgcaccttccatcaaactggtctctcgcctggcctcccccatacctctgtccaatacaactcacagttcatggccttccattctctctctctctctctcaattctttctttctctccatcctcctctgaaaaataaaatcatcctgtatagaaaaattggcctccaaaatctctactttctccagtctcattgacttcccagatgccatttttggctctgagatgtagaagtcctctccagagtggtgacagtgtgtgcctgggtgtggtctcagaccacctgttctcaactcccccggggaccttggtaagcagctaacttccccgaaccctatccatccctactgaattagactctggaagtaagccaggaaatctgcatattaagcaagctccccaggtgatttttggcccaaggaagttggggatctgctgtactgagggaggatattggctttggagtcagagaaacccttgctgggttctgtgcttcgctctttgctagtggcatgattttaaaaacagctttattaagatagaatacacataccatgaaattcactcatgcacgaatcagtggtttctagtacattcacagaggtgtgcaaccatctctacaatctattgtagaacaattttatcacccccaaaagaaaccctgtgtctattagcagtcactccccatttacccttaggctcccagccctaagcaaccattaatcttatttctgtctctatggatttgcctatcctagacacttcatatcaatggaatcctacaaaatgtggttatttgtatctggcttcttccatttagcataatgttttcaaagttcatccgtgttgtaccatgaatcagtacttattccttttcgtggctgagtaatattctactgcatggatatgccagcttttatttatccattcatctactgatgggcatttgagctgtttccagtttgaggctattggaaataaggttgctatgaacatttgtgtacaagcttttggcatggaggcatgctttcatttctcttgtgtgagctaggcatggaattgctaggtcttatggtaactttatatataacattttgaggaactgccaggttgttttgcaaagtgactgcacaattttacattgttaccagcagtctataaaggctgcagtatctccatatcattgccaacacatttattttctatctttttttaaaattatagccaccctactgagtgcaaagaggcatttcactgtgacttatatttgcatttccctaataaataataatgttgagcatctcctataatgattggccttttgtatatcttctttggagtacctaatttaggaaggcatttaacacctctgagcttcagtttccttgcctataaattggagtaattgacaaggtgattaaactaaatgaggcaatgaagttggagtacctgacacacagtaggcacttaaggaaggttaaccttccacaccactgatatttgaaacatgtcaacgtagacagtctggagccatgataaccagattccctttcccgtaaggctctgggttaggattggccaggggagatattagtgggaactctggaagacacaggtggctcaggagccacttcatgctctgaaggttggcacagtgcaccatggcagctcgtgcatgctgctgctgctctgctgtctcactttgttgccatgaggcagcaggtgcccctgcagctctgtcagctcccactggatctggtccttcaacttctgtaagtcctgggccaggtgtctgtgcacttccatggcaaagggcacagtttcttcagcagatcatctgtgttattaaaggtacatgggagacaagcttgggttccagttagtccttatggattccagcttatccatgctcccttctattcacatccaaattttttttcctctctgctgggtctagctgacctataacgacttcaggcttaacaccagaggcaaccaccttgcatagatttttccaccagctttttgtactgtgtatagcccaattcctatgagaaatgtctgattctctatcattcagagtgattctgattctctgattgaacctgtgagatgcaatcaccaagggcagctgtggcatctccccagctagagaaaccaggggctgggatgaaagttggtctccccagcaaaagtaaacgcatggtgacctggagttcttcccataccagtaacctcaggtctccccaggcagaggtgaacctccactaaaccctcctgtgtaagtttcctatgactgctataacaaatgaccactaacctaggggcttaaaacaacacaaatttattacctgtcagttctacaggttgttaatccaaaataggtctcatgggccaaaatcaaggtgtcgtcaaggccacattccttctgtaggctctagggaagaagtcattcccttgtcttttccagcatccagaggcttcctgcattctttggcttgtggcctcttcctccatcatcaaaacgagtagataagcatcttcaaatctctcactctcttacaatgaccctcaggtcccctctataaggagtcttgtgattattctggcctcacttggataatacaggataatttccccatctgcaaagtctgtatctgcaaagtgcccttttctatagtgtggcatattcacagattttgaagattaggacttgcacatctttgtggccattattgagctgaccgcatctctagatccattctccttacttcctccctgctgttcagtgccctaagagactgctgaatgaactgcatttaccagctctcttgccctcttgcttctggtaggatttagccaacggggggcaccagtgaagatcagagaacagaggagtccctgattctctgcctgaggattgaatgcatccctctatcaaaggacacactcctggtggccaaccctttccacacagctccagctccacttgttctatttccatttcttgcccctcaggcctagggatggtagccgcttccctgcctggctagctccaaggtaatgcaacattccttgttggtttcctttaaccctgtacacatctctgtaaaagtccctgtttggcataaatgtaacagctaaaactataaaacacttagaatacaacatagcaataagtattcgggtttaacaatggattcttagatatgatcaaaaaaaccccagtcaacaaaagaaaaaatagatacactgaattccatcaaaattaaaaactttttcataaaagaacactagcaagaaagtgaaaaagacaacccacagaatgacagatctgacaagggtctagtatctagaatataaagaactcttaccaatcaacagaaaaagacagacaatccaattcacaaatgagcaaagaccttggataggcatttctccaaagaagagagacacatggccaacaagcacatgaaaagatattcccaacattagtcattagggagatacaaatccaaacacagtgagatactacgtcacacattgtaggatggccataatcaaaacaaaacaacaagtgggttggtgaggatgtggagagtggaaccttcatacactgcgggtgggaaggtagaatggtgtggctgctgtggaaaacagtttggcagttcctcagtaaattaaatgtagaattaccatgtgatccagcaattccgctcctaggtatataccccaaataattgaaaacaggtgttcaaataaaaacttgtacatgaatgttccattccatcacccatggatcctcccagtcagctcaacttatgagcagaaaacatttgcttttagaccctcacaggagacaatgggtgtcattgcaaaaagccaatgcatggagcctatggaggggagggctgaccattgtccaggagtgctaatcacagcgtaacacaaagttcagggtttctgccagctgggttatttctcagtatgctggagggggtggaggttgcccttcacatgcctagagaggcccctgatttatggggctttaagaagaaaacaaggtcagaggaaaattggctgacccactgtgagtccaagtgacttcaactaaaacagacagagaagatggagatgataaaaaaggaaaattcagatttagtgtctgatgctccacctcctaaaaataggcaacctcccaggctctgtccttggctttctctttgccttgtctcttttggaactcactgttagacatttctgtgctaaatatttctatctgccagctacaaaccctctgctgggagtcatagcacacctccaaggcagcatattccaaattgaactcctctttccttccttcattcactgtgctcctcttgtcaccatcatctccaaactactcagcaccctggcctccctatctgtcatgctggcactgccacttcccctcaccctggctctgaacctcctagtctctggcatccacatcccttccgtttcctgggaccacagcctcacagctgcactgtgctcagcatttcacaaggactgtcacactcagccttcacatttcctagcaaattggaagtgaggcatctgacaccatatacccaacccgtattgcctgccaaagccattgaatctctgcttcctggctctccctaaggggcagtctaccattggacccaatgtccaagttctctgaaggcctggctccaagctacctgtcccctgctataagccttcaattcattatcatagaaatgttgaaaactccatttccctcattctgtatcagaagtttcttgcatatctattttgtgctgggcatggtgttagggactggtatcaaaagagtgagcaagactctcagggggctcacgatccaataggtaaagtaagtgtgacctcggactatagggtgaaaagggctgcaatagagagtgaggaagtgagtatcctctgggaccacaaataaggtaccaaccccagactcagtaggtcagggaaagccccaggtaccctcaagatcaagtctagattcctcagcaagggtgcgagcatacccacacctggcctagattcccttatctggcctctagactcctcacatgtccatgaagcacccacaaagaggtcctcctgcctctttccaaacaagccagcaccctcctactcctaactgttgttattcattcttctttctctgggttattcttgctccttacctttacatgtcaaactcctactgagcctttgagagccatagaaacactacctcttccctgaagccttccctggtctccagactcacacataatttctccgtgcattgcccttatcattttctacatggtatattgcatgtatcttccttgtcccactgaactcagtcagggcaggcacacattgctcatctttgagggctcccaaagggcctacctaccacaatgccctgcactgaggtgaaggaggaggtgagttaaaagcccaacagggccaggcacagtggcttacgcctgtaatcccagcactttgggaggccgaggtgggtggatcacgaggtcaagggattgagaccatcctggccaacatggtgaaaccctgtctctactaaaaatacaaaaattagctgggcatggtggtgcacccctgtagtcccagctactcgggaggctgaagcaggagaattgcttgaaccaaggaggcggaggttgcagtgagccgagatcgtgccactgcactccagcctggcaacacagcaagactccgtctcaaaaaaaaaaaaaaaaaaaggcccaacaggatttcattgtttacattgaaatattaatgggttacacatggtagatttgaagcattctgtatgcactgcgtacttgtactaaaatcctctgtccactcatctgctttctcattggtctgggaaaaagttaaggtatgtcacgttagtctatgtgtcctggggccttgagctacaccttgtagatctgtagtaaacatttcctgacccccaaccaagagcgaaaatgtcaaagtctttcacattacccttgttaagactaaattaaggctcttgcaaatataatcacatctttctctttcatacatttggtgagggagcactggcttttattctgggatcattgctctctgccatccttcccaatccattgctctccatttgtccacccaccgctaaatcttcacctcctaaaccagttctatttggactggccatcagcccaatccatacaaccttccttcccttctctcctctcgcacttgggcctctcaccttggctttactttggagaaagtttaaaaggccggtctcctccgtcccctttaataatattatgttatcttgatcagcatttgtatttcacattgtaagattctggcctgaattctgacttcactggggaaggggagggagttggaaagaggattgttgatgacggcgatattttattacgtgtgatggtcatgggttagacgttcagctcttcaagctggaggctgagggtggggaaggggagaggacactaagtatcatgaagtcacagtgcaagatatttttcaaggagacatcaaagcctttttccatggtgtcttgccttgaccccatttcacactggcaaaacacaaactcaaattaaagtaaaaataccaggacagctccatttagccagttgggctgctgggctaagtgactgactttattaaaatcgccaaatgcaaacattccaagatttattttccttgcttataattttgctgcctttccactggtgggctgtttatttctaataatttggtagaaaaaaacattggctcataccagtggaggtcttatatgccaaactgcaaaccagagcacattttactgaggaataaaacccctggaatacaggctccggggggcccgctgacggcaaatttacaagcgtagtacaattgacgccattataattagttccccccaaaagtcttatttttcagggcagagatccgactctttctctttacacatgaatatctccggactagagcaagaacattacagagggtgagtcatagaccggctttgggctttaaagattaacgcagatcctataaatctaacccacattcttttactgggaatgactgacttttatgaaaaccaaggattgtaaatcagaaacctaaatagcttactttgcagcagataaacacagatttatgtagtgagggagccctaagttaaccctttcatggggccacggcggacctgagggtatgtgtgcggtgggggtgggttccatcagcactgatgttcctttctaaacactgcacggtggagaggagacatgccacatgtttatctccagcagactgaggtgggaggcaggaggagtgcgtcttcttgagccaagtgagcttcctactgatccatctcagctgggtgcacgttaagcagacaagatttggcccctgattatttcaaaggacagtttccaacttgaagtgacacacacaccagggctaacctagaaggggcttctgcactcgtgctcgtatgcgagcctatggtagcctgggcttctaatcatcagctgtgtaatctctgacaaagcaccaaacctctgcggacctcaaccttctcgtcagcaacatgctgcacctgtcatgtcataaggattaaacaggacagttttgtaaggtgcttaaaacagtgctggactcacgctaggcactcgatacatattagccagtattattcctattgttactagagccactggttacatagaccgggcttctcaaactactgcgcacacaagtcgcctagggaccgaattaacgtgcagccctgatgcagccgcctgagacccgcctttgcagcagcctgccaggaggtgcggatgctgccggcgcctggaccgcgcgttgagcagtgcaggtgaacagctcgcctaacgcacaagccacgcccacaccctttctacacgctttctcgttcacttctcattgcaactccttccgccgcgtggacaggttcagcactctcggagtcgatgtcattattcgccatcgacgcgaacctcggcaaagagacgggtcttaccggtctccgaatgttctcaggccctaagcgcgcagccccgcacccgggtgcagccggcgcggtcccacgtgtccctaccgcgagccgctccccgcgtccctgctgccgccgcgcgcttaactctgcctgcccgcccgccccgccccgcccggccgttcctgcgcagccctgggtcggcctcgcgcttctgtgtttaaacaagcctcgcccttgtgttgcccactgcaactttaaagggaaacagggcccgctgatcccgggagggagagaaggacatctatcatttttatgtggcatttcaaaggaggaggcctaggcagtccacagacaaaggcccgctgcggggttaatggagaacccccatttaatcattaacgcttaatactaaacccgcccagaggaggcccgcctgaggggggtgcagagggtcgccgggaggccctggctcagcccttgggggctgaggggccctatgggggtcggacgggttcagggctgtcgtgggttgctatggagttggggctccgggccatccttgcagaagggggtttctgctgaagctcagggtgggagcgtgagaaaggagggagtggtcaccgaggaggcaccaactggggaactgagtgctttccacaggctccccttgccctgggaaggtgaaagcattagtttactttctaggcccgacctgaaatccgagtaaaccacgcaaatccacgcgcacctggcctgtggtcccctgcgaatgtggggcctccgcagtgcttcctccttctgccagggttgtgacatgggcatccccaggctctttggagcgcccctccccaccccactcaaccccagcactgaggcatccccagactctgacatatgctgacgccccccaccctcaggtgcccacctctcacccctctgtctgccccagctccccacccttatcacattttaatcacttacctggagctgggaataagctgcctcctcattgttttcccaaatgcttgaacaaagcctggcattgcacagtgagaaagtcatttcctttccaatgcccctccaaacctgaggaggaggaggagcagaaaacgtggccagcacaggctttgacccctgctgcgcacctgttcagccttttcttaaaagaggagagcagacctcaggccctaaactgaccctggtttctggccagaatttaatacgcaccgtagtgtgttaactcccttctacttaacttttaatttttttttattttgaagtttagcaccatccgtgatgttaactggatgtaaaacggagtgaatcatcacaaactgaacaacctgtgaaaccagcacccagatggagaaacagaatttgctaattttgaattcacaaaacagaatttttctgggctccgggaagcccctcccccatccctttccactctctatccctccttccagaagggcagccactctcctaactcccaacagaagataattttgcctgcgtttagttttccatcagtcatttaaatggactcacctgggctcagcttctctccctcaacctgttggtgatttccatttgtgttcagtggtatgtagttgtagatttttcattccctttgctgaagagtattcattgtgtttatttttatggtgactttctatgtgtaatacacagatgccggttttctatttacctccatctctacatgttcaaattacaaaacaataaaacaaatcgagttcatttaaaaaatcaaacacagccctggtgggacacagataccgcagcagtagtgtggacggtgcatgagtcgttaagatgtggcatttcaacctagtaatttagagagatggggcttctgatcctgtgcacatgcctgggttgggccagttttaaaacttgtcaaatgggagcttaatagagtctcctgggggctcccttgcaggcccagcaccacggtggcatcccccagttgcagctccctggtatgtattaaaaggacctattgggtttacaggtgtggcctccagtacctctcccaaagcactcatgtggtagaagtgggtgggcctgccttagggctctcaggacacactgctgacctttcctgcctccctgtgggaaaattccccaggaggagataagatcagtatagttagggccttgcagggggcctcctgccccaggagcaggatagaaggaaacagttcagatctggcttaagccaagtgcctacccctatccaccaacccccgcccccagggctctgtctccaactggagcttctgcaaatcctgctctcctttccctgctgagggagagaccctcctggaaatagcacccagccaggatcccctcagggctgtaagcaaaggaaggctgagagaaacttgagcccctgctttgggctcaattcgctcaattcggtgtagatttcagtttctccctcaagagagcaaaagtaactcacagaccctaaggagagatgatactgacttgtttaccttcagatagtgctttgaaagtcctgttgactcattcatcttggagatccgatcaccctgcggttgatctcccacacttactaggctgagaagaaagacgtctcttctctccttacaaacccaaatttgaatcccagctccccatcccttcatagctccgtgaccttttgcaagtcccttaacctctcccaaccttaatttcctggtgtgtaatgtgaaggtaatagtacacttcttgcagggcactggtgagaactaaatgggctggtgctgtccaagcatttggcaagaagcagctcactaagcagtgttgggctccatatgtgcaaaaagagggacagaaaaacctcactttgaacccaaaatatctagtttttaaccccagttttgggtgcttcttcattccagttcagttttttctttgaacagaagagagaaatgagagaaagaggcagagctctgcttgtcataccaaggtgattctggctggcttagggtctcaggtttcacctgcagtgtgatcctcccggggcttatttatttccaatgcagccttcgagatgcttccaaagggatatctcagcaccctcagcaaaggccccagtgcaggattctagcaaacacctgccgcaggatagggcctctgctacttgggaaaccttactccctactccctaaggaccacatgttctattctgggactcacaaacattattagacatttctgatgcttaaaagaaaaaatccaagttaaattccaaaaaatttatgtgcaacaattgggttttcctgtcttgaaccgagattaaccaacttgacatcatttgcctgggattttcctggttttagcactgaaattccccatcccaaaacacctccaatctcagataaaccaggataatggatcaccctacccaaatggcttcatcacattctgctctggttatttgctgcctcaccctaattaatagctacgtttattaagcagagactctgctaagcacatttcctacataatttcacctgactttcctaataatcctatgagtaaatattattattattattattattattattattattgaaactagcatacttcctgtttctgtgctaaacaatactgaaactaggaaaaataatttagttgcttgctctaggaaatacttcctgctggaaaacaaagctgctgccctgttttcttatcaagaccaaaagcttgctaatcattactcactctaagaccctagcctgacagtgcacactgatcaaaaggtccagtctttcaagagctgccttaaaatcacacagctcagaagagaaagccctgtcaatacccttctttctactcctaccttctgagactgtgcaggtagtgggcaccctaccttctagtatactttcctgaggttctttttgagaagtcagctgtcagcattatttccctagttttaatgaggcatctgaagctcaaagagatgaagcatttttttttgatgaacagtgagtacttactggttttgctggttgagtccctctcagggttagccagttcccccaaacagcaaacaagtttcccacaagaactcacacaagcaaaccaaccaatcccaaccacacacccacaaccccctcctctatggggctctcacactctgggccactgttctcttgccctagctaccttagggccaggaaccagacaactagggacagccctacaaccccagagcccactggaatgaggcacaccagccagccctccgcctgctgggcctgacttacctgtttgctcccttggaaaccacaataaagtttcctgcccatttccccctccccctccccctcctgccaggccctggtgcttccccgagtgcccacccccactccccataccccctgccccatagtgtgtcctgccccttctcctgggatttgtgagtgtagcactattccttttcaatggcatccatctcctgatctgttggcctcactgtacctgattaataataaaactttccttttaaaatacttgtgtctgagggacagagggcagctctggtcacaggggtcacagctaatgaaatccaaccccgttctgctgctctgtggccatggtggcaccgtgtgtggcatcaccaggctgggccatgctgggctgaggctgagggctgctaacaagtgtcctttgtgcaaaaccacccattcctatgggctgcaggctcctcttctgcccaagtccataagagtccaagccagtcatactgttcagctctgcacctgccgatgacctccgagcactgttgtgtgctcagcagccctgacacagcccctgcctcatgggaccaccaattggagggtaccccagggagcaactccccagcccccagtttctatgtttctgtactagtctgttctcacagtgctaataaggacatacctgagactgggtaatttataaaggaaaaaggtgtaatcaactcacagttccacatggcttgggaggcctcacaatcatggtggaaggtgaatgaggagcaaagtcatgtcttacatggtggcaggcaaaaggcatgtgcaggggaactcccctttataaaaccatcaaatctcgtgagacttattcactatcacgagaatagcatgagaaaaacccgcccccatgatccaatcacctcccccttggcccctcctccaattcaacatgagatttgggcagggacacaaatccaaactataccaagctgtcattaggaagtaccacagatagagtggcttaaacaacagagatttattttctcacagttatagaggctagcagtccaaaatcaaggcattggcagggctagtttctctcaaggcttctccccatggcttgcagatggccaccttttcacagtgtcttcacgcggtgtccctctgtctgtgtatgcttctgttgtctttccatgggtccaaatttcctcttcttataagcacaccagtcacattggattaaggcccaccctgaagccttcattgtagcttaattacctctcagaagattttttcttcaaacatggttaggttctaaggtgctgagagtgaggacttcaacatctaaatttggggcagggacacacttcagcccataacaggtggtgtatgcacatgtcagctcaagcacacaagatggaacacaagtgagcaagtggcttctgtgtgaggaaggtagagaaaattcctcaagtgtataaggctcaggatgggatccatcaccttggggcaaaatgtccagctctagtcccagtctgccatgtcctggccacagaacctcaggtggtacgcctcttctcaaagccatgctttcattgtttcaggagggagaatgatcatggtctcggaggctgacggtgaggagttaacagtgtaatttgtgtgtagcagttccaccagctgacatttgtgagaatgacaactttgaatgacaacttcctttttaattttttttttctaatttatttttgcttccctttagtgagctgtagggaaacttttggcattttccctgcctcctggggtttgttttaaagtccaagtgcttagtaaatgtcagcagttggatttaaagattcttggtaaaaccagcttgagagacacaaatgtgctcatagatttgtacatgattagacaactgtcaagtgcagtagaaagtagccattgggattattttccaaaggtcttagatgtctccaccactctgcctctttctatgagctacttaagctcaccctctgttacctactgaatgaatgtttgttcccctcaaatttatgttgagatcctaacccctgatgtgatggtgttaagaggtgaagtttttttttttttttttttttgagatggagttttgctcttgttgcctaggctggagcacagtggcgtgatctcggctcactgcaacctctgccttctggtttcaagcaattctcctgcctcagcttcccaagtagcgtggcctggctaattagtgtatttttagtagagacggggtttcgccatgttggccaggctggtcttgaactcctgacatcgtgatccacccacttcagccccccaaagtgctgggattacaggcatgagccactgtgcccggccgaggtgaagtctttaggaggtgaattaggtcatgaaggtgaagccctcatgaatgggattagtgctcttagaagagatacaagaggctaggcacggtggctcatgcctgtattcccagcactttaggaggctgaggcaggtggatcacttgaggtcaggagttcgagacaagcctggccaacatggtgaaaccccgtctctaggaaaaatacaaaaattagttggatgcagtggtgtatgcttgtagtcccagctactcatgaggctgaggcatgagaatcacttgaacccaggaggcagaggttgcattgggctgagatcgcaccactgcactccagcatgggtgactgagtgagattcggtgaaaaaaaataaaagagagagagatacaagagcttcctgtctctgctctcccccatgtgagaacactgcaagaaaacagccatctgcaaaccaggaagagggatctcaccagaacctgaccatgctggcaccctgatcacagacttctagccttcagtatgtgataaatacatttgtgttgtttaagccacccagtctatcacaatttgttacagcagctggaacagactaaggcacactctccactggcatttctcaaggaaatatgtagaaaagcaagacccattcctgtcctgaagagttagcatggactgggggaggccagatggtaaagcagtcagcaaacaagatagaatgaggtcttctcaccccagaaaatgccacttgacgctgtgagcagtcttatagagggtaattttagatcttattacccagcaggggtgacttaagagcagcaatatcccttgagcatgtctagactagggaggatgaaaggcagtccaggcgacatgggaaacgctggagaggtggtgaaggagagggaggacacagagaactggtgtggagacatgtttgcctggcacatggcaagaaggagagcggcagagaagaccaagaaggaagctgtggcttgaatgccaagttgggacatctggacacacctccttaagtaacagaaactaaaaccagtattcagtagaaattgtcctcatctaagttgggtttttggaagataactcaagcacctagcagagtggactaaaggggagcagcactaagcaggtggcccagctgtaggtatgccagtggttcagaaaagaggaagggaggagctggtctgggtagaagcagtggggacagagacactggggaggcggagctggtggccagggcagggtgtgggtggagagaagagtttcctgttgctgctgttacgaatcactacaaagatggtgacttaaaaataacacaggccaggcacaatggctcatgcctgtaatctcagcactttgggaggccaaggtgggcagatcatttgggaggccaaggtgggcaaatcatttgaggtcaggagttcaaggacagcctggccaacatggtgaaacctggtatctattaaagttagctgggtatctaaaaaattagctgggcacggtggcacatgcctgtaatctgctcaggaggctgctcaggaggctgaggcaggagaattgcttgaacccaggaagcagaggttgcagtgagccaagatcgcaccactgcactccagcttgggtgtcagagcgagactctgtctcaaaaacaaaaacgaaaaaaacaaacaacaacaacaaaaaaccaaccccaccaactccttgcagtgctgtaggtcagagttttagccaggtctgactggactaaagtcaaagtgtcacaggctgcacccctttctgaaggctctcgggaaaaatccatttcctcatgattttttttcagcttctagaggctgcccacactccattccctgtggccccttcctccgtcttcaaagccagcatctctctgactttttttgtgtgtgtgatcacgtctccctctgaccacagttgggaaagtttctctgatttaaacaattcatgtgattagattgggcccatctggacactttaggataatctccccatctcaaggtccttcattgaaccacatatgccaaatcccctttgccacatagggttacgtgatcacaggtttgaggaattagcatgtggctatctttgggggccttattttgcctaccatattcatttagccacaagctctaaatccaggcaggaacacctctcccggggagcccactgccttcatgctggtccactgtcctctctaagtatttgactctgaattacatgaacagtcctctttcttgcagcattcaacccaagttgtcagctccaaacctatctcttcaactcctctgccttctcctaaataatgtgatttttttccctcagtcccctgggctcctgctgtcaccctgacctctctgtctctgcccatatttccttcttcccagatcagcactgctcacaaggcctcctctcttggtgatgaaccctcagatgtctggaatatagaaaaaacttccttcagcaagctcttggttcagccaacgtctctgcaccccctgatgccaaggggagagccttctgcagatacttccaggccagcatctcctgcctttgcctgtgtggagtcatcactgtctctgcactcagggacctgcacatacagaaggaaggctctctctctatccccacatggttgctgctgagagcagcagaaggcagccaaatgcctaggcagacaggggcaggtcactggtgaaaccccatcttcaagccgaagacagtttaaagcctaaagctacaagtcaaatcctcggaccagtttgcaaacttgtcttcccatttgttgcactttcctctgattgatccccacccttcacctattttacatagacctaccctttcctaattggttttctacactgccatgcccacctttgagtggtgtcttcactttgaccttttttgcctactcacaaaccaatcagcatgcacttcccattctgagtccataaaagaccccagacccaatcacatggggggcctttcccaccttcggataggggaaccacccctgggtccactctttgctgacagctttccttttgcttaatgaattcactccactcactctccagtagctgcacacctaattcttcctggttgtgagacaaaaactcaggcctagctgagctgaggagcagaaagactgcaacattttggtggctcatatggggatacctggagggtgagtaaatgtggtcccaaaccctctttcacctttgtttctgaggcttctcatcctcagacttttttctgaaggcagatgaagcaccaaacctctggtgagccaattaagaatgaatgacgcagttacagaggacaggatacaaccctgccacctctctctctctttcaggtcaaagagatgttggctttgtttcccttcatggaggtctagccatcacgtggaaccagaataaggtcctggggcaactgaaggcatctggccgaggacttaattgccaggaggcccctagacttggctccacccctgaccaccccattatggcatcagccaagacccgcagacttttctatggtatttttcttttcttctttcatggtttgaagtggctcctatctcttcttttacagcattaagtgtgttgttgcaaactgcagaaatattaccaggtagaatgagcatttggcctagccatcagatatgcaattcagaacaatgtgattttcatctgttcttagaggcacgtcccctacccccatcccaacagccacaagcacacatggtggacaaatgggtgcaccgcagctacccgctcccccctcccctcctggctggggcatgtggctgtgtccaacgcatgcctgtgctgcatccaacagccacgcagggcaggagtgagccgtgtctgctgcctgggacccagggaaatcttaggtgccaggggccctgcacagccagctggtcagcattttctgcccaccgccccctcccaccacacacccattgaatctttcctctcatggctcagtctgaacgagaaggagggtccagtgactaagaatctctcccctttggaggaacccatttgcatagagcaagaagttttttccccccaggcaccttccctgccctgcacttaagctgtttttttttttttcttttctccaacatgtcggtagttaacacagccctgcgaatacaggaagcttttctatgtgaggttttttttttttttttttttttttccttttgaaaggcattttactaggccaggacccaaaatcacagaactcccttttctctcccttgtttgaggatgacccagctctacagctttactttagcatttgacttacataaggaagcagcagaggagcgaccctgttggctgttggctgctggctgcagtctggtgaggaccacctgggacttgatgagtccataaaccctcctgaggcagctttttgtctcaaactcaattccaagcttcagactgaagccctagtaaggaaaacgggatctgagggatccagaggcagatgacaatggaagtcaaggggcacagcacaggtgagcgtgactgactaattcctgctgattaagtcccccttatttcaaggatagaggtcatgctagtatccatgccataaatgaggtctggggaacccaaaggttactgatagcatgggggacaggcagcatgtgggcaaatgcagataattcccatcccctaggcaccccctgttaacatgggtgaaagcctcattggcacccatgggcagcaccctgccaaggtcactgggactcagggatgtaaggacccaaaaaacaaatggagatgcctcttctttctctccctcacataccctgagtattcactgggaagagaaagtaactagggacactttcttcccctctttcgagatgggtaaccaatcttcttcagtctgtacttctctgaaatgcctcctgaatcactgtgattcttttggaaaaaaaaaatgccttctttctgctttttcctcctctgtcctctctttggggatgggtaattgtgtccctgtacctaacataggacattccccttggatgtgtcccccaaactgggaagagttaatttccccaacccttaaaatgcttggcttaaaattgagcttgggtgaagggaactcagaagcctgaaatgccagcaaaagggtaaagatttcttaccagtcagacttctggtctccctctccctgtgcaaaccagttgaatgaatgagaaaatcactgtttatatcctctgtaagattttgatgcatggaaaaaaaggatttgtgaggctaatcttaagctgcagccaatctggtgtactttgtgtgtctttctgcatggttctgtcataaggaggaatacctgaggatagagcatggcctagtaccccatgagcccactgttcaagccagccccgcaaactggtcagtaacgaactgtgctgcaggtctccatcttgtcttatgtccttggcagcttgaccttgtaaccacgtggcagtcctttcttttggtctccaccattttacagtggtggccagggttcaatcctggctttagggaatgagtactttctgcttaatatctgtgacttttaccatttcctgattctcttcccttcgatgaacaacttctagcttcctttcttaaatcttcttttctcggccaggcatggtgactaacacctgtaatcccagcactttgggaggtcgaggcaggcagatcatgaggtcaggagttcaagaccagcctataatataaaaaatagccaggtgtggtcgtgcacgcctgtagtcccagctacccgggaggctgaggcaggagaattgcttgaactcgggaggcggaggtttctctgagctactttaaagattccagattttgtaaaaactacttactaccttataaaaaataccttgtacattcatggttaagtcataaccttagttgaggcttcttggtttcaactgtgaaggtacttttggtaaagttcaaaggctagaaatattggccacttggtgtggctaaagtctggtaacaaataatttaaaaggattttcttaaagagcactatcgttaaaagtcagcttaattaaaagtggctatctgagctgtaggtatattgaaaaggcctttgtgtttttctcttcatggatcttgtttttctggaaaaagattttttttctcagtcgactgaattacttttctccattttgtcttgccactctcagtacacgcgtgagaggccctaagataacttctgagagcatgggactcctttgcaaaaacagagaagctgccacagaccccattttttggggaaaaaaacctttgttttccttctggaaccccaggaattaaaaagcagctagatccctcttaaaactggttttgtctttcagctatgcttgttattaggccctagaaactgcatattttcctagccctgtttcttgaagggctccaccctgaggccagtaatccaattaggatattggcaaatgaaaaatcttacaactactggatcttcttctgtccatctgtgtaaccatgtatgtgttatgtgtgtgatggttatattaaaaagaggtctagtaaattggcttaaataaaatgaagtgcttagatcaaatattttttgaaggaaaaataaaagctgtaatgccttttagttcatgagactttaatctttgagaaataaaaacagttttaaagataattggtaaaatacaaatgtcttcaaaatgtaaatatgtggcctaaattatgcggataagatactaggtttgctaagtattttaagcttataacctcttctttggcttttgagaactgtttgacttgcctgttttataatttggtaaggcttggggacatatgaaattaaccacgcccttaactatgctggaaagagtcagattttatgtgcactgagtacatgattaaaataactcaccaggttttaaattaaaatttaaaattgctaagagttgccattataacatgcaattgaaactactgaaaagagatttacatgcaaaatgtgcaaggaaagtaacatgtgttttgagtaaaagattataagaagacatgggagtgtaaagttttgcctagtttagagggttaaaggattgttttgaattagataagataatgctgtggctcacgcctgtaatcccagcactttgggaggccgaggcgggcggatcacgaggtcaggagatcgagaccatcctggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactccatctcaaaaaaaaaaaaaaaaaaaaaaagataatgctgaaggtttaaaaaaaggtggaaatcttgcaaaaagaaactctgtgtgtgaacatattgactaacctcaaaaaggtatcatatggattttccataaattgagcattgaaataaaagcacaacaaggttttattaaggcactgacttgctctttaagaaaaatagtaaacaataatgaatggtttttgtcttttaaaaaattattgagtcatcattttgactaaataaaatgacttacagtaatctggaattctacttcacaatatcaagtgctttgaacctctaacatatttaacagtcttcccaaaatcaaacttgagtttcaaggttgtctttcctgacccctaacttttggatgctacagagggcccctggagcgtctgaaggagaggtaaacaagattatttgacatgtttagtcacgtgggattgccaaaataaaaataatgtttaaccttcttcaggttatattttagtgaataatgttaatatatgttccaaaattgtatgggatttctaaaaatctaatgtctgagtatacgccattgatcataattaaggttattatgttaagctattttaaaccatagaaataaccaaatttctttgtcaatcatgtttttgactgtaactaccctggacattttgtcattcacagatgattgttgtcatgctttgatcctttgcaaaagctataggactttgacaggtgctgtcaaatgcaggtttctgatagctttggagattgtgacattggaatagaggggaacatacaggactcatgaagaactgaaatgcttatgaatatcaagcagaataagagttaactgaagacactgaagtatcagaaaattgaagtaattttttaaactttttctgaaaacactgcagacctttattttttcagagccaaggaaacttttttgagcatctacagcttctaacatgagtaaggtatactcttataaacaaaatttggagcatatttttttctctctgcttggtttctctagatttggaaactgtgagtattcttaagttatgggaatacagttatttggatcaatgcaataagaatccattttcttttgcaacaggatgcaattggagaaacaggttgttttaccaagtctttgactggaaatgtgtgcttccctttaaggaattgagcttgacttgcaaagccaataaaatccccttgggaaaactggcctcataccttgtcaaaacagttcctatacagggttcctaacctgtggtgagtaaacagtgtcatttctaacaggcccaggagccccatgttgtcttgggacttgaagaagagagggatttatccaactcataggtatttgagggtacaaacccatggctaggctcggctttaaaaggtcttatctgagattccttgtggaatggagttccatcaaagccaatttaaaaagcctacatgaaagataattattcttgttacactttatgcaaatgatcaagccaagactaaagtttattttgaaaacaactcagtcctatcatgatttgttttgacaaaaatgtggattggagagaaaaaaaattatgtttcaaaacttatatttgtcattgaattctaatctcagttgtttttaagtttttgcttacattttagactaagactgcttattcctgtgaactaaccagtggtctctgggtgcagcttagaagaaacagaagggatgggtaatgtaaaaatctagatcaacattctagttctgagcaattatcctgcaaatcctgccaggtgataggagtaaatagggtgcctattacctggaggtttctttgtttgggaaaataaggccagtggagctaaccaaagccaagccccatgaacccaactcttagcaagcaaaactatagccaccagttatctgggcattccagcagcctcaggatttttaagctgtccttacccccttgtttcattttgatacatctcttctaataacccggtttgtctcttcttgacttcaggctgtcagactccaaaaggtcatgcaattggagccttggataatggctcccattcaccaagttcctttagataagcctctgagggagatctgactgctgttttcccaaaacatcgccccctgtcagcaggaagcagttaagattggtcttcatccctatgctaatggcagtgagatatacctcttcagaggggggacataagagtggcaggaggcagccaaatgcctaggccgacaggtgcaggtccccgtgaatccccacctccaagccaaagacagtttaaagcctgaaagccaagctacaagtcaacccctcagatcagattgagaacttgtcttcctgtttggcatgctttcctctgattgatccccacccttcacctattttacgtatacctgctctttcctaactggttttctacactgccatacccagctttgagtggtgtcttcactttaaccttttctgcatactcacaaaccaatcagcatgcagtctccattctgagtccataaaaggcccaagacccagccacttggtggggactttcccaccttcaggtaggggaaccacccccgccccaccatcccttctttgctcaaagctttcattttgcttaataaattctactccacttaatctctggtgtccacacacctaattcttcctggttttaagacaagacctcggacctagctgagctaagaagctaaggaccacaacactgccacctcccaggcttggaggatagcacgaactccagaactcaccagcattggaagagtccataactctcctctgagcagactgtgatgcttcaggataagaccagagctcccgtcttttccccaagtgagcccgccccaagcgtgctttgtttttcaaagcctcaggagcaagaaatgcagaattaaagccaacagctcagctctgaccgtgatatcaggttgtgtttgtcccctaaccatacacaaacatgccctgcccttgcacacccagcgtctgcctgggctgtgttctgagcccttgcagtcagctcagcccacggtggcaaaacaaacacacagggcaattctgcagagaagagctgcctaggggcatttgggcccagattttatttgaagaaatgtgggagaagccacggcactctccccagagttcctgcaaacacagcattcatggctgtgaggactgggatggggacaagccacctctccagagccacctgccaccttgctcctgtagggaccctcagctccaagcaaacctgtttaaaagcaaacctccaagcagacaggcacctgtcaccacccacaagcctgaccttctccctttcctttggctctgctgaccccttcctgtctgtgcagttccacaacccctgctggccccctgacactgtggtcttcctggtccaatgctgggcaatggggaccctgagataaggaagacggagtgccagcacccccagacctcacattccaagggagaagtcagggacttatacagactaatatgattcaaggcactaagagcccaaacaatgggacacagcctgataaacagcctggagagtagggaggcaatcagggaaggtttcctgaaggaggagagacctgagcagagtggagagttggccaagcagaggaacttgagggcattgtcagcagaggggatggatgcaacaccaccttgaggagatccttcttccctgcaccttctcacctccaatctcaacacaaatttctctgtaccacccactggtgtggcccctggtgtatgctgctctgtgtagcagtgtgttcatctggctgcttggcatgaccagactgtgtgtgtgtgtgtgcgtgtgtgtgtgtgtgtttgtgtgaagagagagggagagatttatactctccttctaccctctgtgctgtccccagaacactctccattaaagcttgttgagcaaatatcaatgacaacatctccagcacagccattgaagcctcatgcttcatcccaagcctggggtccagcgcaggctctgccccttcccagctgtgcttcttcaaccgtgagatgtagctaatcatggcatcagcctccagggttcttgtggtgactatgtcaagtgatgcatacgtgcagagcattcagcaagtgcctggcacacagaaagtgttaaataaatggtagctattattattcttggtggtattctaaagctcccacagccactgtgccaatgccctggctggcattctggaggccccagggcacagtgaataaaagctcccatttaaaggccaggtcttgggggtgagtcctgccctggctatgcaacctcaggttggtgcctaggaggacccgggtctcctgtgaagtggccgactaaggctcttggaactttcccagaacaacgatctaactccccactgccctcctcccccaacgactgaccatagctcccagatctcccatcagttccctgctttggagtcgtggacactggcccagggggactggcctctgtgccccgagagcctctctggccccctccacacactgactcccagcttggcagcaggcagctgtagaatttacaactgtctgtccagccttggcctctgcccttgaaggtgggggatgagcctggccctgctgctggccagcgctgctccatggggagttcctgctgcctcccactttgctgctgagccacttcctaaaacccacagaggctgaggagctgccaagtcctccaggaaaggctgaggcaagtggtacctgggcaggcagggtggcatggtggctgtacacacgtgcttttggagtcttggatccaaatttcagcattgcccttccaagtcccagaaccttggacaagtcactcagtcactcagagccgctgtttcccagctataaaaatgggaaaataccagtgctctccctttgggctgatgattgtggaattacatgatatttgccctcagcctagtgcctatgtcaaggaacaatagatgtcttcttaaaaaagaatgtgctattagcctaaagctgccaatcaagttccagaagcaaacagtgcacaaaatgggcatctcctgaatcacaagtggccgcctttacagcttgacttggggacccaggaaggtgagagacagtaaacagaccggaggagatgctacctgggcctgcaggaggagcaaggggtgcaaatgtagggtgcaggtcccaaaggacccagggaggggaggaggggaaatacccactcctgggcgggccctgcagagggagtctgtgcactcagcacagagaaaggccctggcagtgggtttcccttgggtggggggatccctgatgctcagccctgcagcggtgcagagcaaaggggcgctgagggtggcccgatggcaccttcttatctgagtgatgtagctgggggctcagctggcctgtggagtgcctaggaacaacttgccagaagccagattggtattgagtgcactgtggctggagctgccattcggttggactccagggggtaaagggaggaaacatggctgaaatggcggggggaacccaggggctgccttgctgggcatgaagtgttttctggagcaccggagtgattagaactgcttccctccacaaggcaactcctctgtttgggctttcacaccgggggagatgctcttttcctctttcctgtgattttttgtggtgagtagacactggccttctcgactggaacctgaaggtcaagaaagaacgagggtagaaaggaagcctcggttcttagggaccacccaagggtcttaggatgaagcccctgggagggaccccctgcacaactccctctggatcccgtgatcatggagcgggagaacagctggtgaaggctgcaggggtttcacatcccaggtcttggccaatttgcttccaccacagacatgattctgagtgacagaaagtgtgctgctggcacaggaggccaacaggacgtccgggagttgtgaggctccaagattgagagggctatggcctccttactctttgagtcactactgaatgctgcctccttatagaagcctccccgcgccaggtttctctatgacctgtgctctctgtttcttccacggtgcaaattaccatttgtaattacgtatcaatttgctcctttgttctctagaatagaagcttctggaagaaaggggcctggtgtacctattctctatggtatacttgacatgccactagggggcaaagaggacaaaagggcttcagagaaaggcctagacatgcgttgctgaaagcatttgacatttgggctgaggtggtgggggagaaggcaacagcaatttctaggcacgggaagagttatgtcatgcaaagtgtaacctggcacagagcaggggagagactggagaccaggagacaagtttggaggccactgccatgggttagctgaaacagggaggggacttggagagtggggcatggcccaccagagaggagataggagaatcttccagaccctaaagccaacagagaagagccagttcatgcagacaggagatacagcgggaagtcagagcacgtgtccattcattaacggggtagtgccatcatccaggagggagtggggctgcagggatggagacatggagtggtcatcataaggaacgtgtgcttgaagctactgcaattctaaaacaaattggagaaacagattttcaccatagactttcattctaccactctggagttccaatttggcccagattctgatcacccaaagcagaaacatagaggagaaggacgctggccaaatgccctcggtgcctttgggggtccagtcagtctcccctccagtggctttgtgttcactgtcagcagagcacacacctccctgccactggaggccacagcaagtccctgcaagacccacagaaagctgaaccttgttagctttcagttcccaccagcacctctaggaagcccagcggaatgggggagagctcctgtactccccctgcactgccttctgctgctgttcgtgtcaaagatgatgataaaggcagggaaaggggatgaaaggggagtgagttcagagacagggacaacaaggagtgctgtccatagagccactgaatccacttagagaagagcccacagccttcaggctggcccctttcaggaatctgtaatgtgcccccactctgtgagtagcagaccctcctctgagtgtggaattacatggactcacatatcactgcttaacccactagggtccttcccatccacacaaccctttttatagcttgcaatgactgaaggtttagctagttccaagagaaatgccaaggagctggtcttaaacaagttccccttgtccttcactggcaacttgcacttccaactcgggttttctgactccctgcttgaacatttctgggctggcctcctggccatcagctctagatcattcgcctcccaagcctctctacttcctgtctcttcttcccattccatggaaaatgcaaaccttctgtgtagagcaaaggcctgtcaatcaaagtgcaactcacagacaaaagaatcaccgcagtgggtggcttcagaactgtgtggctgccagagctgcctgagtcagtggagactgtgaacctccactcgggtgaggagcaggctccctcctgggctcctgctctgggacaatgggtggggaaaagggaatgagtgtgtattctgtgccttttcattccgagctttaaacacatcatctatgtcgttgatccctcaccaccatcctgaaaggcagactctgttatccccactttacagatgaacaagcagatgctccaagaagtcacatgactttcccaatgccatcctccttaccagggacagaggcaggatttgagtagttttgaccctaacactgcttctctttcccaagcatttgacaggaagctgtctgcaatgctagcagctattaatgtcatcaggacacaaaatctagtaaggcgacaaaatatttgaaaccaggactgacctggagaatttcagtgtcaggaggccacctgtagggattggtggaggtcctgaacctccctgtgacttctggagcagccagcacctcgagccatctacagggtggggcagatttcctccatcaggctcaggtggcatctcctagcttttgcccagccaggacattgctagctgacatctccttcattcccatctcacccccactcattactgccaacatcattcacatatatcctccctcccttctgttctccttgctaattacacacatgtttctagatactctctcaattctggttgtcttcaagccaaatttagggctctggcaccaatcgttgctgccagggggcttctcagagactggaagcaccaagtgtgatgtctttgcctcaggaacatgtctgcaatcatgtctgctgagctctaaccccagaggttgtgattcttgggaactatatcagggcccaggaatttgcatcttaacaggctccccagggaattctgatgctggtggtctgggcattgcacttggagaagctctgaatgaaaccattgcagaatgaatgcaaactttttaagtgaaaaaggaggtggaaaatatacttagagaggtggtggcggtgggaagggatgctgggggtgggagggtgccgggaattaacatacatggagctccggctaggagctggttacttttgatatctcatcacctttgggccctacaacagccttgcaacagacaccttatttgcccttttcacaaaagaaggaagcaaaagtccaaggaggttaagagacatacccaagttttcatggactgtcagtaaagacctggaatttgaagctacatctgcctgattccagaagctttcacaacctgccttgccccactgatgactcagaaggtaccagctaccggatgcttttatacagggctgggcacagagtcagctttcaaaacatacctgctagatgaatgaagaacgagtgaatgaatgagaaaatgaaataataaaactgctttgagatcatggaaagtagcccaagaggttccctctgtgacctcatgctcaaacttcctctcccactgtttctttaatctgaaaggtgactccactaaatttgccccgttgataaggccatgcagctcacctgcacctgttatcagcaacctgaatccaaacaggaagccaaggctgagataagatcgaggaaggcaacgcctggaatcattacaaggctggaattagtttgttgccataagtaatctattgagcacctcctaagtgccaagctctgtgccaggccccaaggataacgcaggaaaccaggcagtccctgcccttgaatgtcttacaatctactggggaaggaaagtgggtgttgaagaaataattacgaatgggatgagtgatacagaaaggaagaagtatgaggccaggcagtcacagcaaaccttcctgaggacacaccctgtaggctgggagctgagcaatgaggagctagccagttcttgaagctaggggagccacctaccgctcttcacatcacaactatcccagagcaaaaaggtgcttgcttttgtgtttcttgcccctgctcaaaatggctttccacaggcgattacccatggtcaagctttgctttctctctgcttctactctcctgcattaccagggtttttcctccagcaataatggccaagccctgcacttttcactcaggcctcctgctgcctctcccagctgccttcagccagtgtctgccgaagcccccttgtagcggcctaggcagttgatttctaaacttttttttcttttttgtgaaaattatttttatagagttcgaaagtacacgtgcagttttgttacatggagatagtgtgtagtgaatgaagtgtgggctattagtgtaaccatcacccaaatagtgtacattgtagctattaggtagtttctcattccccaccacctcccacctttctgagtttccaatgtgtattattccactttatatgtccatgtgtacacagtttagctcccacttataggtgagaacatgcagtattttactttctgtttcttagttatttcacttaagataatggactccagttccatccacattgctgcaaaagacatgatttcattctttttatagctgcatagtattttgtggcgtgtgtgtgtatgatgttggctacgggtttgttgtatatgactttgcttattttaggttatgttcctttgatgcctactttgttgagtttttataatgaagggatgcagaattgcatcaaatgctttttccatatgttttgagatgatcatatggtttttcctcttattctgtttatgtgatgaatcacatgtattgatttgtgtatgttgaaccatccttgcatccctgaaataaaacccacttgattgtggcttattatctttttgatgtgctgttggattcagtttgttagttttttgttgttgttgttgttttgttgagtatttttgaggatctgtgttaatcagggatattggtctgtagttttctttttttgttgtgtccttgcctcatttaggtatcatggtgatactggcttcatagaatgagttaaagataattccctcctccttgatttttttgggacagtttcagtagcattggtatcagttctttgtatacatggtagaattcagctgtgaatccatctggccctcggccttttttttttttttggttgagggatttttttattattattactgattcaatctgactacttgttatcggcctgttatttgctctctatttcttcctgattcgttcttgtgaggttgtgtgtttgtagatgtttatccatttcccctagttttccagtttgtgaagatagagatgctcgtaacagtccctgatgctcttttgtattcctgtggtatcagttgtaatgtctccttttcatctctgattttacttatttgaatcttctctcctcctgattagtctagctagtggtctatcaattttgtttattttttcaaataaccaactttttgtttcattgatcctttgtattttttgtctcaatttcatttatttcttctctttgtaattcctttccttctgctagcattgtgtttggtttgtttgtttgtttgtttttgttccttgtggtgtgacattaggctgttaatttgtgttctttttatttttgttctgtaggcatttaccgctataaactttcccctaagcactgcctttgttgtatcccagaggttgtgatatgtcgtgtctccatttccatttgtttcaaaaatttttaaattttcatcttaatttcattgttaacacaaagatcattcaggagcaggttgtttaatttccatgtatttttattgttttcatagtttctctgggaattgatttctagttttattccactgtggtctgagaagatacttgataagatttcaattttttgaaatttattgagacttgttttgtggcctaacatatgctctatctatacagttctatgcactgtatattctgcagtcattgggtaaaatgttctgtaaatgtctgctaggtctatttggtctagatgcctaattaagtccagtgtttctttgttgaatttctatctcattgatctgtctagtgttgtcagtggggtgttgaagtgccccactattattgtatttctgtctgtctcttttcttaggtttaatatttaatagtatttgttttatgaatctggctgcattggtgttgggttcacatatatctatgattgttataacttcctggtgaatacattcttttatcattatataatgactgtcttttttttttcttactgttgttgatttaaggtttatttttattttatctgatgtaagtatagcttctcctgattgattttggtttctgtttgcatggaatatctttttctacccctttactttgagtctatatgcctttaccagttatgtgggtctcttgtaagcagcatatgtttagatatatttttaaatcaattccaacaatctatatattttaagtgcatttgatccactcacaatcaaagttaatactgatgtatgagtatttgctcgtcataatgttgtcacctaactgcgttgtagtctcatttgtgtaattgttttataagacctgtgatttttatacttttatgtgtttttgtaatgttaagtatcaaccttttgtttacatgtttagaacttccttgagcatttcttgaaggactggtctagtgataacaaattctcttagtgtttgcttgtctgggagatactttatttcttcttcatttatgaagcttaatttagcagaatacaaaattcacggttgagagtttttcctttaagtctgaaaattgaaccccaatttcccctggtttgtaagggttctgctgagaaatctgctgtctcatggagtttcctttataggtgattagacactttcctcttggtgactttagaatttttcccttactttggcttcagatagtgtgatgactatatgtcttggtgaagtatatcttgcaatgtattttattggagttttctgagcctcttgtatcaggatactaaatctctaacaagactagggaaatgttcctcagttatttcctcgaataggtttttccaacattttttcttctgactcaagtatacctatgacttgtaggtttggacgttttacataatcccatacttcttgaaggctttgttcattttaaaaaaactttttatttttgtctgactgggttaattcaaaagacttgttttcaagcttggagattcttttttctgcttggtctagtctattattaaagctttcaactgtattttgtagtttcttcaatgaatttttcatttccagaagttctatttgtttttgtcttttaaaatatctatgactttggttaatttttcatttatattctgaattgtttttctgatttctttatattgttttcaactttctcttggatctcactgagcttctttaaaatcagtattttaaattatttacttggtatttcaaatatttcattttggttaggatccattgctaaagactcagtgtgttcctttgtgggtgttgtaacagttttttcatactttcacaattgtttctctgcccttctcatctgaataaactatctctttttattattttttaatttactttcatctggataggatttttccctccttgatgttgtgtagggtcgtttggctttggttctgagtgctttcattggccatgactctatatgagttccttggttatagatagccattgtgtggtggctttctcatattctggttgtagtagtaatatactggacatgtaagcaggctcacagcctcctgcagagccagggtggcagaggtctcaggaagtatacctgttctccagtgcacacgtgtcagcagcttctgtgtgtggtaagattttgtgggtaagagctggcttcaagagaagcagatggtatatgcttgattttgtttactgggaaagtctctctgttgcctcaggcaatgggctgatctgtggaatgtaaagtggcctgaattgcctgctcagccccagatgcagggagaggggaataaagctgagtggagctggactgccaagcctaccacttggatactccaatggtgagcaaaagcactagccctgatgggggtggtgggggagctcccggtgaaatgcaccaaggtctccatggtgggggtaaggaggctaccccagatccacagcctgagcaagcaggaacatggtccactaccttgtcactgattgctaagctttcaaggattttgtgagctggctaaacaaagctatattaaaaattaagttagacatacaattaaataaatcatactatattttattaaagtcaaaggtcataaatactcaaaactcattacttcctaagtattttactcctattatttatgttctggaggaaatttacatctattgtatctgtatagtatttaacaatggtatatgtacagtggtatatgtaacagtggtactgtgcatctcttcccaattctgcattcagtgacatgaacttaatagttacaaatggccatgatgggagtatttataccacaggaattggtgtaagttgttttgtttattgtctgaatttaacaaagtgttgagaaaaatctaataatataattaaattatataattaaacttaaaagtgtgtcctatatagcagttttctagcattagacaactattatcggattcagcaaagaagttgctcacatcactgagtgaagtttcaacatatatcttaactatttcatttttgtctcatgaaaataccaaccaatcaacattcattagttgtacattcattggaatttttcaatgatgtgactgattttgctcattaaaatagtcatcaggcatttattcatagtctgattttgtcacagtatggagttgcaaattataaaaaccataaattttccatgaaataggaagtcacactgaagatatgactttatataggtatatagaattttcaattaagattattggatatttttattgtttataaattctgtgctgcaattctttttttttttttttttttttgtgagacagagtctggctctttcacccaggctggagtacagtggcatgatcttggctcactgcaacctccacctcccaggttcaagtgattttcctgcccagctaatttttgtatttttagtagagatggggttttgccatgatggtaaggctggtctcaaactcctggcctcaagtgatccacccacctcggcctcccaaagtgctgggattacaggtgtgagccacggcacctggcctgtaattctttatgtcagttcaatttatgataaacttatgttcatatgtacatatactttcttttttcaaaaactgggttgtccttagcccttctgccctgttttctctcctgtagcctgaagtgtttggagaattccacccaattatgttgaggagctacttctctgcccaggcaggtctctatccatttctaacattttccttcatgggttcacaaaccagttttcattttaaaggtaagccttccctctcctccacttttaaaatatttaaaactcacaacatttaaataaaggaaaatataggtaaataatggggaagccccatggccaagagcaaatctgaagcatcgtggctgcaggcccttcatggccagcatttttccctggctctgaagtacattggctgggaattctggagtactggcactgtgacccagacaccatacctgggcctctgcatctgccatcttctttcagacttttcactgggaaagcctgaggggctgtccctctcctgtattgtttgcttcaaggtccagctcacttctttcagaagtttctagacctttctagaaaagactgagaaggttcaaggtgtacagggctaataatactatcacggagctgaatctgaggtaagatgtctgccacctaccatttttattatcccgggtaccacaggattctctcattgtaatgtttgattatataattgggtctccctagacattgccagaaatacctgaagtcttatgtgggtcaggagtccatggtagtcagaagtaagacatttggcttttagttcagtgactcaggggaacatggaacagatatgagttacagctactgggcacctgacactttgctcagacatttaatgggttcccacttaatccttactgaaaccccatgaagtggatcctatgactatgcctgtaaacagatgaggacaacagggctgagagagttaactcaatgtgctggagtcccacaggtgatgagtggagactcaggttacaaacttgttctctcccctggtcctgctgacttgctgcccagtttgtcacaccctctggcctatgacctctcccactgtggccacaagtgcacttctgtaggtatcaggaccagatgggaccaatgacttgaaagaaatcactctgccagatatcagaaaatctgatcaaaatgtgagcaaatgaaagcaacttaatcattttctctgacttagtttttctgtttgtaaaataggttgttaagaagtctaagcgagaaaatctgcagagtgcctgacacacagttctgtagggtcaactttaattaatcctacatgagatggcactcataaaccacaaagaagagagactgccacatacggtgtgttcaataagtaattttccttgttattactaatattttctgacctttattagaacaatactgaacctcctgcttctaaaatacccacccgctgtagaagttccagtagctgtcctgcttttccaggacacactgggttacaaatcaggcatctgtggaccagtttaggatcctacctataatctttaatattatttgtactggagtagaagtgtgttctgagttccaagtaactgacttatacgttgtttgaaaacaaagcccatttgtagctatgaatactccatggccttcaaacacttgcagcagggtcagggggtgcacagaatcctttgttcaaatgacatcttatatgttaacctaagatataaaacaggttctgcaatgagcaagtacagttgaggaagagggggtagaggtggcctagagcctgcacccctcaccagagtcctgccaagcatggtataagactcatctcatactattatcagcttgaacttctaaagacaagccggattatttggtttattgagaatggttatgtgtccatcatacggggctacttacgacacatgaaatgcctttagctggaggctctgtcttatttttaatatgcctctgttaagcagaagtaatcatttcatgatcatggcaagttaatggggttactttgctgaaccctgagatattaccaatattacttcccatggatcaaacaaagtagatcaaagtcaaagttttcaaaatcctcctgcaaaaggaaatttctccaggcaaaactttgaggttttcacagttttgaaaagtagccttgactctcttctagtcacgacaatataaaaatccttttatttgtgccaggcaggaatatatttctcctcagaaactattttatagattacaggtcattttctactttcttttttattcctgtagtaattatcttcctttaagaaaatgttagcacagcgttcagtaggcatgttgaggcagataagccgtgcaagccaacccagctatagaacagagttgtttctgcaagccttctaaatcccaggacccacatagttaaatgtcagggcagcattgcattcaagaagccatagtcttgtggccaaaaaagtaattaaaaaggaattccaaaccctaccaggcctcctcaaaactgggacagggatccaaattcagtctacagcaacaatttcttctctcaccagctccctgcacccacccacctgctaggtttctggagcgtctctctctccataggtcttctgtgcttttcttcacaccagccctgcactgaggtggcaattataggactatcttggttgggcaaaggaatggtggtggggaggaaagtctgaatagcctctcttcaccttaataactttggcctgaggtttgctgtgttctaaattatatcctcattattgcctgattttgtgcaatagtacaaatagattatacaacctggcgtacttcactgaaccagctagttcagtgaagcaatatttagttctgttactttacaagttcttagtagcccaaatggcaaagaaaatcagatcccagtaacaataagagaattattatgaccactctttctcataggataaataagagactccatgtattcttctatttgcacgtttaatccattgtcattaaggttaaattaaataaagttattactctgaaaatgcaatgaaagacttctggtttctagtctaacatgtaaggagattggaataaaccacctgatactaacacgtaaaaaagctaaacaactagaaaagtcaatgaatcttagatctgtcagaaaagtaagtgcacagggcaaaaagctgtcgcccaaattggagagacaggcaggtggatacagagaatcacaacttatcagagtagaaacccacaagcagaaacttctctgtgaacaagtgcaaggataggaaaacctaattgtaactgaaagtgttgaaggaaaaaactcaccaactaagaattctacatcctgcaaaattattattcaatagtaaaggagaaataaggactttcttagataaacaaaaattgagggaatttgttgccagtagacctgccttgcaggaaatgttaaaaggaattcttcagagagaagggaaatgatataagtcagaaacagggatctgaataaaggaagggcatcagaaaataattaagtgaaggtaaaatgaaaacttttgtttttctaattcttttttttttttttgagatggagttttgctcttgttgctcaggctggagtgcaatggtgcaatctcagctcaccacaacctctgcctcccaggttcaagtgattctcctgccttagcctcccaagtagctgggattacaggcatgtgccaccatgcctggctaattttgtatttttagtagagatggggtttctccatattggtcaggctggtctccaactcctgagctcaggtgatcctcccatctcagcctctaattcttaattgatctaacagataacagtttattcaaaataatatcaccaatctactcgataatgtatgcttacattatataaatatgtattcctatgtatgcttacgttatgtaatatatatattcctatgtatgcttatgtataagtgagaagaatgacagcaatgatacaagagatggaaagcaagaattaggaatattttgttattataagatacttacactacctatgaagtggtatagtgttattcgaaagtcgacctggattagctgtaaagggatagggcaaactctagggcaaccataaaaaaaaaaaaaaagaagcataactgacatactaagaaaagaaagaaaatgggatcatatggaatgttcaattagaattacaaaaggcagaaaaaagtgtagaagacaaaaaaaggagtgaagaaaaagggcactaaatagaaaacagtaataaagatggtagatgataattcaactatatcaataatcatttcaaatatcagtgtctaatacagcaattaaaagacagagattgtcagagtgaatccaaaacaaaactcaactatatcatgtctacaagaaacccactttagctatgaagacacatatatattaaaagtaaaggaatggaaaaagatataccatgttaacactaatcaaaagaaagtaagaacagcttattaatttcagacagacccaactttagaacaagaaaagtaatcaagcaggaaaaagaggagcattacatagggataaaaggtcaatattccaggaagacataacaatctttaatgtgtatgtacctaacaaaaagagtgtcaaactccatgaggcaaaaaatgactgaactataaagagaaatagatgaatccattactatagttgcatacttctacactcctctaccagaaatggacagatacagcaggcagaaaatcagtaaggacatagctaaacataataccaccatcaaaacactggatataatggaaagctatagactacttcatctaaaaccagcaaattatatattttcttaagctcacatggggccttcactgagatagaccacattctggggccataaaacccatcttaacgtatataaagcaataaaaatcatacaatctctgctttcagtcaacagtggaattaaactacaagtcaataacggaaagttaaaaaaatcccaaaatacttggagatgaagcaagactttcaaataacacatggatcaaagaagaaatggcatgagaaatttaaaaaaacattttgaagtaagtaaaaagaaaatacaacttagcaaaacttgtgggatgtaccacaagcagcatttagaggaaaattaatgccattaaatgtatatatcagaaaagaagaaaaatctgagattaataataatttaaccttccatcttaggaaatgaaatgaagaacaaattaaatccacaataagcagaagaaaagaaatactaaaaactagagcagaaatcaatgaaattgaaaacaataaatcaacagagaaagttaacaaaacccaaaactcattctttgaaaagatcaataaaatcaataaatttctagctaagctaactaagaataaaataaagaagacagaaattaatcatattagaaattaagttgggcatgctggcacatgcctgtagtcccagctacttgggaggctgaggcaggaggatcacttgagcccaggagttccaagtttcagtaagctatgatcatgccattgaactccagccttggcaacagagtgagaccctgtctctaaaaaaataataataataataaacattacctatgtaacaaacctgcacattcttcacatgtatcctggaactttaaataaaataacaatttaaaaataataataaaatacaaaagaaattaaagaggggacatcaccttagatctcatagatcttaataggataataaaggaatattatgaataattttatatccacaaatttgataacctatgtaaaatgaagtaattcctttgtctcagtctattttgtgttgctatagcagaatactagagactggtaatttgttaaaaaaaagaaaagaaaagatttatttggcttatcattctgatggctggaaagttcaagattgatcatatgcagagatcacatgatgaaagaggaagcaagagagaggggaaagttgccaggctctttttaacaaccatctgacaggaaataatagagggagaactcactcacccctgaaggaaggcatttatctatttatgaaggacctaaccccatgatccaaacacctcccatgaggccctacctccaatactggagatcaaatttcatacaacagtacaagggtacaaaaatctaaaccacagcattccttgaaagacaaaatctgacaaaattcacacaagaaaaatagacaatctgattagagctactgttacataaattaaatcaataattaataacattttaaaacataaagcaccaggcccagatgggttactggtaaattttaccaaacacttaagaaagaaattatactaattctctacattatttttcagaggatggaagcagagagaatacttcctaactcattctgtgagcccagcattaccttaatatcaaaaccagacaaagacattacaagaaaagaaaactgcataccagtatctctctaaaacacagatgcaaaacctttaacaaaatattagaaaatcaaatccaaatatttatacgaagaattgtgcaccatgaccaagtgggatttatttcagagatgcaaggctggtgcaacatttgaaaatcaattaacataattcaccacagaacatcctgaagaagaaaaaaatcacacaatcatatcaacagatacagaaaaagcatttgacaaaacctgacacccatttataataaaaactcagcatggccgggtgtggtggctcacacctgtaatcccagcactttgggaggccgaggcgggcagatcatgaggtcaggagatagagaccatcctggctaacacagtgaaaccctgtctctactaaaaatacaaaaaaattagccgggcatggtggcaggcacctgtagtcccagctacttgggaggctgaggcaggagaatggcgtgaacccaggaggtggagcttgcagtgagttgagattgcgccactgcactccagcctgggtggagtgactccagagcgagactccatctcaaaacaaaacaaaacaaaacaaaacaaacaaacaaacaaaacctcagcaaactaggaagagggaaccttccttaacttaataaataacactgacaagaaacttccctctaagatcgggaacaagaaaaggatattgcctcttccctgcttttcaacatcatactggaaattctagctaatgcaataaggtaagaaaaggaaataggtataaagattaggaaagaagaaagaaaactatttttgtttgcagatgacatcatcatctatgcagaaaatttaaaagaacggacaaaaaaactcctggaactaataagtagttatagcaaggttgcagggtacaaagataatgtacaaaagtcaattacttttctatatagcagcaatgaacaagtagaagttgaaattaaaaacacattactgtttacattagcaatcccgcaaagtacttaagtataaatataacaaaatatgtataagatctacattaagaaaaccacaaaactctgatgaaagatatcaaagaattaaataaatgggagatgttcagttcatgaaaaggaagtcttaatatttttgatatgttggttcttcccagttttatctgtggattcaacacaatactaattgaaattgcagctagttattttgtggatattgacaaactggtgctaaagtttatatgaagaggcaaaagacccagaatagccaacttaatattgaaagagaacaaagatggctttgacactacatggcttcaagactttttgtaaaactagtagtcaaggcagggtgttattggtgaaagaataggtaaaccagtcaatgaaacataaaaaaagatccggaaatagatccacataaatacagtcaaaacaatcaatgaagcagaaaaaaatgatccagaaataggcccatataaatacagttgaccaaaagcaaaggaaaaccaatggatcaaagatagaattttcaacaaatcgtgatagaacaattggatatccacatgtaaaaataatgaatctagacacagaacttacacccttataaaaattaactcaaaataaaatatacgcctaaatttaaaaacaaaactatgaaactcctaaaacataacatagatgaaaatctagatgaccttgggtgtgacaatgactttttagacacaacaccaaaggcacaatccttgaaagaaatacatggtaagctggacttcactaaaattaaaaacttctgtgaaagacaatgtcaagagaatgagaagacaagccacagggtcaaaatatttgcaaaggatacatgtgttaaaggcatactacccaaaatattcaaagaacaactaaaacttaccaagaagaaaatgaacaaaccaattaaatgataggcaaaagacctgaacagacaccttaccaaagaagatactcagatgggaagtaaatttatgaaaagctgttcagcatcatatgtcatcagggaattgcaaattaaagcaacaatgatataccactacatattgattagaatggccaaaatccagaacattgacatcaccaaatgtgatgaggatgtggagcaacaggaactctcatgcactgttggttggaatgtataaatggtatagccattttggaagacagcttggcaattgctaagaaaactaaaaatactcttaccatacaatccagtgattgtactcccttgtattttcccaagtaaatttaaaacatatgcccacacaaaaacctgcacatggatatttatagcagctttattcataactgtcaaaaccaaaatgttcctcagtaagtgaatgggtaaattgtggtacatctaaacaatgaaatattattttgcactaaaaaggaatgagctaacaagccatgtaaagacatggagaaaacttaatcaataatgcaaagtaataattattgcatattgctaatgaaagaagccaatctgaaagcctacatactctatgattccaaccatatgatattacagaacagataaacctattgagacagtgaaaagatgagtggttgccagtggttagggaagatgaataggcagagcacagaggtttttaggtcagttaaactaatatgtgtgacactacagtggtggacacatgccattcatttgtcaaaacccatagaatgtacaaaactaagtgtgaaccctaatataaactatgtactttggatgataatgacatgtcaatgtaggttcactgattgtataaatgtaccactgtggtatggatgttgatactgagaaggttatgcatgtgtgggggaaatgaatatataggaacttctgtactttctgcccagttttgctatggacttacactactcttaaaaataaatgtcattgattaaagaatagctagagaagaccaaaaccaaagggaggaaactggatagtgatttgcaaagttcagattctatatttagttatttcactatctagataactttggacaaatcttaacctcattccatctcagtttcctttcaaaataaagattgtgaactagataaactcaaatatcccactaagtcttaaactgtgtgattctatgtaccagtattttttaaaagtgaatgcattagaattccaccagaaatcctaaatcagagaccagtagcaatattgaaagacattcatatgtgaaataaaatcaagatgaaaacataattgaacattctctcaagctagttttatattctccaatgttctgcctactactgcttgagtaatgttgttgaataaaaattaaaaggccataacaaaaaaaaatccagtgagaggcagatgctagatagtaaaactgtaaattcctctttttgctctgatgatgggaaattagtgaaattgtgaaaattgacaatgatttggggtaagaaatacctcttaaatttaatgattgacccctagaaatcagaaaagttttcagaaaagaagtcaactggaagacaagtcaactggaaattcctatgaacaacttctagactatattttcatttcttgctaatcatattcttatttatttaaaaatgagactttatatatgccagtactgaagattcaaaagaattgataaaatagtccctggcttcaagaagctcctactctggtctatagttatagaccagcatagttacagaccagcagactccagaatgctgtgttataagtaatctggaaggaagcttgcattgtggaagcacaaagtgaggaaagatcaagtcttcctgtaggtagagggtcaggggacaccacaccaaacaaagaagactagcaaggataagtatgcataatggctgaaaggtatgagtgtgcatgatggctttaggaaactatgaatacccagtgaggctgaaataagggaagcagcgaaataagattgggggtggaggtgaggatttacaagatgtttctgaaggacaggagcaaagtggtctggctgcaagaaaaggttatggttaaaggaataaggaaaactaacattaattctttatcctgtgaaacacaaatacccagttagtagactgggctctaccacaatctgaagccttacctcctagatccttgagtggctgccacctccacaaactccttcgttttctgtaactcaagagagagctcaggaatcaaggacttgacacatggcagaggccctaggtgtcttgagccagggaacctcggactggaaggagtattctatttccaagtggtgagaaggggccataaagaattcaaatttttcctcgatattgagttccttgatgtttgtaaagtttcacctgtcctttaaaaaagttataatttgaaagaaataaatactcaagtctctatgtacatagaatatctttttcagcagtagaatagtaatctccacaagacattttacaaggaactgaggtaatacaaagtactatttattaaaaaattgcccccacctttttacttttactttttacattatctttataatatcagctcgcctttttttcccactgtgctttttaaagacaagactagaataagtgcaaagaaatacaccacatttaacaacatttgagtctgttaagggcactggctttccgttctggcattaacataatttgatatttgaccatgggtagggcttttgacagctctgagccttgatttctctatcaggaaatagatgaaggtgatctcttaagttccttcctgctcaaatatcctgtggtcttatccatctttgcatctcttttgagaagcattgtgcttgacgcatagcagatgcttaataaatatcttgagtagatgagtgtggggtagtttgctgctattctcaataaagaaaatgtagttggaactgctttgctcccacttctgttggtgcatgaaggttaggataagcatataccctatcaaagggaatagtcattactattgtcttacaggcaattggccttggttttccacaaccaattaaaacccttttaaaatgctatggtggccaaaaaaataaacaaacaaacaaacaaacacacttctgggacctgtattgaacccatacagcaaatctatcctgcaagaagttgaatgtatggtttgaatttggaaatgagtatactgtgcagatgcaactcacaccatcttgtttttcagaggtgcgtgtgtacatatgtactcacatgaactcctacctgctatgtgccaaatcaacagtcatgagatggcaatgataatttcctatgaggcacatcagagactggcagaaatgatccatgtaatggatactctaagatccgagaagaacattccagtgcaaaggcacacagttagatagagcatcctgttggttatgtgtctctcctcaaactcatatcagtgtgccttgcacagactaaaatgcaaagacatgaaattgcagctgttcaatctgtagtggtaactggaaaggcaaagccaaaggggcaaatcacagcaattcagagttatacacatgaagtcaggaagcaagacaagagaggacagtaggatggccaggagacagaagatgtacaagagaactcataaaagattttagtaattacaacttaaacatatggagaaatagggtaggtatagggccaattctttcaaagagtttaaggtgccatgtaaatctttagagaaaccatagcatgagtagaaatcaatgggccctttcagtctgaagactaatgtctttctctagctctgggaaatataaaaatatttcctcctttcagtttgtcctctcttttgtgggtctcttattagaaagagtggacctcctttggagatttaagaatctatcctcaaagactctttcctttctcatgccttctgtctctttgtccttttgaactgtgttctgaaaaaaaaaagtccttccatttgatcctccagcttactatttaagattaaaatgtcagttaaaccttttaattatgatcatcatagtttaactcccaagagctccaattgttttattctatagtgtgttcttgttttagagatgtaatatcctctcttactcctctgaatattacatattttttaaaagtcttcttctgtttgttctattagctcaatttatttagtttttagcgtttttgttattgagtttgtggtttctctttcatggtattggttttcttcaatgggttccttggttgcaatttaagttttgtatctgtgatccactaggcccctgtctctccatgctctttctgcgaactgcaccatgcctctggtgatggaggccaggtcaactgaagagcaaattgtattaagggacatgtgctgccagtagcttttcatctcaatttacaagttctctgttctttttgagtttaaacttttatcaaaattacatctatataatagtttgaagactcaaataagactagaagccatgtcacaaaaagagcagtgcccagtgtcccaccctttgacttcttgaccagtaggaggcaactattttaagatgattctttcggcatttatcaccttatctctacgtaacttgcttatattggtacttcttgattttctccacaatttcaggcattacagtacctatagaattcacactataaaatatgagggcttaatctctctttcaacccaccctacctatagtcccataatttacacacaacacaatgcacacaacaaatatactcacatcctctctgttccccactgtttgaaatgtggtttcattacattttacttagctaaatatatggtgctgtcattgttatgaccgtgtaaataccatgcacaactgagccataaacagtagtacactatgattgctgttatcttttgtggcttttgtttccactactgttaattttttcttttatactctgtttgctcttctaagaagttatcattattcagaccccagacttcctaccatctaaagatctcctcagtatgaatggatgcatcaggtattttaccaatttcatcttgaagaaatttcctctagagctcctgacctataccaatctggactggctgcatttcagtccggtacacagttgccatactgggacctccctctaactgtatctcgaaatcccctttgctgctttcttgtgttggattccactgtctgtatcccataaattcctctttttttggtttacttctccattttagtgaagcacatcttccagtaagtatctgagaaaggatgcatggcaggtcaatagttggggaatctcagagatctcaaaagtctctttattctattatcacatctgtttgatattttggttgaatatgggattttaggatgcacatagcttttcttcaagattttaaaggtgttgctacattgccttcttgtttccaatgttgctatttggaagactgaagccattctgattcctgatcctttatcaggaacattctccttgcccttctgaaagcttagagaatattttttttgtgttctgatatttcacaataatcagtctgggcttattttaaaccattgtgttggagacttgtgaaatcatgacaatgtagaaatttatattccttattataaggaatgtccttgaattattttatatttaatttctttgcttttattttctgtttttgaaacttggatgatgaattctttgaaccagtctttaattttctaatctcttttctattttctatactcctgccttttgctctacattctggaagatttcctcaagtttattttccaacctttctattgggtttcagaaaccttgtgtgtgtatttgtgtgtgtgtgtgtgtgtgtgtgtgtgtaaatattcaagagctcttttaattttctgaacattctttttaaatttcttcctgtttttcattcatggattcaatatcttctcatgtctctggggatattaatgttacttttgaagtcttctacctgaattttttctatttcctctcatttgttttgttgttttttattttgacttgaaaactggcacataacaattgtacatatttgcagtatatagtgtgatgttttgatacatgtataccttgtgtaaaaatcaaatcaggatatttagcatatccatcacctcatagatttatcatttatttgggatgagaacattcaaaatcctctcttctagctattgtgaaatatacagtacaatattgttaaccatagtcaccctactgcactagaacaccagaacttattcctgctatctgactgtaactttgtacctgtttaccaacctctccccatccttattctcccttacctcccttccccagcctttgacaaccaccattttattctctacttcttgagatcaacttctttttcattacaggttttccttatatgtctgatgatcctggttttcctcccataactaagagtggggcataaaaaagttgattggctttgggaggcaaaggtgggtggataacctgaggtcggcagttcgagaccagcctggccaacatggcaaaaccctgtctctactaaaaatacaaaaattagctgggtgtggtagaatgcacctgtaatcccagctacttgggaggctgaggaaggagaatcgcttgaacctgggaggcggaggttgcggtgagccgagattgtgccattgcactccagcctgggcaatgagagcaaaactttgtctcaaaaaaaaaaaaaaaaaaaaaagttgattggaaaacataactttgaaacggagcaacaaattggaaggactacacagcctgatttcaaaacttcctataaagccacagcaattaagacagtgtggtattagttagacacactgacaaatgaaaaagttaatacagaaattgagccacacatacagggtcaattaatttttgacaaaatgccaaggtaattcaaagggggaaagcatagtctatgcaaaaaaagatgctggaataactacatatccatacagaaaaacagaatgaacctcagcctttacttgcccacatatgcaaaaactaactttaagtggatcatcgatgtaataataaaatctaaaattatttaataaaactgctataatcatagaaggaaatctttttgatcttggaaaaacttcttaaataggacaccaaaatcataaaccataataagttaataaatcaatttcctcaaaataaaaaacttcagctccttgaaaaacatcattaataagtaaaatgcaaatatacactagaagaaaatattcacaataaatatatctgacaaaggatttagatccagaatacataaagaattcttacaagtcagtaataaaaagacaaataatctaattaaaaaatggaataatgtgttcttgccactgcttctgcttttttcataacactttctggatgtccagaaacccagtagcatggaaattgagcaactttatttatttcatatattctaccattactcaatgacattctacttgagacatagatgcttaatgaagagaaatgtaagtaatttgaaaaaaaaattgagcaacggcctgaacagactctgctcaaaagaagatatacaaagagcccataaactcagtagaaggccctggaagcccctgagatcattagtcactggagaaaagcaactgaaaaccacagtcacacacacaataccatttaaacagtggctttggtctaattgtgtgccttaagattttggttttgatcattttaagaagacatttatagtgccttgacataggccagtcactgcgctgcagacaaatatcatgtcattccacagtcatcagcccagggagacagtgctagtattttcccagtttcacagctgggaaacggaggctctgagacgctgagtgacttgtccaaggttctgagacttggaagggcaatgttgacatttggatccaggactccgaaagcgtgtgtgtacaactaccatgccaccctgcctgcccaggtacctcagcctttcctggaggacttggcagctcctcagcttctgtgggtttttaggaagtggctcagcagcagagtgggaggcagcgggaactccccatggagcagcactggccagcagcagggccagactcatcccccaccttcaagggcggaagccaaggctggaaagacagctgtaaatcccacagctacctgctgccaagctggtagtgggtgtaaggaggggagcagggaggctctcggggtccaaaagccagttcccctgggccagtgtccgtgattccaaaggagggagctgatggggcatccgggagctgccggggaggaagggagtggagagatagagcactattctgggaataggaaaaagatgttgattggaagctctgagcctgggaatgaggtgtgaaagtgacaggtttcttgcaaggtgctcaggtcttttctcttgggccactcacactctctagagaaggatcttccatcttctgcctggaggtaatagttctgcccgccagagttctagagactgattacaatttttcattcatttaggtaaatgtttatttaacttcctggaatgccactccaaccctcaactctctctggtgttcccccacattccatcctagctacagctcaagatttctgctatggccgtagcgatggtggcagtggctctaggaaactaatcacttcttaaatactcagtgttttgtgctgccttcatccctccttccagaggtacctgacactgccaagcctggcacatttttccctgtaagtcaggttgtttcctgccttttcccatttcgtctttaggagtcagttttcttgggtcagttgccattggtccatctgtttccagaatccagaattttgttacagttgccctttccccagtctgtttgtccctgtgggtttatgtgttaagaaaaattaaatctctttacagttcatttagaagggttttggagggagagtaagaaactgtgggtgtttgatctgccatctttactgagaagtcgctccctctcctttgggtaggttccatagccatctggacactgccctgctcctctggaccgcttgtccactcactgcttttgtctgaatgtaaatacttgaaactaagtcctcaattaaccacacataagcagtagctggggttcccctttcccttctcacatctgtgacctctgggctcccagcatcttccaatctttccccttccacagatgttcctcctgcgtatgtctgaggcatgggttttctgcaagctttttcttttccctgtgttgatctgatccatttcgattctttcaggagttaaaaaaaaattcttgtcctctgatggcactttttctcattgttattcataccagttatagttttattattaaaatattttttcctacatttcatgagatttctggtggaactggggatagttgcaagtgcttagtcagccttctcctccagttctgaagtttaaactatttaagcctccacctttttggtggttagggcaaggtggagtttatggaaaacttagaaaggtctttgccacaccaagattattcacccatattttcttctagtacttttgtgggtttttaaaatatttacatctttggttcatttaaaattccatatgatgttagttgtataccggaatttagatttcttttcaaatgtttagctttttgttcaaacattagctattgactaattttctgatttgaaatacacactttgttaatttgtatagctttataataggttttattgtttcataggttaagttcttcttaagtcttttaaaattatttcttggtataattttttccattaaataaaattttgaagtttggccaaatcaaaaaaaatctcacttgaatttgggtatgcctgcattacttttctattcatttagggagcattagcattttaatgcattaaaagccatatttcaactactgggatggatctaagttatctagtcagttgaagtaatcatttactttaagatgtaataaaattgtttcaacatcccaagtcacacctgatagaagtctcagcacgctttccaggctctctggggtgtcacggcagtcaaaggggttggtgtttatttttcccggagtcagttccatattcctgcttccatggaattcttgatctccagtctggctctgacccccgcacatctgtcctttctccagtccacaacactccactggaaaccatctgatcttttcactggcactaactcaaggccatgtgcatggtagataggcaacatcagggtagtgttacaaatctgagccctggagtcagaatgtctgggtcaacagcttgacttcacacttgtaagctatgcacttgatcaagttacttaatgtctctctgccttaattcctcatctgtaaggtaggaaaataggatttttgtgataattaaatgtagaaagttaaagtgttaaagagttaaagtgctcagggcagtgtctggcaagtaggtgctcaataaatatgagctgttataattatcatcgaaggtttggaggctatggaaatgggttacataaaaacacagcacaacaaatgactataaactgaatattggaagtgtattcttaaaactccttctacttgtcttattacaaaaggaaggttccctctctctctttaagccccagctgggcccctaactttgatctcgtcccttctcctccctgtttttcaactctagtcaaatctcactctcttaattagtccattatagtttccaaggcatgaggacttatctttccaatacttaaccagctcatcatttgtttggctaaacaaaaccagctcaggctgcaaaaaaaaagagcttatcttccctttagactatagaagaatataaaagaatgtagttcaaaaactaacaatgattttcctgcacttcgtaaagagagcatatctaaaaggtacagctctccattttctcaaaactctttttctgcccatgaatagaattttgttgttttctctatatagcacgtcttatggttactatatataaattgttattatgagtagaatttttattcactatattttcttactggttattgttagtatgaaagaaagttattgcttctttgtacatttattttgaaactagagtcatattaccactgtttcatatagtttctaatagctttctcagttttattgtcttggattttctctggcatataatcattttatctgcaaataatgacaattttgtttgctcatttccagtatttacaccacttattttggtttattgtgctggcttggacagacattatgtaaccgtgattataatgatcactgatagtgctggttctatttgctaatattttgtttagggtttataaatgaaatggctgtagttttctttttagtataattttgatagattttgttataatactttgctggctttataaaaacaagaaaagcaaaaaggagtagctcttttttctctgagttctaaaataatttaaataattcttgtgttacctattcgttgatggtttgatctgtgtggactatatgggcctggccacttttaggataaggttcttcacaatcatcttatagcctattttaggtttcctatttctacttcatatagagaacttatttttctaaaataattatctatatcacccaagttttaaaatttatttgcacagtttttctttatatactttaagttttagggtacatgtgaacaatgtgcaggttagttacatatgtatacatgtgccatgttggtgtgctgcacccattaactcgtcatttaacattaggtatatctcctaatgctatccctcccccctccccccaccccacaacaggccccggtgtgtgatgtttcccttccagtgtccatgtgttctcattgttcaattcccgcctatgagtgagaacacgcggtgtttggttttttgtccttgcgatagtttgctgagaatgatggtttccagcttcatccatgtccctacaaaggacatgaactcatcattttttatggctgcctagtatttcatggtgtatatgtgccacatttccttgatccagtctatcattgttggacatttggtttggttccaagtctttgctattgtgaatagtgcctcaataaacatacgtgtgcatgtgtctttatagcagcatgatttataatcctttgggtatatacccagctttacaaagttttctttaatactttaaaaacttttccctgcatctgtggttatctatcttttcttttgactagttttgggtatttgtattttcccacctttttcctttttttgactaaggtaggttatgatttattttcttattttatttttttaaatatcttgaattaattaaacaattctattgcttttggcttttccagtttaaactcaatttcacatttcatatttattctttccttttgctttaggttagataatcttttcctacattattgagttttgtgtttattctatttcactctttgttgagtaatgacagaacttacagatgtaagtttttgcctaaggacaagtttagcttcaacacatacattttagtgtacagtagtcttgttattgttgttttagcaaaacaggtattttaaagagactggtatatttcccaaatggttggcaagttaccgtttgcttgtttctacttaatttctagctgtattgcattttggtcagaaaacgtgatctttcctcttcctacattttaagctatgttgaggttgccttcatggaatgatatggattttatgctgagtacacagttaagatctgtaattgtttcataagtacttgaaaagaacatacattctctaatgtgataatgtaacatgtaatatgcatatatagcatctgtcaaggactgagagaggttcaaatttgcttctttttctcacttgcccctttcattgatctagtttgttgtacaagggaatggttctcaaagtgtggtccctggaccagcaagcaacagcatcacctccttagaaatgcaaaatcttgggccctaccccagtcctgtgaattagaaactggggccggcactagcagtctgtgttttcagaagctctctgggtgattagaatgcacactcacattcaagtacactaggagaaggcatgggatgtggatctcattttgtcttcctttgttctgaaaaattactctcccccgtcccacttgtttgtgatgctccccttttcaataacttaattctctttataaactattcattctgtaccattaatctgtgtcacactgttttaatttttatagttaataatcaaaggcaggcaaattggaattcggtattatgtttttcctattaaatttgcaaagatttaaaaactcaataattttcagtgttggcaaaaatacaacgaacaagacactctcatacagtggtggtgagaatgtaaagtgatacattttttcctgaaaagaacttatggcaatacgtctaaaatatctttgcctctgcttcaataattccacctgtagacattcattctaaggaaataatcagaattggtttaaaaattatacttacattgttttttgtttactctgttatttgtttttaatgaatagacatttttggaaaagctttcggtttatggaaaaattgagcagaaaataaagtgttcccatatgctcctccctccccaacatttgccttattactaacatcttgtattagtatggtatatttgtaacaattgacgacccaatcttaatacattattagtaactaaagtccatagtttatattaggacccgctgtttatgttgtacattctatgggttttcccaaatctgtgacatgtacagaccatgacagcatcattcagaatagtgtcctaaaaatcccttgtgctccaactatttgtctttttaaatagaaaaaaatagaaagttccaacaatatgagcatgtttacataaactatgatatatttaattcaactaaaatattatgcaaccattaaaaatcatgttcctgcaaaatatttaattgacttgggggaaatgtcaatgatatattactaagtttaaaaaaagaatacaaactgtatttgtaatatcatctgagctttattattatttatttattttattttattttatttatttatttttgagatagagtctcactctgtcacccaggctggagtgcagtggcgcgatctcggctcactgcaagctccgcctcccgggttcatgccattctcctacctcagcctcccgagtagctgggactacaggcacccgccttgacacccggctaattttttgtacttttagtagagacggggtttcaccgtgttagccaggatggtttcgatctcctgaccttgtgatcgcccgcctcggactcccaaagtgctgggattaccagcgtgagacaccgcgcccagcctattattatttaaataataatatatgttcataaaaaatactcaaaggggccgagcacgtgcctcacacctgtaatcccaacagtttgggaggccaaggcgggcaggagtttgagaccagcctggccaacgtggtgaaattcagtctctactaaaaatacaaaaattagccgggcgtggtggtgggcgcctgcagtcccagctgcttgggaggctgagacaggagaattgcttgaacccaggaggcagacgttgcagtgagccgagactgtgccactcactgcagcctgcacaacagagcaagcctccatctaaaaaaaaaaaaaaaaaaaaaatcaaaaaacaaataaacaaacaaaaacgccacagggggaaaagactgaaagctttacatcagaatgctgaaaaggtctgtgagaagctaaaagtagcttgtagggtcaggaacactgcctctggcatcagccacctgagaactgcttgatcttgggaaaatcacattgctttcttttttgtctttatgaaattttctaaactaaggatggattgtttttagaatgagaaaaaaactaataaaaaaactacaaatagtaaaagaggaagtgacagagaagcaaaagaagacacaatggggcaataaaggagtttaaatggcaacatttcctacccaaagtgactggaagagaaaagagaagtcattgacttgcacagccaaaactactagagggctggcccgaggctcagcttggggcagggctccaatggtgagcctcatgccccattccctctgtctctcagatcactatctggatttccccctgcagtagcccaggcctcactcacgtccttcccgcttcacaagctgtgagagtttgccagaattccccccagtgaaaatttcatctcatctcattggttctagttgagtcacatgctcatgtctcaaccaatcaaagtggccagagaaaatgcaacttgttgagtggtttaagcctggatccctcaaccttcagaatcaaggatgaaatcagcttccccagaaccacgtggagtgacattaagtaaaagagtgattccctaatgggaactactgggtggcaattaacaaaagatgctctttgtccctgaagggaggtggctccacagctctgccagacgttttgggtgaatctctgcagcacccatgtcactcctgaagtagttttaggggtatttgttttcacgcccacagtagaggtggctgtattggtttgtgctgaaccaagacctgaccaggcagcaaatgactggtcctcaggacactgggaccacaggcttactgttaacatctttcagtttgtgctttcagcatttcacatcaaaaggattttataaaatgccctttttaaactttctgagactattagtctgagtattgggaggcacagagacggcatccctgaggcaggggttaggggatgggagatcttcttttctgtgtaactgaagtgcagtgatgtcttttatgacctccccaaagacaaaagatgagtataacaatactcttgccaatttgctggaaagtttatcgtttttagtttcacagctggagatcctcagcccatttcattatccttgggctaaacagagtcctcattttatggctgttgtgaaactgtattcttggaacaatgacaacctctgactcctctaaagtcatggccagttgaactcccttgtgtcattgggattggcaataaaaacaggttggatactaagcagatacacctgccgctcaggcatctctcaggtgccaaaagatagactgattgtgtggaccaagctccatgctctgggacgaagggaatagaattgaattcccttgggaggttgaagcttcagggagtatagatcaaataaacctcccttctgtgtaggctgtccttccatctgacagtgaaatgatccagttttcttgggctatgaatatggacagacctttagccccaccttagccaacacatgaaaaagtatataatcctggcaggaacccatatagaagaaggcactagaccaggccatctgcaccttgtcatttctttaataaaatgggatttcattacctcggccctgtcagtatttttatcttgcctctgcctctttacacttggagggggttgctgggttacctgaaaagagactgtttttcaaagcaaaatactgcattactattactaatatcactattagtaatagtaatgtgtccggaattggtgggttcttggtctcactgacttcaagaatgaagccgcggaccctcgccgtgactgttacagctcttaaggtggcacgtcttgagtctgtcccttctgatgttcagatgtgttcggagtttcttccttctggtgggttcgtggtctcgctgggctcaggaatgaaactgcagaccttcgcagtgagtgttacagctcttaaggcagcgcatctggagttgttcgttcctcccagtgggctcgtggtctctctgggctcaggagtgaagctgcagatctttgcagtgagtgttatagttcacaaaagcagcgtggacccaaagagtgagcagtagcaagatttattgcaaagagcgaaagaacaaagcctccactgtgtgcaaggggacccgagctgattgccaatgctgacctgggcagcctgcttttattctcttatctggccccacccacatcctgctgattggtagagcccagtggcctgttttgtcagggcgctgactggtgcgtttacaatccctgagctagatacaaaggttctccaagtccccatcagattagttagatacagagttttgacacacaggttctccaaggccccaccagagcagctagatacagagtgtcgattggtgcattcacaaaccttgagctaaacacagggtgctgattggtgtgtttacaaaccttgagctagatacagagtgccgattggtgtatttacaatccctgagctagacataaaggttctccacgtccccaccagagcagctagatacagagtgtcgattggtgcactcacaaaccttgagctaaacacagggtgctgattggtgtatttacaatccctgagctagacataaaggttttccaaggccccaccagagcagctagatacagtgtcgattggtgcactcacaaaccttgagctaaacacagggtgctgattggtgtgtttacaaaccttgagctagatacagagtgccgattggtgtatttacaatccctgagctagacataaaggttctccacatccccaccagagcagctagatacagagtgtggattggtgcattcacaaaccttgagctaaacacagggtgctgattggtgtatttacaatccctgagctagatataaagactctccacgtccccaccagactcaggagcccagctggcttcacctagtggatcccacactggggctgcaggtagagctgcctgccagtcctgtgccgtgcactcgcattcctcagcccttgggtgatcgatgggactgggcaccatggagcagggggtggtgctcgttggggaggctcgggctgcacaggagcccatggagggggtgggagactcaggcatggcgggctgcaggtcccgagccctgccccgcgggaaggcagctaaggctcggtgagaaatcgagctcagcgccgatgggctggcactgctgggggacccagtacaccctccgcagccgctggcccgggtgctaagtccctcattgcccggggccagcagggctggccggctgctccgagtgcggggcctgccaagcccacgcgcacccggaactccagctggcccgcaagtgccgcaggcagcccccgttcccgctcacgcctctccctccacacctccctgcaagctgagggagtgggctccagccttggccagcccagaaaaaggctcccacagtgcagtggggggggggctgaagggctcctcaaatgccaccaaagtgggagcccaggcaggggaggtgccgagagcaagcgagggctctgaggactgccagcacgctgtcacctctcagtaatagcacagccccatccttgctgtacattgtggacattatcttgactcctcacaataactctccaaggtaggtctcatagtcaccattttaaatgggaggaaactaaggctatgtcttgttaggtaatttacccagttcatacagttctatgtgatagaactggagtttggaaactaagcctgacaatgccaaatactttgtttcttctcctcattatcaatagctgactaaaatgtaattttgtcaacctgatcttgaaaaaatttagcctgattttatttttatctgttattcctaaattaagcagcctcagtggcattacaagccgaatccttgaggtgactggtcaccagaaggaatccagccttctccatgcataatcactctacagcagccttccagacccatccatgggaatccttttcttgaggtctgggcaaaaccactccaagaacaaaccccccaatctccatcagagcttctctgccccgtatttgtctgacccctcagttcagcagtgatgatgaccagggcaagtcaaatctatgtctgagcctgtggcctgaccccattgtttgtacttatccgatgtgaaatgctagtacttgctttgcaattttacattttgatgcaagtgaaaggtttgaaccagctgtttaaaaaaacaaatagctttaaaccccattgtaaagtgatgacctcatgtaggaaaactggttgggctcttgccctaggaggggctgggggtaggttcccgatagacaagctgctccttgtgaaccactcagaagctggctcttgctcagcggctgtggatgagccatgagagccacatctgtttttaaatcttcaagatgaatggagttgaattttctattctttaaatgtggagaagaaaagaacaaaacgcttcctgtcagtgaagtcctgtgtttctaagtggggtaacttcttttttattgaacgaaagcttttcaagaagcattccaaagaggatataccagaatctggaactggcatatgaaaatatcacctctagggaacaattcataaaaccaccaattactccgtggactccttttggctctgtccttgctttagatgataggtacattctcacacccctgagctcctcagaaaagcaggagggatccctttgtgccctcgtttataccctgctagaggttaagcatagatgatacactgtcacctcactggaacattttaaacttgaaaaaaaaaaaaaagagaaagaaaacctattaaaattgtcaacattcccacagtaattgagttttctaaattcattcaatagctagtttattcatttaatcaaccattttttgagtccctactatatgccaaatgctgctgtagggtgaggagttgaagatataagatccattacaatcatccccctcatcctcaggaatacatgccaagacccccggtggatgcctgaaatcacagacagcaccgaatcttatatatacaccacattcttcctctacattcatactcatgatagcttaatttataaattaggcaaagtaagaaactggcaacaataataagaataattgtaagtacactttaataaatgctctgtgaatgtagtctctctccctctcagagtatcttattgtaatgtacctactgctcttgtgagatgataaaaagcctacatgataagataaagtgatagggctgggcgtggtggctcatgcctgtaatcccagcactttgggaggccgaggtgggtggatcacctgagatcaggagtttgagaccagcctggccaacatggtgaaaccccatctcttctgaaaatagaaaaattagccaagcgtggtggctggtgcctgtaattgcagctacttgggatgctgagacagaagaatcactggaacccaggaggtggaggttgcagtgagccgagtcagaacagcatgcactttaaagcttatgaattgcttatttctggaattttccacttagtattttcagaccatggttgactgcaggtaactgaaaccatggaaagcaaaaccacagatagagggactactatacctgtactcaagtcgacagtctagcagaagaggaagagaaatagataacttgaagtccatgtggtcagctatgctcaggacactgggggataggcctgggggtagggaaggaagtgatgaccaaagatggcttcctgtaagaagaaaccccaatctgagctttgaaggacacgatggggttagcaaaacgtttaagacagaagaagcagcctgtacaaaggtggaggagtgagacaggagataggagatgtattgcaggggctgtgggggccagggcacgatgctggtttatgatagtgttatccctgtgataagtcccacacctttggtccatgggagcatctcagcactgggaggcatctgtgcatgtgtctcctcatagctgtagactctctgaagatgtctctatggatgtggacactcttcccctgcatgttatgactgtctgtttcacactttccaaagcacatgcacacacatgcaggcttccacacagaaatttcaaacagattgttatttaatgactacagtcattcatccaaacctacactactggttgggtgtttggtctgtcttatctccatttatagcacagagaaaggtatcatcaaccagccttcaagatgtcatctcagaggccttccctctactggtagggaaccccccgccccaacacctctctacactttctcccctccagaacttctgcctgtttaactcttttcctctaacaatgtccccacatcccttcttattctggctactctcaccctcaggcaaaagtcagcaagtggcttgtccttttggcactcacagcctccctggatcagtgttgagtgaagaaagcccttccctcctcagccaggtgaaggaagggagagctttgggtcaggaagctgtgtgtggctggtgaagatgatcatttactcctggttgtgcttttcctgatttttcctttggtgcctcttactatctctggaaaataaaaaaacacacaacttacgccaggagcatgagatctctgccaagaagccctgttgaatcctttgagagtcacaatctctccgagtaattctgaacttattggtccagacatggatttatccctctactcatcttcatcttctttgtgaagcccccttccattcatgccaccctaatggaagtgtccagtcattctttcttaattctccctgattggagggaagaagcgttgtccaatcacacaccaaacaaaattagtaatcttaaggggttccatgcatgaatacctgctaggtgctaaccacagggttcaattttgttcattactcagtggctagcacggtgtcgggcacacacaagttcttcactaaagcgaagttcttcaataaagaaatgattcccaacactcacaatgaacctggaagttaggtatgattatttccaatttataaatgagaaggctaaggctcagaaagattatcatagtcatttagctgataaatggtagtttggttcctaacaaaggtctttctggccccaaagctcatgctttttccagaaaaccatgaagtcatccacctgccaactcactaaatatagttcattatgtcaataaagattaaccctttacatggacacttaactgcaatggtcttggtgctgcataacgaagctgtggacttgggcaactcttcatgacccaacttgctacttctgagttgcctccctctctagagtttgtctccttcagcctattcaatgcagcacctattcattcattcattcattcattcattcattccacaaattttctggaagtatctaccatatgctagatgctagagatacaaaaatgagtccaacggctcctgccttcaaggacactagaattcatcacagtatattagtcgcctatgtgactaccttaaggacagagagagttgtatgatttttgtggttgtttccagctcccaacagaagacctggctgatgagaggccctcagtaagtgttggctgtattggattgatatggtgtctaatgtaatgatgagtgttatatataaagctatgttccatgagccacaggcattcttttggggacatgcatattaattatttttttcagatcattgagctgtcgttcaataaatgacacaactgccttaatatagaaaattgctagaggagctagatttattttctttcctcacactaagaagcaattgtagtaattccttatgtaataaaccagtaagaactaatttaatttaaaaaaattttttaaactggattacacacaaatatggtagaaagttttaaaaacttacaaaaggatataacattaaaaataagtctcccacttctggccctaggcacccagctttcatccttagaatgcacggctattaccagatttcttgaatattattccagagatcttctgtaggcacacaagaataaatatgtgtacttctatgcatgtctgcacacactgccccccacacaaggtggtatacttcgcacaatgttctagactttgctttgttcatttaatgctgtgccctaaagaccttttcatgttatgacatagatattattctcatttttaaatgactgttatacggatcgtaccatcttatccattccttcattaaggtacattcaggttgtttccaaatgtttgttttattactaacaaagccacagtaaatttccttatccatatatcattttgcactctaacagctgtgagataaattcccagatgcaaaatgtaaataaatttatttcacttttaaaatttaaatttaaaatgtattattataataaataaaattgaatacattcccagaagtgctggccaaaggatatatgcattttaagataaataagatgcatttaacgtaaatgacatagcctaattgctctacacagcagttgtgctaatttgcactcctatagcaatgcatgacagaaattttctcctatggtcaagacgactgacttaccaaatttttttgatctatgctaatctcattgcaattttcatgttcctttatcttattatgagatcttatttacttcttaatagtccagtttaatgttaagaaaccataattcctgtcatgtcaaaggaactgcgatcataaattttgagtttatctgaactactgttcaccagaagttaaaaataacagtgttattagttacatttttatatcactgccaatctcaaagtgaacttgagataacttaataaacacacaaaacaatgagagagatagaaacaacatttttaaaatcaagacaacagaaagtagaggcaaaatggtaaaatgaagtaagagggaagtttagtgaaacaaaatgcatatcttcaggtccaaaaatctactaattttggtccactgttttggccttaagcttcttagaggtcaaagcaaaaaggaaaatgtaatcaattttaaaatgtacattgttaaagaaaagaaaatcaaaagatttttggcttttaaatctaagggaaattcataaggtttattgcagaagggactccagatagtatctcaacaagattcctaaaatgaaagaaaaagtaggggttttggagaacaaagctctgacgccgtctatgtagaatgctttcctagggccctttgtctggtaagagctccccttttcctccgaggaccaactctctgactcttcatagtcctggtagggatatcaatgaccatgccctattccttccaccttgaatactgctgtacaacaaaccacaccaaaatgcagaggctacagggcagtcctttagctcgtgcatctacaggtagatcattctgtctgagcttggcctcacagttctattcttggctgggttctctcccaatccaggggctgtctggccattgcaggggcatttgggtatcttggtcctgtcccacaggtccctcagcctttagtatgctggcctggcatgttgtcatggtatggcacagctccgggagtagaagcagaggtatgaagatgcctttttcaacctcggtttgtgtcatatctattaatgtctgatggaccagatgaatcacatagccacactcagaatgaaaaggtggagaggtgaatttgtgggaggattgcaaaatcacatggaaaaggctgtgggtaagggaagtgtgagtgccacaactcatcacaggggacagtgatctaggcttagaaagtggggaggaagtgcactttccactgggttgcccaactgagacttcggggagccatgtttttcactacttgctgcaggagggaatgggtattcaaaaagaagaggagaggggtggatcagacacatgcagaaagaaagagcccggtgctataaagtccctgaagctcttccagtgtgtctgcaggtcactccagtacccaaaccagcccctgagctagtactttttcctgtttgctatatcaggcggtactcaagagtgaatgctgcagccagtctacctgggtacaaattccagctgtggctgaataactgtgtggcttggaggcaagttgcctcatttctttgtgcctcagttttttcatctataagatggggataatgataatcttacctctcagagctgttgtgaagatcgaatatattcatattgggaaggacttagaacagtgcctggcatatattaataaatgtgtggtaattattttttgctgacattagtttgaattgtgtccctgtcaatagattggatttcgtgggtggcatctcaggtggatttgatggaaagacaaagctgtctctcatgggagctgggctcctactttcacccaaaggcactgaactgcatcccaattgccaaatctaccaaccaagaaacaataaacccaataccttccacgggaattaccctaatctgtgactggcctggtgagtgtgtcatttatagagtcaccataaccacagaacgtggtacatgccagcaatcttcggggaccttagtgctccccttccagatatagagcgaggtttgcctgagtccaggacctggccgagtgggccagattgctgtgtgggtttatggaacagagtgtgatgataatgggcttctagattctttcggtgcagactccacctccctgcctgcagccaatacggagccctgacaggaaatacaaagccgctgacagccccagacttgtccgcaccaccatcagggctctgagcagccgagctggagccccctctccctccaggtcggccatccggctgggtcggctcagtcaacagcagtttacagtttggctgactacagcctgactccacaaggggaataaagcccagcattgtgctgggcttgcaacatctttccccgtccagagttcctgatgtgtttgttacacaggatctggtctgaatgtttcctttgtcgcagaccttcacgtgctgaggtgggtctgccttctccgcggcagtcctgggttaaataaatacattaaggcaacatacacggcttgacactggagccagcctcaataactcaaataattcatgtggcaaaagatggagcctctgtggttttgaattcatttaaagatggatttctttgttcacttcctttgctcgaggagaacacaaactgggaaggggccgccatgctccaactcagctggccatttttctccagcaagtctgtttgagagtttctaaatcccgtgcagatgaacacagaacatgaccttcagccagttataggataccatgctgacatcaccacataaatatacactcccgagaaagctgtgattaagctccgcgcagatttttatcacttttccagtgcaccggcaggctgcttgttcgccatgcacctttacaaaactcataatatttagaaatgtgctgtgttagccccagaggcttaaataaactaaagcctgtgaaggttttaatgtaacaagttaccttcacatgtgaaattacgagtctacatgatactcaataaggccaacattgtacacactctgttcttttgggatcttatgtacatttatcctgacatatctgtttcagttttttaagaacggaaaatatttctatttcaataccaccatacatgttcatgacactaaagaatgagtgagattgtatatttaaagaaattcagagtctccgccgggtgctatggctcatgcctataatcccagcactttgggaggctgaggtgggcgcatcacaaggtcaggagttcgagaccagcctggccaacatggtgaaacctcgtctctactaaaaataccaaaattagctgggcatggtgatgggtgcctataatcccagctacttgggaggctgaggcaggagaattgcttgaactcgggaggccgagattgcagtgagccgagatcgtgccatgcactccagcctgagtgacagagcaagactacatctcggaaaacaaaacaaaacaaaatattcagaatctctactcaaggagtttgtgctttaaggccaacagaaggatgggtgggagggtgctgtcattgtaatctcctataaaatcaccaagttttcattttcttttcttttcttttttttgagacagagtctctctgtcgcccaggctggagtgcagtggcacaatctcagctcactgctcactgcaacctcggcttcccgggttcaagcgattctcccacctcagcctcctgaatagctgggattataggcatgtgccaccatgccccgctaatttttgtacttttagtagagacagggtttcaccatgttggtcaggctggtctcaaactcctgacctcttgatccacccgcctcggcctcccaaagtgctgggattacaggtgtgagccatcatgcccggccttcatttacttttaaaagtgcagataaaagatttgttttatgagtatagcagagattctcaactgagacaattttgccccccaggggacacttagcaatgcctagagatattttttggttgttacaactggagaagcagggtactattggcatctagagggtagaaatcatgatgccaatatctatgtatgtatccttccatacacaggacagcccccctcaacaaagaattgctcattccaaaatgccaacagtaccatgcttcagaaaccctaaggtacagtacatttgggaggaggggttgggacagcatatgttctaacaggctggatgactgtaaactttttaaggtgctatgcaaacactaaccttgccttctagtcaatttactggctgctaaacattgtttcaaaattctgactctccatttatcctaagcacattgctataaaatgccttattgatgaggcttgcctggcccaaaatctaaacagggctgctcaagttttctctttttaaaagagaaaaataaaaaacttttcttttttactttgaaatgatgttaaactaaacatgtagtttctaacatagtagacagtaccttcaccctgctttcccccagtgacagcatcttacataactatagtataatatcaaaaccagaaaactgatattggtatgatactattaaactacaatctgatttggactttactactttgctcaagttttaaataataaaacattttaaattttatttctcccaaaatattcaactttattcttgtagaaatgcttaccatgaaaaacaaaacaatgatgatctttctgcttctaaatgatcctcattgccaaggtgctacccgttgcgagaaaagaaagtgaccggtggaaataattggcttgtagttttattaatcagtctctaccctcttcaaaacaaagactcccatgatattttctggctgtcagtgccttcttgttgttgttgttgttttgatcggtttacatgtccttcaaaggctcaagtattgaacattaggaccaaaggtaacaaatttctcaaccttcacccccacacccctcaccccgacactacagcctcctggaagcactctgcagaacttccctgccaatatatatatatatgtgtgtgtgtgtgtgtgtttactgggtttacaccgtcggtgcccctgtttttcaggccttcagattcagactagtactattgtattatagtaccaagagcagaagataaatgagatgtcctagccatatgtgtatgtgtgtgtatatatatacatatatatacaaaaactatatatatacacacacacatatatatacaaaaactgtatatatatatatacacacacaaaaaaatatatatatatataaactatatatatagtttttggatgtttttaagggaatcttttacaaatacaaatggagtgccctgctgcagacccacccgagggaaggtgggaaggtgttgtctttactgccgcacagctattaagaccttcaggtgtaatgatcgggataagatacatgctgcttctaccttcagcatccttcaagagcataggagaggaggcattgtgaggacctgggccccaagtgggattccttatgttgttctaacctcagaaagaaaaatacactcaaagacagccagaaaaagccctagcagaggggctttagcgtggacttttagagcaccatctgagaaggtcggcattcagtggaagagaaagcctcagaccatggagaactgagttcaagggttggtcctgccactttctggctatgaagccttggagaaggcactgaactaagcttggtttctctatcaataaaacagtgacactggtatcaatcccggtaaatacagaaggtggtgtgacggtcgctgacctgcttcattggaaggtgtcttttataataggagaaatgaaaaaaatagggtgtcctcatatagtgaaagtaaatagagctacagccacacacatcaacatgaagaaaccctgcaaatacaaataatacaatgtattaatcagatttctccatggaaacaaggaaagagaaccaatatgttatatacatatataatatatggatgtaatattacatatatgtatataatatatatgtatgtaatattacatatgtgtattatatatgtaatattacatatatataacatattgttctctttattaatacatatattgtattatatatatgctatgtaatatataattacataattatataatatatacatgtataattacatacctacataatacatatatgcattacatacatatatattacatagcatatacacacatacatataatatacatgtattacatatgtatattcatatagtgtgtgtgtgtgtatgtgtgtgtctgtgtgtgtgtgtataaaatgtattatgagaaattgactcacacaattatggaggctgagaagtcccatga

SEQ ID NO: 724 - DNA, 58353 bp, Homo sapiens
tagcacaaccgcctaagcggcggaactctggagagtgcggaacctaggatcctaggaaactgaaggcaacggaacctgggggcgatggaatccgggagcggtggaacccggagcctgtagaacttgaatctagaggaacctgacagcggcgccgagggggccacccggactctgtttggaacggaagcacagtgtccgccgcttcctggttgcgggtcagcgcccaggtcctgggctggccgccgggatgttgccctacacagtgaacttcaaggtgtcggcgcgcaccctcacgggggccctcaacgcccacaacaaggcggcggtggactggtgaggacgccgagcttccaggtcgccaggatcggccaggaatgtgtgagggggaagggggaaggacaagaggtttcaccccctggttagtttggcctcgctaaggcagggagccgccctcacgcaatgagcttgctttcagttggtggatttttgttgttacaaaagtgataatagccccgtgtgggaaattcccccatgcaaatacatttcccctctttctcgcgtatttctctgctgttttctctgcacctcgcccttttgccgttccattcctctctcttttcctctcctccagcttccaggcttctctctctccaccattaattccctgtgcactttctctttcccatcctgtcttttctttttcgttgtcttgtattcctgttgtctttcaacaatgtgccagaccctgtgctaggcgcctgttctttcacctgtccttttcacctcttttcgggctcctcctgtgtagaacattcctgccttcaacaggtcgtctttattactctctcctttcactataaattactactgcagctctgaaaactactcattagacaaatgtaaagcaaaattctgtggctgtgggatgttgttaggaggactgaaacgtcttgtgcagtgtttgtcgttttatttagttggaaggactaggattagtcgcagtatccccaggcacattgtggatactaaggattagaaatcggataagcgaaagacgtatgcctacaagaacagtcagagggcacaagttcctttttatgtcctcgggtctctattttcatatcttttagaactttttttatccgaatgaaaagtgaatttcaacaagcattttaagcttagccagatcttttatttaagtgggataatgataaatactggcctttgggtttaaatgattttattaatggtggtacatatgaattagacttatcatttatttaggcttggcaagaaagaagtcgtcctgctttgttctgtacttaaactttaacattactgttttgctaggggctggcaaggtttaattgcttatggatgtcattcacttgtggtagtgattgattccattactgcccaaactcttcaagttttagaaaagcataaagctgatgttgtaaaggtaagtaaaatcccactttgacgctaacatgttgtctagtctaaagtttaatactgtgtatcactaagctctcattaagtcttacgtgtaagtgttgaatagcttttaaatataacaacctatttggggtagcctagaattttcatatatatgacttaatgtcaatacagggtgagttattaaatgctagttgttagatcattttaaggcagatgaaagttctaccatttacaagaccactcagtcattccttagttttgagcacttaccatatgctatggatatggagatgaaagccctcagataattctccatcttataaggaagactcacagcgtgatagtgtgataagtgagacttgcgtaacacgctgtgagaaaacagaggagctgcatattgcctggttgtgaggagagtcacagaagtctacagtttcaagactagtagacagtagttagccaagtaaaaaattgacaaggagcattgcagggaaaagcaagaatatacacagaagtaagtagcgtgccataaagatggctaaagatgggacacttgtaggagtgatgaaataagaggcagccagagagattcagctgtctgtcctgaagttttgtaagattacgaaggagtttggattttttttttttttagacagaatctcactctgtcgcccaggctggagtgcagtggcatgatctcggctcactgtaagctccacatcctgggttcacgccattctcctgcctcagcctcctgagtagctgggactacaggcacccaccaccatgcccagctaattttttgtatttttagtagagaccgggtttcaccatgttagccaggatggtctcgagctcctgacctcgtgatccacccgccttggcctcccaaagtgctgggattacaggtgtgagtcaccgcgcccagcaggaatttggatttttgagtaggagattgatgtgaccatattcgcgtcttagaaaaactctggcagcagtggaggatctgctgaagaaatgcaagactggaggcagtaagatcatttaggagatttctgcagtaattttggtgggaaattctaagggcctaaaataaagctggggcatggagaagtcatgtttaagagcagcaaagaggtaaacctgatagcctttatagtgatcagtataaaggagagtaagagaatagagtgactccaaggtttcttttggtgtaattgaatgacagtgtttccagttatcagaggtaagcatctgtgaagtcagtgaatttttaagttttcaacatgcaaaatctgagatgcctgtaatatattgcattatagtgatccgggctttaggagataggtcaggattagagatagagatttggagtctttttcttttttaaataatagctttattgagatactcataccataaaatgtactgacttaaaatgcacaattctgtggcttttagtatatccacagttaatgcagccacaattacaatgaacttttttacctcaaaaagaaaccctatatccactagcagtcatattccatttcccccatttccctcatcctttggcaaccactgacctactttctgtgtctgtagactggcccattctggggattttatataaattgaatcatataatttgtggtcttttgtgcatgacttctttcacttaggataatgttttcatggttcatctgcgttgtagcatatatcaatactctgttactgatgaataatattccactgtaaggatgtatcacatttattttattgatggacatttggatattttgtactttttgcctgttacgaataatgctgctttgcacattcatgtgcaagttttgtgtgaacctgtgttttcatttcccttgagtatgtttctaggggtggaattactgactcatatggtaactctgtttaactttttgaggaactgctggactgttttccaaattaacattctcattagtagtgtatgaggagtctaatttgtccaaatcctcaccaacgcttgctgttctctgttcttttgattataaccatcctaatgggtatgaattgattctcattgtggctttggtttgcatttccctgatggctaaaggtgtggagtatcttttcatgtgcttattggccatttgtatatcttctttggagaaatgtctatgcaggtcctttgcccattttaaaattgtattatttatctttttataattgagtcgtaagatttctttgtatacagtagtcctcccttatccagaagggaaatgttccaagaccccagtggaagcctgaaaccctggatagtactgaaccctatatatattgtgctttttctcatacatacttacttatgataaagtttataaaccaaaccctgtatatactgttttgtctcatacatacttacctatgatcaagtttataaattaggcataataagagattaacaacaataactaataataataaaggagaacaattataacaatacatcagcattactactcttgcactttgggggcattataaagtaaaataagggttacttgaacatagcactgagatatcacaacagttgatctgataatcagtatggctactgagggcaggtggtgtatacagcatggatgttctggacaaagggatgatttatgattaaggcaggatggaacaggacagtgggagatttcatcatgctattcagaaaagcgcataatttatgaattgtttatttttagacttttttgtgtcatatgtttggattgatacatgatttgcaaatattttctctcaatttgtgggttgtctttttactttcttggtggtgtcttttgaagaacaaaactttttcattttgatgtagtccaatttattattttgtattgttgttgcttgtactttttgtgccatatccaagaaaccattgctttctccaatatcaagaagatatatacctttgtttttttcttagaattttagagctttagcttttaatccattttgagttaatttttatatatgatgtgaaatagggaaaaatactattaatttttgtttattgatcatatcctgtaatctagctaacttcacttagtagatctatttaatagtaattttgggtaaattttttttaagtagacagtcatgtcactgcaagtgactgcagtttaatgttttcattgataatctgtgtgtcttctatttttcttgccatgttgcattggctaggacctctactacaatgaatgggagagtagtgagaggatactcttgtcctgttcctgagcttagggggaaagtattcagtctttcatcaagtctgatgtaaggtatagggtgttttgggaaaaatatatttaccttctctttccctctctgtttcctttcccctacactgccccttggcatttctggagcttttatttctttatgtaggtccaagtttcagtctggtattatattcccatcgactgaagaatttactgtaagttcttaaagtgcctgtctaatattggttgattctcttagcttttatttctctgagaaagtatttcacctttgttttcgaaagataattttcaaaggatatagaattctgggtttataatttttttttctagtagtactttacaaatatcattccattggccaggcatggtggctcacacctgtaatcccaacactctgggaggccgaggtggatggatcacctggggtcaggagtttgagactagcctggccaacaaggcaaaacctcatctctactaaaaatacaaaaattagccaggcgtggtggtacacacctgtaatcccagctacttgggaggctgaggcaggagaacagcttaaacctgggaggtggaggttgcagtgagctgagatagtgccactgcactccagcctcggcaacagaataagactctgtctccaaaaaaaaaaaaaaaaaaaaatccctccactatcttcaagcttacatagtttctgatgaaaaatttttgtttttgtttctctgcattatatcttttttcctccgattatcttcaagatttccttaaccttggttttcaatagtttgattattaaaatatatatatatatggcttggagtttacctaaatggaattcaacatatacatatacaaatatatacacatatacaaacatatatatacacatagagacagtcaattcttgttatttgtggtagctatattctgtaaagttgttgtatacactgaattagtgaatactgaaactttgtttgctcctaggggttaggttcttgtgaggctctggtcacaacattttcatcaactgatcaatagataaccttgctttatatgtgtttccgtttaaagacatattaatatgtcagttgatctattaacattgaactcatagccaacaacacatgcctgagcaaagattatcacatatatatatatgtatgtattttttgcaagacacatcacaacttctcatacttagaaacggtaggcagtatgcttggggacctatttaaacagtgaagtcaccagcaaaaggaacaaaaatgtgaaaaatgtggtactaaataaatcatgagatgaacacttgttttgccattggaaaagctaaagcaagaattcttgtttgacttcagctgggaacacacatgtatgttcggtgacatttttttcaccattctgcacttgtccacaaaagcactgcaagtattgattttgaggttgcaaattatagtgagtaggtaaattgacaaatacagaatctataaataactagaatggactgtgtacacatatatacactatacatattctattcatacacattctatacctatgaacttaaacatatacacatacaaatatgcatacacacatacatatgcatatatacacatacctcatttaaaaatttttgcctgagcaaaagatctattacaggaaaaccttaaggcctgttcacgctcattttcagaaaacgttgtttccatctttttcatgaatactactgcaattggttggcttactttcctaccttagcattatatatgagtgtatttatatctgtacacatatataggtatatacatttatatgtatttatagatttgtggtatttaaatctacttattaaacagaccttggacactgtactaagtctgagaatagaaatgcaaacaaagaccacatggtgtgccctatggaacttacagttgatggactcatgaataggcaaaaagaatgtaaataaaataagtacaaattgtgtagtagtaaatgctttgaagaaaataagcaggatactgagaagagaggggtggtagtgaccagggaaggcctgactcctagtgaggactatgaaatttttcccttattctgtcagtattcattgttcaagaatttaatcagatttgccctggagttcatgtgttttttattttaaaaattctattgttaatcatgttgctataggcatgaagcatttttttttttttagagaaaaacttaatgttttgtgaaagagagagacagctagagttttttgtttgactttgccttctcctgactttccctctgcaaggtttttgtgtttctaagttgtcttcttttagttaggagactagaatacagaaaaacattctgctaaatatgattttaggtattttgtcataaattagatcttaggaaaactgattttcaaggcatcctggggttttaacctaaatttcccaaaatattaaggctgtgaatcatttttcatcacaggatctttgtgatgtgtcaaagaaaacaattttgtaactgcagttaaagatatctaccaaagtaacacaaatgctgccttcaaaatgaaaaccagttttctgtttattcttgctaaatgtttatgtaatataaatgtagtatgggttctggttgatgttttgtgaaaattatgttctgtttcatccagcgcaagtatttacttgatctgatttcttcttgatacaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccagggtgaggaaagtctgctcagctaagtgtgtatattgatacacttactcttggagtggttttttggttttgggggttttcccccattcatttaattttatcaattccaagttagctcttgattgtgttttgcctattctgctgatctaaatctggctttctgtccttactaatacacttctaggcatatttcttcaaatctcaactgatttgtgctttggtaaaactcattaattgcaatatcagcctcattcaagcatgataagaaaaagtaagtggtacaatcttgtaatctaagctacaatataaggaaaattggccactgctgttaggaactagccatcagtgcttactctacattaagtaatttgttcattatcagagatgaacaaaattttattctcattttcatatagattgcttgtttgttcgtttcatgttactgacctaaaaccagtacggtattctttttttttttctttttttttttttgagatggagtgtcgctctgttgcccaggctggagtacagtggcgctatctcggctcactgcaaactctgcctcctgggttcacgccattctcctgcctcagcctcccgagtagctgggaccacaggcacacaccaccacacccagctaattttttgtatttttagtagagacggggttttaccatgttagccaggatggtctcgatctcctgacttcgtgatccacctgcctcgtcctcccaaagtgctgggattacaggcgtgaaccactgcgccctgcccagtacagtattctttagacttaagtcctccagtggctctcttgactgaatgaattttttaaatgactatttaaaaaatatttattaaatacttactgtgtactaggtactgaactagatctttgcatattctgtttattttttgaaaaaccatgaagaactgtaaagttccattaagtaattccacagaaacattaggaaagtctgacatcttggttgtggctaagagagtttcatattgattttatagttttaagtaatgattagggcaaattgccttttattttctttgaagtaatatttcagattacttcaaaatttttaccttgagagtttaaccagacaacttatttttatatagaattagttttttctctggaatattgatacacacacacacacacacacacacgtcacatttggggctggtggttaagtttttaaagattatattttaaaaactaaatatcaaggacaagttagccaaggactttggagagtgtggtttctgaattttgcctttctttatcgggtctttccagatgttcagtggttgtggaatcaagatgcttcccgcgatttactgcttgctatccacccgccaaattacattgtgctctggaatgccgacactggcaccaaactatggaagaagagctatgcagataacattctttctttttcttttgacccttttgatccctcacatttaacttgtgagtaacagttgcttgtggaaaatgagttaagtgagatatttataatatagtaatgctatgtgcatgagatatacacacacattatacatctataatgttaaaatgactgagcgaagtggagaagcatgtctagtccatatatctgcagctcctaatacacatactcaatcataagttcatatcattgcaaatatgataaaaaattaaatcagcaagctacaccttcactgtgttgaatttgtgaatagtattagactagccagggacagagagttactttgacactccagacttaattagttcttctaagaacatttaaataacttgaatcaagggtttcattcagtctgtggccaagttaagttcttgctttttaataaattgtcctaattcacgccattcattttgagtgccataaacagatgcatgtaaagaagaaataagcctaagcaagttttttcttgcagagatagtttttgctaatatgcttttaatgttttcctgagctaatgatctaaaaatgagatgtgctttaggtatttttgtggctaaattgtttagaaactatttaatcatccaacagatatttcttgagctattgctactcttctgggaaccaagatgtctcagaacccaaaaggcaggagccttcacagagtttgcattctagtgagaagaagtcatatcataaactgtgaccacaatgaattaataaattctagtgtagtaagaggtgacaggtgatataaaggcaggataaaggggatgcagaagaatgggggatgagggcatgcaagttgtatgagataaagtggtcaaagtaggcttcactttgataatgatcagaaatgtgaaggaggtaagggaattagctatggtaaggaatgtttttcctggatttgaatgactcaaaattgttttacccatcaacttttattgaggggtgtgtgtgtgtctgcacgtgttaaaggaggaagagaaaggcagacaaaattgaaattataataacatgggaaatgtggctgtgtaaatacactacagggtgcttaggcttttatgtatgtaaatgtttgtatatggacgtgtgcatacatacactcacttggtcaccagtttacttactcacataggtgcagtgctggggaaacacctaggagggctggcccagttggcagagtcagggaaggagggcatcacaaaagaaggaagcaaaggggaccttgaaggatgagttctggaacctgaaaaggcaacaaggctttcagctaacttgattgcatcagctctttacatctctgtaatttggttgatgaaagcattgtgtgttccagagtgtcagttgacctaacatctttgatttactcatattgaatgtgctagggttgtcataactcttgaatgcatcctttttccctgtgtttagagcagccttgctaagggctgggacccagggtagtaaggtttttctgctcatgtcttccagtattaggcccattgttgagggagattattttttcagtcataaaaaggcataatttgtattgctaaatatggtgctccctccttgactatttttgtttcatgtacacttagtaagtcactgtgggcccactactgttttctaaatattaagggaaaagaatattccttaatcatcttaaggttcgatctgatgcttgagaagaaaaagggaatatatttagactgagtagctcaggataaaaatttggtatcatcaaataaaatatatgaacttagctaattgtgatatgcagagcctcttaagtatggttttttgtttttttaagttatgggatatgttaaagtttttttgtttgtttgttttttgtttttgtttttgttttttttttttgagatggaatcttgctctgtcacccgggttggagtgcagtggcactatctcggctcactgcaacctccacctcccagttcaagcgattctcctgcctcactctcctgagttgctgggattacaggtgtgtgccaccacgcctggctaatttttgtatttttggtagagacggggtttcaccatgttgatcaggctggtctcgaactcctgacttcatgatctgcctgcctctgcctcccaaagtgctgggataataaggaaagatttttaatgaaagtccgtgccctgaatttatttagaagaacaaacacttgttctttctgccaataaccttatgttatctttttaatataagacataatatagaatgccaagcttggaggcctctgatgaattgtaatggaccacctgtttctcttcaacttagagaacattcccattatgttatgaatgcataacattgccagttatatattattaaaattatcactatattgctctcaaaattgtattggaataaaactgtatgctaaacttcattaaactttaatcagagttttgcttttctcaatatagtgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctaggtaagttacaagtgtaaaattaacattcatctacttatctggtatgaaagcatcatttttggagatgtacaaagactgatgtttttcttcatctcactttttctcatttctaattttgaatttattagaggaaaaaaatatttatttttgtcccctgccctaagaggagattcagcatttaacattgcctttgtttccactagctgtgctaaacttccccactgacttttatagattaaaatttttgaattctgatttttacttgtgaaaatcgcaatgatcctaaagttcaggcaattgaatgcattaaaaatttgggcacaaaagctggatactcattttaaatacattttcctgacttaggtgctgtgcattctcattcagcagtaaaatcggagtgtttttcttatgcaggtgaagatgtctcccatcctggttaagagccaaggctccgggggaagctttagctatgagactgagaaacttctttaatcttactcaaatttctctctcccagtctctaaaataaggctttaaagtatttcatagggttgttttaaagatcaatagatccaataatgtaagtaaagcatgtaatgtcattgatacatagtaatttatttagaagatgtcggctgttattaagaaattacaactgaataaaagtttattttaagtaatttgatgtattcaaaataggtttctttctttttcctatagcaataatctgtatattattgctttggcaggcttttttgtttgttttggcattcattttcagatagcctttatttttaatatgccaagattactctctctaggcttggtgagtaactacttgaaaaatatgtggtaaaaatataaattgctctacaaatacattttgcacttgtgtgtaagtatcacttctatatattaagccataggctggttaagttcactagttaatttatctctcaccctgtgccaaaatgacttaagattacttcttaagtatcttaagagaactttctattttttatgtattccctctcataaacaagaaattatttggcagtctgaatagttttataagttatgttttatatttcttaagttttctctcatatgaattatatgtatatcttgagtattggggaaatacattatttcttcaagtagaaccgctctgggtgctttcacatctattaattcctggactcttactacaattctggcagtagtaatattcccattttacaaataaggaaaactgagtcccacaccaatttaaataaagttactcaagctcacccaactaggacatggcagtcgggattttaatgcaataaaaattcctctttctagtcttgtgaactaactttattttaaatttcaaagccttttaataaaattatgtttgtaaaatgaaatgtaaaatgaaaatagtacataattgtatgtctattcctattgaaatatatttaatatagaaaaggtcattgaatgtatgcaacaatcacaaattattaaaatgatttttcagaccctaacaatctcttaaaatccttatagtttcacctgttttatttacacacaagaaaatgctgcaatataagtgaaactttgtttcaaaaaagatttaagacagcttaaaagtgaatgaaggcagccaaggggaagttacttgcccaaagccatacagatagtccagtaactcctggtccaggggccctaattaccctaaatgttgatgtttttcatcctgagtcttgattttaacagtttgcctagtacttttaatgacaaagtaaaagtaaaataaaactgtcttatgcatgccagctattattatattatcatttaccatgtcttgtgtaatattaataacttaatattctactacttaatatttcaaaaacttagaaacactgacatttctacccatcctatacaatattattagcatttggattttggtacatagtagagatctaagttttggatgccaacccatgttggtcacttcagggaatagttgtacatttttattgtcaatttttatgtgtaaagtacaaaattaaatcttttattaggtctgatataaatgaagtctttgacccaagtgaatgtttacttttttcagtgctgaattcataactctcaatgattgccttcagttggcatacctgccttcaaaaaggaatcacatgttgttgctctatcctcgagagattttaatccttgaccttgaggtgaatcagacggtgggtgtgattgcaatagaacgcacaggagttccatttttacaggtatctacaattcataaattatattccccaaaattattaagaatgttatattaaaagaaggccataatcttgcataagtcttgtcttcagttctccactttctcttttcaatttatcaaaagactagcaacactattttagattgttttttttgtctgcacttttgattggtttgatttaccctagaaattgtgactgatcctgagatatttattgaactatttaagtcacatgggtaaagacaaattattttaggattataaatggatattttaaatgtacatttagttttaaagtttgggatttgtctatttttttttcttttgcccatattatctaaatatgagtttgagtttcacagtatatactttattaatctattgtgttttaaaaaataaatatatcatctatttaaaggtaataccctgctttcagcgtgatggtttattttgtctacatgaaaatggttgtataactttacgtgttcgaagatcttataataacatttttaccacttcaaatgaggaaccaggtgagtttctgtctcacaataatgttatatttttcttcaaaattattttataaagcttgatgtggcaaataccagccaaggtatatagttaatgatactccttgctttgaggaagtttaaaatatggttataataagaggcataaaaagtataagcccaagattaatctcttgatgttaaaacagtgcacctcctgtatacatcaaagagagtaaaattttgtgtttcttgatcatatccatgagccaagtagatattattttttggaattttttttttttttcagtacaagtccaaccttgtgtgcctttattattatacccccttgacttgttggctgtaagaacttccattgtaaagtgacagaggttattaagtctcagttgtcaagtcagtcttatcttggagaatggaaataatgtttttgtgaaattatatactgtgtaaagatcaaagtgattttcacatcttttggaaagtacagttattttcaggcttatagactactacaaattatgatggaaatttattcattaattatatatcactgttgatcctttttcaaagtatcgtctttattttaaaatattgaaaaaagatatcttgattatagttgttattttggaaattaaacttagtacagtcattaagtaaattatatttggaaaaaatttagtagtaattgtaaaaagtgaagccatgcttgacattgcattcatgaaggagtgatgcccaaatttagttgaggttttatttaaattgaaacaaacagtagtggtatcgatatggctgctttctgatatttaaaacaattttatgtgaagatccagatccagttcaggagcttacctatgatttacgaagccagtgtgatgcaatcagggtgacaaaaaccgtccgtcccttcagtatggtgtgctgtcctgtcaatgagaatgcagccgccctcgtagtgagtgatggcagggtcatgatatgggaactcaagtctgcagtttgtaatcgaaattcacggaacaggtaaatgaatcaacaggatcatggttttgttttttgtttcctgtttccttttataaaaaatttccataatcataaaaataggagggctggttttctataaaaatatttttaaggtaataattaaggctttagattattagggaattatgtaaatctgctagagctatttcacctatgggtaagatgaatgaataatataaaaatagatagaatgccataatctggacttaatactttgaattcctaatacgtaatgcagattttaagtatgtaaaaccttctaattattatgtctttgcagtagttctggtgtgtcacctttatattcaccagtgtctttctgtggaattcctgtaggagtgctacagaataaactcccagacctttccttagataacatgattggtaagcttttttcccctctaactccatgttaagtattctttctgaagggcaaaattaatagaatcactcacttgtaattattttaaagtcaaaaaagttaatacttgagaaaactagaacatggaatcattctttcctaaataaatcagaggggtttaaaatacttaggtagaaaagtgcctgaagtagcacgggtttgcattatagttgttagaaatagaaaacgttcattcgtgagagactgatgtaaatgaaagcaatgacattaggcatctggattttggacctagagccgatgctgagctatgccatgccaactcagggccttgctgtttgctggttcctcagcttggaatgaagtacatgcttcctttctgtctgctactcctaattcaaaattcaactcagatgttgttttctttaatctcccaagtctaatttaaatgctcttcttttgtttttcctaacagttatcagcatattttaattgtgggtttttttcttctgtttcatctcatcaattgtaagcatcacaagggtggtacagtgtttgattctattttgtctttcccagcactcagcacagtaccttgtgcatgcctgttttgtagtaaatatttactgaaggaataaagtaactgagcagtattagaaaagattattttaactttttgacatgaattatttttatgttggggattctttcaaaaaatcatttttggagataaagtgttcaaagttatttaattatgaggccagtatgtattaaaggaagaatgagagtttgtgatttcaaattttatgctacttgaaattataaggctttgtaaatatgccaagcaatttggacatctaatttttttacagttgtggctatggtttataaaggattttctgttttattatttattctaccataatataattgaaaacgatattatttaggagggtttttttgttgttgttgaaacgctaaataagtgatgcactagaaagagcattggccaggcgcagtgactcacgcctgtaatcccaacacttttggaggccgaggcgggaggatcacttgaggtcaggagttcgagaccagcctggccaacatagtgaaaccctgtctctactaaaaatataagaattagccaggtgcagtggcatgtgcttgtggtcccagctacttagggggctgaggcaggagaatcgcttgaacctgggaggcggtggaggttgcagtgagccgagattgcaccactgcactccaacctgggcaacagagcgagactcgatctcaaaaacaaaaaaaaagcattacattattaattacattaattagatcacatttattgggtacttcatactgtgttaagtgctgtgctaaatattctacatattaccttggtacagctttgcaatgtaagtaatattatctccatttgatacatatgagaactgaggcccagagagattaaaactttaaaccacacagtcacacagtcacacaatggaagagcccaagtgtgacccgggtaatcctggctccagagcctgctccttagcaatggcctccagtcctgacagctccactgtcatcttgggtaagaccatcattcatctctaggcctcagttttttcacgatttctgccagttatgaaatccttttgttcagtgatacttactattatatctaaaattatttctctccactatctattctaccagacataaatccatatgaggaagcctggacacatgttttgcaaaatttattttatcagtaacacaattttttgagttaattcaccttgtctactcttaatatgaaaacttaaagtgaaaagaattataaacacacacaagaacagcactaatcagttatatggagcccataggagtttgaaattttatgctgtttaggtatctaagtgatataaattacaggttttttttttttttttttttttgagacggagtcttgctctgtcgcccaggctggaatgcagtggcgcgatctcggctcactgcaagctccgcctcccgggttcacgccattctcctgcctcagcctcccgcgtagctgggactacaggcgcccgccaccacgcccggctaatttttttgtgtttttttagtagagacggggtttcactgtgttagccaggatggtctcgatctcctgacctcgtgatccgcccgcctcggcctcccaaagtgctgggattacaggcgtgagccaccgcgcccggccaaattacagtttttaagagacaaatggatacggattgtatagcagttcttgacaatgtagttgattttaaagtgttaaataaagcttcgtacttgaaaacattttaatttaaacttttaattaaacttttaatttgaaattcactgtgttcttagtgaaaattcaaagcaattcaggtaaataaagaggctgatttatattcactggataaatgctgatacttattaaggcctaatttgccctacattgtgaattgcctcttatgaaaaatacttgaagaaaaatgtggcattccctggatgtcaactcaaagccaacatatgtatgtgtggcacttacatgttaagcttcccattccttcatatttcatcttttttattttattttattttttttgagatggagtctcgctctgtcaccaggctggagtgcggtggcgcaatctcggctcattgcaacctccacctcccgagttcaagcgattctcctgcctcagccccatgagtagctgggattacaggtgtgcgccaccacacccagctaatttttgtatttttagtagagacagggtttcaccatgttgaccaggatggtctcaatcttctgacctcgtgatccggttgcctcggcctcccaaagttctgggattacaggcgtgagccaccacactcggcctccatctttttttaaccaaagttatgtagagagattgatattgagtatgtggctaatcctaagggatcattttaataggattaaaatgctattttttctatatattttgtggattttaaaataacattattaaaacaactttacagcttcaaaaggttgtatttatcacccactcttagtaattatttatacttttcctttcacactatatacatgtttgtgtttatgtgtgtgtagacatgtatgtatatactcatgcatattctttctatttttggcaagttaatcccaatattctgtagtggtttataggaaggaaatttgtatacctttttaatgaacagtcttgatttcattgtactgtttagatttagcttttgttagaatgatttttattggagtcatctttttagtttgagacttgctaacctaagtacgaatggtatatgtgaaaataatgccattgaagtcttaactattgacagtgatggtgtatatattatacacgtgatttatgaatatatatatttgtatttgttttatatttacttataaaacattttgtaattacactgacacattaaggtttcttattagaaattatgaataagttatttaaatctgtttttcatgaataccaattttgtatgtactttacagagtacatcagattgaaaagtaaccctttcaaaaggcagtaaaatgagaaaaatgtggtacagtagttcactctgcagaaactgttctctaatgcaagttctcttgctttgttctgaagcctgtgtagtgctttaataccaggaacattgactgaaacagtgtttcttagaagacataggtccctgcattctggatagcaggactcgggagtaatctatcctttgaggtgttagttgatgcaatttaagtcctatagccaggtacagagtcattgtgtccttaataactacagccactaaagtactacattaactacattatacttttagacctgaagagcatttctactgaaaattttctttagctttttaagatcagcatacactgtagttaatatatttgttatttttattacaaatcagggcaaagtgcaattgctggggaagaacatcccagaggttcaattctgcgggaagtgcacctcaagttcctgctgacgggactgctttcaggactgcccgcaccacagtttgctattcgtatgtgtccaccgttgaccacaaaaaacatcaagatgtatcagccactgctggctgttggtgagtatttgacctggtctttttttttttaactcactttataagatgtttaggttttctagtttctagaagatcctttattctttttgaggatgctttaaaaggagatagagactaagtgaaactgtaaatactcatcctggaacttaaaaaaaaaaaaatttctgtccttttattccaactgtcttatattgaattggaatgctgagtcttcatccacctgagactggacagtcgagtctctgacgctgtccattcatctcggaaataccaggaggctcatccctgcagtgctgaatcccaggctccttgtctgtaattggaccaccccagtctttatgtcatgtcagttttcgttgggtctttattgactaaaaatatagtcagggttaatagcttaataatagcagggttcttcttttgccaagagttatatattaaatattatttaaagtggctatggtccctataaattaagatttgccttttggtgtgaaattgtgtatttgtatgttataggtagaaaaatttatctgggttccaacttgctgtcacattgatttcatagtaatgtgatgaacctaattttctttacagcatagagaaaaaaacaaaatttagtttgctattaagtacacattattaaaatacatttctccaaaacttctgaaaaacagtgtatttgtttgaaactcaacatttcttcttaagatgctatcggctggcttctggctttctcccccagtctattaacatgtgatttgtggtgaaaacctcaccatatttattctgtggccaacatggctgacttctcagtgttaaagactcatttgggtattactgtttggtagtacccttctgtttttttctgtgcctatcttttgaaagcgatttgatttttatgattcaattgtctatatatgtgtcccgatttatataatgcagataaatgtttaatttttgctttagaaactgttgattaatatttcaccactaatagattttaattaggattcatcagtgtgcttcatatgtgcatgtatgtattatgtcagtgttcctgatttgtcagttaggattttgtcaatttcttggggaaaactacttcttgggatagctatgtaataagagctatggcaaggtctgagctttccattgtagaataagctgtattggtatgtagtgaatatcatttactgaatttagtataacaaagtaaaaatataagtacctaaaagtttgtctagaggtgtcactaagaaagataaataagagttcagctatggaattaattctccttgtggtgcccctagtgcattagatcataggttcagcattgttaaaactttcagattgcagaaatcattggattattatgaagttctgttaattgaaaaattttagtaatttagttattttctcagtgccaaaaggtattattatgaaatagatgataaatgtaaacaactgtacaatgtgtttttctagaatagttttgcaaaagatttctggagttttattcagcaaataagataatattggaatttgcccagcatttttacttccactctgttgctttgcatgaattcattaatctttaaatcatgtgcagtgcaaaagtgattgtccatatagactgttcacttttcttgcttaacttataaaaacactatagagactgaagctttactttctcatgtatgtccgtgtcctttacatttaaactttagacatactacctgagaccatgaaaagctttagaataatacctgtaaactattaattatagtgatgacagaatactaatagttaaccaagtgcttactttgtgccaattactgtgcttagtgctttatgtttccccatttaatctccaacaactagattttctactcttcccattttaaagagatgaaaacacagatttagtgtgggcaagtaattcatccaagagtataaggaagagccagggcttaagcccaggtttctttaattgcagaaaccacagttaaccattatactttactctcttgtcaggatttatttaataaaagagacaaaacaaaaagaaaactttggaaagaaaaatggataaccctggttagtgagctctgctagattgcttatttgaggaccagctataataaaccttctgagtctcaaaaagtataaattcccatgtgtataaaagcttaggaaagtgtttcttcaaattgtatgtgtattaatgtaagttttaaggtctttctgtgaaaaatctattcctggaattaggcaaggcttttgagcacgtgaggttaggcccattttttttataaggaagtggaccagagaaattcattcttctttgtgtgtttgtttaaacacatagtttgggtttcttttataaaagataaatgtgttaagtgattaaagtcttgagaaaagacttttcttgcaaagtgctggaactcccactgaattaatgctcttccatgatgtcattttgaaaggtacaagtaatggttctgtcctggtgtaccatctcaccagtggtctgctacacaaagagttaagcatccactcatgtgaagtcaagtaagtatgtcattgtgatgatgacatcacaaacatcatatcagaaaaaaaattctcatagacttttctacattgagtactctgtaatatctgcagtggtgattatttgaaaagtttgaataatattcatgtccaactaatggctatgttaatcaaggatgataactaattctttgctgtgtaaagaacataagcagtagagaatgttttctcttttattaggttggtgcaaaagtaattgcggtttttgcagttttttttttttttttgttgttgttgttgttgtttgttttgttttgttttgttttttttaaatggcaaaaaacacagctatttttgtaccaactaatattgttgcacctcatttatttctcctaagggccaggctgttttctcactggatatccttacgttgccttgttcaggtttattttatttatttattttgctcaaaattattattttttattattttaaaattttttttactttaagttcctggatacatgtgcagaatgcgtgcatttgttacatagttatacatgtgccttggtggtttgctgcacctgtcaacccatcacctaggttttaagctccacatgcattagctatttgtcctgatgctctccctcccctcacatgcccccgccaacaggccctagtgtgtgttgttcccctccctgtgtccatgtgttctcattgttcaactcccacttatgagtgagaacatacagtgtttggtttttctgttcctgtgttagtttgctgaggatgatggcttccagctccatccatatccctgcaaaggacatgatctccctttttatgactgcatagtattccatggtgtgtatgtaccacatttcctctttctttttttttctttaattttactttaagttctgggatacatgtgcagaatgtgcaggtttgttacatagatatacatgtgccttggtggtttgctgcacctgtcaacccgtcatctaggttttaagccccacatgcattaggtatttctcctaatgctctccctccccttgcccctcaatccccgataggccccagtgtgtgatgttcctctcgctgtgtctatgtgttctcatcgttcaactcccacttatgagtgagaacatgcagtgtttggttttctgttcctctgttagtctgctgagaatgatggcttccagtttcatccatgtccctgcaaaggacatgaactcattcttttttatggctgcgtatttttcatttctataacgatccatcagtaggactgcttatgacaaattcaaataaagtcattttaattgttaatttgtcttatttattctttgtttaaacatcatcagaacgctgcatagcatttatttgatttttaggacatgatctgcttatgagttctgtgtatgcagagctgtccgagggaaagctaaattgacggaaaagtgcttcttgctttctgttccaaaatgcctacctgtgctgtccatagcattatttcgctgaatgcaaggctattttccttttgtgtcctatcagtgatagatcgtagagttacatatataaaatatgaatttccacttttttgtttgttttttgatacagtcttactctgtcacccaggctagagtgcaatggcgcgatctcagctcactacaatctccgcctcctggtttcaggtgattcttatgcctcagcctcttgagtagctaggactacaggcacgtgccaccatgcccagctaaattttgtatttttagtagagacggggtttcaccatgttggccaggctgatgttgaactcctcacctcaagtgatccatccacctcagcctcccaaagtgctgggattacaggcatgagccaccacccccagccagtttccagtttttttttatgatctttcagtgaaagcataagaagtcattttctgttttctgtacattaaataattgtaggtcttgtgtataaaaattctcagtgaacccttagcaaacacattatcctgagtacatgcattttcttaatggagaagggttaaccttttttttctttttttttttttttttgagttggagtttcgctcttgttgcccaggctagagtggaatggcgctatcttagctcactgcaacctctgtctcccgggttcaagcaattctcctgcctcatcctcccaagtagctgggattacaggtgtatgccaccacgcccagctaatttttgtattttttagtagagacaagatttcaccatgttggtcaggccggtcttgaattcctgacctcagatgatctacctgcctctgcctcccaaagtgctgggattacaggcgtgagccaccgcgccaggccaggttaaccttttaagtatcacagcttctgattgtgatggaaatctctgaaaagtttgcattgtcttactgtttcaagtgcattgttgtgtggtgcagcccaggtgactgtttattgccaccttacgctgttcctatacagcatctccccagatacatttacgtggaataataatgtctttaaaagctttgggcttttgaggtgcagtgacacaggtatctgtttggactctttcaggctgttattcatctcttctcttctgttgcagtgtctgtagcttgccattctggcacttctagtagtctctgcttacactgctgaatcttctctctctctctttcccatctcctcttctctcgacatttcctttcaccctgccttgtgtgtctggtgtttccttttatggtcagcactaaccaatcgaaactctccatttaatcactacttattctagggattatgttaactattaatacttcacacgtatcatttcattgaatccccactacaatcgtatggggcaggtattgtatttccagtctacagagtaagaaactgaaaattacagagtaatctgtgaaggagctagatggaattcactctgggcctttgaagcctcagaacctgaactcttcacttatacttacagtgcatgtgctgcatctcctgctaaaatacgcacataggttagtaggaatcatgttggcagtaaaattaaaatgttggctgagccaagatttgtgctaagaatttcacacatgcttctgaaaaatcaaacatgttgtcttttcaaacacagaaagttttaatagctaattaatcagagaggtattaattttaagtaaggtttattatcctggattagtcaggttatagatgtcactaaatacttgacttatacatgttaagataatatttatggttgagtaacattgaaattgattataagtgttacttgggatactaactctgagggatatactacttatcagataaatgtgaatgatcatacaaagatactccatttttatatgaatttttcctcttcattgccattttgaaaataatttgtattttatattcagagatactgcccaagagaacactaaaatcctgctttgtgtttcagttaatgcaattttagtattataatcaaaagccattaagaaaatttcacagaaatacaaaaattagctgggcgtggtagcatacacctgtaggctcagccatttgggagcctgaggtgggaggatctcttgaacctgggaggcagaggttgcagtaagttgagattgtgtcactgcactccagcttgggtgacagtgagaccctgtctcaaaaaacacaaaacaaaacaaaacaaaactttcacgatgtattataaaaatgtctgaatttattagcagtaaactcaaaacattttagattttcatgtccaaataaggttaacttttagaaagttgtttttctaccttttattaagtgtgtttttaaaaaatcataatctaaagcacttgaaggttgtatatactgtgccggggactcatgacagcagatagcacaaagtgtgtgtgtttttaaaaccatgatgttttaacttgtgatgctttatgaatatctgttgaatatcttctctatgcttataaacagagaaagcctttgaagcttataatgcaatggaagatacttagaagtaaacaaaatagagaggtatatgtagattttcttaggtcattagtttgtgtctttgtctggtaggctgaaactactgtcatatgactctctccctggccagattttaatagtcatactaatactgatgtgaatcctgataattaaactatcttgtcattacatttgtagataaagttttggttagaaatgattttgtatgtgttaggtatggtaatacagtctcaaataaaaggtcatgttaagataaaaggtcatgcttactttttaattaatttgtgtaataaaatttaggtctttggaaaacttatttttcaaataaatgaacctttcaaataaaaaagagaattagtttaacctttatctcatttcctattataggggtattgaatggacaagtttgactagttttctttcttttgctacctcaacaccaaacaatatgggattagtgagaaatgaacttcaactggttgatcttccaacaggtttgtttttaaagatccaaataggtttgtcatattgaataaacatgttgccatttataaaacatgtttgaaagtacttctttcaccttggaatttttttttatatttcatgcttatatatttattcttttattctctaataattgccctagaaaggcctcatcattgtttacatggaaatgttgttggcacaaatacatggtaaaatggaggaccattagcctgaacagacagattcattaaaaaataggataccggttctacttttaagtgcattgttatatgtaaccaactttaaaagatcgatttaaaaataactctgtcaatggactttattagagtctgtgctggaaattttggcttttataggaaacacttagaaaatttataggttaaggattgtttttaaatgctcaaatttaaaacttgtaatagtctctggctgaatgaatagagaaacttaatttgggattttgaagattctacagtaggaaacgtcccaataaggtaactttttcagaattgaaagcctaaacccagtgaatttcaaaataaagaatttgaaaatataataaggaaagagtttcaaattattttctggtgtatgcagtagtttcaaagaggtttttttaaaaataaaattgtgatgagtttctttaaaatggtatagcaacacgaatcatatgtagatgatcttaaccaatgagagcatgtgtatgtatgtgtaaaatgaattaaatcaaataaatggttgtaaatcaagtaagttgtaaataaatgaagtacatggttgcttttttatgttctccatatgtattttcaagctctcaaagatccagttgttcttacttctcagggtatgttgctgaacttccaggaatcattcccgtctttagtccagtgttgctgctctagtctcattggaagtgacctgtccactgactctcatccccaagttcctaatttgccagcagaatggtactggccctgtgtctagtgatcccagggataaaatgctgttgtctagtatcattgacttaaaaaaaagaaaaaaaatccctgttttatttgttttggtcagctcaagttcaggactgttagataacttaaaatctgctttgcacagatgtatttttaaggaacaaacatctacagtaacagttacagatttccttaagtgggatatttgagttcatagatggtagacttttatagcctgggcttctaaggagggcagcagactagtgcagtcaggacaggacatgggctgtttggggtataataatagtgagtatagtgagattccacatgatggaatctcaacaaagagtaggaaggcgtttaggccttcagttgtccttgaattgagtatgttctctcttttgtttaatgtagataaaaatctaacacaagatactaaaacatacaaggtagaatttatactttttttattcacagaaaatcatgtaacttcctttgcgggtaactcattctttcacagcatacatgaacaccgtagttattccctagtttccagtttataaagatgttttgagaggaacatgttcaaaatatttaactagtattttgcacatgggacaagaagatcttaaatacatgtttcaagagtttttcccccactagttagtatttggaaacatgggaatgtttgtattaaatattactttaaataagtagttttcgcaccagacaattgctgtaccataaatatcttaaaacttaacattgtttttttaaatttctaaaattgaattatagaattcaagaaactgtgtgacaaatgaaaatgcctttttacaaaataaatatctgaatatgtgatatattattgatcattagtttgtaacacttttaagaatattctttgaacttacattattagaaacagcttagaaggaactgggcgccgtggctcacacctgtaatcccagtgctttgggaggctgaggcagatggatcactagaggttaggagatcgagaccagcctggccaacatggtgaaaccccatctctactaggagtacaaaaatgagctggcgtggtggcgagcgcctgtaatcccagctactcgggatgctaaggcaagaaaatcacttgaacctgggaggcggaggttgcagtgagccaagattgcgccattgcactccagcctgggtaacaaagtgagaccatctcaaaaaaaaaaacccgaaaaaacagaaacagattagaagcaaatggaagaatgaataggagaacagagggtaggatgggtaggactgatcaaattacattggcgtggcttcttgtttttcatacatgttttatgcactgttctcacttttttaaatatttgcaattaaaggtaggagcattgcttttcgtggtgaaagaggcaatgatgaatctgccatcgaaatgattaaagtatctcatttgaagtaagtgtcaacctaaaaaaaaatctatggtgttatcacaatgaaatctcgtggatttttttaatctttaagaaaatgggaatgtgctggaatgcatatggaatctttttagtgatagcaaatggtgatatgcagcccaaagaaaatattttgattacaaaattaagttgctatcacttttaattctctacttctaaaaagatgaagtaacttttgcatgaatcgttatttactttcggataaagttcttatgtacttctatctaagcatggagttactgagtgaaagaactcattttctttatgtataatttaaactcattttgcttccagaaattgagtttttttgtttcaggggaaaataacatgtaaagcagtattattaaaaatagaaactgaatgaaaatcaatcaaaattacaaagaaagagtaagctttctaaagtagttttcaaacttgttttggcttttctaagatctttgcatttccatataaattttagaatcagactatcagttttatcaaaaaatcttcctgagattttgattgggattgcattgaacccatcaatcagtgaggggaagaattggtatcttaacaagttttgtaactcatgaacatggtatgtctctccacttatttaggtcttttaaaatttcagcaatattttgtagttttcagtgtgtaagtcttacatattatttgtttattttgtgttttctttgatgcttttataaatgacatttttaaatttcaattatttattatttgtatattaaaatacagttaattttctgatattgaccttgtgccttgtgaccatgctaagcttagttattacttctagtataggtgcttttgttaattctttaggattttctatagagacagtctcgtttgctagtaaagacatctttacatcttttcgatctataggccttctttttgcttgcactaattaggacctcctgtatagtgttgattagaactgagatgtcagctacgagctgacatctttgctctgatcctggaccttatggagaaagcattcagtctttcaacattaagtatgatactagctgtagattttttgtatatttcctttatcaagttgaaaaagttttattcctagtttgctgagcctttgtattatgagtaggtgttgaatttatcaaatgctttttctgtattcattgatatcatcatatggtgtgtgtgtgttattttgtttttctttttgaagttcactaatatggtgaattacattgattgattttcagatgttaagccaacatgacattcccggaataaactctagttggtcgtgatgtattactgttttgacatattgctggatttgatttattgatatattattaagagttttatgatatattattaagagtttttatatctatgttcatgaaggatattggtgtcgtttttatgtaatatcctttgttttggtatcagggtaatactgaccttgcagaacgtgttgtaaagtattctctctcctttttttttgaatgagtttgtgtagaattgatattattcttactaaatgggaaaaatttattaggaaacccatctgaacctaaaattttctttgtggcaaagtttttaaatacaaattcagttttgtttttttttttcataaatataggactatttagattctctttttttgagctttggtaattggtgtcttccaagtaatctgtccattttgttgaagttgctgagtttattaatttattgaaataagcttgttcatcatggatctatgatcagtgattatctttcccactcctaatatcagtaaattatatcaaccaattttatttattgatcttttccaagaaactacttttgattcatttgattcttctctatgatttttccattttcaatttcattgtctgtcatgcttatcttttgttcttctgcttactttttaaatatgctctcctttttttacatagttttctaaaatagaaacttagataattgaattaagttgattctctaaaatgtaatgtaaacagttaatgctatatgagcaccagttttcctgtatcctacaatttttgttatggttatatgttttcattttaattcacattataatctttaaaaatttccatggggtgttattcagaggtatattttttaacttcaaactatttgggtgttttgccaggtatctttctgtaaatttctactttctgttggggtcacacatggtcctgagtggaagaatctcagtcctttgatacagggagtacagggatcttcctactctgtcacatttcctctatgtcagccatcatttgctgataatattttagttcctcataatgcttattgagtaatcagtgctcaaattatatttgttgaattgcactcgttgatgtcattcagtacttctttcaggcttaacagaaagtgaataaagtggcatttgttgaataccaactgtagtagaatgatagaaactttacatactttttcattgaatgtttaccataatctgtatatcaattaattgaggtacatgatgagattctcctgtcatgtgtgagaagttgagcctcaggagggttaacataagttgtggcatcagggtttgaatctatgccactctttcttccaagttggactccttgcctaattgtgtgagactgtatgttctcttacaggtcacttagagctttaccttcttatgactgttaatcatggtgctaaatggtagtttaaattgtctatatttagaatgcgtcagctgagtttttcaatttactgaactttttatttgctctaattcatggtgaaatttttgcaaaaaggggcttatttagtaattttgtttattttaggcagtatttggcagtcgtattcagagataaacccctggagctatgggatgttaggacttgtacccttcttagagagatgtccaaaaacttccctacaataactgctttggtaagttacaatttaagaatttaatagcttatttaggtatatatgtatgtggtgaatgttttgcttaagcttgaatcaaaatcattactgccaatgtcatttttttggttaaaaatgtgtgttcagagaagatgatctaaataaatggagataattcttattttcttggataaatcaacctaatatcatattagtgcaattccaattcaagtttcatttggatattttgaggaatatggtaaacatattcaaaaatgtttatgaaagaataaaggtcctaaatagctaagtcatccttgaataaagaggagtaaatgtgggaggtgtgggtggggttggcccttcctacctgatattagtacatcttacaaaaccatggaaataaaatcagtattgtattggcacaagaatagaaagtgagtcaacctaataaagagctcaggaacagacccatgaatatttggggacttaatatacagtaaagtagcacaaatcaaagaggatggacagactgtgtagtagacggtgttgggaaaactgtctcactttatggagaaaaatacttgatctctacttaataccgtatagagaagtgagtgtcacaggactaaagacctaaatgtaaaaatgtaaagctataaaattgaatataacaaaatacaaaatattgctgtgacctagaggcaggaggagacatcagaagctcaaaccaaaaggcaaaaaaaaaaaagaaacaatgcatttaattaatcaagattaatgctttttgtttgatgaagatgtcaaagttaaatacagaagacattttgggaaaacaaattttccagtgtctaaatttaactagaaactcctgcaagtcaacagtgaaaaaaagcgggaaccctagtgagaaaatgaacaaagtctgtgaagagctaatgagaggcagagaaacctaaaaggccaacaagccatataaaggaatgttcaaactcatcagttttcagagatgttcaaaccatgatatggatctaccgtttagactaacaaaaactggacagccatatagtgttaagtacgggtggaacatagggtatgggaatccttgtgcattgctggtaggaatgtagaccaatgcagccattctgtaaagcacgctggcagcacttgggcaaacacagacatcttctgtgtccgctgagctcttggtcgtaaatgaacttttgcaaggatattgactggtgtgttttgtcatgatgtgagtttggagaccatctgtgtgtttttactgagagaggagacagattaacaattggctgatgcacccatggagtattacgtagcatgcagaaacaggaggaagaggacttaaatacagtggaaagagtaagaaacaggatgaagtatatatatatatatacacacacacacacacacacacacatataaacacaatactatttaggtaaattagataataactacatgttaagaacttatacatatgcgaggatattggactaaaaggctttacaataggtggaatataaaagaatatataaataaaacaagtgattttggaggaatctatggatgataaaggaccctggttcgagaactgtgattgtcttatcgtgtgcacataagagatgggggaggagacgaggaataggcaatactatcattgaattcattattttcattttgtaagtattttataaaaacatcaaaaggtcagaccttttggaagtttgccataaaagctccaattaaaatgcattcatttagcctttctctaagtaggtaaaatctaaagaacaaatgtggattcatgtgtagtaataataaatgatactgggcagtggtgtgtgtgcccagctcttctggacgattctttgacagaaggaaacctagcacttctaggtttgtctgcatttgctttacaggagtggtcaccatctcacaacttgaagagcctgagaaagaagcaacttgcaactcgagaggccatggcccgccagaccgtagtctcagacacagagctgagtattgttgaatcatctgtgatcaggtacagtacagtgtttcttgacactgtcatttgtgccattagcatcatgtctgggaagttgacaagtatcatcggaaggtgtctatggtagcaagttggactctgcttttgaacatacttagtttcatctttcagtacatacccagattactaaaaagataattttatcatttttagtattgtactatactgtttgttataactaataacatatgcagtaatattcacccatcagcatctagtagtaaatgtgctcattccgagtgcccttctactccatacacttcagcttctgaaattcaaatgaacatagcatagacatacagatagatcatattatcatttatacacaccaaagaaaatgtgttgggaatcctaaatttgtgtatcatccccatccataccaatcttacagataaaaggcttcagagataatgttgggtcactgtacagcctcccttctgttgagcacagttctatagccaaaatctctatgaattttatttttcttgtgttaagtttagatcaccatttctctctgtgcagggtaaacttcctctgatgttgtggctgttaaggagtgattcatgtttacccataattagctgggcaaatattagtttcagacttttaaaaaaatagttttggacctcctcttaatgcgtctgtactttgggcaagttaattaattatgagtatcactctaggggaaaaaaaaacatctttatcatatgtttcactatcccaaagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatgtgagtacaaccttgattaaatcttcatcaagaagattttgttttgttggttccatatccagtgaaggcatagttaagttggaaacttcagaaaagcctaatgtaaataaactttatttaaggagatattatcgattaaacttgttccatactgctagagaataacgctgtaactattttgattaaatgtttactgtgtgctactcatttttatccctgtaataatccatgaggagttatctccattttacccataacaaaactgtgggagaataagtaactttcccaaagttatccagcttactcatatggcagagcagtgttttaaactcaggcctgtctgacttcagtatctgtcttctttccatttcaggcattaccctgaaggatttgacttacaatctagtattatttttggataatagtaatcaggttgtaagtgtaatagtattattaacatttactaacttacatatattcttatggccttgtggaatctgtaactaaagttttgccattaatcatttgtgtcagcatgcatctcatagatagtttttaatagatggatcatgaaaatgtttatgttaattaatgcaggctattataatggttaaatgaaggcatgaggggattttttaaaataggtatatttattttaaattgctatctaaaaatggaatgctctagtagaatgccaacccccataattttataggtggctttggggtctcataaagttacaatctagatgttggctgtggctacagtcttttgaagtgtaatgggacagaaggatctatttccaagttggctgcctcacaggctattgcacattaatgctggctgttgacgagggaccttagttcttcatgtcgatctttccataaggctgcttgagtgtcctcacgacatgacaactggcctcccctagagtaagtgatctgataaagcaagaaggaagttgcagagtctattatgacctggtttcagaagtctcttcaaaggcaacttcttaattaaacattctattttatggctaggaaagtagatatcttaaaatgttgcttcatattatatacagaatttcatttctttaatatttttttttattaatggactttattataatattgatttttaaatccagtttttgttttgtttcttgactattaccagagtttttacggtattcagtgtgtgtgctagtccactaatggtcaattattcaaaccactagagttttcttactttttaccatggataccatttgaatttttatgttgtacaataaatgcaaaaataaaatttcttttaataaatagagaagtaattgagcagtaatattatttaatagctaacatgtattgactatttactgcatggcaggcattgctttaaggcctttgcctttataaatttattaatactagcaacaactcaagtttcatgaacttaccctactttatggacaataaatccaagacagaaaggttaagtaaacatgcctcaaatcacataccagtttcaagctgggattcaagcccaggcagtgtgactgcagagcccaggctgctgagccctccatgataccacctctgagcatctattagaactgcaagttcctttcttcctccaagttagattgactacagcagcatttcattcttatgttgtgcttctatatgtaacttctgagcaaagctttctgtgaatttaaactgcatatgcctttagtaaacagcatctcttcaccttcatgattccacaatgttccaaaacgtgtcagtgaagctctggatccttttttcaatagaaaaatcacggcacaattagttataaaagagctttaagtttcccttggaatggatttagttatccttttgcagtgagagataagtttgagttggctctctggaaaaccttccctttacttctctgtttttcttactttaatttcccccttttttttttgaggtatttgttcctcaaaagacatcccctctctttaaatctagttccagtaactacttaatgtctatgaagttgaaatctcctatttcttcatagttgaaattgataggcaatgtagctctttgttagtgtctaaagtctgttttaggatttgatgactaaaagcatactaaagcacagccctttaaattaagttttattaaaatatttattataatgtcttatacagcatagtgaaatttatatttgtttgttgctgttgttttctagggaagtatgggtagtattacctgcatcgcttggaaaggtgatacattagtgcttggagatatggatggaaatttaaatttctgggacttgaaaggcagagtatccaggtataagccaagaatgaaatcttgttatttcattaaaaaaaagaaatgaaatctttttgttttgttttgttgagatggtgtcttgctctgtcgcccaggctggagtgcagtggtgcaatctcggctcactgcaagctctgactcccgggttcatgccattctcctgcctcagccacccgagtagctgggactacaggcacccaccaccacgcccggctaatttttttgtatttttttagtagagacgggatttcaccatgttagccaggatggtctcgatctcctgacctcgtgatccgcccacctcggcctcccaaagtgctgggattacaggcaggagccagcacacccggccaaaaaatgacatcttgatatggttccattagaggcttgtgacttggcaagaaggatcagtaaactcgtggaggtgtagcttggacccttgggtcccttcacctaaacttgggaggatgggccttgagccaagcattcttaggagatagttatctgcaagtggcccctgcagaagtcttagctgaccttaaagggcaggccctttctgtcagatgtggcccccagtcccagcaagtaaagggttctcccatcatcagacctgttagaaatggaaatagtgagagatgttagacatagcttctggtgaccagatctcactctacattgtattgatgtttttgtttctttgtcttcagaggaatacccacacaccgaagttgggtgaggaagattcgttttgctcctggtaaaggaaatcaaaaattaatagcaatgtacaatgatggagctgaagtgtgggatactaaagaggtaggccctctccatgaggataaaacgtaaataaattgttagccataggaactgtgctttgttaaaaaacttctttctgatttagaaatgaaaagtacttaatgagttcgtcaagtttcccataacaaattattttctttactttacagtatttgtgttctaaaggtaacaactcaagatttatttatttatttatttatttatttttattttttattttgatatggagtttcactcttgtcgcccaggctggagtgcaatggcgcgatctcgacttattgcagcctccacctcctgggttcaagtgactctcctgcctcagcctccctagtagctgggattataggcatgtgccaccacgcccggctaatgttttgtatttttagtagagacagggtttcgccatgttgggcaggctggtctcaaactcctgacctgaggtgatctgcccgcctcagcctcctaaagtcctgggattataggcgtcagccaccgcgcccagccgatttatttattttttaatattatcactgtctctgagacctttaaaatgctgcctatttgtggaagatagattgccagaggctgttcagttctaaacttgaactgggcctttgccacagactgtcttccttgaccatttaatctagaataataaagatcttccttttctgtctggaagtgatgcccaaattcactcttgaaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccggtatggaatcctaatgatagggggctttgaaacctgtctttactttgccacaagctcttgtattttggggagagagctgctgcttctgtttcatttcagtcttattttcttagaatctgagtttaagaaaatatattaacttgaagcttgagtgtttttactgctgagatgctgcaatctttgtaactatagatgtcaatcattctcaattcaggttttttaagtgccccttttgactcttttctttggtttgttaacaagataaaagatgtttatgtttataaaaatggcttactcagaatttaggcaaactcatcagaggacataaatctagtgataaggctgctggctttttaataatggccttatgtcttttgcaaccatatatcattgaaaagtcactttagaaagtgttctgagtattatgaattttgatgccaatctgtgactagtaaaatgaccagtcaagcaaattagcagattgcagtatcttgctctgttttgtatggttgttttgacattgctttttaccagaataaaaagcattttagtagaatatactccatatatgacttctaaaaaaaaaaagaatgggacaattgtgaatgcatccatttatcagtttaaaaggcagcttttggctgatgcaatacagtgttcatccttggaagatacttgatcctacttggagtggaggagggaacttcttgcctgagtattctcccagcaaaactttggtgcacactctaggctgatatgtagaaaatttcatgagacttttctgaacctttgtagagtcaatatttggcacttcagacacagtaaggttttaaaaacctggtttttcactttgtgttcatgcttgaggcactactgagttgctgctaatgttagcagggctgcctttaacttagttaggtatgctttggtttttgtcactgcccacccctgcccactgcatttgggcaccaccacttcttactatgtaactgactgccatcaggtgaagccagaattcaagacctacattcccatgtctgtccttgtgtcgtttgccagctctggggaagcaccaggatggcctcctaggaaagggcaagcattggtattcattttaaacctaaaggtattgaggacattgaaggaacttcaagggtggtttttgaaaaaattggttactaattctagataaagaagtgtggaactgctatctaaatgtttgaagagcttttccttcacttttaatataaaatttgaatctaaaaagctccaaagtcaaggtgtagcttgttcttaaattaaactgactacagaaatggagtccattgtattaacccatgttcaataccatacttgaacatctggcctgtggccagattttagatcacatgtttcttttaaaatttttctgatttttttttatattcttttcaatctctaatgttacagcctcagccagaaagagaaaactaaatagcaattgggaaaggtcatgcaattgtgtattcattccacaaattgaacttcaaattcagaacaacccttaataaatgttaaagaatgaaaactatggtagtgtaaatgtggagtgaggaaaaagacatctgtgtgttcacctccagattcatggccgatttggtcttgaggaaaaaaagtttgaggtagtatatttctattctgaggaattagaagtatatttggggcttactgacatgggataaaaataaaataggtcctaacattggtgtttcctatgttttcttcaattctccttgaaaacaagtagagaacgtaaaatattgattcacatctgtacattttcttagagcagcttagataggccacttcttcctccaataaagagggggcagtcagacaaattagaagattagaattcctgtttttgagttggagaacctttcttatcggctgcctaatatgtcagggacacaaagagccatcaaaataaatcttaatagtctttttagcagcatctaaaaggaatgcaagaatatgagactgtttaatagcattctggtatcatgcagtttccacaccctttaaatagtattgacttgatatcagggactgttcaacctaatttcctccccagtgttttttttttttaattttattattattatactttaagttttagggtacatgtgcacaacgtgcaggtttgttacatatgtatacatgtgccatgttggtgtgctgcacccattaactcatcatttagcattaggtatatctcctaatgctatccctcccccctccctccaccccacaacagtcccaggtgtgtgatgttccccttcctgtgtccatgtgttctcattgttcaattcccatctgtgagtgagaacatgcggtgtttggttttttgtccttttgatagtttgctgagaatgatgatttccagcttcatccatgtccctacaaatgacatgaactcatcattctttatggctgcatagtattccatggtgtatatgtgccacattttcttaatccagtctatgattgttggacatttaggttggttccaagtctttgctattgtgaatagtgccgtaataaacatacatgtgcatgtgtctttatagtagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgagttgcatttctctgatggccagtgatgatgagcattttttcatgtgttttttggctgcataaatgtcttcttttgagaagtgtctgttcatatccttcgcccactttttgatggggttgtttgtttttttcttgtaaatttgtttgagttcattgtagattctggatattagcccttcgtcagatgagtaggttgcaaaatttttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaatgaatttttgtataaggtgtaaggaagggatccagtttcagctttctacatatggctagccagttttcccctccccagtgttaaaggccactgctaagcacatttttcctaagtaagcatatatagaaagaagctttctgaaatcagatttctgcacaaacctttcctcttcatctgccacagctttccacagtcattttcggtaatcttggggcattcagaaatgtctcacaatgacttgccgatgtggggaggtctggggatgctaaacaacctggaacgatctggcgcaatgaagaattgtcctgccccaaacgccagtagtgttccttagctctctttttcaccgttcattgaatcacactgaacaaaatcacaaaatatggtcctttccttcccagacttccagctcaccttaatgttgccatttccaagtggtggaggaataacttttttctactgattttcttcttggctctttgcttactgattttctgcattcctgtcatgtaggtagctaaaaacctgggtgttatgattcatacctcacataactttagcccagatggagcagaatccgtgacaaacagcaatgatgctaactgcttttgcattctaattgtgtaattttcagaggtgaatgagctcttgcatgtgagtttctccagatgtgagatgatctcctattactttttcatggctgatctttacctttcagaagaaagatttcaattcatttgagggagggaagtagttaagggtcactttcagtttgttcatgctcattgggatgctgtcaacaatattttgcttttggagaaataacatatttgttttaaaaaataaggtatttccctccttttattcagacttggtaaatgttgtcttgcttgcatgatgtaaacactcgatgctgccttctacgtggattctcttgtatcttttcgtttgttcattgattaagaaattaccacacagcatgagaactttccctgaaccattccaagattattatgtatagttaatttttttccctgacatttaccatttccaaacatactgtgatataataccaacaactatctacatgaatctacctaaaacatatacatatgctatctaaaatatgaatggggctgacttgagaattatatagattgtcgtctatgaaggatgaatagaaagaaagttaagtaagctagccacctgcatccctttcagtgttaagtgttcagtgcttctgtaggtagttagataagcctcatttttccaagatgcaatccttcctttatagcccagatgtaaaagaaaagatgactaagtggaaattaaaaaaaaaaattcaaagcaaaagaaaatctttaataagaataaacgaaagtgttcaataagcaaagccaaatacaaatgattacctggaggaaagtaattcacaagtcacagactgtctacagaggggcaaaacagataaacaaatgatgcttcaacatatgaaatgatactcaactttatttataataagaaaaatatttgacctcctactggtaaggataaaagaagaaaataattttaaaaagtaaatttttaaaaagagaaaaatacaaattaaaattgtttcttacctatcagattcaaaagcttgaaaatatactctgttggcaaggctatgaggaaacaagcactctcatccattgctaacagtaagatccctataggaaggaatttggcaatatctaacagagctacatgcacatttacctttttacccagcaatcccagcgctaagaatttatcttaagatgtacattcataccctgtgaccaaaatgcacacaaagttattcatagcaaaattttgaaaaaagccgaactgcttagccgtaggagattggttgaataaatctggggacatctgcagaatggagtaatctatgcagctgtaaaatagtgaggaatagctctgtgacctgatgtagagtgatatccaggatatgtgtaagtgaaaaatgcaagtgtaaaagagcacgtatagcctgcttgtgtacaaaggcggattttatacataggttcatgcacacgtttgcttactaaaacacacaccacacatacacagaataatccagaaaccaatgagaatagttagaagatgtagatggaaaaatggagagtatggggatagcagtgaaacttctctatctttgttatacagtttcaagttttgaaccatttatatattttatatattaaaaatacacagtgaaaacaagagtgaagaaaaagcaaaccctaaaattgaatgcaagacacagttgaaccaaactgtgtaacaacaatattggtaacataaccacacacacacacaaaaacagttcaaataactaaaacacagaacttcccattcactgcacacctttagtggtttatattctaaggacagaattgctaaggaatgttgaactttaccggggtagttgatggtgacactagtaattctgaagctgttttgtgcatgttgtagtctggaacacattagtaaccaaattgcagttttggggagccaagatctgtgctgatagaaagggagatatggatgggaaatggcggtggtgggaagaaacattccaggggtggatttgggttggtaaaaaatcatgacttcttgaacatgtatgttccctggctctgctcacagagagttttcttgcaatgacactcaatggcagtgagcgcacatagcacccagattttactttgcaagttccatttccaggctaaaaggagccagagctctttggacaaaaagtttatttcaggacagaggcacaaaaggtgcaagatgggtctggggcatcttgtggtgccagaattcaagtaaggaattgaaaaaccaaggaggacctgacataagaggcttctcctgtcaaactgggggtagtctgagcatcacgaaaactaatggtggtattgatgtaagtgcagaataccaaagaaaccctcactccatagtaatagtcacagtaaggaaacgggaagtgggcaagaagcaaaagctcaggtggacagaagaatgccagctgacaaatgcggaaagaataagattagaaaatcaccactttgcagccccgatacaataattaattgtatacacaagcaaggatcacttgtggatgtcaaatcactgagtaaaaggatgtttgagaataggaaattcaatctgacaatatttcctccacatattacttactaattaattatacagtggagaaggtgccctgataagagctctggtgaataccccttatctagatgatcagatttagtgtttcctgtaaccagacagctaacatgttccttctgatgcaatgcagtgaaaagtacacagcatcctttgttcagactctgtcaaaaatgtttaacccgaatctgataatcagaaaacagacaagttagaacgtagggcattctccacagcagctgaccaggactcttcaaaaatgaaaaggtcacataaggccaaaaccaaaaaggaagaggaccattctagattggaatagactaaagagacatgacaatgcagtgtaccagccttgactggacccgatttttaaaaataatacagctgccaggacatttggggaataacaagggacttttgaatttggactgcattttaagtgattttactgaatcaatattaaaattcttgggtgtaaaaaaaaagtattattaaaaatatttccaatcactttctggcttttaaattgaaaaatccacataaaatattttgtgtataatttaatttttatttaactacatagaataaagttttctaaagcagagttttccaatagaaacataatgtgagccacataggtaagcttaaattctagtatccacattttaaaaagtaaaaagagatgaaattgattttaattaaaattttatttaagccaatatatccaaagttttatttcaacatataatcagtattaaaagttactagtgagacattttacttttttaaaattattcattcttcaaaattctgtcagtattttacatttattgtaaaatgaattgccctcaaaatttataggacaaattttcagcacaaacagttaagctctatttagattttataaaattttcagttgaaaaagtaggcatgtattcaagttgtttcaaacatatttaaaagttatccaatgactgaatcaataatcactttttaagtttaaattagacaaacattcatttccttcattatactagccatatgttaagtgactatcatattggatatcatactggataattgcacagtccagagttgatgtggatcactgatacgatttggctctgtgtctccacccaaatctcatgtcaaattgtaatctccacaggtcaggggaggcagctggtagggggtgattggatcatgggggcagatttcccccttactgttctcacgatagtaagtgagttcttaggagatctgatggcttaaaagtgtggcacttgccccctcgctggctctctcctgctgccatgtaagatgtgccttgcttccccttcaccttctgccatgattgtaagtttgcctccccagccatacggaactgttgagtcaattaaacctcttctctttataaattaccctgtctcaggtagttctttacagcagcatgaaaacagacaaatacagtcacttaaataagccaacaccatgtataagtttgtgtcattttacataattgtgtctattcaagggatccatggataaagcctcttcaggattctggaggggagttggtagtaaggccaagttgtaaaagccagggcacccctagaaatttggagctaaggtcgagtccgatagagtgtagggtggtcagagcagagctgctgggcattgcagcctttaggtcttctgcttctttgcactgaaacatgttgacaactaggcaaatcttgcttgttagtgttctaagtaagccagctgctggatgtgggggatgctagggcctagagtctaagaagatagcccctgtgttcaacagctacctttataagtgagacctgggaatgctagtgatcacaggtggcatgatcccttcagtgacatactcaaggttgataggccatgttagttgaatagtctcggaaaaacaaaagtacatacaggtaaatatatttatttttaatatttaaaaataatgaactttgttgctatttgttgaatcattgcattgaatcctttattcaagtagtaccagagttgtataccacacaggatacttaaattttaaaggggaaaagaaggccgggtgtggtagctcatgcctataatcccaggactttgggaggccaaggtgggcagatcacctgaggtcaggagtttgagaccagtctggccaacatggtgaaaccccatctctactaaaaatgcaaaaattagccaggcatggtggcaggtgcttgtaatcccagttacttcggaggctgaggcaggagaatcgcttgaacccgggaggcggaggttgctgtgagccgagatcgcaccaccgcactccagcctaggtgacagagcgaggctttgtctcaaaaaaaaaataaaataaaaaatcaaaaaagggggaaaagaaaaatatgttaatcagatttgaatgcagagactctctctgctcttggcttgtgtttcctaagcggtgactacattgaatatactctcagttgttccagatttacctgttgctctctgctgactgctctgtaaatggtttatagctgaagcttcactgtagtataaaacttcattttatttttaaaaacctttctttgttgtctagagcctgtgtggtgcccctatctccttgttccaagggcctctcttgccttgaaagccttcttattacaccagccttggaatggacagtattctttggacatttctcatgtgtaagtttttcacttttctttttctttcataatttacttggggttgaaagacacccatgaaagtcagccatggcctgtactccagcatttaaagggaatggagcctttaaagccgagagaaggcagagacactacagaattgccaggctgcctctgggttctcgggcctttgtggaagtgtgggtcagtgaggagctgtgagggcgtgtattgctctcaggtggctgtgtgcttgtcttatggtctgaacatggatgtgtcgtgatgatgaaaaggatgcgtgtgaagagggcaatggaaggcaggagaatttggagccgggcacgttctttttaaaagcagcatcattagcttcagggatatactgtgtcttaaaaatctcaatatttgcctcattgcaaaaaaatattcacagaaactattagtgtttattaattaaattcacaaatattactgaactcctgccatgtgcagcacggatggaggatttaaaaataatgccaggaagtgtctgttctccaagcactgtctcctcagaatattcattctgcagagctctaaatgagcagattcctttagtaacattgttaagttcttcattaaaaggaatctaaacctgatagattttaaagcctgcttataaatttcctggtttcttgaaagccaaggagactttctttactcattttcttgtttttgactcaataagataaaagcagatattaaagttgattggtggggtcctgagtagattgttgttattttggtctataaccaggtttctaaccaagaactacgaagaaggttatctctatattaacacaacttttttcaggtgaagaaatacgtggttttaagtgaagagataatgaactcattcaaaattttttctttacagtgactatccagaaaatgaagaaataaagaatctcctccaagaacagttgaattcattgtctaagtaagcactccatgtttcattagaagataggaatatgagaaagaaaaatgcaattcaactttaaatgcaattcaaaattaaaataagttacgttttagaaaatattagtggcccaagaagagaccattctgtttagaggtttgcttcccgttagagtctgtgttttgcagaaaaagtacttattcagtagttacagtgacagagcatctgtcttcaccaagttcatgagcaccagctgctctgatctcacatcaaggcaggactagatgcatagtgggagcatccttgtagctcagcttgcctctactacaaacctccatgaagcctcacagcgggagacgaatcgcagggtgattctgggtctgcttcccgcttctaaaatgagttctctgtgtcaggtgctggtgtgcacaggtctggctaagaaattaatgtgctccctagagccaagggcatttaacagaatgtactgggaataagaaaggaaaaaatatgggtctacaaggagttcttggggaaagcgtaacacatttttgcaatctagaatctgttacatataattatagtatttaacaaattaagcatgatattttattgacggaaaattcaaaataattagttttttctatgcaaagattaacatttatgtttaaatgggaaactatagatttaaagaatgtcttcctttctgatttgtgaatattcagtattttactattttagaaatacgaacttataaaagcacaagccattcttccttagatactttatttttggaatagtttcagaataaattacgaatgtcatcttctttaaagtatttactgttcttgatgattttttcaacaatggcattcttgttccagtagttaggcagctaatactttcaaaaactgttgtaagcctataaaccagaaatgagagcgctgcagctccctgtggtggctgaaagctgctgcttctccaagccttgagaacactctcagcccccttcaacttttataatttcagggtcatggtaaagtaccttgtcttgtgtaaattctaaacatgttatttgactggaatttttcatttcaagagtatattgatcaacccccatgctttattgtttgattgaaaacttttgtctcacttttgtccggatttcttccacagtgacataaagaaactgttgcttgatccagaattcactctcttgcagaggtgcctgcttgtttcaaggtaatattgtttgatgtattctgtataagagacaggatttcaagttaactcatttcttttaagggtttttagttagaaacacttagattttagaaaaatgtatcagttcatcctttagatttaacttaaaataattttgacagtagtaataacaaatagggaaaaatcaaattgcattttaaatgtgagatctaggccttctctctggaaagcacttcctcctacagctttttaaaatatgtgttttaaaatatcagatacaggtatatttaaatataccaataaattatatttagaagcgataacctctatatcctgacttacagtagagtttgtcacttataaaaaagactcctctccccacagaataaatagcacattactttcataccttatctagccagttatcccagaggaacttcttcctaatgtgaatcaatggcccacattgaaaggtgtgctaatggcaaaccaggtaaataattgttcttaacacagaacagaaagatgctggagtctgaaggggtcctgtgcagtcaggcccccgtattgttgaaggcccagtagcagggcaggagaacttgctgcctccccctttcaccctgtcaggccccatgccagtatcccagtggatatgtgacaacactcccttccagtccctcagtctactctaggaagccatccaggccaggtgtgctgagtgcagtcaaaactttgcttcatccttgccaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcaggtagtctgcttcacacagcaaaacctttagagctgtcatcttgattacttatatctttgtcaatatcttaaacttgggaaactttcaaactaagttactgttcagtaatagaaataagcccttgaaaattagctgggtgtggtggcacgtgcctgtagtcccagctactcaggaggctgagggaggagaatcacttgaacccaggaggcggaggttgcagtgagctgagatcacgccactgcattccagcctgggcaacagagcaagactctgtctccaaaaaaaaaaaaagaaagaaaagaaagaagccctcggtacatttgcattaaaaaaaaagcctgatcaagatttgaaaagctcatagacagttactgcgttgtttactaaacattaaaattttattattaaacaggcttgtttaatttgtcttacatttttaacttggcttcattttaattctgtcattaatttcctataaataacaaatactttatacacttggtttgaatttgctgttcacatgataatttctttaacctcctgcagaatccttcagtgcacataggtttttcatccggctctacttaagtgtcagtttctgtaggcaggcaggtatgcatccaagtgataatatctatcaacatttttgctgttcaaattcttattaaatgtttggggtgctgtaaagttgattatctagtaacctgaaaagtcaaagtagtttattaaaatgatcttattaagtacagtaaaatttaaataattccaaactcttataatccaggcttaatttttcttttttttccaattctagaaatttcagctagaaagggttaatctgcaggaagtgaaacggtcaacttatgatcatacaaggaaatgtacagaccagctactgctcttgggtcaagtatgtcagtttttataactctacatgcttcattaaattgctagttaattcgtatttcagagcaatatatctgtatgtatatatttcataatattttccccttgtatgtacctccttccctgtagacagtttaggctttctttcaaaataataccaataaacctcatgagaaaaaacatatggttaaccagcttgtaatttagacttccataatgcccagtggagcccagctatttgttttgttttgtttttgtgtctgaattgactggtacaaagctaaaataggcaattactcgagcacctagatacaccagcctctggctttatgtttgtctcaaaaaagtagtgtagcacctctgtttaatgtttgtatttgtaaacaaaatattcaattgcattttttgaaaatgagtgttttcctttagttttctaccttatgaattttaaaaagttatgttggaggaaaatgttctcataattagaaaaaccgtttctcttactagacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcaggtaaggcacacttgatatgtttgtcatctctctgaaaaatgagaccttgttcccagcaaagtatctgattagtagggacatttctttctcttttacatatgctgaagaaaaatagaaaaattattgctacctataaatcagatgaatataattgtctaaaccagaattaattgtttacacttttcagagtgaaagggggcactgttaataattgctgagataataggcataaatccaacaatcctaggcaaatcagaacaataaaacctgtgagagaactatgctctccctacttattctccagactgtattgtgcttcctaccctggttacttgagtaataacagtaaaactcttaatattatgtttcagaatttaaatcaagaatgtcttcagtaggtataaaatgggcacgactagataaggtcaaatggggatttaactttttaatgacttctcaaagaaggagctgcagtgtcacttaaggggatgcgcttttgtctttcagagggcgttcagttgctctgcctgatagataaggctgcagacgcctgccgctacctgcagacatacggcgagtggaatcgggctgcatggctggcaaaagtaggtggttccaagtttcaataggtgccctcaacattcgggatagaaagctcagtcctgaactttggacttatgacttagaaacattttttggcctgcaaagctgctttgcaaatactgtcttggaacctttatccttttcctattctttatgagtgtaaattgcattacttatttaaaaatggatcttgcattggtagcaattaagtaaaagcagctgcctcctctttctcccagagtctgagccgaaactacagtccagaggtatagccaggccctgggtcccgtaggcacagaccgttatcattattcagagtatgcagcagcttcagggcagtgtgctagtcaagcagagcatagcctgtatttcatagaaacagatctcactttaactgaattattattttttctttatagagtgcaggatgtttttgttgttaacacaggcgtctttctcaggtccgtttgaatcctgaggagtgtgccgatgttttaaggcggtgggttgaccacctttgttctccacaagtcaatcagaaatcaaaggctctcctggttctcctctctctgggctgcttttttagcgtggcagagacgcttcacaggtaaaccgagagttcacatgggctgctcaggcctgcccgtgagcagtcacttcatgttctctcgcggttctagcaggtcatggtactcgatgtgtaaagtgaaaggagaagtatacatttcaggtttgtcaaaaaacccaaaggagaatggaactgtccgtattcattacatcttcattcggtctaggagctatgctagtttcctactaatatgctgatcagacttaacaggcacctagtaaaagggaatttaaaagtcttcagagaattggggtccattcagctttgactagagcaactgagaggaggcccagagagcagggggagaggcgacagaaggcatggtgaggtggagacatcccgtctgaaaatctggaagaggaacaaccatcactaattgtggagcatttcatttattcaaaactaagggaggtagattacggaaatatgacaaaagattacttgtcaactctggacaggggtacatgggcacttgtcatatctctgtagatttttgtgtatttaaactatttcacaattttttaaagtattaattttaaaaagcttgtgtttggagatgtgagtattcttccctccttttttcaacaaactagggcttagaaaagtgcttgtatcttaatgcagtatgcaggtttccagggaaaatgtgtaaatgtctttatacccttcgatgctgctgcccaccagtgatgtaaatcacaaagcataactcttgttttgttctgttgagcagcatgagatactttgatagagcagccttatttgtggaagcttgcctcaagtatggagcatttgaagtcactgaggacacagatatcctttgcaaggttgtttgtagtgacgaggaagaaagtgacatgcatgggttttggaatttcccttagttgtgctgcctggacaggaactatattatattgtgaaagatccatgttctgattttctgattcaccaaagccaggaaagagggagaaattagaggacaaagaatcagataagaaggtggctgcaccatgggtgtcagctttgactaggatggagggaggcaggaaggactatagaggacagggcccccaagtcttgtctgaacttaaaaagaagatgaaggaatgatttgggaaacaggtagaaggacctggtactttgaaatagtactttttcaagaccagacattccatggaataaattttatatatttatctagaaaaaatatactggaataactaaaaaagtctcacgatcacctctagtgacaatatgatatgggacaaaatacagcacttaaagagaggtgttgctcaggccagccactataatccacccatcagccagaacattttatttcttctaaatggcacttgagcaacattggtttctttgaaaagaatgaacttgagaatgcaactcccaggaccagaaaagaatgaaactgggccagtgcttgcatggtcctgctgctgctcactgcactttgcttcaaattcttacatttgctctcatttctacatggcaggtacttggttctctctctctttctccctctttctctgtgtgtgtttataatttttttttttttttaacagagaattaaaactaaactaaaaattttttttttcctttttttgaggtaaggtctcactcttctgcccagactggagtgagtggcacgatcatggctcactacagccttgacttcctgggctcaagcagtcctcccacctcatcctccccagtagctgggaccataggtccacaccattgtgcctggcttttttttttttttggtagtaacccgggtctcactatgttgcccaggctggtcttgaactcctagttcaagcagtcctctcaccttggcctcccaaagtgctgagattacaggcatgagccacccagccctgcactgaaagttttttaaaattaaactgaaggctgagcctactcaagatcatgtacctagtcactgggaaggtgactggttcagtgtatgcattttgaggatcaaagcatcagcacagagtacccaataggctgtttaaaaaaataaaaataaataaaaaaaaaccaataggacagggctttctaaaaacccaacaaccagatatagggaacattcagaaataaatatctgcccccaaactgccagcctctcagactttcaaatggaatgaggatatgcaggttaagtttctcctctcttatcattcatcttccaatcttcagttgagtgtaggttatgggaggatgttggttgggtcttctggaaggagaagctttggactcagctggtacgaaaggtaatgatggtacagactgagacatggcctactatggccgggaatcaccctctgcccgcgaaaagtctcctgtgttcatcctgtgctgcccgctgtggacaccaggtcccttccgagcagccagcagagcagacgcgactcacccttcctgcttctgggagcctgtgaagagtctcatcacagccctttttactcttcttttccttaactatggtttacagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattccatccagg

SEQ ID NO: 725 - DNA, 116637 bp, Homo sapiens
cacagactttttattttattatttatttcttttaatacaaagctttggcattagcaattttatgaaaaaataaaatgtactaaaaataaatgcttgtgtggcatgattggtaaatgatgcacaaaaataggttcttttttccttcaaggcaaaatcagtcagaaagcaggttttttcttcttcaaaaccattctaccctatggaataaaaggaaaaaagaggtcataaattaaagagtagtcaaatgtttaaaataacagagaagtgaccctaactgaagggtggcctggctgtccccagctagttcccaacccctctggtaaggccaggaagccattaagtgttttcccaaaatcagcagtttcagatctgcagttgactgactcatccatcttagaggtgctttaatactcccaaaaggatgaaggaaaaggtcaggcccatggcgtgttgtttaaatacacagggacaattatcatacaatttacaatttttcctggtttaaacacatgttctgaatgctgagggtgctgaaatctgccgctgttgtctttaaaaaatgctcctcttacctctcaaacaagaatgtcctcacttattttgaagtgatagggatgtatggctgtctcacaggaatcctccagaccttgtgtgtgtttctgtccttgcatcaggtgtaaaaacagcctatgaccttttgacaagcccctgcgctgcccgagctcctgctgccctctctgcagccctgtgctgtggggctgtcctggctttctgatgccttggattcctgctcatttccagggtccccaaatcaagctgttagcgttgatctttttctttctgctgagctccagatctctgcttcaaaccatataagctttggttattacacaactctctagcaactcctgatttcagctcctgctcgccaccctgacttgctccttcaactccctatttttacctaatctatcttcctgccttcatgccctaccacagcaagcaacttcgcagccactaggaatatctctctgctgaaaggccttagagcccattaccagctctttataagaatcaagtccaaaatctgtctcctgcctaccgtcaccaccacctacagcagacacaccaaaccacacaactcgctgatcctgctctgtgcggtcctcactgtgtgccctaattatgcccaggctggttcctaagtcactcttccatgcagccttttcagctcccccaaaggtaaggcggcagctccgcaggcatgacccagaagggcctttgcgtactccctcactctccagccacatcagtacgcacatgagggcatagccctgagctctggcggggccagaccaggtctccattaccttcagcactgcgagccccgtgcttggcacaagcccgggagcctacttgggaaacagcatctcaatgaatgagggggcgttgtcaacttttttgaaaaacctctggtataaaggatattcacaacttcacataaagttctgtaccttattatttcttgtagttcctatttaaggtaacacattttctaatatttcctcagaaaaactggatattagatataaagaatttttaggggtaatttagttttcaaatctactttatcttgttgcctcttaaagaaattataggctgggcctggtggctcacgcctgtaatcccagcactttgggaggctgaggtgggtggatcacctgaggtcaggagtttgagaccagcctggcccacatggcaaaaccccatctctactaaaaatgcaaaaattagccaggggtgctggcaggcgcctctagtcccagctactcgggaagctgagacagaagaactgcttgaacctgggaggcagaagttgcagtgagccgagatcccaccactgtactccagcctgggtgagagagcgagaccctgtctcaaataaataaataaaataaagcaaaataataaccactgccaaagagagcagagaagtgcaagttcccactgcctttaatactcatgttgcaactgcatttttaggaaaccaaatttgtctccttcaaccacattatttggcactatcctcctctctgaagtagtcaaatgcaagcagtttaaaggaaaaggttggaaccagaggtgctgggtttgaattccagtggccttcttcctatggcatcccttcagagtcactcaatccctcgaagccctactttattcttttgtgtacatatatctcacactcagattggctacaaggagaataaataccaagagaaagaaaaggatccactatccagcaatacacctcaaacagaggttaattttaaatcttttctggaattgttacaagacgggctgtgtgagcaaaaggttatcaggttgagaactaaaaattcaaaattcttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcactgttttagccgggatggtctcgatctcctgacctcgtgatccgcccgcctcggtctcccaaagtgctgggattataggcgtgagccaccgcgcccggccaaattcaaaattctttagacaagtgtttctcaaaactaaagcatacaacctattaatggttataccatcaatttaggagttaacgactaatattaacaacaaggcacaggactgactacatcagagaatactgcatgcagtcagggaagtgtgtgaaatttgtttcagttacacatgggagtactgggtcacaacacaaaatgtatctcttacagtaggaagatggtttttagaaagtctgaaaaacactgcttttgatatttaaggttctaaaagaggtaactgaaagagaacccaacagctctcctcggcctctgatccctcctaggaacaattcaagagggaccctcagcacaggacgcatctcagagccttctacctgatctgaggtcggcctgtgaacaggtctatcctgtagcttctgtctgaagaatcaggtcctggtgcaggctcgctagctttcaaagtgtcccgtgttttggacggacaattttaactactacaaagttgtttctttctttttttttgagacagagtttcactctggtcacccaggctggagtgcaatggggcgatctcggctcactgcaaccttcgcctcccaggttcaagtgattctcctgtctcagccttagctgggattacaggtacctgccaccacacccagctaattttcatatttttagtagagatggggcttcaccgtgttggctaggcttgtcttgaactcctgacctcaggtgatctgcccacctcagcctcccaaagcgctgggattataggtgttagctaccacgccaggccacaaagttctttcttatatcaagtggaaatctgcctccctgtagatatcgccagagctccagaaatacagagtaagcatcactctgtatgcactggttagtcaacatgaggctcttttgagtattaaaccaggcaatacgggtaaaagagaccagtgcaggactaagatcttggtaggcattcaataaacagtagttattctcatctttgttattctcatctttaagagtccttcaaacacctggaaacagctctcatcttacccggtcccctctcttccaaaccaagcatccccaagacatcaaataattaaattttcagacccttttatgctgagtgtgctagtttctcaatattcctcttaaaaagagtactgagcactcaagcctgtaatcccagcactttgggaggccgagacaggtggatcacaaggtcaggagttcaagaccagcctggccaagacagtgaaaccccatctctactaaaaatacaaaaaaattagctgggcgtggtggcgggtgcctgtaatcccagctactcagaagactgaggcagataatttcttgaacccgggaggtggaggttgtggtgagctgagatggcgccactgtactccagtctgggtaacagagcgagactccgtctcaaaaaaaaaaaaagagtactgagcaaaataattcagaaatactgagagtaaaatagaaacatcattctttttgtataaataaaggagtttatatatataaatttctactactacactaagaggaggaagatcaccgggagctttctggtggacctgctacaagaagccagggcttcctgatctccggtcatgccactggatcatttgctctagttatttcgtcacctttaccacttcagattcatttcctcatgccaagatttttttgaatcttgaataatgagctaccgttctctgcaaatcttagaacgtgatttctatgaatcagaatccagcaatgggaaaagggctctaggggatacctagtcacgcctcccactaaacttcaaatctctactacacatttgtatatgttcctcaaataaaaataataaaaatatttatttttcttattttgagggaaaactagagtgacacaaatttcagttggtaaatgttgacatttcacaaggtttatatgaatagccaagtagagcagaagacctcttttgggaattgaaattcagtaacctcgcttacctaggtactaagaaaccgaggtgtgagaagccaatatgtaaatatatttaccttgcatttattcacttctttgactaccatcctgtttatatttgcaaagtttcaaaatttaccagatctgtttgcagtgttaaaaaaatttaatgtataatcagtcgcagtactaaataaacagtatttcatcataacagaagggcagtgactccaaacacaagggctttttgatggacttctgattgaagccaacagcacgaagcccttggtcaatgcaccgagcgtggtgaggaagggatgggggcttgcaccccttgtggggatcctccttgtgtagttagcaacccacccatgacagggggccctagaccacctgggtcccacacactgccctgacatcttgcccacagggtttcaacagtgagtagacagggtcaaggacttgcttgaacagtaatatacaagaacagtgactagtaacactgccagaaaggtaaactattctagtaggtatatgcatagaggtggagtttagtatcaatttttggacagtcattaaaatgccaagagatgaaatctatttatatatgactatcttacaaatggatgaggttacccagaaaattaagccagggcaattaaggtgaaaaaaaaaaaaatcttattttggttgtaagtttattggtagataaaggcaaaaacagaaataaaatagatgttgaaaaattcattaataacgaataattacaaatttgtttgctaaaataaacttttctctggaataaaatcagtaggaatttttcattgatatttttgagaaaaagacattgggtaagagtactattatctttcctatcatctgccacaataaaaactgcctttaaaaagattaagtaattcatgcttactgttaaaaaaaaaaaacacaacacataaaagcacaaattgaagaagacgttgccccagattctaaagtaagataatcaccacattctggtgagcatccttgctcgtatccacatgcgtgcatacacaacatgcacgcacacacacactctctccatttttctctctaaatgggatcatgaatattgtccttcggtggttttgactgaaggcacagaaataataaccaaatgagcaactgtgaaatcaaccctctacaactgctaatgggagaagggttgaactaagtaaggcatggatctaagatccatgacttagattctgagtcatgcaggtatttaggcatggaactaaaatattacggcccacatactatgatttctaataggtaacatgtctactgagcactctcattttaatctgatgcatgaactgaacatcagacagattctgagtggcagtcaggtgactattaaactacccaataattctcgaaaagtgcctagtgtaattatttgcttgtactggttatcactcatttgtgaactttttaagaagtaggcttgtattactatcttgcctgatgggttagcatgggaataagcaaaagaggtggctgtgggtgaaataagtgtttccctctaaactcaggtttgaatcacagctactcacagagctactatggtactgtgtcccacttcacagaagaaattaaattcacttcccagacaataaaggcagatggtcatctgactcacacaacttcaatggcactgcagtggcattggcttggctaacatttattgagcacttcttatgtaccaggcactgtgctaagcattttataggctgattctcataacaaccctgcgatatggtcctagcattatctgtttatgaatgactacaaggagcttcaaataaatataactgcccaggtcttacaactgaaaaacggaggagctgagagtcaaatccaggtgtgtgtgacctagagtctaaggaattaggtgcgccatgctgaaggaaaactgcctgggtggccaacagcagcagctagtggttcacctgctggatgaggtgcagtgctcctctgaaggctggggaatgccacccgaccctgacatctgtgagcctcaacatgtatggctcacagatgccagggggcacttcttccaagtatctagccccagatgaggttagattgaataacacatgccactgcaagtggaggccacttgcccattgtttctatagatgtcaattacagtttctatagccagacaatgggcagtcaattacatcaactgcatgaggtaatcagtttggttattactcatcaattaaagtatcaggacgtaattgaatatggagatcacgtgaattccacccatatcaacctaggttcaaatttgggcaggaccccagggttgctttcatctctaattagttttcatgaatattggtaaaagaaaggactgaacgatatcctcagtaaatgtccaaaatttagaacaaaacaaaacaaagcaaaaataaaaaaaccctttctataccttatccctatggaaagctactcttggaacagcattggatcaaaatggaccataacagtcatctagcccaatcctccatcctctcaaaacacctcactacagcacccctgacaagtgacatccagcctctgcctacattcccagtcctgagcgtgccctacagcaaaccatcccgccactaaccaaccccaccgacagacgtccttccttttaccgacgtgaagcctgccgtcatggagcctgctctttggtcgccattttgcccatggagatagcgcttagacttattttctcttcctcctcacagctgtcctaacatctggaaacagcgggtctttcaaactgcttctttcctgcaggccaagtacccaaggcactggtcctgaccacaggcacggccgccggggcttccccagaagctagacatgccaggctccagatgtgtgtgatgaacgcaaagtgggctcttcccatcagcgatgaggatgctgacagccttttacactctaagactatactgctcctttgccacttgcattacactgctgattcattctaagcctgtggctaatgaaaacctctggatcttttctcaaacgggctgctcttgttgaataaggtgaattcccaatctgtgttactgactaaaaatatatgctcatgaaataaagtattttgctagatacgatcccatcaggatccgtatgaaactggtagaaagccagttctcaccaccttcatgaaaactgctccatgtgttttcctgggatcatctggcacatgcaatccaaaaacaatttgttacttactcattagcattcaagctagctgtggctctgatgatcatgtagcagagtgtgagggcactgaggaggccaaaactggcaataataaaccattcttctgttgacaaaggaaagggaggaaatcactctggggagaaggtttaagtcaaatcgatgccaacatttccctcaaatgcaacgaagcagacgtcaacggaggtgtaagccaagattggcccaaggaagtgaagcaggaggtttgccagagagctactaactggagaaggttagtggaagtactggtgaaagctgcaagggagaaaggaaagcatggctcaaccatttcttccatttaggtcctgaggtctgtgaggagtgtagccaccaaaaagtgtgcggtgaaaatatgtatataaaattgcacaaggacatagatttttttcattgttaatgtaaatgacagtaaagtagactaagcatatttataaccttctttccttcttcattctgtcatttctgcagggctttcattcttagtcaaaggctgaggagcacggagcagcagttctccaggtcctgtgggtgctcccagccgtctgcgagccggcctcccatggcatccatggctacattcttctctcttatgcatgggcttacttaggatatttacgtaaaaaggacatctcactggtgtctcaagaaagtagaaactactcttcccaacccctgccgaggagcagcactggctgtccaggctgtgacaagcacaagtaggaggggcgggcgactgaccgggtacttggccaccacagagctgaaaacctctggtgcttacaacaataaggatgtttactagactgtctctctctctccatccagatattctcctttaccttttcagagcctatgttgtcaaggtaacattttaaaaacagtatttattgagaacctctaaaacaacctaagaaccaatctgacttgctaaaaagtcttaactataaaatatttctttgagtacacactgactagggctgttttaacaaaatgttatacaataaaattacctatatatgtgcaagaaggcagagagaactctttacacgtggactgccaaatgttttatgcacaagctgtatacagcatgtgtgtttctcaatctgggttccacaaatcctaaccctgcatgcagaattgtgtgtgcataggcatttttctagaaaaacatacttttgttagattttaaaggtggtgactttcaaaaggtcacgcagcactgctcctggggacttccggtccagagagtgctctaggagcatttctctgcccaccttagcttgtgttattaaaatgcttagtaaacccctatcttttagacaccagtgcagccacggcctctcaaattacaaacttcctcatcagtagattgaagctttttatttaatcagcatgaacattcaaaaacacatataaaacccaccatttttacctgtaatgttttaagttagggaaaatgtatatggcatttataaaaatcaagagccgaatgtcatcatcatcaaggaacttaacacagtatcctcttttttcttcttggagacttttatatatgatatgcagactaccttgtagaacttcgtcacatctatgcttccaaattctgagtctaccatcccgtatttgcatgtctttgtgtgtgtgtgattgcaattttaaaaactagtaacaaaaggaagtaaacaccatcataaaacacccaatatgctggcagcatttccacagtgcccccctgcagccggcctggctacctctgcccccagtgcctacttagcacagtgcctggcacacagtgggtgccagcgggaggcactgtggttgctacggtgcccagggcttcggagggaaagcagaggtagctgtggtttagttcaatcacgtgggttttatttattaacatcatgtgcaaattctgctaaaggtgattaatttggtatatgaagtaactttttttcatcaaagtataagattttgaaaggacatttctacataaaatgtaatgggatcagtacttaatgtagtaagtagtaggtgctcaataaatgtttgatcaatgaaggacctgaaaaactcactaataaaccaacaacctttgtgtcctttattactactcaatcaagttttaaaactgtagaccataaaacctcaacgccaaagtaagaaaaccatgaaatgctattaaacgaatcgagagatggtgagaaatgagccaaactacactcaaagcacagttttctctattgcatagctgaatgaagcctccctgagtttacacagatgacagaatacaacctgggcaatcattttctaataataatgtctggttggttaaaaacatgaatactttgattgaacagaccacacgagtcttaacatgtgaggagaaacattttgtaacagtgtcatccatttcactgactcccagactggagaagggtcccacgagcctcagggcgtgacgtgctaggcaagcagcagcaggtgctgggaaaggcaacagcagagcagcaaccaggaagatgggtgaaaggttgttagatgaaaggaacatgtagagaatggaagcgaagagaagagctggcttgttgagggctgaatgtctatgatgcctacacacacgctgtcagctcactcacaccgtcctgaggcaccgccatcaatacactcagcatttctttcctgctagtcgacagtgcaatgtgaagacgttcataactagctcacggtatttttttttcaggcagattgtcctttggcttttctcctacctcatgtacaactacaccaaagagttaagtgccaagagaccaaacttccataaaaaatgtaaaataaagtgcgcaacaggctatgttccaagaactgtgaatttttaggttcaagttctagatgagtttcccactaagtagcctgtagccccggaggtggagagcacgagcgctcacagcatacaacacaccagcaatactgctgggggactgtgtcaccttccaacatctccctttaaatgcctgtttgtaatgcaatgatttcaaaacaaggtttataaaacagcgactaagacagacctctgaacagctactcatcaaatgcagctattcctattaattatacacaaacacaccagctacttatcataaataaagtttcattcttccaaatacctgttttaacagcaacacacatcactttcttggttacagtctgtgttgcaggctgaggcgagtgccttgactctcctgatggtcccgaatgcccacataggcagccacatgccctgtgcctgagcggaggcccccacttacttgttactgcaatgttgatttctcctgttctcggagtgagctccccatcctgaggaagaggtgagatccccgaagttcgaagtggctcaaggccaagggagttgtcgccggcgaggtcgccgagggctgatcttcggttaacagcttgggttctggtgagcctttccatatcgaatgctacgttatcagtacatggcaaattcggctgcaaaatatttccaggttaaaaataattgtaaggaaaacacaacctttcataagattctaaaaaagattctaaactttgacgccctgttgcaaagaccttaccaggttcttttcctgtgatgtcctctcatttatctgcccacctacctactccttcttctctcaccctaagagtttttcttcaaaaggcacagagatctcctctcagaaatgttacaaaggaaaactaaaattcattgcagatcagagaagactggtcatggcccacaggcacagggagtcgtaatcattaacataaagatagcaaacatccagtttaaaagagtaaactattactttgcttcatggtaaatgtccatgttgaagaatcccaggtaatagaaaacacctctttcatcctactaacttctctaaaagccccatttatctggtagtcagtttttaagtatggtctgcctttaaacacaagaaaagcataaaaccaagaataggtcaaagttgaaaagacttttgaactataagaaaatgatctgtttcaaaacctaagcacctaatcctgagggagaggtatagagctgcttggggccaaagtctaccaattaaaaagtgagcaccaaaagtcttccgttgtaacaatgtggctatttgtttacctaacaacctttggttctctcagcaggcagcagcaggcagcacatgagaagcacagctgggaggggtggttgtgagaagtttgtatgtttatagagagaagtttcagccaaccaaacctggaactaatggcttcctgggcaaaagaactgtttcaggtcatctcaaagccttatttaaaacagcaaaaggcagtgtactaagtgatgcttaggctcacacccagttaaaagaggtttttttatgttcattacatttaaggatccaatgataacctgcaatacattttaggaggatttttgttataaacagaggagaaaagtattagcacttaatatacttaacaaacaggctgggcgcggtggctcacgcctgtaatcccagcactttgggaggccgaggcgggcagatcacgaggtcaggagatcgagaccatcctggctaacacggtgaaaccccgtctctactaacaatacaaaacattagccgggcatggtggcgggtgcctgtactcccagctactcgggaggctgaggcaagagaatggcatgaacccaggaggcggagcttgcggtgagccgagatcgcaccactgcactccagcctgggcgacagagcaagactgtctcaaaacaaacaaacaaacaaacaaaaaaagaaggcggcggctagcggtaacaacagagggtaagttactgtttttcaagtttctacactgttggccaggcacggtggctcacgcctgtaatcccggcactgtgggaggccgagaagggcagatcacttgaggtcaggagtttgagaccagcctggccaacatggggaaaccccatctctactaaaaacacaaaaattagccaggtgtggtggcaggtgcctgtaatcccagctacaagggaggctgaggcatgagaactgcttgaacctgggaggtggaggttgcagtgagctgagatcacaccactgcactccagcctgggtgacaaagggagactctgtctcataaaaaaaaaaaaaaaaaaaaagagagaaagtttctacactgtgctaggcatcatggcagatgctctatgttagaccagtctgaaatgggggtgagtttgctccctgggggacatctggcaacgtctggagacatttctgactgtcgtggctgtggtgccatgctactagcatttagatgctgctgaacggtctacgatgcacaggacagcccccacaagaagggattgtccagtccatggtgtcactaatgcccgatactttgagaaatcccatcactactgacatgatctctggagacaaaggacaaatggggcattactgcccaactgtatacactgaaactgtgtttgacagtatatttaaaataagatgacttcgatctcctttgggttgcaagctaaaatgagttcatctgttggatcaaactaaactttttgttccataaggagatcattctttcattcttttttgagaccagaaactatgttattttccaataaaaagcataaccctggctatacatgcttctcttaagcaagggctaacgaaggtccttggttactcaagtcagtgttgacctggcacctgccacagctggactctggcacgcctggcgacagcccctgccaggctgtggttgtcaacagttctccttgggctccagtcactgcctgccttctctgcttgcaacttaccaaccctcaagagatcaaagtcaaacttcaggctaaagaacataagcaatgacatcgttttatattatgccaagcacagaggagtttatgactggaacagagtcaacagcatacagcctaccttctaaaggtaggtactggaatgaagaaaaatcatgtccttctctctttcttcatcccatactcatcgaccaacagaagcacccttttaaaagtggaccatgccaggtgtggtgactcacgcctataatcccagcactttgggaggctgaggcaggaggatcacttgaggccaggagttgagacccgcctgaacatcttgtctcttcaaaacataaaaaagtggccaggcacggtggctcacgcctgtaaccccagcactttgggaggcagaggcgggtggatcacctgaggtcaggagttggagaccagcctggacaacatggtgaaaccctgtctctactaaaaatacaaaaaattagccaggggtggtgacgggcacctgcaatcccagctactcagaaggctgaggcaggagaatcgcttgaacctgggaggcggaggttgcagtgagccaagatcgtgccattgtactccagcttgggcaacaagagcaaaactccctctcaaaaaaacaaaaaagttagccaggcatggcggtgtatgcctgtagtcccagctactcagaaggcgaggtgggaggactgcttgaacccaggagttcgaggttacagtaagctatgattgcaccactacactccagcttgggccacagagtgaatccttgtctcttaaatttaaaaaaagaaaaaaaaaggcctagtagagttatttaccttctcttccaggagttctctgagatggattagacttcttagtaatctggtaaaaaggtcctgttgggcttacatggttacatggcaaatatagccagtgttttcttctgtgtcttagtcatgcctcctattatgccaattatgttatattgtattacacatacatataataatatacaaaagtggtaacaaataaaataggaaacgtaccacaattcccagggccttcaatatattaagtttgcacataggacaggtacaatgttcactaagccagggatccacgcaggatttgtggaaaacatgcctataaaataatggagaattatgtcacaagttacataccaagaaacttattaggccaaaatggaaagaaagggaatttttagttaagttttcttttccccctttcaggacatattttaagccccaagagacaaatattgggaatttattaaaatataacttgcagaaaatctcctgagcccaacctcatatgtacaacaccgtgtaagaactgctaagtaggatttggttgtttgggccttttattttaccaaattccaaaaaggactaatggaaacttagaaaatttattaagaatgaaaataatcacaccttataaaccagttatgctttctacaatagctaacatagaaaaatggagtttcaaaaagatactaaatcatggctaagtgaagagttctctgtatagtgattagttttttggcaccctgattgaatgtcatttaaaacatcatttttaaaaacttctaagcaacttatgttgaatgtttataaaagctacagggaagctgaaactattttaaggggtaaactgtgcctagattcaagtaacactcagcaattttcagctgaaatgttaacgggggaggatgggagattttctctcttattcaggcaagtagaaagtcacagtcttgtgactggaaataagtcagtcatacagggttttgcattcttaaaaaaaggaacttgtgccctccggaagagctgcagaaattacttctcaagctctagcacccggcccagcagccttctgaagctctagagtcctggccaaacagggagaaggtgggtgccaggacagacgttcagggcagctttggaagaaacactaatctgagtttgggataagataaaagaaatttttgtttgtttgtttttgagacggagtcttgctctgtcgcccaggctgaagtgcagtcgtgcaatctctgctcactgcaagctccgcctcccgggttcacaccattctcctgccttagcctcacaagcagctgggactacagcagcccgccaccacgcccagccaattttttgtatttttagtagagacggggtttcaccatgttagccaggatggtttccatctcctgacctcgtgatccgcccgcctcggcctcccaaagtgctgggatgacaggcgtgagccaccacacccggccaagataaaagaaatttttaagtaagatgccaaattgaatcatggtatatacctttacaactttgattgtcaatttctaagttaatgttatttacagctgtttaaaaatgcagttttgatttataaaaagaggtctagagaactcagtttctactgggatctggaacaaacattcatgcttacaactttggcctgaacaatatacacacacgtctgcctatcactgtttgatggccttatactcacttctttggggacaagagtaaagatcttgaagaatgaatttatcaatctagtcttaaattcacagacaatgaaataaccagaaccatcacccctgaaggcatttatttaaaccttaaagcttttacttaagggctggaaacccaccaatccataggtaagccccagatacattcagtacacctaaggcgttatgtcttgttactcgtagcctctgtgtgtggagtggttccttactccagggtgtccccagggccagctggactttccagcaggggtcaagtgcactaatgctggctactgaccaacaaagaccacaacaggcttaacccttttggggcatacaaactcccttagatctgatagaagttacagaacctccctctgaaaagtcacggggacgcaaatgcctagtaccttgcatacattttcaggaggagtacggacctatgcactgggttagcgctagggtggggtggccgggaaggtgctgcaggtcaggcctacacagggtggacgatgggacttggctgactgacaggtaatggaagacatatgatgctgtgacctctgatcaaggctctggtgcaggaatgggaggcatcccgctgggggtcgggggaggcctaggtgccttgacttctgatcagggctctggtgcaggagtgagaggtatccagatgagggtggggggtggctgggcttgctgaactgttggtggggacctggtaaagccgcagcaccacctggggggatggaggtgcggctctggtgctccctactggggccagattttgctttgcccttttcttattgttccgtctttcttttctcttactatccagaaagaaccaaatggtataatcctcatatttcatttttaaagctgcatgagtacagtgttctctgcctgtttctttaacctgaaattagttataaatatgtttgggttcttgagtaactgtttccttctaggattattgatataaaagaagtgcccacccctctgttttactaaacaattaaaaatttctcctctaggctgtggggtactatgaagaaaaacaaaaaagaccaactggttctctggtgacaaatttagaaaacctcccttcctcagctaaatgaaaatctgaaatatttttggtctttaaaaaaaagttcctttgggctctccatccaccccatccctctcttactcctgaccctacctctgagcactgaacacccttccctcctgtctttccaaattccccgctagtccagcttctgtgcaactcacccagagatcttcagtctcaaattcccatggcacatccctcgcttccacaaagctgggtggctgttctcttcacccatggccctcctctcctgtctcttctgtgatctccacaggcagctgccctgaacacggcacctttttctcctcatcacccattgtctaaccctcctgctagtctcttcagtgcaactttcactgaactcactgtggccttttcttcccttctaggcaaagttctgctacaacagtctggtgctcggcaaaccacctttctgctgtgcagaggtctcagctaaggactgggccaggggcgtttaatctaccttgggaagtgtctggagcagtcaatgcaacacagcatgtgggccaaggctgagcacctgcagggccatcacacgggcagagcggccccgccacctggccattcccgcacgcctgaccgcgctcaccctcactatggctctgggctctcattatggaaggtgctccatggacacccaggaggcctcagaaagaggcacctggggcaagtagggccttgaaaagaagttccccactcacgtgataaaaacacacataaataaaaaacaggcccgccacacacagggtgggtggtgcatcgggacggaaagcaggtaacgtggacagtgaaacctgaaaagcacaagcatactgagcgccaacaaagtcctttattcctatgagaaatacttggggatacagaacgagaaacaaatagaacatgaaaggaacaaacccagcaatcatgaaattcagcgccctcccctttcctatgtcccacacatgccatgaactagagtgagcagaagagtgctgcgggaggggaggcctctatattgaaggtgagttgctctcacagctctgcagcctcttggtgccatgtaagaacctggcaaatataaaaggatgcaggattattaaaggtcccagacaagaactctcttctgctagctggggctggcagcagtctctgtctctatggaccctcggctgcagtggagcctcagacatctgcagcggccggccccccgctttagctcctgaagtggcatggaaacatacgttcatccacgcggcaactccacttctgaaaacgtacttctaacgactacacactccgatggccgacctttaagaggtctaataagaccaggtgacagttcctcggtttctaagacctgctggctaacatccaaaggagaatcagccgtgatcactgagccgaggaggaggcccctccgccatgccaactgccatctgtccacagtaaatagtgcgacagaagaggaaaaggaaacgtcacgtggcaagaagcaggcaatccatgagcggcttgacagctctggatagaaagtcctagctgagcttgtgaatcgttaaggaaagatggacacgagggtgtccaggcccatctccctccctcacggagggaagaggcagtgggcaggtgtgacagcagacgctgtggggcagtacttggagggcgatggctttgaaagagagttttaaaaactggactgggaaatgcgagtgtcacgagatgccggcgagtggagacagaacactggaaggagcagccagccaagagaacgaggccccgaggaagggagagagcaggcacgcagcggcgcggggaggagcggcatggaccgcagcagacggcctctccggcctgcgcacccgggtcagcacgctgagggaattaaacccattgcttcctctgggcagtcaatggtgaagcggtcctctgagagtgaagaacaagcgtgtgagttaaggtgttgaagtagagtgaacacacctgcaggtgctgctgtgccgaatgcggagcgccagccaggcggggaggctctgtcttgccaagtctgttcagagtcccgtgggaagacggtgagggaacagaaccgcttagcaacatgaggtacagaaagccacagcaggtaacaccgactctgggcttcaaagacaataggggcggggaggcgtcccaaggcagaaggaattctgtaagcggcagtttggtgagcgcgaaggcgcagctgcgagtggcatctgctggggtgaggcttgaagagccgcgcacagccatcctcagctcagcggttctcatctggaggcagttttggttgtcacaactgtgtgtgggtgggcgctactgacacctagtgggtagagggccaaggacactgccaggcccacacccccacacaatgacctggtcccaaatgtcaacagtgccaaggctgagaaatgctgctctagcttaaagactgtcacaagtaccgcttgatgtgtaaagttaatttttgctacacctgataactgcactgtcgctacatggcagtgagatggtgtgctgtgctgagcaggctgtgtggtgcagtctcagggaaagttacagcttggtgatgcgtggagtgtaagaggaacaaacagccgctcagttccacagcaacagggaaaactctacactcagccagggcagtaagcacagctagtaacacagtgacccagtactgaaagacaaccaagtaacagtaccatagagggtgcagcgaaattccgtgaaccgtgccaaaaattctaacattcacaagcagaccacaaacacaaaccacttctatggtggcaggtgcagcgcagaaatggttcagatcaaccatggcctggaccttggtggcaggcgtggctttgcagcacgagaatcgggcgggaacttataattaaagcgcatatgcccggcctccacccgggatgcttctgaaagcctcccactgactctgatgcagtcaggtctggaaagcaatgaactaaattttaaaaagagggccagacgtcaggctcatgcctgtgatcccagcacttcaggatgctagggtgggaggatacttgaggccaggagttcagagcggcctgggcaacatagtgagaccccaactctacaaaaaataaaaattatacaaaaggaaaaagataactccgaatgaaactggaaaagtcaacactgaagggatgaagataatgggattaagttcccagaataaactactttaggccgagcctcccctgagggaagatcccctcattctagtaatatacccatgaatggttttggaggcccgtagttttaggtgccatatggttctggaggatcctgggctgaaacagcaagacagaatttggagagccttggcttctcctggtcattccagtgttgaagcaggcaagtgtggatgacgcctccctgtgtcccgctggcccttctcctgatttgcactggcgtgtgcatttcctttagcctcacgtttagaccgtcaatgactgcatgtgaaggaagactggctgttccacagtttaattttctagaggacagcttacatttagttttatagattttcctttatatgtaaactagaatgactggacttccagaatcttggatttctgtttcagtacatgtaattcttcttcagtttgattttttttttttttttaaaaacagatcttcctagactcaaaatagattactttgtaagtaaaataagaccagtagcctcatggagataacaactcacaattattttattaattcacatgctccatattataaggctggagttgtgtggatgtcttttaaagggaagggaggaggaagaggcaaactctttggttttaggcttcttggcaggtgatttcctatttatccaattgatactcagaactgtgtatcttagtttcatgctccccagcttgagaggagccacaggagaaaccaacatgctgtttccagggcaaccaggcacaggcgagtcctttcctcatggaggaaggcttggtcccatgtggggagcaccacattaaaggcaggccttgacacagctctgccatttctgaattgtgcgaccctggaacctgctatcggctcaccatccttcactgtacaacggggaaaacacaccctcttaggactgctgggagaattataggagacagtgagtatagtctgctcagagcagagcatctgaaccacagcaggcacaaagcaggtatcagttctttccattttgcataatccaggtttagaaaaagatttaatccaagtccctggagttgttgtacccagagccaggtgagctcgatggaagtctcactgaagggcttggagatgtagtctaagatggagaggaacaaggggctgtttttgaaacccacaggaatcacaaaacaatgccaagcacagtgactcatgcctgtaatcccaacactttgagaggacaaggcaggaggactgcttgagcccaggagttcatgttcagctgtgcgcaacatagtgagaaccccatctttaaagaaaacaggccgggtgcggtggctcacgcctgtaatcccaggactttgggaggctgaggcaggcagatcacctgaggtcaggagttcaagaccaactggccaacatgatgaaaccccgtctctactaaaaatacaaaaattatctgggcatggtggtgggtacctgtagtcccagctactcgggaggctgaggcaggagaatggcatgaacccaggaggcggagcttgcagtgagccgagattgcgccactgcacactccagcctggggtgacagagcgagactccgtctcaaaaaataaataaataaataaataaaagaaaacaaacataaaaagataaacgaaaccatagaacaagaattctcgacctcaacactcctaggctgtgtctggggagtctggaggccgcgtgccacatcgcatattggctacacctcggaaggccgtgcagcccgcacctgctgaacagcaccactccctgctggcctcagccccatggccagcaatgcacagcggacttggcctccagaaagccacgaggtgggtggcgctcaaaagcaagggagatgcccaccctgaaaaggaggcatacaaagcacattaatatcattctttctcaaacaaatgaagttgacatacttgcaggggagaattcggacgacatcattctgcttatagctctctatgcagactgcacaatgatcaaagtctgggtcagtttcctaaaatgaaaagtacagaaacaaaaagtcacacgctgcaagtatataaatggttgggatgcaattcagctcagaatctttctgtggctactatggtaagcaagtgttataaactgaaaaatgattaaaattattttgtttttatttgcctaactatattggcccaaattatgtctaagtcaatctattttgttttaaaaattataacaatctatattaattttgttatgatatgtcttacaaaaattaagtcggaattctaattttttccaggttagaatcagcttggaccatcatgatctccccatccctcattccccctgcattacttattggtctgaagaggtttcactgctatgtttgacacagcctggaagctcaccaggatgttcacttaaacacacacctaagtacagacaggaaagatggtgagttgagtcccagcagactgctgtctagaaacccaccccaagaatgggagctgtgaatctggtcacagatttgggatggagaagggtcattggctcaattcaatactcggtcttcattaagagtgagaaagagtcagccaggtattcagacaccagattaattgatttccttcctcctaggactgagaaggggttttgcaaaagttgtcataaaacaaaacatgccaggaacctaagccaagaaaacagactatttgctgtgtcactgtcacttggactgaaactcagtggacaactcttgccaggtctaggaggtacaaactaagatgaattggctttaataattaaaggaaataactgtgctggcccgggatacaaagtcagatgggtaggttaaatccgctccagggaatttcatactattgtggcagctgaggctaccaggccaagaaggcatctacactgtcaccgtggtcaccactcctctgccattgaaatgcaagccgttttgatgctgcttctattttcttaagtgatttcccccttttctgtttctttggtgtacaataaagttcactaagaatgtctccaccctctgaagctgtttcaaaggcaactagatacggtggtatcaaggcaatgggaataaaatgggtaaagtccaagaaattggtaaaacttaggaagacagagaatcatatgaaattatccttccaggcacaagtctgtgcttaaatattagaattgggtgtggggcaggagacagttttcgttttatgccttttgagatgccattttcccattctagataaccttgaatactctgaatgtaggggcagcactaagatgcaactgtgtccttctagcggagaagcagggctctaccataactagagctctgaggcgggatgtcagttagaggtctccgccacagcatcctgacactgcctctctcccttggtcctccaagccaccagggatgaccctgacacactttgctcttctttcaaactgctcaacccattgtaaagagagcacctttttaggtgaaactccctagaaatgcaggtcttcaactctccatgtatctagtgaaaaaataaaacaacaaaagagacatagcaaagtcccaggaagtataggaagaaaacacatctcctggctttttaacgcacaaatggtcccaccagaattctctgaaaatgcatgctaggttttagcagaagaaacctctgtaggaaaacacagctagagttactgtaagaaggtagtttaaaataaagcattaggtagtgtagttggagaaaatctaacgaatgaaatgtaaacaattagggtgtgtcctctcccaccaaacaaaaacaaaactgctggattacttttacggtgctgaagttgtttcatgactgtaccttgtcacccttctttactgtcctggttgtcaatttactgatggctttcttggctgcatctccgagacgacgctatgaaaattgcaaataaaaacagatactaagtgtaagatctctgaatgacgtactttatttttaagcaattaaaagtataaagtctctattttactacatccctctccatgtcctacatataagagaatgataaaatagaaaaaatggtggctgtatcaagattcagcattctggttgaaaagtaaaaagtgttagaacaccctgttaggtcaaacagaaatatagaactataggtcttcaattctccagcagtaaaaaagttaggtgtcataattgctgcattttgtgtcgaataaacatttgaaacatcacagcactatcaaacctacttcttgcacactccagagccactcctgctgctccaatggcttttggattctgctcaacgaatgatcaccattaggtgtgtaaatgccgtcttattaagggaaaccttgaccgctccttgaaattgcttatcgcatcatcaagtgtgaagagaaggaatgcgtcacagctccacttctggctcgctatactatcatcctctgggatcctgggaaggtgtacttaccttccagggttgagctgttttcattatctgtaagggtgagggcagagaaactccaaggctggatttatgcaacattctcccagacactgctagcactgcttggcaccaacaacccacagatgaagagatggtgatccctaccctggaaaagctcactgaactgggacagctgcgttaatggtgtatactcaagcatgcccagggccaggtggcagcacagaggaggcgactaggaggggtggggcgaggcaggggaggaacgtcagggaaggtcttgaggagtcgaggcctggactaagactgggaaggggttagatgggaaaggcgtagggttaggagggggttccgggtgtaggggtaggagtgggttccaggcaaagtaataatctagtaaagataaataggtgtaaagaacaggtatgtgaagaaaactaaggtgagcatctgctttcctgttcaaattagaaagctttgtgcatcagagggccctaggaacactcacactgggacaaggggcaaaaaccgcgactgtcccaggcacatcagggagacgtcactctagacacatccaggccttacactgtgggaaaaggcagatgccgctcctgacggagcaaggcggggaccaaaacaacggacaccttaagaatgttaaaaacccatagaaacatgtaagaaaaaatttaggggaaagttttaaacacacaaaagaacagagaatgatttaataaagccttccctatgtatctaacatccggcttccattaccagtactttacttctatttttcatctgtttccctctttactgtgttagatgattttgaagcatatggcaagcatcacataatttcacccataaaattttcactaagcacctctaatagacacgggcttttgttagatgccactgtctttcctaacaaaagtaacaatgattaatcaacattatccaatactcacactatactacaatttccctaggtgtttacagaatgtctttaagcagctggcttgtttgaatcaagatacaaaatccacacactgcgtgtggctgctccgtctttgaagcctaatctatgagtcccttctgtcacgctggttttaaaccaccttatggagatataattgacttaaaatagactgcatatatttaaaatctacaccctgacatatatttaaagttacagtttgaagttgcatatgaaatctacgctgttttcattacccatgaaaacctaactacaatcaagacagtgtatctaccacatccccaaacttctttgtgccccttcctaattccctcctcccgccaccccatccctccatgatctactttttgctgtaacagtctgcaacatcatgagttttacataaatggaatagatacagtatgtactactgtgtgtacggcttctttgactcagcatgattatcttgagattaagccaccttggtgcatgtttcaacagttaactcctttctaatgttatctagtatcccactgaagagatggcccacaatatcctttcacctgttgatgggacatctgcactgtggtccagtttttggctgtactgaaaagctgacaacaacattctcaattctttgcatggacatatgctttcttttttcctgaggtaaatactgcaagtagaaagatgggctcacctgatagttgtctgacttttatttaagagactgccaaagtgttttccaaactgggcatattattttacatttgcaacagcaatacatgaaaattatagttcctccacattctcaccaacacttggtatggtgagattttgtgttttgttttgttttgttttgtttttaagacaaggtcttgctctgcttcccaaactggagtacagtggtgcaaacacggctcactgtagccttgacctctggggctcactcaagtgattctccagcttcagcctctggaatagcaggaactacaggggtgcaccaccatgaccaactgattttttatttttatttttgtagagacgaggtctcactatgttgcccaggctggtccgaaacttcttggctcaagcaatcctctcactttggcttcccaaaatgctgagattacaggtgtgagccacggcacgcagcctccttacagttttaatttgcatttccctattgtaatgatgttgaccatcttttcatgtacttattggccatgtgtacattgtctgtggtgaagtgtctgttcatgtgttttgcctatatgtgtacattgtctgtggtgaagtgtctgttcatgtgttttgcctatatttctgagttgttttgtattattgacttttgagagaacattatatattccagataaaaatccttttgcatgtatttcccctcactttatggcagtttttaatttgatgaagtcgattaatcattttttcattggtagactgtgctctagtatcatattaaggaagctttgcctatttcaaggttacaaagacttccccgttttctcttctagaaattttatagtttcgtactttgtatttagggttctgactcattttgtgtattctgtcaggtacagatgaacttttttttttttttttttttgcatatggacatacaattgttctagaatcatttgttgaaaaggttgtccattctccacagaattacctttctaaatctgtcaaaaaccagttgtccataaatatgtgggtctatgtgcggacactattgtaccatgcatctatttgtttaccattaaggaaatacaatcctgtcctgatttctgaggctttgtaatagatctgaaattaggtggtgttaaccatcccacatttcctttctattctaacatccttgtggtttttcttgatattttgcattcccatatgaactttaggatcagtttgtccatctctatgataaaagacatcagggatttacaatgagattgtgctgaatgtatacatccacttggggagaactggcatcttaacaacattaagtcttccactgaacactgtgtatgtgtctctccacctacttagttcttgattaatttcctcagcaatagttagttttcactacatagggcatattgcatattttgtcagatttattgttaagaatttcctatttgttgatgctatggaaaatgggatttcttaaaatttaactttcttagagatagggtcttgttatgttgcccaggctggactcaaactcctgggttcaaataatcttcctacctcagcctcacaagtagctggaactacaggtgtgcaccatctgcttgatgaaaatgcattttttaaaaccaattcaattattcattactcatatatagaaataaaattaattctttcatattgatcttgtatcatggaaccttgttaaatctactgttggtctttttcatagattccaacatatcttctacacgaaatttctacagaaaataatgttgtctgtaaatgaagacagcttacttctccatttccacaatggatgtcttttacgtcttttcctttttacttactgtgctggctagaatctaaagaacaacgcagaaacagaagtgatcagaggacacattcttctcttgttcctaatgttagaaaaaagaatttagtcgttcaccattaaatataatggtggctgtcagtttttcatagatgccctaatagtttgaggaaagtttaaaaatcaggaatcgatgttggacttcggcaaatatcttttctccatctattgagatcatacagttttagcttttttggcctgctaatatggtaataatacattaatttttgaatgttaaatgaaacttatattcctggagtaaacatcacctggtcatgatgaatttatatatattgttaaatataatttgctaaattttttagaatttgtgcatctatgttcaagaggggtcctggtctgtagttttgttttgtagtagttctgtctagttttggtattaggaatgatactggtgccatacaatgaaattggaggtattcctgccttttccatataagttaagcatttgaaattaaaatctgaaatgctcctaagtatgaaacatttccagtgccaacatgaaactcaatggaaatgctcactagagcattttgcatttcagaattttggatttggtatgctcaaacggtaagtataatgcaaatattccagaatctgaaaaatttctggtccaaagcattttggataaagggtactcaacctatagtttgtttgatattgttatcatagctgccccttgaacaacatggaaacacccatttccatcaagtcatctcctattaatttaattactctggtgtagtatctatttgctcttgaatttcttcaacatcctcatcttgaaaccctttaccccctaacttttttttttttttttttttttgccatatccacaatctgtttcatgatttccttgactggctctatcataaatcctgtgaaatcatgtactacgtctggacacagttttctcccatagaaatcttttgtttagactttcatggcatttcctataataataatgacatcttcaacagtgccatctttccagacttttgtgatgttttatctggattctattctacagcattaaatgctttacatagcatactgtgcatactaagccgtaagggtccttaggaccccctgctctagaggttgaattagaggcatgtctggggtcaagaaggccactctgaagccttcagtattgaattcatggggttctgggtggccaggggcattatccaatatcaaaaaaacgttaaaaggcagtcctaccctggcaaggtacttcctaatttcagggacaaagcactgataaaaccaattcagagggttcccactattcggtcctccctgttttgcaattaaaaaccggcagatggtatttataatttcccttccaggctggtgtttagtagctttatcaataagggcagtcttgatcatagacctgactgcatttgcacaaaacaaatgcctgaagtcttaattctctcttctctaccttactaataaatgtcctttgtggcactttccccccaaatagggcactttcatcaatattaaaaatccgttcacaaaaataacctttctcctcaatgattttcttaatgaaatctgggaacctgacttgactgctacttcttgatcgtcaaaagctacttctcctgttatcttgtcatttttaaagccaaatctctttctaaacttttcaaactaacgtttgctgccattaaattctccagtgctatatcctttgctttccttttaagttgtcatataatgacttttcttttcctcaaatcacattggatactacaggtatgccttccttatagaaatcctgcacccacataaaggctgcaaaaggtatttagcaaaaagtataaagtttttgtgcctgttggtgtagctatagcaatggcttcatgaatagatttttctgtccttttatgtgttttacaatgatatgctaagtcattctttgtgaaatggcagcacctgcagctgaagacctctatctatggtacaaatcaagcaatacaactttttcttgtaacgtcatgacttctctccgcttcttgggagcatttccagcagcactatggcacttcatacaggtcccatggtgtaatattcaagattcatgatactgcactaaacacattgaaaactatgtgagaaccacaagaggtcacttttactgcaataatcaacctaatggagggacgaactactcataagcgtatgtcacatgacatttcaagtggacactggcaacactggtgatcacaatagcaacaggtggctatgaaattattacattaatacagtacgtactactgttaattttatgcggttatgatttaacatggtttacatttcttccaactgtgaatggtgccatgtatttgttttaataatttttaactttttacaatggatttttgtatattttatgatagtaaatgatcaaatagactagtatctacatgtattttatacatgatgacatatatttctccatttttctgtgatctcttcaatttctttcatcagtatttgagaatattggttaaatttattattcttatgtattttatttttatgtgactattgcaaataggactgctttcttgatttccttattacccagtttgttactggtgtacagaaatgatactaacttttgtacacaaactttgtattctccaactttactgaatttatcaggtttatgagtttttggtgaactctttgttttttttctacatatggtcacataacctgaaaagggagacaactaacattctctttatgatatggatgccccttcctcccttcctcctttccttccttcctttctttcttctattttttttcttagagacagggtccctgctctgtcacccaggctggagtgtagtggtgtgatcatggctcactgcagcctggacctcctgggctcaatccatcctcctgcctcagcctcctgaatacctgggactataggcacacaccaccacacctggctaatttctatatttcttgtggagaaaggggtctccccacattgcccaggctggtcttgaactacttggctcaagtgatccgcctaccttggtctcccaaagtgctgcgattacaggtgtgagccaccgagcttggccaccttttatttctatgttctgactgctccggctatgacttccagcactatgtggaacagagggggtggtaggtagaagtgggcatccttgtcttgaaccagttcttaaaggaaagtctttcagcttttcctaatcaatatgatgttagctgtgggtcatgtgtatctttcactatattgaagtatgttacttctatacctaatttgcaaagagtgttgaattttatcaaacgccttttctgtgtctattgagaatctggtatttgttgttcctttattctgttgatgtgaaacatcatgactattgacttgcaaatgccaaaacatccttctatccccgggacaaatcccacgttatattgctgtattatctttttgatgtgttgttggattcactttgcttcgtactgggttgaggctttttgtgtctatgttcaaggacattggcctgccattttcttatttcgttgtgcccttgtctggttttaatattggaataatttgggtctggtagaatgagttagaaagaattctctcttctttcattttttgaaatagtttcagaagaactgacgttaattctcctttataaatttgataggatttggcagtaaagccatctggtcctgagtttttgttgagggatcattactatttattgttctgttcatgttttctatttcttcttggttcaatgttggtaggttgtatgtggctaggaatgtatccattttctctaggttttccagtatgttagtgtataattcttcacaaacctctaatgatcctttgtattttgttggtttcagttgtaatgtctcctttttcacttctgattttatttgaggcttcttttagccatttatctattgaaaaaccaaatttcattgtgttgatcctttgtattgtgtttttagtctctgtttcatttagttctatgctgatctttattatttctttcattctaccaattttgggtttggtttattcttgcttttccagttccttgaggtgcataactgggctcttcatttgaaatatttctaattgtctgatttaggcattcattgctataaacacttccctcttagcactgcttttgctgtatcttgtaggttttggtatgttttatttccattttcatttatttcaagaacttaagaaatatctcttaatatattcatcaaccttatggcagtgatcatgttgtttagtttccacgtagatactgtttccaaagttcctctggttattgagttttattccactgtgttctaagatgcatgatatgatttctatttttaaaaatttgttgagacttgttttgtggtctaatatatagtgtttctaaacaatgttccatatgttgaggaaaatgtgtattctgcagcaatttgatacagtgttctgtaaatgtctgttacgtccatttggtatatagtacagttcaaatccaagtattctgttaatttctgtccagatgatctgtccaatgttgacagcgggtgtattagtccgtttttatgctgctatgaggaaataccccagactgggtaatttataaagaaaagaggtttaatcaactcagttccgcatggctaagaaggcctcaggaaacttacaatcatagcagaaggcacctcttcacagggcagcaggagagagaatgagtgccagcaggagaaacgccagacgcttataaaactatcccatcagatcttgtgagaactcactctctatcacgagaacaacatggagttaaccaccctcatgattcagttacctcccactgggtccctcacatgacacatggggattatgggaactataattcaagatgagatttgggtggcgacacagccaaatcgtatcagccggatactgaatttcccaaccattattgtattggagtgtatctatcccttgaggcctagtaatattagctttacttatttatgggtgctatggtgttgggtgtataaatattttgaattgtcatatcctcctgcagaattgatcccttcactattatctatttacgttttttaatttttattttttacataacgtctgttttatctggcataagaatagctattcttactgcttttgctttctgtttgtgtagcatgtttttctctaccccttcactttcagtcgatctgtgtgtctaggtatcacacagttgtgtcatttaaaaaaatctattcagtcaggctgtatcttttaagcggagcatttgatccatttaggttcaaggttaacattgatatatgacatcttgttactgaaatatattgttatctagctgttttgtaaattctttgttttattttttcttctgtctttgtggtttcatggagttctatcatggtgccatttgattcctttctcttcttcgtgtaattgttttatgagacttattaattttatactttcatgtgtttttatgatggcaaatatcaaccttttgtttccatgtctgggactcctttgagcctctactatagtattagtccagtggtgatgaattctcttagtgtttgcttgtagggtccagccccacggggttggtgggtttttctccccatgtgtggagacgagagattgcagaaataaagacacaagacaaagagataaaagaaaagatagctgggcccgggggaccactaccaccaagatgcggagaccagtagtggccccgaatgcctggctgcactgttatttattggatacaaagtaaaaggggcagggtaaagagtttgagtcacctccagtgactgataaggtcacgtgagtcacatgtccactggacagggggcccttccctgttaggtagccgaggcggagagagagaggacagcttacgtcatcatttcttctatgctcttttcagaaagatcaaagactttaacactttcactaattttgctattgctatctagagggcggagccaggtgtacaggatggaacatgagagcggaccaggggcgtgaccgctgaagcacagcatcacagggagatggttaggcctccagataactgcgggtgggcctgacatcagtcgggccttccacaagaggtggtggagcagagtcttctctaaactcccccagggaaagggagactccctttcctggtctgctaagtagcgggtacatttccttggcactgacagctaccgctagaccatggtccgcttggtaatgggcgtcttcccagacactggcgttaccgctagaccaaggagccctctggtggccctgtctgggcgtgacagagggctcacactcttgtcttctggtcacttctcaccatgccccttcagctactatctctgtatggcctggtttttcctaggttataattgtagagtaaggattactataatattggaataaagagtaattgctacaaactaatgattaatgatattcatatataatcatatctatgatttacatctagtataattcttgttattttataatattggaatagctcgtgccctcggtctcttgcctcggcacctgggtggcttgttgcccacatttgcttgtctgagaaagacccgttttctccttcacttacgaagtttattctagctggatgaaaatttttctccttttagcactttgaaaatagcatcccattctcttctggcttgtgtagtgtatctttccctatctgctgagaaagtctgttgtttgtctgatggagcttcccttatagatgactaggtgcttttctcttgttgattttagaattttttccttcacactgactttaagcaatctgatgactatatgtcatggtgaagtctttaagcaatctgatgactatatgtcatggtgaagtccttttgcaatgtatttgcctgttaatctttctgcctcttgtatctgaatgactagatgtcttgctaaacgagttaagttgttttcatcaattatttccttaagtaagttttctaaactccttgctgttttcttcttcctctgaaacaccaatgattcagtttagttgctttatatagtccatgcttcttggaggccttgttcttttgaagtttttcttttctgtatttctgtgcgaccagattcatccaaaacacttgtcgtcaagttgtgggatgtttttcttccacttgatctagatcagtggcccccaacctttttggcaccagtgactggttttgtggaagacaatttttccacagactggcgggtaggggatggtttcaggatgattcaagcacattacatttattgtgccctttatttctattattattaaattgtaatatataatgaaataattatacaaatcaccataacgtagaatcagtaggagccctgagcttgttctcctgcaagcagatggtcccatctgggagagatgggagacagtgagagattaggcattagattctcatgaggagcactcaacctagatgctttgcatgtacagttcacagtaggcttcacactcctatgagaacctaatgccacccctgatctgagaggaggagcagctcaggaagtaatgctagcaatggggagcgactgtaaatacaaatgaagcttcagtcactcacctgatgctcagctcctgctgtgtgtcctgtatccatggtctagatcattgttgggaactcctgatgtaaatcattgttttttgctttttgttttgagatggagtcttgctcttttgcccaggctggagtgcagtggcacgatctcggctcactgtaaactctgcctcccgagttcacgccattctcctgcctcagcctcccgagtagctgggactacaggcacccgccaccatgcccggctaattttttgtatttttagtagagacggggtttcaccatgttagccaggatgagtctcgatctcctgacctcgtgatccacccacctcatcctcccaaagtgctgggattacaggcgtgagccaccacgcccggccctaaatcattgttaaagctttcaaatgtatcttgcaattccttcaatgagtatttcatttccaggagttgtctgtttttaaaataaaaaacttatcttacttgacattttgaggatttaaggatccattgttggagaattactgtgtttttttgggggggtgtcatattatctttttcatacttcctatagtattatattgacttcttcacatctgcacaaatagttgcttgtccttatttttaaattttagttgaagtgggattattttttattttttatggtttatttattattattatactttaagttctagggtacatgtgcacaacgtgcaggtttgttacatatgtatacatgtgccatgttggtgtgctgcacccattaactcatcatttacattaggtatatctcctaatgctatccctccctcttccccccaacccatgacaggccccagtgtgtgatgttccccatcctgtgtccaagtgttctcattgttcaattcccacctatgagtgagaacatgtggtgtttggttttctgtccttgcaatagtttgctgagaatgatggtttccagcttcatccatgtccctaaaaaggacatgaacacatccttttttatggctgcatagtattccatggtgtatatgtgccacattttcttaatccagtctatcgttgttggacatttgggttggttccaagtctttgctactgtgaatagtgacgcaataaacatacgtgtgcatgtgtctttatagcagcacgatttatagtcctttggtatatacccagtaatgggatggctgggtcaaatggtatttctagttctagatccttgaggaatcaccacactgtcttccacaatggttgaactagtttacagtcccaccaacagtgtagaagtgttcctatttctccacatcctctccagcacctgttgtttcctaactttttaacaatcaccattctaactggtgtgagatggtatctcattgtggttttgatttgcatttctctgatggccagtgatgatgagcattttttcatgtgtctgttggctgcataaatgtcttcttttgagaagtgtctgtctgtatcctttgcccactttttgatggggttgtttgatttttttcttgcaaatttgtttaagttctttgtagattctggatattagccctttgtcagatgggtagattgcaaaaattttctcccattctgtaggttgcctgttcactctattggtagtttctttagctgtgcagaagctctttagtttaattagatcccatttgtcaattttggcttttgtggccattgcttttggtgttttagacatgaagtccttgcccatgcctatgtcctgaatggtattgcctaggttttcttttagggtttttatggttttaagtctaacatttaagtctttaatccatcttgaattaatttttgtataaggtgtaaggaagggatccagtttcagctttctacatatggctagccagttttcccagcgtcatttcttaaatagggaatcctttccccatttcttgtttttgtcagctttgtcaaagatccgatagttgtagatgtgtggtattatttctgagggctctgttctgttccattggtctatatctctgttttggtaccagtaccatgctgttctggttactgtagccttgtagtatagtttgaagtcaggtagcatgacgcctccagttttgttcttttggcttatgcgggctcttttttggttccatatgaactttaaagtagtttttttccaattctatgaagaaagtcattggtagcttgatggggatggcattgaatctataaattaccttgggcagtatggccattttcacaatattgattcttcctatccatgagcatggaatgttcttccatttgtttgtgtcctcttttatttcgttgagcagtggtttgtagttcttcttgaagaggtccttcatcccttgtaagttggattcctatgtattttactctctttgaagcaattgtgaatgggagttctggagtggactttttttaatcctgaggatgttactatgatgtaatttgagtaggattgtttgactttgcttctgagtgtgttcagtagcaaatattctaggatttccttggatataaacagccttagtgtggtggctttctcaaatgctggttacagtagtggtgtatcgggtgggtgagctggctcataacctcctgagaagctggggtggcatgagcaatggtggtaaaagaagtcatgagaagcttttcttattcccaagtgctgtgcacttatgtaagcagatgttgtaatgggctgtgtgggtcaacctccaggccagcaggtggtagttgcaggtcacagctggctacagttctaacagtagggtttacgacttatctttgttaaccaagagaagtacttaagtgtcccacgcaatgggttgggccagggaaagctcagtggtttgggtcttacactcagccttgggggaggggaggggactggtggggagaggtgaagctgggtagagctggactgggcaagacagccatttggtcccccagtagcaggcagaagcactggctctgacagggatctagggacagttgccaaaccctgtagaaatgcctaggcaaagatgagagcaactgacattgcatcaatgtcccagcacaggaaggcaagggcaaacccattgttaaaaccaggcaaacagtatgggacctgcctctctctctctctccagaaccatcaggactcatttcctcatcccaaccacaggaatcagacagaccatatatctgccttcagcctgcaaatttgctattgggtccaaaaccacacctctcaggcaaatctcctgctccagtcccatgatgggggtgcaggggtccaattctagtgcccaaagctggaggcccaagctgtactcatttatcatttctggctgtgtgggcccctttcctaccaaagacccagtgttccaatcctggcatgagactttataatgctaacagatgctgcttctgctgctgctgctaggccacaggattcccacacagtttgctatgagctaggactgagactggagtcctcttatcagccaccaggtctgggaaaatgcatgggatgcatcccaggttgttccttctcaatgtctctcagctactccctaagtaagatccagggcttgggaagctcaaggtgctctcctgtggcctggattgcacacttccccagtgggaagatggactgcagaggaacactgactccccatctcctgtattggggattttctgtttttagccagactctgccaggagggctgtctcccaaatttctctttcccagtgtctgaaatgttctgttcaattcctgtattccttcttggataaaagttaatgatgtgactatctgcacactattttgctttttccaagtgggttaggcatgctggaaaagcctctaatctgctgtctttgggggaaaaacccatacaaagattgtgttttctatttctgtgaataatatcactggcattttgatagggattacattcaatctgcaggtcacttctgatagtactgtcattttcacaatattaattattcctatccatgaacatgggatgtctgtttttgtttcctcttcaatttctgtcatcagtgttttagttttccttgcagacgtttcacctctttgactaaatttattcctatgtattttattcttttttggtggctattgtaaataagatggacttcttgatttatttttcagtgagttaattgttggtgtatatacacagaactgatttctgtatgttaattttgtattctgcaactttacttatcagtcctaaaaggacttccagtaataacatgttaaatagaagtggtgaaagtgggcatcctgtgtttttccacatcttagtggaaacgttttcagcttttccacgttcagtatgatgttggttgtgggtaagtcatatatggcctttattgtgttgaagtatgttctttctatacctaacttgttaagagttcatatcatgaagccacttatcaaatgctttttctgcatctactggcattaccacatggtttttgttcttcattctgttgatgtgatgcatcgcatttatggatttgcatatgttgaaccattcttgcatccctgggataaatcccactttttcatcatgaatgctcttttcaatgtgttgctggattcagtttgctagtatttcgttggggatttaaaaatttatgttcatcaaggatacttgtctatatttttctttattttgttgtatcctcatgtggtattgctattagggtaatgctggccttgtggattgagttcagaagagttcccttctcttcagttttctggaggagtatgagaagaattggtattagctcttctttaaatgtttggcagaattctgcagtgaaggaatcaagtgctggacttttctttaatgggagacttttaattacagattcactttaattactcataactggtctgtttgatcaggttttctatttcctcttgaatctatgttggtatatgtgtctgggaaaatttactagtggttgtcaattttattttttcaaatctttttatttcactgatcatttgtattgttttttagtcttttttaaaattttatttcttttggagacagggtcttgctctgttgcccaggctggagtgcagtggcgtgatcttggctcactgcaacctctgcctcctgggctcaagtgattcttccatctcagcctcctgagtagctgggattacaggtgcacaccaacacgcctggcttatgttttatttatttatttatattatatttttttgagatggagtctcgctctgtcacccaggctggagcgcactggcgcaatctcggctcactgcaacctccgcctcccaggttcaagccattctcctgcctcagcctcccgagtagctgggactacagactcccaccaccacacccggctaatttatttattattatttttagtagagacggggtttcaccgtgttagccaggatggtcttgatctcctgacctcgtgatctgcctgcttcggtctcccaaagtgctgggattacaggtgtgagccaccgcgagtggccttatgtttgtatttttatttgtagagatggggttttgccatgttacccaggctagtcttgaactcctggactcaagcaatcagtctaccttggcctcccaaagtgctgggattataagcatgagccaccatgcctggccctttagtcttgatttcacttattcctgatttgaacttcattatttttttttgcttcttctgactttgggtttgctttgttttcacttgttttttgagacagagtcttgctctgtcaccagactggagtacagtggtgtgatctcggctcactgcaacctttgcctcctgggttcaagcaattctcctgcctcagcctcccgagtagctgagactacaggtgcgcgccaccacacccaggtaatttttgtatttttagtagagacggggtttcaccatgttggccaggatggtcttgatctcttgacctcgtgatccgccaccttggcctcccaaagtgctgcgattagaggcgtgagccactgtgcttggcctgtttttgcttttatagttccttgagatgcttcattagattgtttattgcaaatctctattgttttgatgtaggtgttaattgctatgaacttccttcttcaaactgcttttgctgtatcccataggttttggtattttcttttcattttactgaagaaattttaaagtctccttcctaatttactcattgacccactggttgtttaggagcacgtttgtaaatttccatgtatttgtacaattccaaaagtttctattgttactgatttctatctttatttcatttgtggtcagaaaagatcctttgtatgattttaatttttaaaaagttcttaaaactaagaaacgccatctcactatattgcccaggctggtcttgaactcttggactcatgagatcctttctgcctcaccttcccaagtagctgggactacatgcaagcaaaactgtgcctagctgatatcaaatcttgttttgtggcttaacatgtggccaatcttgaagaatattctactggtgatgaaaacaatgtgtgttttgcagctgttggatgaaatatattgtaaatgtgttacttccatttggtctaaagtgcagtttaaacccaatgtttctttattttctgtctagatgatctgtctaatgctaagagtggggtgttgaattccccaactattactgtattagagtttatctctctctttagatctagtattttttatatatatatatatatatatatatgttttatatatctgagtgctccagtgttgggtgtatatatatttacaatgattatatcctcttgctgaactgatctctttatcattatattatgatcttctttgtcttttatttttcaatattttattttattttgttattattttttctttttttgagatggaatatcgctttgtcacccaggctggagtgcagtggtgtgatctcaactcactgcagcctctgccttgcaggttcaagcgattctctgcctcagactcccgagtagctgggattacaggtgtgtatcaccatgccgggctgatttttgtatttttagtagagacagggtttcaccatgttggccaggctggtctcaaactcctggcctcaagtgatcacctgcctcggcctcccgaagtgctgggattacaagcgtgagccaccacgcctggcctgttttatctgatacaagtacagccactcctgcttagtttttatttccctttgcatggaatatcttttttgcaccccttcatttttagcctatatgtgcctttagaagtgaagtgagttggccggccatggtggcttacgcctgtaatcccagcactttgggaaaccaagacgggcggatcacctgaggtcaggatttcgagatcagcctggccaacacggtgaaaccctgtctctactaaaaatacaaaaattagccgggcttggtggtaggcacctgtaatctattcaggaggctgaggcaggagagttgtttgaacccgggaggcgaaggttgcagtgagccaagattgcaccactgcactccagcctaggcgagcaagcgagactccgtctcaaaaaaaggaaaaaagaaaaaaaagaagtgaagtgagtttcttgtaggtagcatataattgtgtcacggtttttaaaaatttcatttcaccagtttatgtcttttaagtggtgaaatttaatctgcttacattcaaggttattactggtaggtgaggacttattcctatcaatttttaattgcctctggttgttttatatatcctttgttatttttgttctctcctattgtttatcattaaggtttggcggtttactgtagtgctaagatttgattcccttctctttctcctttgtgtatctgctctctaccagtgactttcatactcctgcatgttttcctggtagtgaatactgtcttttcaaaatgtaaaactctctcaagatgtataactttctcaatttttgtctaggaaagactatttcacccccatttctgaaggatggctttgatggacacagtattctttcttggctggcaattttctgctttaagcactttaattctatcattccattctctcctaggctgtaagatttctctggaaaaatctgtttttagtctaatagggattctcttatgtgacttgatgctgttctcttgctgttttgtgaactctttcactctcgacaatttgactgtaatgtgacacggggaggatgttttcagatttactcttatttaggaaccactgggctacctggatctgttgtccatatatctccgtagacttgggaagttttcagattttatcacatagattttttaatgcctttccccttctctccttctggaacacccataatacaaatatttgtttgcctaatgttccataagttttgtaggcgttcttcattatttttcattcttatttctttttttttgtctctgacttgttaatttcaaataacctatcttcaagttgagagattctttcttacatatgatcaagtttgctgctgaaattctccactgtatgttttttcattcattgaattcttcagctgcaggatttgattcttacttctcttttattcaatttcctgtttatattgtgaactgtttccccaactctattgattgtctacacgttttcttgtatctctctgagtttccatacgatcataattttgaattccttttctggcaattcattaagttttttcccattggagtgtgttactagggaattacgttcctttgatggtgtcctacttccttatttcatgtttctcacgtccctgtgttgatgtctgtgcatctggtggaacaatcacttctttcaaattttctagagtggctctcctggacaaagattttcgcctacagtttaatcttagtgtgccagttgggaagggtgtggtgactatttctggataggtgcagtggtacagtctctgtgcagtttcagctgaattcaacatcagcaataaccatgggtgcctcagtggtataagctgtggatgtctgctgcagtggtgtaggctgttatcctttcaaaggcctttggggacctactattcttgctttccccacaatgaggagacttagccaaagtgatccctcttggtgtgaggtctgatgttacccacaagcagctgcagcagcactggattccaggagcaggtgctcagaatgacaatgggaccatgtcctaggctcagagtctcacaaatgtatttgtggcacctgtggcaaagtgggatatgttacccacatggtcaggatctgtgactgtcaggtacccactggtagcttggacctaagagtctactttgtagctgtgattctatccctgggaattagggcataacactggcctgactaggtagaaggggcattctggaagtttgggtcaagggtctggctgcaattcaggaacatgagtcagcagggctcagtggcaacttaggtcccatggaatgaagcaccatacagtattgactatagaccctgggatggcagggctcagcagtatcttagatctgtgaagtccagtgcaatgacagcaagtatcctagcttaggggagcagagctgttgtgtggacccagcatgggaggggaggatagcacagtgataattccactctccaagaggaaggttatctaagcagctgagcttcttgaagactagtacaggttcaagcaagcagggtactagagttctacggcctgtaagggcaaggtgtctcagctcagtcaccgctctatttctctgggacatggtgtactatatcagctcatccctggcatgcacaactgctcagtctggccaaggcaccaactccccaaaggataatgtgctgcttcagctcaggcccagggagcatactcttttgggtgggccaggcaccatttccctgtgatgctgggagctgcttcagcttaggtactgggatgtgtgatcactctggatggccaatgcaccacttcctgggaggcgtggcgctgcttcaactgagacactggggaggcatgattgctctgagtgttcaaggtactgttttcccaaaaggcaggatactgcttcagctccagtccaaagcagctgggggaagaacaggtggagcagctccatctctgctggcccccgaggaacagagccaacagttgctcccagctcagcctggagatgtggggccactgtgctggggtggtttggtggcagcttagccttagggacaaaggggagccatgactactcacccctggagcaagacacacttcagtcacagctccaattccaagatggtatagcacagcagctgtgtgggccacagggattgaggcacagtgtcagctccttctctgtggggtgcatagccgggtggactcagctgggcttagtgcctgtgaggactggtgggaaccctggtggtgaggtctgtaggtatccacagtgttgaaggggctgctgggatcctctcacttacctcctcaccacagtgagctcttcctggttcccagctgatcctggttagaggatgggacagtggaggcccagtgtttccttcccatctctatgtggctatctcaaacgtctgtgctctccagagcttctgtcattcctcggatgcacccctgtactctccctctgttattttcattaagttgtttatttattgttcaggctttttttgcaaggaggacaagttctaaggatttctaatgggtcattttcctaaggtaactcagatctgggttgttattattattattattaaggaatttgaggagattttacaagaatctcattgcttccattctgttcagatcagaattctaccaaagagttctgaacagaaaagttcctgatgctatttgaggcttggagaattaaaatcttgcctccacaggatgtccaggtagggtctctaatatttcagagacaagaagggcctgaattaggcaagcagcagtaggtaaagaaagaagagcgcaaagtcaagaaagatttagcaggtaaaaccgacagaacctcatgactgacatggaggcacgaagaggggggtttgaggagaggtgcccccagacttctggctcggtgatgagccgtgtgagagcgcctgccatcacactgcattatggaatagccaaaagcagagagcaggtgctggtggaagcagtccagtcttcagcaagctgacgtgaatgcatgtaggttatctaatcagagacctacaaatatttaggtagatcatattttccacctctgaactttgaacacctcttatagcacaaggacaaaatatctcttctctgtgttaggtattaatgtcaataccttcactgtaatttttctttggacttggcttcagtattactaccttcttctgaattatcctttgagtttttaatcagtcctttaacatttcccatcactttgcgacaggtaaacctgtgacaggtataagtgtctatgtatgtgtgtacaatttgatctcttcctggaatctgtctaaaagccactatttttttaaaatttttcattctaagtctatttgcatccggctaactctcaagtacctacgatgaggtacaaaattcttccatgaagatcactttttattaaagtctcttaccttcacctaaacaccatgccattaagtcactgtttttcaaggtgtggtccatggggcagatgcattaaatctaccttgaatgcttagtaatatataataataaaatctatactaactaaggtttattcggtacataccatgtgctaggtactgttctaagcccttcacaagtactgactcgtgttatcgtcacaatcattttatgagaaaagaactataatatcccattttacagaagaggagattgaggcagagattaaataatttgcccacatcaaaggctagtaagtaggccctatccagacttgctgaattaaggggaggaacgatcttggaaatttgcaattttaaaaagtgctccagcccctaaaaggagctctcacatgattcttttgtatactaaagtttgagactcactaaatgaagtacaaaccctggtttcaaagcattttcccgtaatacgctacccactcactgatattctccgtacttcacactgtgccctattcctttaataataaaactcctcaaatttacacctcatcacacacagaatgttagaaatgacaaaaccacagaaaggcatcattttacaaaggagaaaaaccaagccccagaaagagatgaggagatctgtctgaagttactaaaagtattcggactaggaccatagatctcctttccacttcagttcttcctccactataaaatgctgaaaagactttctatagcatacagcttgaggggtttgttaggggccagattatcttatctcatctggtcaaagctgcaacaataaacaccattctatatttgaaagcaaagtgacaaaatgtttgaattggcagaaaacaagttaaaacaattcttacggcttaatctaataggaatagttggttcaaagccaaatggttcagagtatattgaggataggtcactttgatgaaattcatctcaggttttgccattcggcaatcagaactctctcacagaattagagtaagtctgtatctgcacagagtagggttttctttttgtaaacactggtgaaatctaggtataaaatctttccccaatgcaaagtgccttgtagtctgcaccctccttcattcattcaccaccattttttcccatttttttttctcaaaagaagcctctgttaactcttttgcaagacaccatctgcctgtgcccagatcactcctctcctctctacataaccttattttattaatatcatcttcctttgctcttcaatatttcctcttttcatagctccttctccctaagtctctcgcaccagaaaagaattgtatatcactccactgctaaaaaaccgtactgatggcccggcgtggtggctcgtgcctgtaatcccagcactttgggaggccgaggcgggtggatcacctatggtcaggagtttgaaaccagcctggccaacatggcgaaaccccgtctctactaaaaatacaaaaattagtcgggcctggtggtgggcacctgtaattccagctactcaggaggctgaggcaggagaatggtctgaacctgggaggcggagcttgcagtgagctgttaatcgagccactgtactccagcctgggcgacagaacaagcctctgtctcagaaaaacaacaacaacaacaccaacagaaaccatattgattatagaataaagcctaactttcttatgtgattcatgcccttcatagtctagtgacaatttattcatctaatatcagctcaacactcacaagtctcctgcccactattcctgatgtttcagtcattcaactctttcatctctctgtggaaaatgatccatttgcctgactctccttcatctccatctgatgaagtcttaattcatcctttaaaattcagctccaaggtcacaacctaccttctctgtgaagtgtccttgactccctgagagtaatatcactctgcccccaaagaataactcctataccacacagtattttgactgcatctgtcattgcaacagaaggtaagctcattcttgaattcattgaaatatttactgaggcagtgtgatgtgccaggccccatgctaaaccccaaggatatagaaatgaattatcttgcaaacactatgatcttaagagcatattttgtgctttaaaaaaatcagatcttaagcccctgacatgtaatatttagaaggtatataatacagtctctgtatatgaaaagtgttatttatttacaaaatggcaggacatgaaaaacaaggtatcagagtatttgcagtatttttttaaaactggtaagataataacttctcagctcaaacatctatttcccctttccagttcttctggaattgttaatccttaagaaacataatgaacaaaattcactctgccatctaaaatgacaaaagaagtctgttttggggccatataatccttttctgtaggacaaatcttggcagtatatacaatacttcctctcttccaatgtggaagaaaaaaaaaaaccttttgaacccaccagttttcaaagattaactgtactcatgcaaagttttaacctttctctgacacaggaatgttccatatatttccacattctgacaggcaaatgcattctccaattagctactgacctttcatgatgaaaatgggcaataagagtgtatttcatttcagcaaccctgagatacttataaagtcaaagaatattatatacacatgttatggcaagaagcttttacaaattttaaataccttaaaaagcacatgcattttcactgggaagttttaagaatacattctaaatattcaggagtccattaagtggcagaatattttacatctgccccgttcctaaacagtaaaatgaaaatttcattgttctgctttagaaattaaatttgaccactttgaaattaaaggtgcaatattaaccatgtaactgttaaacattttacatttttcagaaaatccttaagcatttattcaaaataaaggtaacaaacatctaccgttttgtgtaaaataactatcagtgacttaatttgacagcgacatttaagtttaccatcagtggtagtttgaactatctacacctatagatagtaattagatacattctgacagttttccaggaagagcaaaccacagacacttagtcatgaactgaaaagccaaagcattagattcttatatcacatgcaaaatgttctcaattgtgagcattttactatgcttagaaagttatttacaatatatggatctctttggtagcatgttctacaggaagaactgcttcatgataacagtttgtgggggccaggtgtggaggttcatgcctgtcattccagcactttgggaggctgaggcaggaggatcacatgaggtaaggagtttgagaccagcctggccaacatggtgaaatcccatctctactaaaaatacaaaaattagccaggcatggtgacacacatctttagtcccagctacgtgtgaggctgaggcaggagaattgcttaagccgaggaggcagaggttgcagtgagccaagatcgcgccactgcactccagcctgggtgacagagtgagacccagtctcaaaaaacaaaaacaaaaacagtttgtgagagaaaatcagagtctgtccttaaactcactggttttcctttgctaatattatggcttctcttttaaaatagccaaaggtttcaaccagtctagctgctgccaccttcttattaaactttaataagctaagctttttaagccacataaaaatttcatcaagcatttgtcaaccttggggaaaacggaaggaggaaaaaaggtcagaacatcactttccaccacagtagcatctggagagacgctttggaaggatcctgcatgcagtcagccgcaaaataaatgctaggaaacaagctcgcagtttgtggcctgcaccagatggtgattatgtttcctccttcatcagccccggccccacactgggtgctaattaaagcactatcttccaatagcaggctcctgggacaaccgtgagcctttgttccaacgtcctcagggtgagctacacccagtccactaacacaggcttgcctgtcaacaacaccactccagagcagctccttctcattttactttcagtgtttcgtatgtcaacatattttaaaaacaaatcttttagttttttttttttttttttttaacaggtatattacatgttataggagggaaaaggaggtgggctgcctggggccctcaagacatgagaaacgggtggtggcttccaagcttccttacttcccccatagattcctgacaatgtgctgcagaagcctccaacctggaacagccaacaggaccagagcagcccaccacccgaccccagaaaaagccgagaaaagcccaactccgctagccaaagtaccaagagaaggatggcctaacatcagaaaacacttgcagtaatattcattctactccagccaggcgccaagggcaaaatcacaatcctcctcccaccctggtctcacagagcccagtgggaataggctctcccagcccggctcctcaggaagaaaagctgtgcccactggtctaattaacacccagagaacatgccacccaacagcagaatattttttctaagcaccaatgaaacactgactaagacaaactacatcctacatcataaaacaaacttcaagaaacagaagagaactgaaatcatagagtatttctctgagcataatggaatcaaaccagaaatcagtaacactaagataatagtaaaatcttggcaggacacagtggctcatgtctgtaatcccagcactttgggaggctgaggtgcacagatcgcttgaggtcaggagttcaagaccagcctgggcaacacagtgaaacctcatctctaccaaaaaatacaagttagccggacacggtggcatgcgcctgtaatcgcagctactcgggaggcagaggtcagagaatcacttgaacccgggaggtggaggttgcagtgagctgagatcgtatcactgcactccagcctgggtgacagagtaagaccctctctcaaaaggaaaaaaaaaaaagtaaaatatctaaactactggaaattcaataacatacttctcagtaatgtatgggtaaaagaagaagtctcaaaagaaaaaaatacataggactgaatgaaaatgaaaatacagcatatcaaaatatgtgaggcatagccttaaagaagtgctgagagagaaatttatagcacttaattcttacattagaaaacaggaaagccttcaaataaactaatcacagacttaaatgtaaaacataatataaaacttccaggaaaaatagtagaaaatctttgggatatctagggataagtaaagaatttttagacttgacaccaaaagcacaattcataaaagaaaaaattaataaaccataaaaattagaaatttttgcttttcaaagaccttgttaagaggttgaacaaaacaaaatacagactgggagataatctctgcaagccacatatttgacgaaggacttgtatctggaatacataaaaagctctcaaaattcaacagtgaaaaacaatctaggtagaaaatgggcaaaagacatgaatggatatttcactgaagaggatatacggatggcaaacaagcacataaaaaatgtctaattagagaaatgcaaactaaaaccacaagagatgttactacacaactcaacaatcacaagagatgaaaacaccaagtgctgtcgagagtgtggaggaactggatcagtcatacatttctagcaggaatgcaaaatggtatggccactttgcaaaatgagtctaacagtttcctacagaactaaatatgcacttatcttaacagcccaaaaacttcactcttggaatttacactgaactcagaaattacacatttatcccagggaaacgaaaactcatgtttacaccaaaacctgtatgtgattgttcacagctgctttatttgtaatagccaaaatctgaaaacatcccagatatccttcaatgagcgagcaattaaacaaacggtggtacatccaaaccatgggatatagttcggccataaaaaggaataaatgactgatacacataacaacttgaaagtatcttggccgggcgcagtggctcacgcctgtaatcccagcactttgggaggctgaggtgggcggatcacaaggtcaggagatcgagaccatcctggctaacacggtgaaaccccatctctactaaaaatacaaaaaattagccaggcacggtggcaggcacctgtagtcccagctactccggaggctgaggcaggagaatggcgtgaacctgggaggcggagcttgcagtaagctgagatccagccgctgcactccagcctcggcgacagtgagactacatctcaaaaaaaaaaaaaaaaaaaaaaaaaaaagtatctcaaggtaattatgctgagtgaggaagtgaagaattccaaactctagaggttacatactatatgattccacctatataacatttttttctttatttttttgaaacagagtctcactctgtcacccaggctggagtgcagtggtacgatcatggctcactgcagcctctgcctcccaagttcaagcaattctcgtgcttcagcctcctgaatggatgggactacaggcgcatggcaccttgcccagctacatttttgtatttttagtggagatggggtttgccatgttggccaggctggtcttgaactcctgacctcaagtgatccacctgccttggcttcccaaagtgccgggattacaggtgtgagccaccgtgcctggcccatgattccacctatttaacattcttgaaatgacaaaactatagagatgagaaacagattcctggtagattagggaagggggaaggagggaggtggctgtggttataaaagagtagcacaagggttccttgtgatggaactggtctgtatcctgaccgtgttgttggtcatgtgaatctacacatgcgataaaactacacagactaaagacagacacacacatacacaaataagtacacattaaactggagaggtggggagatttcagtgtatttaggaagatcagtggattgcatccatgccaatttccaggttatgatactgaccacagttatacatgttgttaccacaaggagaaatgagtgaaggggataagagacatctttgtatttgtattatctcttacaaatgcaagcaaatctacattttcacaaaacgcatataacctgaaactaatcacgaaggaacacaacacgtcggataaactcaaatacaaaataattgatctgtacttttcagaaacgtccatgtcataaaaccaagtaagaagagacaactgaatgcaaaatccaatgagctccaatcaatccaggattttctttgctataaaggtcattattgagccagttttacaaaacccaaaaaaggtctatcaatcagataatgtattatatcaatgttaatttactgattttgataaccacactatggttatgtaagagaatgttcttgtttttataaaatatataacaaagtatttaagggtaacagggcatcatatctcaaacttactctcaaatagttttgttaaggtatatatacaaaggttgagggtggtgttcacacccataatcctgacactttgggaggccaaggtgggcggatcctttgagcccaagagtttgagaccagcctggccaacactgcaagacctggcctgtgcaaaaaaattaaaaaattagccagtcatggtggtgcataccttcagtcctagctactcagaagattgaggccagaggatagcttcagcccaggagctggaggctgcagtgagccatgactgccaccacactccagcctgggtgacagggcaagaccctgtctcttaaaaaaaaaaaagttttttaaattaaaaaagtatagttacatagaaaaggaaatacagtaaaacattaacagctgtagcatctgagtgaagggaatacttgccacttatcttacaaattttttgttaagtctaaaattacaaatataaaaattttcaaaataaaaaaaattaaaagtgcacagggagagcctggcacagaaagcttcaataaactgcagtcagtgtttgggtattttatatgtacttccacagtcagcgtttgggtattttatatctactttcacagtcagcgtttgggtgttttatatctactttcagatgagaaagaagctgagatgctcaagaaactgtccaacagggtgaggggtcatggtgaactggtggtgcaggagggatgtgagctgagacctgttccatgccaaagtctgcgctttttccgctagaaagaggaaggataaaaatcccagtgtgcccatccccacaggaatttgaatgtaccatgttaggagaagacagcgttatacaaaaactggcttcaaatcactctccaagcaagtcacttcttagttttctacacaaaaagtctaggagagggacctaacacctggaacctggcacctagggtgtgtattctgtccacagcacatcaatcaaactcagtcaccaactgagggccaccatctccaggccctcacaccggggaagcacactgcttttcctaggtttattcactcaaccaaaatagatgcgctgtcagtggaactcctaggatgactacatagacagacatcttctattggtcttcccccactcacccttaccccatgtctgagcttagatgacagaggtttttcattgatttcattttctgaatagataatactttcccagttcaaaattcacatgggaaagaatttcacataggaaggggaagagtgaagtctccctaacccccctccaagttcccatttgcagaaacatccaaagttactggtttaaaaatgcaactttgtgctatttctccaaattaacagaattatctagataatactatgatatcaagctatctacctgactagaatattctaggtgatcacaataaatttagtaccttttaggttattttaaatatcccttaaatactcatgtagacgtttccaacatattaaaatgactgagtgagggtaacaacattttttaaaagaaaaaacatgttagtaagatgcatggtcacgacagatgactgtgaactctggctgttacgaaccaatcactgttgagtactgagctcacctggttcctgtcgcgtgcatttgtgtacctgatcttctgaatgaagtagaatatgagccatgctgaagaaataatcatcaaaacaataaaggatattgacacgaagactagagagccacggctgaagttcttcggtggcattcgagttccaacagctattgtcatttgtacagagatgtttttctccagataactcaaaatatccttacccctcaattctgttatcatgacagcaataatatctccagtgcctgcaatataaaataaatatataactcaagtgacatttaaaacttatggaaacatcaaatgtatcaacacgctacttaggtaactactataatgtctggtaatggaaagggtatgcaaactccacttctcaactgaaatgtagatgcagctgggtatgctggcaccaagtaggaacatgtaatttgttgtgtggtacttaagacttaaacagacataaggcatagaacgactgcagtgttaagaaccatattaacttgtctgacaactacatttttaaaaaaagattattaaaccagccaaatgtgacaacagacagcaacataacattatacagcaagagaagtgtatcaacatcatggtagatttacactgtaaaaccttttctattttaaaatgatcttcagaaagtcttaattccttaagaaatggagtaaagtgctgtttttatagcataaattggtacttcttgcactaatctaggaacattcatggagtacccactgtctgtagaactagtgccaggaacaaaaacaagtacaggataccaagctttctaatctcactgagacaggggacacacagctggtaacagagctacaaagtgccaaatggtgccaccttttattagtgacatctgaaactaacttgggtcttatgtccagacttgagtggagttgaggctccttgctagtttaccccagaactcttctggaaatcaaacgttccagagacaggtccaggcttcaacattctggaccagtttggcatcgaaatacctccagcctctaacagttgtccagaggtctgcccacaagcacaggctatgcaagttaattacgaggacagtcttaagttgccttatagttacctagacctttcccctacataatttccagaagtagtaacagtgaaggaattgaatacctcttcctatggacagcaggaaactgctatccctttcctcctccacaaaggaaataacttcccactgtcttttaaggaaacagagaaacttctatcaatctatcagcgattgtcctttcataagctgaagctgccggtggcaacatgtagcttctacatttgccttctccagagagcccctgagagagactaggggtcattagaagggaaataaatattttattttgggaaagagaaaattataaccacttatttgaatttgaataaggtttgtacatatcaatgtaaaccaacaaaacaatcaagcagaagtccccaaaacttgtccttttcaatccttcttcaatgaataacacattgaaatatttggttttacatgtttcatttaccatatttagctaaaagaaccatctttgtgttacatgcagtcacagaagactacacgcaactgaaaagaaattcaacagggctgggcgtggtggctcatgcctataatcccagcactttgggaagccagggcaggtggattgcttgagctcaggagtccaagaccagcctgggcaacatggtgaaaccctgtctctcacaaaaacaggaacattagctaggcatggtggcacatgtctgtggtcccagatactcaggaggctgaggtgggaggatcactggagtccaggaagttgaggctgcagtgagctgagatcacgccactgcacgccagcctgggtgacagagcaagaccctcaaaaaaaagaagagaaatacaacagtaaaaggagttttatggaaaatgtaacccaatggaacatatacctttttactaccttactcaaaattgttacagccactttattagaacagcagtttaccagaataccgattaaaaatctacaaaaaactataaaattaaagcaagcaataaacatctaattaatatctaattacctttctgaaataagagttgtgatcagtaaattagagacaatcacaaaataatgctaaaccgctttaaatttccctttagaaatctcttaaaatgttgttcaacgggccatgatctgtggtataagataccaggtatggctataaagtaactgagacggatcccacaaacgacatatgacaatcagtctcattgctttataatcacaccaggtacaaacggttttagaaatcagttgaggctccctcttgaagactcaagctggaaaaggagtagggaaaggagtagggaaaggagtagggaaaggagtaggaaaggagtagggaaaggagtaggaaaggagtagggaaaggagtaggaaaggagtaggggaaggagtagggaaggagtagggaaaggagtagggaaaggagtagggaaaggagtagggaaaggagtagggaaaggagtagggaaaggagtagggaaaggagtaggaaaggagtaggaaaggagtagggaaaggagtaggaaaggagtagggaaaggagtagggaaaggagtaggaaaggagtaggaaaaggagtaggaaaggagtagggaaaggagtagggaaaggaaagctgaacaggtagccaaggaaaccaatccatgtgattctattcaaagaacactaaataagaacaccaactaatttcaacgggaaagctgtttgggaaaagaagtgtgtaattatttcaaccatccattcaacaatatttattgagcacatactatgatcaggctcctttcacctcttaaagagagtagaaaattacctgctcttgatgcaaaaatccacacgccctcaggagcaaagggggaaccttttggactaggaagagaagccgctcgcggtggcgtcattacaccagcacagagaagagccgggcagaggagcccgaccctgccgatcgggcaggaggacagcagaacgaaagcccgccaccaacttgcaaaggactggagttttaggtcttaaatcttttacagaatctggcgaaagttatataggagtcccctcctaggagaaagggccttctccccatactccacccctaaagcctgatagggctcaaagaccctgacctaaagctgcctcagacacttgacttttaaggatctgaggagctctggcccagtttcacgccaaaggaaatgtaggcttcacaataaagggccggtcagaggaggcagtgactgaaaagagtgaagaataattagactgtaacgctgtaaatatcaaagcacatttgggacatgccccaccactcccatgtcccaggccctgggcaaacactgctagtaagtcacggatgcggccacgctcccacgcacttccacgtctggccgccagtactaactgtcagagatggcaatccagtgaaagcccatctgtgatccctgcttccaactattttcttgagaaacttcccccactgttattctttaacaggaacttctgtttccacactgcttgagtctggctactttaataaacaattctattctttccactttcatcctgagaattttcaaacccatagagcagttccaatactgtgagaacactcatggaccttttatttagatttgtcaacattttgtcctttctatatgtatttatttttgctgaaccaattaagagtaaactgcaaacacatgacattttattcttaaatacttccacggtccctcctaagaacaaggctagctacgtggccacaattcatttacttatcctcaagaaatttaaccctgtgttctttaatagatggtccattttcaggtatctgtggtgatgactttaatagctgtttaacttgtttagttttgtgtccaggattcaatcggggctgtcggcatcatgcttagctgtcatgtctcattagtctcctttgatctagaatagttcctcagtcacttccggtccattcatcacaacactgacctttttaaagagtccaatccagatgttctgaccatgcccctcaatctggatttgactgtttcctaatgattagatctccaaattaaatatttctagtaagaataccacaaggtgatggcgtgtccctcctcagctcgtcacttcaggaagtgcaggccgggttgtacctttatttttggtggcaaattttatgacttggttattttggtatctgccaggtttcctcactgtaaataaatgttttcctcttaattaataagcaatctgtgggctgatacttccagattgtgtgactagccagttccccaaaaacctttcactcaatgctctcagcatccactggtgtttgcctgaatctgttacgacaatggtatttgtaaaattctaattccctaatgctgtgatttcttctacattttgtaaactgattctataatcaaaggcattaacaacactttctacttatctttgtttcccattaaaaaaacagaaatgctgggtgggcagtttttcggaaaagagccccccatccccatcaattctattttttaatgaggaaaaaaagtgggaaaatatgataatactgctataatcctgactacaaaatcagttttgagaggccaacagaaggaacctcagaattaagctcctttgggctccggaatcggagggtctaggttcaaatcccagcatggtactttaacctctttgaacttcagtttcttctttcaaaaaatgacaaactacctgcaggcttcacagcagatgttcagtaactgctgcagcgtaatgagctgtattagtctgttctcacactgttacaaataaatacctgagactgggtaattgagaaagaagaggttcaggctgggcgtggtggttcacacctgtaatctcagcactttgggagatcaaggcgatggatcacctgaggtcaggagtttgagaccagcctagccaatatggcgaaaccccatctctactaaaaatacaaaaattagctgggtgtggtggcaggcgcctgtaatcccagctactcgggaggctgaggcagaagaattgcttgaacaagggtggtggaggtttcagtgagccgagactgtgccactgcactccagcctgggaaacagagtgagactccatctcaaaaaaaaaaaaaagaaaagaaaagaaaaaaagaaaagaggtttaattgacacacagttccacatggctagggaagcctcaggaaacttacaatcatggcagaaggcacctcttcacagggcagcaggagagagaacgagtgcaagttggggaaatgtcagatgcttataaaaccatcagatctcatgagactcactcactagccatgattcaatgacctccgcctggtcccacccttgacatgtggggattatagggattgcaattcaaggtgagatttgggtggggacacagagccaaaccatatgatgagctaatcctacttgtattattactcacagaaagcaaaagaaaatgttgtgggaagaaaatcaaaaggcctctaaccacagatttttggatgcccattctctcttcgccccctgcccactgctcagaaaatgcccagggatctgctgaccaacacagtcctgccagctacaaaagaatttatgctttagtttagaaagtgagtctacccagctgggaagagtctgatctatgccctcaccctcttggcttccctccactcctcctgggagtaaaccccggggcaagcccagtgtagctgagcagctgataaaggaagatccaggaagagaacaaatgagctgtctgaggcaccaggctgcaagaggagagaggtggctttaccataagcatttttactattggttactcacagtggcattagttattcctatataacctattatacgtaaagcagaacaccatatactttaagtgaaaaagattaaaatcactttgaggccgggcggggtggctcacgcctgtaatcccagcactttgggaggctgaggcaggtggatcaccaggccagaagatcaaaaccatcctgactaacacggtgaaaccccatctctactaaaaatacaaaaaattagccgggcgtggtggcgggcacctgtagtcccagctactcgggaggctgaggcaggagaatggcatgaacccgggaggcggagcttgcagtgagccgagatcacgccactgcactccagcctgggcgacagagcgagactctgtctcaaaaaaaaaaaaaaaaatcactttgaagttccagaaggactgctgctgaggcaacagctaggtgtattcagggtcaagctgcacatggggcagagccctggctgcctgtgtctcagggagactgctggctcctgatcccaagacttctcatctcactccactgacttaatgaaagtccttctcaaatgttcatccacaactttcagttcttcaaacccaatcttcattcttctcttcactgatcccttaaagaactcaagggggaaaaacagatacattctacattcttttaggaaatgaatatagcaataattctgacagatggaggttatatcaattatagatttcctgctgagacttgtcagtagttttcctaaaatatagacctgctgtcactctgctttcaaaagcctttgatgtatcccttctgtcagaaaaataaagtgcaaactctttcactggacactcaagcactggggagccacatggccctgagggtaactgagtcacggaacggtgaacactctcggacccagtgaaactgttgggcaaagtgactggaatagtggttcatgcaatctgggcaggacggagaggtgaagccaggagggaaactgggagaaaactaagaaagggtccagggaactggaagcttcaacaaaactaaatgacaggaagagagggggagaaagggaagaggcactggtcaggacacaggacacaggagtttgcaactcgagatgtaacaattctgggagatgatgaggcccagggagcagctatgggaccaggctcctggagaagtggaatgactgacgggcctgtggaaggaattttcggttaggtgttcactttccaggtggattctcaagttgcccaggatggtggcaggaccgctgatgaacggggagcagtgacaggcggggaagcacgtgactacggagaggaagaacgcggtctgctgcacaaaactgaaagtgaagtctccccacgtggaagtgactggtgtggacgtgctgtacgccaccaccacaggatccctcagcacccacagacgcacagcaaagaccaacctgtaattttgcaaatgcttgaacctgaacctcctgccatgcgtctgctgggaagccgaatgtgtaagccactgagtggtagtcactcactgataattcctgaggacagtgggctacagcttgtcaccaaaagccaagggtcttctcttctttcttccttgaacaggaagttcttcaatcacatacaagtagggccaaggggccacagtacagcacttgaatgtcagcttttcttcttatgctatctcttgactgtatgtcaagagaaagaaaagggggcaggagcaagcacctgcccagaacagaaagctttcttccttcacacacagaggcagaaggggggtgggcactgaagaagacaagccaccaatcagtggagagccacagactctcagtgaagaatttccaggggttgccaactttcaacacaacacaggaactcccacaaattactgatcctctcaactgagtagttctgtccacaggtcacctggatttaagtcttaggtcttccttccttaaaatctaattttttttttcttttgagacggagtctcactctgtcgccaggctggagtgcagtggcgcaatctctgcctcgcgggttcaactgattctactgcctcagccttccaagtagctgcaatgtcagacacgtaccaccaaacccggctcatttttttgtatttttagtagagacggggattcaccatgttggccaaaatggtctcaatcacctgataggatggtcttgatcacctgatctcatgatccgcctgcctcggcctcccaaagtgctgggattacaggcgtgagccactgcgcctggccaaaatctaaatttctaaacatctgtttgtggctcgtggttctctcctccggaaaaacaccactgaataaacctgtttttcatttattgatgtataaaataccatcaaccacaaggtacatcattatgtatcatgaagaaaaaaatctgtcaagcaactctaagatgtcatggaatacaagaaacattcccactttaagttgagcatcccagaaccaatgagaattcttcaacataacaattcttaaaatgtgcaaagacagcctccctgggtccccacttcagtcttttttccatactaattctagagtcccaaatcattcatttaaaaataataataattattattatttaaagaatctaaaacttacagaaaaattcgaaatatcatataaaaacttttaaaacctagaaccattcaagagtaagttcctggcatgatgcctcatcacccccgaatatgtggtattttcctacaaacaaaatttataaacataatacaacccccaaataaggagcttaacactgatgtgtcactgccatccaatcccgaagtccatccaagcttctgcgactttcccaataacgtcctttacagcagcccaggtccgagtcacatgctacactcagtcgtcacgtcatagccatctccgtcagtctgcaactgtctctcggtctttcttggtgtttgtgaccttggcactttcgaagactacattcggcccagttgatctgtcgaaggtatttccctgtggctagattcaggtcaggtgccgctggcagtaacaacacggaggtgaggctgcgctcttttcagtgtacaccaccaggcggccgagagcttttttttatttgccattactagtaaagttcactttgataatttggtaaaggtgatgtcctccaggcatgtgcactgtgaagttcctcttttcccctttgtaattagtatgtattctgtggggaggtgctttgaggctaggtaaatattccatcctcatgaaaccttcagtttacttttactttttaaatcagtacagattcatggttcctattttattcaatcagttgaaacagctactaacgttattcattttgatgctgaaattctaaattatgcttcataagaccctgtgtacagagctttcctaacttattcttttctggacatcagttttccagtgtcttcacttacgtaaatgtgaactacaaatacaatgctttcagtatcaagagtagcatgacactaacatctccttacatctgattatggccacagggatacagcctaagattccaatgtaatgtttggaagccacggcacacatcaatgtacacggagctcacgtgactgaaggttcccaggcattctccttctccatttgaactgttacttaagccacgtctccacttaagccacgtctccacaaacctttgctatactagttttaaacaacccatttgcaggttgacttaaggaatactcctcttatctatgtttcaagatttcacctccctagttttgtgcctctttcaagtaagatgcttacatttatgctttcttacaagcttttgataaaagaattttaaatgggtgggaaaagaaacattaagtagagagttcggcattctaaccaagggagattcaggttgggaggaaagtgggctacagaagctttcacgccaagcaccagaactctaaaagaccttcaaatctgttatttacattaaagaatttataaatctgagagttcagtgagctgaataattaagtaaatagatgtaggatggcaagagccaggtttttcatttaggagtgggagtttagtgataagaaaggagagagagctacaatgatccatgtggcaatatattagaattggagacataagtatgaactcattgttagcttaatatcaatgcagatgattacagatagaaatatttatagatatgtagatatgcaggagttaggatacacgcatgtatttccttgttctgtcagctgagaaggcccagaagcaacaggcatctcggcagtaacatcacatctaatgcccggatcttggtttttaataccactctccaataaacagaaaccagggttccttggagaaatggctgattctaggactgatgtgtcattactgataaagttcaataatgctcaaggggcagaaaatatatgcaaaaggagcctggcacatcttacagcaccagaaagtaagaaagtgctcaaaaactaaactaaaccaaaacaaaaaaacaaaaatccaacacccacaacaatggaggcatgtcaaaggacacaggagccaacataaagaatccccagtggccaaagctaggataatttgagtaacagagttgtactgtactataatccagagtgtaaaataaatacccatgggtccataatgatataaataaatgactgaataaattaataaatggagcagaggcaaatcacccatgcagaaaaattccaaataattatgtagatactctaccctaagggagatggagcataaatccccacttattaagtgtgggctgtgcacagtggtgtcaaaagttatcatatggcagggggaaaagagttaacttcacagtggagaacctgacagacactacctcagccaggtgaccaaagtcaacatcactggtgatacttcacactgatagcacataaacttggtatgacaggatgcatgctaatggtactttacaaatccctgtggtcttcctcccaaaaacccatatccctagcctaattataagaaaactatcaaacatgtcccagttgaaggacattctacaacatgctgggccagcagtcctcaaagctgtcaaggtcatcaaaaacaaggaaagtctaaaaaagtatcacagccaagagaaaactaatggatcatgatgactaaatgtaatgtggtgtcctgggtgggatcctagaacagaaaaaaaactaggtgaaaactaaggaaatatgaataaagtaatagactttggttaataattatgtaccaacattagttccctgtggtacaacaaattaacatgtcacatggtacctaacaggaaactgggtgcagggtttgcagacattctttgtactatcttcccaatttttccataaatgtaaaacagttctaaaaagtaaagtttttttttaaagactcattatataaaagggaacaacttctcatcagaaaaaaacgtaagccagaaaacaacaaacaacacctttgaagtgctgaaaggaaaattctgtcaacacaaaaatttatacctgtctttgaaaaatgatggccaaaaaaagacactttcggataaataaatgttgagagaattcatcatcaggagatctgtgctgcatgaaatgatttaaaaaaagggaaatgacaccaaacggaaacttggaaattcagaaagaaataaagaacagcagaactgttagtatgtaggcaaacataaaagcctaccgttttttcatgagttttgccattcccactcccttcacgaatgaggggtcccttttcattcttcctctaaacgctcctcaaacttaagcatctgacagtgggtctcaacaggggcagtaaagctctcctgggggtgtctggaagccctgtgggaggggtctccatgctgtcgcaggcgcagaggtgtgccaccagcacttagcaggtccacacctgggaggtgaaacactctgtaatacaaaagacagacctgcagagcaaaaggactgtcccaaaatacccctgccttgtcctccacttccatcctgaatcgagaagcactgtaagcatcaatgcggggtagagatcctcacccagacctctaacacctatagcctaaggctgcatgatcctccttagcagctgtgccagtgagaccaactcttgagatcctaactccaaggtcaggtccatcatcatatgaacttctatcagttaagaacatcctccgtcctggaacctaggaaactgatttctaaaacagtatttcaaacccatgtagatcctttatatgattttaccttcctcctcttctgctgccagtgaggaaagagaagcacagaaaagacaaaaaagtaaatcaagtgacaacttcaaacaacccacttgggacacggagactgcaaggaaggctagaggacagtctcatgtatctgctggtgaaggcactctccagttccacttcagatttaaagaaaaaagaaaattaagagcttatggaagttttaaaatggaaccattgcatttattttattaaaggctatttttatttttttaaagctactgcttaagtgtttcagttttagattttgataattatgaattttttttaaaaaaatgtatgaaccagatggaagatacagtagaagcatgtgcaaactcaggcaaaaatataaatgcaatttaaacccttacttcctgccacagcagtacacttcaattccaagctccatcttttctgaggtagttaaatccatattcaattagaagctaaaaaactttaaacggtaaaacaatagtatacttatattactcattttcttgataggcatttagaataaagaaaatagatttacgttaagtggcccaaattactgatacgtaaaggtattctacaatgtgtttgtgatttctttttacttgttttcataaagtattttttgtattcacagtgaattttctatattttacaaagtgtgacatttttctattcaatgctagataataaatatagagctaaatacgtttttaagagaatatgatggaaaaaaggtgaagagccattcaactaattttgttcaaccatccaaaaaaaaaaaagaaaaacccagtaagaagcatctgatattgctgattgataaaaagattaaaaagcaacattattatttggttacatgtttatctaaattacctcatcttcctttcaacaatggaaagaatgtccacaaaattcttacagacatacagataaaactacagctaattctatcagacagtgatttaacacaacttaagatgattaaacaataacagtaaagtctatataaatctttaaaaaccaggaaaataaatccataattttcagacaagtatgcattattgtaaactatccaagaacccataacgtccccttcatactaccacagatccgctaactacatgacaaagaactcactctgctaaccagaggtaacaagtgaaaccacacaatgagtagcctttcctgtcaatgacgtcatggacagggcactggaacagacgtccttcagtcaccaggtgaagggcatgctttagaataaacaggaccaagctcttggttgacaaggcaagaaaacaaaatacttacacttgtattggtacatacagtatatagggaatacttatattccaatgtggaattttaaaattaggtataaaacatagccttaaatgaaaagaaagcttaacaaccaaactaaataacttaataaaatcatttcagagcaagccatatttattttgttcagggcattctgctgaccactgcagagaaccgaaagacatgacacaaactttaactgcatgaaaccctgggcttttccttactgccagtccagtatgcaaagaatgaccacatgaaaggaaaaggacaatactgtcatggaggcacagagagggctctgaagactgcaggagccttggactgtaaactcagtaagggcaatgatccgggtttctctccttttgacttttaccagttcttactagttcacatcaaaatgcacagcacagagagctgccaaaccactgcttctgccctatgatgaagggagggcaaaactggcacaggagcaggacggggtgaaagcacgggtctctgggtccatcccttgagactgtctggggtggggtggggggaggatcctggaatcagtgtctttccaattagcttatgtgattctgacaccagggttcttgaatttctgtagacagcactgccctacagggtgagaagggttatctgtggaggaagggaactgagtaacacattgatgagcctggaaagcaaggagttgccagtgtataatgaccttctctgagtataagcagaaacagaaaggcagagagttatggcatacgaaagtcagaagaggatcataattctggagatttaccgtgaatgcctggctgaaaagacgagactcagagaagcttctgatagtgtgtgtgttctctgtgctacttaacctgcacttctcaccccattcttaggacaggctttcagctagtgcagctcgctggactgaaacaggacctttctataaccactgtccctctcatcctgagcacccactccattaagaaccctagcagccaggacgcgtgccttcctgctccactcttcctctccacacgtcacctgtggggcttctgttgccaccactggttccctccacactcccacccaatgcttcctgctggttttccaggtcccaatcagatggcagagaagaagctaggaaccctgctagctgcttgagacagctgccatcattcactggggctccggctgcccggctctgtggctgctgccggtgtgagactgcacaccccagtgcagcgctggaaagcacagcttaggccgcatcaacctcatcgagaccacgcctcccttctttcaaatcctcccgtgttactaagcgacagtccctgctttaggcacacttctgctctgaattgaatttactattaccctatccaccatgttgagctgtgctgtttttttcctgtacttaaaattacttttgttttgcttttccccacctcagatccttcacttacaaggggcctttggcctagaatactcttctcaactcctcaactccgactcggatgctgtttcctcaaggcattcctctctgaccccttggacctaagtcacttcccacagtcatgacttcgtactcaatgttcatcttctctgcttgttataactccatggaaagaggcaccatgtgtgtcttgtttatgcttggagctctaacaagagttcaaaaaacaattagcatatagaatccaactccctctctctacttgcagttacctgattttctccatttccttccgactccctctcctctcaccagatttttgattcatgtggttcgtctactgagaggattttctctttctggtcgaatcctaagtaatcctcattatgcagggcctggcacaatgaatgcctcctacatgaagtcttccagacctgggtcagaacccctttcgtaataacactacagctgatcccgctacgtaggtatgcaaagttatgcactgagtggttccccaattacttcaggcgtgtgtgtttccctaagggaggaagtgttcccggcaaacactcactcgtacatccttctacaaatccctacagtgtccatcacagaatgcctggcatatagcaggtataaatcgatacctgttgattaactatttttttgtactagatatattttaaacaattaagttatatggaaaaacaccaggagaatgaagaaaaagtatacttagaaatttttttaaagtgccaatctcaaaatgaaagaaaaattgatttcataattttataaaagctactgcttattccaggcataagaaaaattgtacaactgttatacattacagtttgttagctcaataaattttgcaatcaccctcttttaggtagacgaggatgccagtttaaggactccgttacccgaaatcacaaagctgataatcaacttggtctaagattcaaatcccaatcttgtgactgtttgacatttatgccaaattcttttctctattttagaggtactatatcatccaactaaaacatttttttcttctataactaaaaatgattgagaatgtcataaaaaattaaaatctgtgataaattattaaatatgattttggaagatgaacaaccagaagaaactgagacagctatggaaacagtgatctataaattggatgaagtatttcaataatgtttttctaaggtgatgaatatgtgacaggcagcatctccactgagaacagcatgaaaccaagaatttattctgtctgaaaaacaggagacaatgggcaacagcctagaagttcaaagggaaaacagaaagtgctcaaagaaaaaggataaaagctctaaccaagaaccaagaatcttttcacacactaagatgagtagtttgcagataattcacaaattcccaaacaaaatggcatttttactaatcttaaaaataaaagcaatattatattgcagaatttttttaaacaaatgggtttacttccattgcttttgtgaacaatacagccatgtagtccaacgtagctgggactacaggtgagtgctaccacgcccagctcatttttgtatttttagtagagatggggttttgttatgtctagaacaggctgacctagaactcctggactcaagctacaccctgcttaggcctcctaaagtgctgagattacaggtgtgggtcaccatgcctggccactatccacctcttttttttttttttgagacaaggtcttgctttgttgcctaggctagagcgcagtggcacaatctcagctcactgaaacctctgcctcctgggttcaaggattctcctgtctcagcctcccaagtagctgggactataggtgtgtaccaccacgcccggctaatttttgtatttttggtagagatgaggtttcatcatgttggccaggctggtcttgaacttctgacctcaggtgatccgcctacctcggcctcctgaagcgttgggattacaggcgtgatccacacccagccactgtccactttttaataccattctatccttatatgctcttttaatttctatcttgaatactcaaaatacaaataaaagtaaaaaaagatcacctcataaatacttgctttgtctctccaagtaagaatacttgaggacatacaactgaaacctgtttcagtttaagaatcttgtatttgtgttgcttttgaactttagtttgcattatactttttaaaaacagccttaatgaggtataatttacatcctacaagactcatctttgtaagtgtacaatgagtaaaattacagggatgtgcaaccatcatcacatccagttttgggtcatttccatcaccccccagaaaattcactcacgccgtttttaaaaatacatgttccctttttggtgttttatttttgttttttaaaagatgggggttttgctgtgttgcccaggcttagacttgacctcctggggtcaagggtgctcctgcctcagtctccgatgtagctgggattactgatgcttgccaacatgccagctccctcatgctcactgcaattaatcttcatgcccagctctaccctacacagccactaatgtgctttctgtctctgtatgtttgactttcttagacatttcatataaatggaatcatataatagtagccttttgtgtctggcttctttcgtttagcataatgcttttgaggtttatccatgtgtcaagagttaattccatttacagctgagaataccaccagtgtgaactgtccagatccacttacaggcaaattttcttcctccttggccatccctgaaataacaagaccaaccgtcctcttcctcctaccccctaagcctactcaatgggaagaagataaggatgaaaaccattatggtgatgtgaccaacttccacttaataaacagtaaatatattttctcttccttatgatttccttaataacattttcttatataacagcatataacatatataacaaagtatgtattaatcgactatgttatcagtgaggcttttggtcaacagcaagctattagtaattaaatttagggctgggcacggtggctcacgcctgtactcctagcactttgggaggctgaggtgggtggatcacctgaggtcaggggtttgagaccagcccggccagtatggcgaaaccccaactctagtgaaaatacaaaaattagctgggcatggtggcacgcacctgtaatcccagctactcgggaagctgaggcaggagaattgcttgaacccaggaggcggaggttgcagtgaaccaagatcacaccactgcactccagcctgggtgacagagttgagactccatctcaaaaaaaaaagttaaatttggggggaggcaaaagttatacgtagctttttgactgtgtgggggtcagtgtccctccctaaccttctcactgttcaagggccaactgtaattgctaaactatattcaattttatggacatataacttgtttgtttattcaccagttgatgaacaactgcgttgtctctacttttctggccataataaacaatgctgctatgagcatttgtgtgtaagtctttgtgtggacatttcattgttttcatttctcttagatatctgggagtgggactgctgggtcatatggtatttttatgttcaatgtttaaataaattgccaaactattttccaaactggttgtaccatttcacatttctactcgcaatacataaggattctagtttatccacatcctcaacaaaacttggtactgtatgactttttaattatgatcattctagaggatgtgaaatagtattgttttggttgcactgttgttttgattgcatttgtctaatgatcaataaaatgtctaattattaaaccttttgcccgttgtaaaactaggttgtttatcttgttgatttataagagttctttatatattctggatgcaagtcctatatcagatgtatgattgaaaaatattttgtttgtagcttatcttttcattgtttttcaatggtttcttttcaatgacaaaggtttttaattttgataaaatctaattttttttataaacagtgtttttggagttataggcaagaacttcttgttcaaaatcacagactatcttctaaaagtttacagttttacctcttacattttgtctaatatccaagtgaagtcatttttatatagtctaaatcccttcctccctccctcccttctttccttcttccttgaaacaatcttgctctgtggctcaccttagagtgcagtggtgccatcatggctcactgcagcctcaacctcctgggctcaagtgattctaccactttagcctcccaaagtgctgtaattacagcatgagccacgaggcccggcttctttttttaaatttgcatgtggataacaattgtttcagcactggttgttgaaagactgtccttccctcactgaatgatcgtggcacttttgttgaaaatcaattgaccgtaaagatatttatttctagattctcaatttggatccactgatctatatgcctgtccttctaccaataccacaatgccttgattactaaagttgtgaaacggagtgtgtaagtcctctaatgctgtgctttttccaaaatgctttggctattctaggtactttgcatttccatataattttaggatcggcttatcaatttctacaaaacacatgctgtgatttgcataggtacataccacaaggaatttatatatccattttaagataactgccaccctgacaatactgaacaatggaatcaaaggatatgaaaggtctctccatttatccagattttttttttttttgagacagggtctcgctctgttgcccggcgagaatgcagcagcaccatctgggctcaccacaacctctgccttctgggctcaaatgatcctcccacttcagcctcccgagtagctgggaccacaggtgaatactgctacacccggctactttttttattttttatttttttgtagagacagggtccccctatgttgcccaggctggttttaaactcctgggctcaagtgatcctccctccttggcctcccaaagtgttgggattacaggtgtgtgctaccacacttggctgagattttcttgaatttctctcagtaatgtttgtaggttcaatgtgcaattcttacatttctttttaacaagtttttgttgttaggctattgagaatgaactcttcttaatttcatttttggaacgttcatagctagcatatagaaatacaatggcttttgggcaggcccagtggctcatgcctgtaatcgcaacactttggaaggctgaggtgggcaggtcacttgaggtcaggagttcgagaccagcccggccaacatggtgaaaccatggtggtgtgcgcctataatcccagctgctcgggagtctgaggcaggagaatcactttcacttgaacccaggaggcagagattgcagtgagccaaggtcgtaccactgcactccagcctgggcaacagagcgagactctgcctttaaaaaaaaaaaagagagagagagagaaatacaattggtttttgtataatgactttgtattctacattctttcaagacttgtttattacatctagtggtttttaataaattctatctgattttctacatacacaacctatgaataatgaattttatttctgcctttcccaactggatgtcttttatttctttcttccctgtgtacaatggttaaaaccacaagaaaaatgttgagtaagtataatgttgaatacaactaatgagagtggacatccttggcttgttcctgatcttagggagaaagcagttagtctttcactatcaaatatgatgctaactgtggcttttccacagatgccctttatcaggctgaggatatttcctaatgtgttaaatgcttttttttttttaaatcatgatgggtactgagattttgtcaaatgctttttctgcacctaccgaaaatggttagttggctttttcatttattctattgattttcagatgtaaaaaaaaaaaccatatatcccattcctggggtaatgaatctaatccattttatatattactagattctatttgctaataattttaaaagaatttttgtgcctacattcgtaagggatattggtatatagtttccatggatctctttgtttggctttgatatgaaggtaaaaaccagctccacagaataagttgagaaatgttctctattttctgaaagtttgtgaaggattagtattattttttctttaaatatttgatagactgcaccagcgaatttcatgggaagatatttaatccccaattcaatttcttacttattatagctactcagatatgctattttttcttgagtcaattctgacaatctgtatatttttaggaatttgttcatctaaggtgtctaatttgtcagtatacagaaaaaagtaaacatagcaggtttgaactactatccgtcgaaaggcctgcttacaatcttggcccttgggtggcatctgggaacatgggtttggggaggattcccaccattacctaataagagtgactcactgtgagtgtgactatgtggtgagtcctgtgagtcctcctagtgagtcactgaacctgtggatggtcatggggaccccagacatagttaccataaagttcttcacaatattcctttataatcctttaagtttctgtagagtcagtagtgatgtccttttttagttgtgattttggtaaactgtcttcttttttattgttggtcagtctatctaaaggtttgtcaattttattgatagttccaaagaaccaacttttgggtttcgttgactttctctatgacttttctgtctcacttatttctcctctaatctttattaactcctttgttctactggtttggggttttgtttgttcctcttttttatagtttccaaaggcaaaagtatctttgtttactgacctaggtatttaaagctattaactttcatctaagtactgctttcccagcatcctacaaattcggatgtgttttcattttcgtttggttccaaatgtttttaaaatttccttttgaattttttattggacccgtgtgttatttagatgtgtgctgcttaatttcaaagacttgggaatttcccagcttttctttagttgtggttgaagaatacactttgtacaatttcagtctttgaaaatatattcagacttgatttacagccaaccatatggtctatccgagagaatgctccatgtgtgcctgaaatgaatgtgtattctagtcagtatgtagagtgtgctacatatgttggctaggtcaagttggttaatagtgttggtcaaggtttctatatgcttgctaattttctatctagctattctatcaattactaagagtagggtgttaaaatctccaactataatgattgaaatgtctgtttctccttcccattctgtcagtttttgctttgtgtatcttaggtctctgatatatgttggtgtgtctgacagtgtcccacaggcatctgaggctctgttcattttccttcaattgattcttccctctactattttgaatctgctgttgaaggcctctagtgaattttccatttccaaaattgtactctccaattccagcatgtctgtctggctcggctcttttatagaatttttatgttctttactgagaatctctatttgttgactcattgctgccattcattattgtcatactttatttctttaatatagtttcctttagtctttggacatatttatattaattgctttgaagtttgtctctgctaaatccattatctgggaacacttatagacagtttctatagacttttgttttcctgaatatgagtcaaacatctctatattttgcatgtcttataatctgttgaaaagtgaacattttagacagtatattgtagcaactctggattctgatattttcccccttaaagttggtggtgttgccttgtctgcttgttcacttttgtttagtaacaggctgggttaaacacatgaaatctattttcactgtgatgtgcaaccatgatgtttccactcagtttcttcttgttctatgttctttttcctccttctttttaataagactggtttcctaggaactgcccagtcactggctctcctctgctagcccacctctgtgaagtcacttccacagacagtgacactggactctggtgtcattcaccactgcaaacagaaactgccagtccttgcagcctgctccacactggcagaaactccacacagcatagcttggggagtttgggaagcagcaccctgctaaaccacaaatttccactgctcttacctgaagtctagaagtttttcaaagcataaatgtgtctcagattattgtcccttcattaatatccagaacactgaaatggctgtttcgtcaattttgtccagttttatagttgcttttttggaagaggatttgctgatctcttcacttcgtcttaaccggaagtgctacccctacttctctgttatttttaatcctaccttataaatatttcacaaagtttttctctaatgattattttgaaatacttcaaataagcaaaaattacaaagaatataatgtctgtctacccccacactcagcttaagaaataaaacattatagatacatttacttctctctgatcctatttcctttcttccctctccagagacaaccattaccctaaattttgtatttcttaatcttatgtatgtttttcttagtttatacctatatacatgctcttaaatgacttaattaaaaagttttgcattttaattgtattcaaatgatatccaactataaatattcttctataacttactgtgtttgggagacttattcatgtaaatacatgtagctttaatccactgacagttaactgctgcataaacgtgccacaattaatccagtctcctatgacagatgcaggtgttttcaataatctgctgttacaatgctgtaacactctcctacgtgtcgtccatgcacatgtgcgagagtaacaagggtggaaagaaggacagagagaggctatcagtgcttgtgtgagtatatgaaatctgcccgctggctctcacacggttggaggtgaaatgtgagagaagggcaaacagcagttgtgctccaccgtaggcatccatggccctccacagagtctagatttagagtcacaagaggccttacagaaggcctctatcctccaacccgcactcaggaggcagcttggcctatgtcacagagcacgtcagtggaaaacctgggactaaaactaggtttcccttcttcactgccttctttctcaaatcaagatctgtaggccagcaacatcagtgtcacctagaaacttgttaataatacaggctcttgggtcatattccagacttactgaatcagaatttgcattttaacaagattctgagctacacattcaagttttaaagatggaaaagtactctagagtatgtatctggagtgaaattaatgatcgcagtgtgcagattcttttaactataccacataatgccaaatttctctccaaagtattgttccaatttacccaatttactttcccacattatgttttctaactgtctatgaatctaatcacaacataaagccgtttcctattgctcttatgcacacctccactgtttgccttaccttccacttcctaaatatatcctcaaactatacccctgcatttctttaatttgtgctgttatacactcatctgtgataaaaagagttacatggtcaaataggtttgggaaacactagattactcaaaataaaacagggttttttgtttagttttgtgtttgtctttgagacagcttctaactctgttgtccaggacgcagtgcagtggtgtgatcacggctcactgtagtctcaacttccccaggttcaggaaatcctctcacccaagccgcccaagcagctgggactacaggaatgcaccatcacacctgctaatttttgtatttttttgtagagatggggtctccctatgttgcccaggctggtctcgaactcctgggctcaagcaatcctcctaccttggcttccccaggctcagggatccatgatcgtaccaccacactgcatcctgtgcaacagagttagaccctgtctcggggagggggaaaaaaaaaaagcctgttttgtttttttttttattttgattaacctagtatttcccaaagtgcttggattataggattacaggtgtgagccactgcgaccagccaaaacaggttctttaagacttctcagagacccaaaaatgttaataagtcctaggagcccctaaatgtggactacatttcaagcattttctgaaacttactgtttccccatgagtcctctaggaacatatctaaacaaactaacatttcaaggaacacagctgggaaatgctgcattgatacaggcttcccatcctttttaaatacaagtaatttaatttttttttaagatttcaattccctcataattcccagatcatctcatacttttattaaaagactctcattctagctacttctctgtggttttgtgtaagtaaaacaacattaataagaaagaaaaatacattttgctcagttgaatttctccctattcatttttcttcatgttttaagtaaagaagaaatcagcatggaatgaagataagttacattaggcccacatctttaaatagtttttcttccctctgagacaactgaggaaagcaaaccggcacctgctctgaaacctagcagaaaaactaccctcgagtcctgtgtttccacatagatgtccagctaaattaaactgccccttaattttcttttgctttccctgaataaattaaaagttacacgaccccagtgatctccggatagtgaaaaatcacacattttattttattctttgtgtttttctttagtttcagtttttgtacaataagcatgtgttacttttgcaattggaaaaaatacaccttacttcttttcttttcttttttttttgagatggagtcttgctctgtcacctaggctggagtgcagtggtgtgatctcagctcactgcaacctccacctcctgggctcaaacaattttcctgtctcagcctcagtagctgggattacaggtaccctccaccgtgcccagctaatttttttatttttagtagagacaggggtttcagcatgtcggccagggtggtttcaaactcctgacctcaggtgatcctcccaccttggcctcctaaagtatatcttacttctaaaaggcttagtttgaaaggaagaaaacaagtcagagggcactaaagttgaaatccatctgcaccattctatcaagatgtgtggggaagtaccaacgactctcaattaaggtgggcaagtctttgcaagaaacttgctaaaaataattatgtaaaaattacacgatgaaaagttagttctttaaataagccaaactctaaaattctcatgaatgcaaaactaaattttatctggatttcaacttaaggagacagagtggtgaaactaacagaacatcaacaaaactagggtgtgagccctcttctgttggcccttacctctttcagtccccttcctagtctgtaagatgggagagaacatacatcatgcatggttattgtaaagactgtctaaaaaatatatttaaaaactcatcgcacagcgcctggcatttatatagtaagtgctcaataaactgcaactattgttattaaacaatcagaaatatcctaaatgcttccagaagaaataaagaagcattgttactactgaaattatattaattactaagtcaatttcaacatttatcctgatgaaaacagaatccttcccagacaggcaatccttgagaatccatgacataacctgggcgaatgattccaaatcaaatacattatttgtcaaagttattaagcaaaatgtagaaatgcaaaacaactaaggatttaatcacagccagttatttaataagtccaagctttacagactgctatcaccattacttacaaaaaagaagaaattcaactatggggaaaaaacatgcatcccaacaaacaaatggcaatactaataggattatgttggaaattacatggcttcagcagaggcagaatgcttacctataaagcaatgatttctaagaagaaaaacaaaatcaacaaccctcatttttgtttacctggatgagtcatggtaactggctcctctttggatttattattgtagatgactacagcaactgcattgtggaaagcggcccgtgatattttctctttaaacgtgcagtttcccctctgcagcaaggcaatccactgtttgatattaggagggacaaagaaccgggtttgtggatcacagcccagatgatcagcaactgaaaagaaaaagaaatacacacattaaagataaataaaactgaccaagtctttatcaaagtgtcaactgctttctgaataccacacagagctaaagcacgtgaagcagctcgctgccagcagagctatgaatacatccacaaacaatacaatgaagctgaatcagtacctatagggagagatgctccatgggacggttacctataatgcaaattaaaacaatgaaaatttcttaactttacagactgataaaaaataaaaaaggactgataatatccagtacagggtggtaaagggaggaggaagaaaaggccaacacagacgagaaacccaggtgactgatgtaaccctgacaccctgactcttactcattcctgttcatgtactagcctctccacacaccgccaccaccgctatccccacagtgagaaaacaggagcctggactgggggccagtgaggaggccaaaataatcctcggttcagttactaagtgatcctgttgaaattcaaccatgttagagcaaatttcttcataaatgtctaaggaaaatttaaaagtttggttttggcttatatttgaaagttgaagtagttaaaataacatctaagtagaataaatgtattattcctctaatttatgttagcaaaagtcaccccacaactccgtatcaagatacacttactgtatccatctgtctaacaggttacaagaagacactaagaatgttggtactacaaattacatggccactgttctggattttttgggatagtttatttaaaatactcataagtacatttaaatctgtcagagtaagcgcctcaatttttcactctgcacatatggccatcatggttctggcatcctctgcaaatcttaagaagaagcccccggctgctcttcccactcccactttcacatttataacaggttcaaatgagagagaagggcagcccagaaggggagagaagtcaccaaaggtagagtctgcagactgctggcgcacagtggcagagggtgccagccctgtgccctgagtcagccctgccggtcctctgtgtgccgggaaggaagtaaggaaagggaacacagcgcatggatctaaaaaggtgacaccagaagtaaataaatcataaaagcaaggcgaggtgtggtggctcacgcctgttaatcccagcactttgggaagccgaggcaggtagattgcttgagcccaggagtttgagaccaccctgggcgacaaagtgaaacaaaaaatacaaaaaaattagctgggtgtggtggggcacatctgaattcgcagctactggggaggctgaggtgggaagactgcttgagccatgatcgcaccactgaactccagcctgggtgatagaacaagaccttgtctcaaaacaaatcataaaaacatgaagtattaattgtagtagataaagagatgacgccagtgggaaaatgttggctttctacacacctggaagcacatgcctagcaaaagaaactaaatgcttacacgacttaaattgtaaaatgtaaagatgccagtaacttcagagaactattacatctaccattcccacttaaatatctttccccaaattttctttcaactattgtggtgagagactgcaccaagagtgtatttgctaccagaggtctcctaatacatgaaatggaagatgaatgttttcacaatttttcatgattgatattgtatacgaccattacctacccttttccttaaaaggtttctgcactctgaacctttaacccttcctcaatcaaattaaacggggatagaagcctatgtcatgattttaggagtcaactattgaaagacacagacgatgcactataaaactttaaaatcctgaaacagattgtttactttcatcactatctgtttcaccgataattatgctgtaaaataaaagcagctcagtgacctgttacgataatctcctcttagaaaaatgtctaatactgtatccaaacggggaataaccaaggaactggttttaggtgttctgttcgttatttttcaaaacatactgctgcacaaaccctggaagaaaacgcaaaatcaagaatatctaaagtgatgtgtacccctgccttctgtgcaacacatttaatcatttgtctgtgacttatctcttcttccctgtggtctcgcatacatgcacaatgtagtaaaaagcaaacaacatagttatggaatcagcaagactgtgctccaaggtctagatcaactgcttactagctgtgtaactatcacaggtgactgaaattctcccatctttaatttgtacttatttataaagatttagatagtcttatctcacagaattttacacgtgaaaaagccaagagtaatgctttctggccaggcgtggtggcacacacctgtaatcccaacactttgggaggccaaggtgggaagaccactcaaggccaggagttcaagactagcctgggcacatagtaagaccctcatctctacacaaaataaaaaacaaaaaaattagctaggcatggtggcacgcacctgtagtcccagctactcaggaagctgagatgggaggatcgcttgagcccaggagttcaagattacagtgaactatgatcatgtcgctgcactccagcctgggtgacagagcaagactctatctctaaaaaacagtaataattccttcattcttcaatgcttaaaaaacactctttccctttgtttgtttcactgacattcatcctatgttgtcttggtgatccagtttggtccccttgggagtttctgtgccaaaatatgtgagctaccccacgctcagcagcaccccacactcctctgctcttagtaaccaccactcacagatcccaagcctcatcttttttacctctttcgacagtgtcacagtccactcagaagacagcagttcagtaatattcataatattctaagaatgaaaagacacagcaaggggtgcaaccacagagcaaaagttatcaaacatactgcaggaggactttaaaactctgctaaaggaatcccgcccactgagaacagattctatgaacaacagcatgatcaaaacaaatccaacaacggcctgtataagcaaaagaatgttcctgtttcccaaaattcatctaatcatcatccataaaaggtctctgaaaacattcatattggtagtacaatacaaaataagcaaggataggaagcttctgttcaaaaaagtggtatttattattcagaagaaaataagaggttttcataaacaggaacttaatactgtagtatactcattctacctagttattccctcctgtaattaagaaaatataaataatgaaaacaacggttctataacaacttttcatgactgatgactataattaagtagtattactccaaaatttaataccagttgtttacacttgagcaatttattaagtgaagacatattatggtgtaaaatatctatataattatgagcctttaaaatttgtcaatagcaattctgttaaaattcagaataacggtacttccgtttttcttacctgccaacttttataagaggatactatctctgaattatttgcatttattaattatagagccaggaaaaacttactagaggttctgataaaaatttcaagatagataatacaaaatattttactacagaacttaattttttttttcctctagggctttttcctgctgagtccaaaagtattaaaagtaatgagacttatttacctcttgacaggcaccaaacaattctgggctcctcacctcaatgaatagtaacttatgtgctcagctacacgctaagtaccaaagagagatacaatgtggcaaacgccttgctcttgactcttaaagagcctccacatggccgggcgcggtggctcacgcttgtaatcccagcactttgggaggccgaagtggacagatcatggggtcatgagttcgagaccagcctgaccaacacagcgaaaccccatctctactaaaaatacaaaaattagctgggcatggtggtgggtgcctgtaatcccagctactcagaaggctgaggcaggagaattgcttgaacccaggaggcggaggttacagtgagccaagattgtgccactggactccagcctgggcgacggaagtagactccgtctcaaaaaaaaaaaataaaagcctccacattcactgaggcatcataattggcaccagcacagaagctgacgttagagggtgccaacacgaagtgcacttaagagactgaaggagggaggagggcaggacgatggtcaagatttagtgttagctggagcccacatggaacccctgaaacttgcgcagccaggaaggaggtggatacgcaagttgccagcataaaaacacagagcaaagactaaactcttctcttgaactcttgcaaaattaagtaagacgatatgtaacagagcctacaacactatacaaatttaagaaggtcaagttcagaaaagatctcatttgcaatgagagaaggagaagaatattcaggtaagaatagtatgtaaatatttaaagggctgtaggaatgaaatctctattccacaccccactgtgttcggaattcgtgggttcttggtcttgctgacttcaagaaggaagccgcggaccctcacggtgttacagttcttaaagatggtatgtccggagtttcttcttactggtgggttcgtggtctcactgacttcaagagtgaagctgcagaccttctcagtgagtgttacagctcataaagaccgcagggacccaaacagtgagcagcagcaagatttatctcaaacagggaaagaacaaagctcccacagcgcggaagtggacctctgcacgttgccgctgctggctcgggcagcctgcttttattcccttatctgaccccacccacatcctaattggtcaattttacagagagctgattggcccattttgacagggtgctgactggtgcgtttacaaaccttgagttagacacagagtgctgattggtgcatttacaaaccttgagttagacacagagtgccaattggtgcatttacaatcctccagctaggcacaaaagttctccaagtccccaccagattagctagacacagagcagtgactggtgcctttacaaaccttgagctagacacagagtgctgattggtgcatttacaatcctttagctagacagaaaagttctccaagaccccacccaactcaggagcccagctggcttcccctagtggatcccgtgcggcatgcccacactcctcagcccctgggcggtggatgggaccgagccccgtggagcagggggcagcgctcgccggggaggctccagtggcgtggacggaggggggtggggctcgggcatggcaggccctgccccatggggaggcatctgaggccccacgagaatctgtgcgcggtggaccgcggcgcgtgcaggcccacagtgctgagggacccagcgcaccctccgcagctgctggcccaggtgctaagcccctcactgaccggggcaggtgcagggcccgccaagctcacacccacgcagaactccagggccagcctcggccagcccagagaggggctcccacagtgcagtggtgggctgaagggctcctcaagcgtggccagagcagacaccaaggcgaggaggcaccgagagcgagcaggggctgctagcacgttgtcacctctcaccaccagtctgaaactctcctcctctttgattcatttgatttagtaaaacctcatttcttagaaatgtaaacacgccacataagaagcactcaccatgttgtgtaggctaagggtttccttcctacccctgagaattgtcagtctgctgcaggggcagaagtgatagcctcggacagtatttttctgcagtgatggtcaaaacaggcggccgcacagcacagtggcaaagatgtgcctctccctctcagagcctgtgtgtgtcacttcatcctcctgaaatgccagtcccaccactcttgctcaccaccttctgagcctcaggattctgccaaaatgtcttctccagaacgctttcccagcctcctaagactgagttgggtgcttttttcaagttgccatggcacccttaggttacatccatcttggcatttatcatactgtattagtaactggctgtttacttctgaggctttccttccggaatgtgaggtctagcatctcctgcgaatatgtctggcacatagatgtttaacatgattgatgaaggaaaaggggaaaaacaacagggaaattaagccaaaactggcattaaaaaaaagtttgtggcaaagagttctctgtttcacgtggtaatatcctgactacggtaatgttctatcagttgcttcctacaaaagaggtaaaaataaaaatgagactaattagttaccccggatttagattcctccattgtcagctatggtctggttgctttcctactcctgaattagattataatttctttattctttaaatttcctgcttctaccctatctttccttattttcctttgtcaaattctaattttatgattcaaagaaaaaatacaattcatcatttctgttatcaatttcttaattttatttttaatggcagctactggacttaggtggagctttcattctctttatccacttccatggatataacttattattttactgcttctacactttcacttaaacctaacatttctttttattacttagcttcattgggtgtttagtcttattgaaaatgtttttttctggcccggcgtggtggttcatagctgtcatcccagcactttgggaggccaaggcaggcagatcacctgaggtcgggagttcaagaccagcctgaccaacatggtgaaaccctgtctctattaaaaatacaaaatttagcttggcgtggtgtgtaggcctgtaatcctagctactcgggaggctgaggcagaagaactgcttgaacctgggaggcagaggttgcagtgagccgagattgcaccactccactccagcctgggcgacagagtgagactctgtctaaaaaaataaataaaataaatctcaggccactctttgttctccaaactggcctgccccagccaagcgctctcctctctccactcccacgtcccacttcctccaggctttcctcctgcactaccacagtcattctttgggtctttactgcctcttcttcctccagtcgaaccttcaatactgacgctcccgagtactctgccttccctggcgtgggcccaggactctccagggttcatgttcaccatgtcaacagcacactttttttttttttattggaacaacaatgcttactaacatctcatgctgagcagccctcttctgagaaattatttttcatttttacttctatgaacccagtttctaatagacacagctaaatcaggtcaacagcatgctaagaatcgggagaggaaagtggaaaattacacacacagaagggaattcattcccttccattccaagcaaaacctctgccttgatgagttaataggagttctccaagatttcaactggtttacatggaaggggcacggaagggagtctgtagtccggtttacggcaaatcactctgtatctaatttgtctgtttccaggttgctctgccctgcttctaggctagaggatgatattattatcaaaggctacaggattaacctccgaatctaggcaatttctgcttgactcacataggaagaaccagtgttccatgtaacaaaatcaatgacttagattgattaaaaataatgaggccaggtgcggtggctcatgcctgtaatcccagcactttgggaggctgaggtgggagaatcccttgagcccaggagttgaaagctacagtgaactgggatggcgccactgcactccaccctgggaggcagagagagatgctatctcaaaaacgggaagagggaatttatcctgtctcagaacagggctgtattttgcggtgaagaattcagcacctcagcagtgtcaccaggatctggttccttttcatctcttccctttgccatctgtagcttcagcttcatcctaagagtcccctctttatcataagatgactgccagcagcaaatgaagtcacacagctccctgttcatattcagtgggagacagaaaaagccaaccctccaggtatgtaatttaagctcttcacttctgtgcagctcaccctaggtcatttatccttctgtgccccacaccctcttctgggactcaaacaggtgtcacttaaagcatgtggctgcatggaagtgatcacagatgcctgaattacataaggtttctgttttctgttttaaataagcagaggctggtaggcaattaacagctcacttcaaacctcaaggtaaccttatacagtggctcttaattcatcagaatccacacttggcaattcaaacccaccaaaaaggacaaaacccaaaaagaaagcttctttggtttccaagcgctttgacacagggagacagctaaggtaccacccctctgcctccttccctcactcgagggaaacatgagctatttgggagtggagagccccacttgaagatcagcagctacagcaagcattcttgacaaggctctggggatagaattcagggctgagtgacatttggatgaggggaaatcatctttatttctgctaaaatctaactgaaatctagcattttatttatttataaacacagataacaaaccatctgtaactctgtaaccagcagcaaccacattacagttattgcaaatactgcaaaatactgataaggtgattaggcccaccactgaatcctgtccctaatgttaactgtacaagtattaccatgtcacagacatgttaagtattttaaatactttgatacattgtttcagtatacttgggtttctttaatcctatttactcctgcacttaacactattctgagaagcagcccacaggttaaatcagactgcaaaaggagtctcaactgccacgcttagtctatttgcatatgtatatgatatagctggattcatctctattattttattgtgttcttatttattctacttttctaagcttctttatactttttttccctctcctttctgcctctgaatatattgaccgaatttcatttcccccttttcctcatctatatattcaagttctatttttttagtgcctacccttaaaatgttaacatgcatacctgataaaaggtctacaattaatcagtacctctattctcctcctgaatacctcaaggctcttagtttcctagggctgccagaacaaagtaccacaagcatggtggcttaaacaacagaaatgtattctcccacagttctgaaggccagaagtccaaaatcaaggtgtaggcagggccactctccctatgtctagctctatctagttatttctttatacagatatgtagatacaaagggatttattataaggaattggctctggcaattatggagacagacaaatcccaagctctgcagggtgagctggcaggctggagacccagcagagccgatggagttccaggccaaagaccagcaggctccgcgcccacaagagtcaaaggtctcagccataaggcagtcaggcaggaggaaacccctctgactccagggagtgtcacttttttgttctattcatgccatcagtggaatggataagacccacccacattatggagagcaatctgctttattcggtctacccattcaaacgttaacctcgtccaaaaccaccctgaccgaaacacaagaattctctcaggatactgtctgaccaagtatgtgggcacctgtggcccagtcaaggtgaaacatagaattcaccatcacagtcctcctcacagctcacttttttccttctgtgttccatttccctcctccttattctacatccttcagaagttctttcaatgaggatctgttaggtaaacttgtattttacatctgaaaacatctttcttttgttctcattcttgagtgacaggttaattaagtaaaaaattccagactgttaattttctctcagcacttcggggttgttcttgcactgtcctttttatttttatttttggagacagggtttcactctgtcgcccagggtggagtgcagtggcacaatcagagctcactgctcaacttcctgggctcaagtaatcctcccacctcagcatcctgagtagctgggactacaggcatgcaccaccatgcctggctaatttttgtatttaccccaacatgaggtctcactatgttgcccaggctggtctcgaactcctgaactcaaacaatctgcccacctcgacctcccaaactgctgggattacaggcgtaagccaccaaacctggccaattctagtacttttaaaaagtaaactaaatgtgtttcttgtttttctcctaattgacaattcttacaattaccaattgtaaataaaaaggtgatacattcttacaacaaattatcacctttttgtatagatattatatttatttatttatttatttatttatttgagacagagtctcgatctgtcacccaggctggaatgcagtggtgcgatctcggctcactgcaagctctgcctcccgggttgacgccattctcctgcctcagcctcccgagtagctgggactacaggtgcccgccatcacacctggctaattttttgtatttttagtagagacggggtttcaccatggtctcgatctcctgaccttgtgatctgcttgcctgggcctcccaaagtgctgggattacaggcgtgagccaccgcgccccggcctttgtacagaatttttaagaaggtggcagcaaaataccttctggacacctaaatgctggatgctgcagtcaacatggcaggaatgtcctaacagtggaactgcagcagatgcacttgtcagcagccgtccatcattgtttgtctgctgaacttagttactgtgtatctcaaatggattttgattattttttacatccttagaacgcaaatatatctgttggatgttctccatgacataataaaaagcatcttaagagtaagtttaaatgacggctaatacaaatcactttgcatgaaaagtcaatttcaaaaataataatttctattataaatgatgcaacagatacttcatgcaagatgctacagatctaaataactgaaaattagagcttggtcctcatacaaagttggtgtcacagtgcaatataagtgttaattgtttatccacatcactcttcgttccacaaaggaattacagtactgagtacaactcttcccgaggctctctgttctcttggctcctatccatcaagttttcctcccacctctctaactattctttctcactttccactgctagaccctcgccaaggtctgtcccaggccctcttttctcagtggacagtatcatccactcccctgccttcgactaccacctgtgtacatcacaatctaaatctaaatctccctcttgagcttttctgtttaatattcacctgcctgcttgacatttctccatgaatactgagcagtccaaacttattagcttcctctcacatgtgacgtctttccagtgtagagttctggctaacagcatcatctactgaaacacaaaggacgaaaattcctgttggaaaccaagtggccatatggagactcaacttcccactgctgctgccacacatagggacacaaggacaccacccttgatccagagcagcgcctgaaggcactactaactcttgggcagaaaagaatgtgggagcaagcttgttttatttcatcacttctttcttctagtatgagtatttccagtactaatgactcgatgcaatgacagtaatgacaaagactgggctatctggaccataatttaaaatgtaatgacaggccaggagccatgcagctcacactaacagggaagaagccatctgtccagcaaccaaaggactttaagctaaattggtgaggagggagggaggaagagaatacaagggaaatcataaaatcagtccctacggaggattacagaaaaagaaagactgagagagattgctcacctgagaaaataagaggtttaaagtgttcttaatctgagacgtccataaaccaataaatacaagtaataagaaaaaaccttaaagttcaccttaaatatagaaaataatcagtgacacttgttgaggcaggtctcaagattggcctataatgatggaaagcacactattattcagagggaaaaaaaggattttatgtcaagataatgtacgtccttcaaggaatcccaagtaaacagaagcactcaagaacacctctgagaggcagaaagctaaattagacttcgatgcgggagcatgccgaggtcaactggccaaatggagtaaagataaaggtttttaacagatctcaaaactggcagacaggatagggcatggacagggattgcaaccacctagagctgcagaagagatctcacccctccgcttccattcactttgcctcccacaggacagtggccaggcatatcccggtgaacagctgcccgaacccaatgcaggccccgaacagaagtgacaagtcacatggaagaaagcaacgtatcatttcagagtttacaaaatcctgggcaaacaaagctcagtaacaaatcatcttgatgagaaagaaaatgacacattttatgaagaaagcagcaagaacacacaagacaaattaagctttaaggaggactcaaacaaaacctgaaaaggcaaacacaagatgatggtacaggcttacacagcttttctttaaaaagcccagaaagttgaaggttgccagtaatgataggaacaagcaaagctacttctcacaaaagttttattatttttttaagtatattcagagcaagaagagttggaaagaaataggtttactgcccagggccaactaaatgatggatggaaacatttctcaagacttttttgcttttgctttctctaccacagagaataacctgagaactgcaacaagcacggctacatgacactgacaatgagtgcagagactgtaaaaaagcaaatacattctttttttttttttttttaatttgagacagagtctcactctgtcgcccaggctggagtacagtggcacgatctcggctcactgcaacctctgcctcccaggttcaagcgattctcctgctttagcctcccgagtagctgggactactacacccagctaatttttatatttttagcagagatggggtttcactatgttggccaggatgggctccatctcttgacctcgtgatctgcccgcctcggcctcccaaagtgctggattacaggtgtgagcccctgcgcccggccagcaaatacattcttagaataggtttctctgttacctatttttacttcatttcagtagaacagctgtttatatcttatgcattcatgctggtttcttcaattaatcactcatattgtttcttgagatgatttgtaacgacccagctttctttgtcctaggatttgcaaacttaaaaaatgatacaatcgctttcttcccaatttctaggcactttgcattatatcaccaaatgcaaagaattccttccaccccgtggcatgtcaccctccaggccagggtcagatgcagatgcccacttagcttttgagacaatgcacattcctttcgcatcctccctctccctctaacttctccgatatccagttgtccccgcaccctttactgaaaagactattctttccctctattgaattgtctgggcacccttctcaaaaatcaagtgacaaaagggtttctttctggttctcagttctactccactgatctaccatgtctctatcagtaccacactgtcttgtagtaagttttcaaattgagaaatgtgaattctcttaattttattatttgttttcaagattgttttgactactgtgagtcccttttacttccatatgaagttctggtattttcacaggatggtctgaatgtgtaggtcaatttggagggcacaggtaccttaacaaaacaagtctttggacctatgaacatgaaaagtctgtttatttacatctttaattccttgcaacagtgctttgcagttttcagtgccaatattactttaaatgatattgtgaaatttttattttctaattgtttgttactggcatatagaactacaactgacttaatttttgttttattgatcttttatctatgggtgttcctaaatgtatttgagtttttaaaaaattactctgctggttattggtaacaagaaataaattttggccaggagtggtggctcacacctgtaatcccagcactttgggtggccaaggcgggcagatctcatgaggccaggaatttgaggccaacatggtgaaaacccatctctactaaaaatacaaaaattagccaggccctgagatcgagccactatactccagcctgggcaacagagtgaggttctgtctcaaaaaaaaaaaaaaaaaaaaaaaaaaaaaaaacaaaaaaaaacagcaaacaaacaaaaaatgcaattttttttttctttgagaaggagtcactctgagccaccatgcccagctagaagtaagttaagttttactggcatttaattaaggattaacactggctgctttcctcaacctgaatgtcagatgactttgtgtgtgtgtgcgtgtgtgtgtgtgtgtgcgcgcgcgcacgcgtatgtgtctgtgtgtctgtctgtctcatgtggtataccagttgtcctaaataaagagagggatttctgaaatgcaacagggatggtagtgactctctcattcatccgtttgttttcagataatactgccaacagtataatagccatacactactcagttacaggatttacagacgaaatgatccactttttactaaattgtccctcatcaaatggacaaatgcctttttttaaaaaccccagcaaaaataaactggtagagctgatacttctctctttttagctactataaagggttaaaaaacaaccatcaccattacaactggtgcgtggctcatggctgtaatcctctcactttgggaggctgaggtgggtggatcatctgaggtcaggagttcaagaccaccctggccaacagggtgaaaccctgtctctactaaaaatacaaaaattagccaggcatggtggtgggcacctttaatcccagctactcgggaggctgaggcaggagaattgcttgaacccgggaggcagaggttgcagtgagctgagatggtgtcaccgtactctggcctgggcgacagagcgaaactgggtcttaaaaaaaaacaaaaacaaaaacaaaaaaacaaacaaaccatcaccaccaatcagatttggaaaagaaagtcaaaaaactagaaaatatcatgaagactatcagaaatatagatttattcccgctgttactcttagcctaagtgttgagccttaagatagtatctgtggggaaaaaaaaaaaaaccctaatagtgtatgtatgacatttatgagtttaatgcataccctggggctacatgtggatgtgcaacagagaaagtctgtgtcctgttactatagagaatgggctagaagggagccacagaccagaggaggctgcaacaggtgtggagagaaacagaccacattttagagatatttaggagtttggatcaataggacccagtaattacttagatatgggagtggggggtctaaagagggaaatgcctcagtttctggcaaaacacactgggcagaggtggtgttaccgacagacagcaaacactagaggaggaaaagattaggaaagatgaaccatgttggacacgttgggcttgaaagaagactcagagaaagaagacaattcttcctctcttaagagtgtcttatggacactcaaatgtattcccaataaaatgtgtatatatgtgtacaaaagacacatacaatgctcatgactggactgcattgttcttaaccaccaaaaagcaggaaacccacaggcccatggacagcagaatgcataactaccacatattcataaagcagatcaccgacaaaaccactgctacatgcagtaacatgaattcatctcactaacatgatgtgagcaaaagaaactagtcacaagaaggcataccgtgattccatgtatattgtgatataataagaaatacatatttagtcttcatccctggtttctgtcatagaattcctaacacgttagtaatttcctgagtgacaggggtgagaggagcatgttttcttattcaaaataagcccctttcaaccataccagcgtctgtgctaataaggtgactcttggaagatggggtctggttgccagaggaaccaatcatgtaattagaggactgaaactttcagcccaactcccagcccctcaaacctctggggaggggcaaggggctaaaggttgagccaatccaatggccaatgacttaaatcaatcatgtctgtgtcggggtgggcacagtggctcacgcctgtaatcccagcactttgggaggccgaggcgggaggatcacccgaggtcaggagtttgagaccagcctggccaacatggtgaaaccccatctctactaaaaatacaaaaactatccgggcatggtggtgcatgcctgtaattccagctactagggaggctgaggcaggaaattgccggaacctaggaggtggaggctgcattgagccaagaccgtaccactgcgctccagcctgggtgacagagcgaaactcagtctcaaaaaaaaaaaatcatgtgtaatgtgtaatggagcctccctaaaaactttaaacaacagggttcaggtagctttgggctaggcgtatgccaagaggattattacacccccgcaataccgcgacagaagctcctggtcatgggacccttccagaccttaccctatgtacctctccatccggctcttaatttgtatcttacataacaccctttataataacagggacagtaagtaaagtgttttcctgagttctatgagctgttatatagcaaattatcaaactgagtagggcgttacgggaacctcctgaattgtagccaagtcaagacagatgtgtgggtaccctttgtcccactacctacaaccggtgtctgaagtagggggcggttttgtgggactaggccctttacctgtggggtctgcgctaactttaccaggtagttagtgtcagaattgaattaaactgtaggacatccaattgatgttgaaaatccacacatttggtatcagagtgctgcaggtaaaaagctgtcctttacacataagttaaggaacaggtataaactacggtgtcaaagcgaggacagaagttactgctggggagcgaggagggaaggagccgtgactggaagggacctgaggtggtctgcaaagctggccacactcaacttctccactaggttcatggctacatcagtgtgttcattctgtgggaagtcatcaggctgcagacttacggttgtgtatttttcagtgtatgttacagctggtaaaaatgtgtgctaatttttaaaaatctggtcactttattccccaggttaaaattcttcaacagtattttaacacatgctacaacacagatgaacctgaggacatatgctaagtgaaataatccagttacaaattatgaggaactaacctagtcgaattcatagagacagaaagtagagtggtgttcgcaggggctgcggcagagggggtaatggagtcttgtcatttaatgggtatgtttttattttttatttttgagatggagtcttgctgtgtcgcccaagctggagtgtagtagtgtgatctcggctcactacaacctctgcctcccgggttcaagcgagtctcctgcctcagcctcctgagtagctgagactacaggtgcacaccaccacgcctggctaacgctaatttttgtatttttagtggagatggggtttcaccatgttagccaggctggtctcgaactcgtgacctcaagtgatctgcccacctcagcctcccaaagtgctgggattacaggctgagccactgcacccagctggtataatgggtatagagtttccattttgcaagacaaagagttctgtagatgggtcgcacaacagtggaaatgtacttaccatgacttaacagttagatggtcaatttatacgttattttaccacaattaaaaaatcttaaaacaccaacaaaaatccctccaatagttttccattcctcttatataaagtccaaaatcctaacaaggcctggaaaacactgactttttcaactctactgtgccccactctcccccttactctctaactcctttcaaattccacaagtacatcacagtttttgcaccttttagtcttcgtgtatatttccttggactgaaacatcctcctttctgccccctctcagtgtaatatctgctcatgctgccgtctcagctgaaacatcatttcttcagggacgccttgaccaccctagactgagtctcttctgccatttatgctctcagcatcccgatgctttcccaagactatgattaaataatcgtgttatgacctgtgtaacggtctgctttccccagataggacacaagagctgactccttttacttccccccaccagacagcaacagcatgcaggaacttcctgtcctgtctggaactcagtaggtgcttaataattatttgatgaatgaatacttgaggcagctgtcccacaggaatttaggatttttctgatccagatgaattagtctgctgataacatgcaaatgagaaggtgcatcactgacctttaaggagtcatagaaaagaaatgttggaaaaccaacccgtgtacagagcactgatacgaaacaatgaaggtgagccgtgaaaacaactgacccattagggtcctgctaagccttagaaaaatttcacaaatgattactgaaggaataatctgcagacagtgtgaagagaaagctgtaatggtggggtgccagcacaggcctgctacgtgagagaggcagaacgacggctccctcaaagacgtccatctcccaatccccaggacctgtcagtgaatacatcaggttacagagcaagggggaactaggttgcagatgaaacaaggttgatcatcggctgactttacaataaagagattctcctggactgtctgggtgggcccaatgtaatcacaagtgtcttttaaatgtgggtgacagacggagaaagtcaaagtcagagacttgaagatgggggaaggggccatgggccagggaacacaggcagcttctacaagctgaaaaaggcaaggaaatgattccccctgagagctccaaagccacgcagtcttgccaacaccttggtctcactgaggccagtaaaactcatttcagaattctgacccccagaactgtaagaggagtaaattggtgttgctgtgagccacctagtttttggtgatttgttactgcggcaataagaaactaacacaccaaggctaagccatgaaagattcacttcttttccttccgtgcagtggctcctggcctagccaatcaggaacaaagtacatagagtatccttgttttttccagcaaagcatctgattatgtcttttatggtatcataagctgaagaaacacatgctaaatgcaaagtcaataaagtgagttagaactctgtgaaacggccatccttgaagagtgctgattaatggaataacgcccagcagcctagatttttaccaacacaccgcgagggcctgtccgttcacttgccagcacttccaccctaacttagcgcagggattcttaacttggggcttcaagaggcaactggcctcctaaccttattaaaagttctgtgtatctctacataaatacgtagtcttctggagaaaggtacaccgctttcatcacttatcaaaggggatctataaagcaaaaggctaagaaccactaacctagatgaagatacagaaagctatgttcggccgggcgcctgtaatcccagcactttgggaggccgaggtgggcggatcacgaggtcgggcgatcgagaccatcctggctaacacggtgaaaccccgtctctactaaaaatacaaaaaattagctgggcgaggtagtgggcgcctgtagtcccagctacgcgggaggctgaggcaggagaatggcgtgaaccccgggggggcggagcctgcagtgagccaagattgtcccactgcactccagcctgggcgacagcgagactccgtctcaaaaaaaaaaaaaaaaaaaaaaaaagctatgttcatgcattcactagtgacacaagctgctagaaagagtaaagactgtgggtgacgcatcaggattcagcaagtatcctgaaaggctgaatgaaatggctgatggcttaggagcagcctcggtggaaaacactggaagtttaatcaacagtgggctcaggatggtcttttggaaaaaaccacaacaactgacgtgacttcaggcacatccagaaggatgaagaaagtatagctcgactctctcctgtgctggcaaagctaaccctgcatgcctgtgttcaacgctgggattctctttgtattagtttccagtggcggccgcaagacatcacaaacttggtggcttaaaacaacatagtctcattgtctcacagttctggggccccaaagtctggtgtgagcagggctgattcctactggaggctcaagggaaaaaccacctccagcccctctcccagcgtctgatggctgctagccatcctttgcacccgccggtttgtggcagaatgatgccatctctgtaacctccttcttcctatggccgccttctctgtgtgtcttcctgtatcttttcctcttcttataaggacattagtcgttggatttagggcccacagtaaactgaaatgattttatcctgatcctcaactaattacatctgcagagatcctatttccaaataagggcacattctgaggttctagggggacatgaatttttgtggacactatttaactcatctcttagtcctttcgggctgctgtaacaaaataccttagactgggtaatttataaacagcacaaatttgtttcacatagttctgtaggctgggaagtccaagttcaaggcaccagcagatgtggtgtcagagcccgctgtctgcttcatcaatggagacttctttgtgtcctcacatggcagaaaagggcaaacatgcttccccctcccccagcctcttttttttttttttttttagacggagtctcactctgtgacccaggctggagtgcagtggcacgaccttggctcactgcaacctctgcctcccaggttcaagcaattctcctgcctcagcctcctgagtagctgggactacaggcacgcacagccacgcctagataatttttgttatttatttttttagtagagatggggtttcaccatgttggtcaggatggtctcgatctcctgacctcgtgatccacctgcctctgcctcccaaagtgctgggattacaggtgtgagccactgagcccggtccccccagcctcttttataagggcactaatcccattcatgagagctctgccctcatgacctaatcaccaccaaaggccccacctcttaacactatcacattggaaatggagcttcaacatatgaatttgggtgggacaccaacattgagactacagcacctactacaccctttaagtggaatattaatagacaaatgcattctgaggtttaagataccatattcccaagaatggtcaaaataaatagggatatgaagcctaaaggttagaggacttgaatcagacaaggaaagtgtctataaatacctgaaccatttttttccagatgaaaaagactttctaacattgggtttgccagagatgaatgtggtagacttctgtcacatttgttcaatcttaacctgtacaagtatctgactggaatgctgaagcctcagatgggggacttgacttgttgactactaatggccattacattctaagattctcaatctgtcccgttaactggccattttacagaacccaagaatttttgtaaagttccactaatatagcaaacactgtgggatgccaaccagagggcacacactgtaaagaagacatagaagccctgggaactgaaagaatatcagaatggtttcagaaggtgagtaagggtgaaatgacctgggggtggggaggaggaaggggctggagctagaccaggtagtgaacacctcatactgcacagagacttctgatgtccgttctaaggatgatgacgagccactgcaggggtttaagcaagcagtaacatgactgggtgaacctttaagattattttggctactatagaagaaaagattgaaagaagttaagaaaaaaggcagagagaccaagaaaaagagagtaggaaatgatagttgcctgaactaaggcggcagccgtgaaaatgtcaaacaacagatacgtacgatccattctagaggtaaatcatgaaggatggattagatgtggaatgtgagccaaagaagcaaggatggtcctaatttgtgtaaataacaagggtggatggcgatgtcatttattgagatgggaaagactggagagcagtggtagcagatagggaggtgaaaaaatgaatcaaagctccatctggagcttatcaatttggagatgtctttgtgacactgaagtaaagataccaataggaagccaagcgcatgaacctagagaggcctaggctaaaaatcaagatacgggaggaggtaacaggaggtacgtggagagaaaacaattcctgtctcagtgttgtcttatttcattacaagaaaatatttttggattactggacactgttaagtgcccatttggtttttcttaacatgtctgatctcaaacctaagacttttcccagcaacactcagctgttgagctgtaggaagcatgagaaagaccaacggtacatggttcatccacaatggaaattttgtgtttacaaaagacttctgtaaatacaaaattatttttggaagacagaggaaaaagaggtgatttcatggaattacatcaaaaaagaagagaagtgagaagccaggagggggctgaaagataactcattctacccaatggggacaaaggacacaatcacactgtgcccaattccattaccgctgagagcctgccacagtggactggggaaggagggaagtgccagagaaaatggaaacactatgagctaggcaacgtaggacctattataataaattattttatgtccatggatttaagcctatttatggaataaaatcaatttaacagtagctttccctgatttcagagtctcctgaaatactgtttagtttgtgcacaatctcaaattccacagcatgtcactggagttggagaagatgctgggaaaataatgagcttctcaaatgagaaaaaataaaaatagggagcagattcatttgcagcaagcaaagggaaaagagtgggaatcttaactgcatgcatctatgaaaaaagcaaattcattcaatggcttgcaatgacacacacctgccccagtcaccctacctgcccatagtccccagaggcaaccacttccaacagtttttagttcttctggtggtctattccaccgttccaaacaggtctctagccatcatttcttggtttgccaactttggaaattgtgtgcagatatatgatgtcactaattaggattgtgtgttcacttactcttcatctccccttcttcccaattttattgttatgttcattttcctctgtttttaaacctttctagcttcgcaactagaaactatctcttgaatccccatcctgtgagatgaatacactgactccctcgccctccctaacttttctctcttccatttctccacctttgtcatctgtgtttgtagagtctcaagctttctgctctgtaactagaattaagtcttccatgctttaactacagattagttctaagcagtgaaaaccacaaaaccagtaagagcattaatatcatcagcatataaatattacactaaaagccaagtcctgaactaggattccacttacttctctctaggattcacaaactgctcaaaattatgacatattttagcttgcttcatatttggaccaagttgtcttggtcctagagtgcctcttttcttactagagaaaaaacacgcctttttcaacattttcctagtatcctccagttccttaataatcctaaccaatgcttggaattcattttgttcttggagctacagaatgaatttaaaaaaaaaaaaaatcttgcaaagacctactcgttcctggttgtccccttcagaaggtacaacttttccccctgtcctttcatggaaaattttcccctttcatagtaaaaattaacaataatttttaagagaaatgtcacccattatctaatcgatataacacaaccatttttatgtctgcatcctatctggagtcctcacccactgtaaataaatttaacacaatcgtagttcacaatgttcccgttttatggctgtgtaacactccactgagtggatatatcataatttattaaacccacttgggaagctgtacaaagaagtggttaaagtacaggcactaggccggtcacggtggctcacacttgtaatcccagcactttgggaggccgagacaggcggatcatgaggtcaggagatcgagaccatcctggctaacatggtgaaaccccgtctctactaaaactacaaaaaattagctgggtgtggtggtgggcacctgtaatcccagctactcaggaggctgaagcaggagaattgcttgaacccaggagacagaggttgcagtgtgccaagatcatgccactgcattctagcctgggcgacagagtgagactctgtctcaaaaaaaaaaaaacaactatgtaaagaaagagttcacaaacacagaaaaaaatgtttccttcctttatagtttctctctttttttaattaaactttcattaccttgcttaagcaggtatcttattcacaactgcctcggaataactttcaattattgtccaaattcaaatctatcaagaaaagataaaaattttacatattgcagactttataaaattattcaatcaaaaaggtaatatcacaaacattaaacagtgtcatcctaataatgtttaatgttttcactgctgcataatatgtgcatatatgtgtacacatacacacgccctctgatatggtttggctctgtgtccccacccaaatctcattttgaattgtactcccataatttccacatgctgtgggagggacccagtgggagataactggaatcatggaggcggtttcccccatactattctcgtgatagtgaataagtctcaccagatctgatggtttttatcaggggtttccacttttgcatcttcctaattttctcttgctgccgccatgtaagaagtaccttctgccacccaccatgattctgaggcctcctcagccatgtgaaactgtatatccaattaagcctctttttcttcccagtctcaggtatgtctttatcagcagcatgaaaacagactaatataccttcccaatatgactaatatactccccaacatgagggacaagaacaacactgtccctcatgggtatagtctagcaagtttgtttaaaaagatttgtcttagcctgggcaatacagcgagaccctgtctctataaaaaatctataaaattagccaggtatcgggcagatcacctgaggttgggagttcgagacgagcctgatgaacatggagaaaccccatctctactaaaaatacaaaaaattagccgtgcttggtggcacatgcctgtaatcccagctactagggaggctgaggcaggaaggcggaacccgggaggtggaggttgcggtgagccgagatcgcgccattgcactccgcctgggcaacaagagcgaaactctgtctctaaaaaataaaatacaataaaaataaaaataaaaataaaaaaattagccaggtataatggcatgcacctgcagtctcagctactggggagactgaggcaggaggatcaatcactcaactccccgaggtcaaggctacagtgagctatgaccacaccactgcattccagcccgggcaacagagcaagaccctgtccttaaaataaaataaaagacatgtcttaccaatttacagtcacaccttattcaaggcgggagggatctcagaagttatctagtcttgaggcccaaatgcagcgcaagattagacagggcaaggtggggtgaggtcagtgagagctcacaagctttgtcatctgacaggtagctaagccttagctcccttctgctcccctccatgaaggtgatttttttttaacccaaatctatgtcttcattcctattaatttttttaaagctatatagcccatcattgtacacattaagatctttgcaattctgaccctgctatcaaatatatgttacatatgccacgtcttcatcaaaatcactggcacggcaatagaagaccttcacaaagagaagagcagcaggaggaaaaatcagaggcagtaaatgtagataacgtttagaggttcgctgtaagagagaaatggggtggtagcaggacagggatttggtggagagatcaagtggtttttaaaaaaattcaaatatttataggctaatggaaatcatcattcaaatgtgaaggaaaaacacggtatgtaaaaacatgtcataagctgtaaagttcaacataaatataatttattatatacatccccttttctcttgccagcctatttatgttaaaatttgatttttagagcctccagctctttctgaatgttcagagaccctgctcccatgatcatatatcctttttctctgaatattttgaaatctgtgtccaatagcccctgcctttgctgttatgaattcaaacattacatgacccctttcacccaaatcctgttttcgcatcaatctcctccactgttcatgagaatttctaaaaaccgatttcagattcattaaaggaaccattaaaggcttcgtctaataggattacatttttaaacatgaaaacctaagattcacttttttgagttttattgtatccctaagcaagttagcaaaacaagatttattatttggtaaaattattctctaaggctgtaacatccaatcctgaaaatttctatgcaaagcaagaagtggccgatactaaactcttccccaccagcacatctgcatacataatcacatcatcaacacagggctttctcctctcccaacccccactctggggccaaacaaaaagttagtgtgcacacacataaagcacatttacaatgtctgctccacagcagaccctagctaggctgctccgcaaaggtactaaatattttgctcctagttctaagctcaccatttgagtaagtaataagaaagcaaccgtgatctgtgcataaatacaagacatgttccttcaaaactccgtttctaaacacgaattctttaccagttaaaatataaaatgtgttagccccaggcaaatgattctacacccaccaatgcattcgacttaatgacaaagacatatttttaaagtacacttgtttataagatatctcataaagtatactacgtaaagtatagcacttgccaaaatatacttttaaaataccaaagtgcctaagaaaaaaattgactatttgctctttaaagggataggacaaataaatgttattcagaaattcacacgtgccaaactgatagtagcactgcaaagcgaacaggaaggtttctagtttcataaatcaatccacagcttcaaaatgagccatcaggttcaactctaggaaaactataaagttcttttgtctttatgttcatttctatcaaacaccctcaaaacaaattttcatgaatttcacgtattggccacagctgtttttccaccaggacctgtctgataactttgtgtgtaatctgagcattactttgcttagtgtcaacgtgcagtaagtcctcaataaacatgtcaagaattctcctcaattcaaaattataagagcatcaaggtcataaagatgcactattttttctaaaactaaaaaattgttaaactcattaaatcaagattataatgtaaaatacccaagtattccaattttaaatcattttcttaacacgaataattttaacagatttatatcaccatttctgtttctaaaataaattcctaagttcctactgcaacagcagaagatttagatttcatataaacccataggtttagaaactactgacaggtaggctaacttacaaagatcccagcagaagctatgcttcatagagacggatttttttaaatctgttttgttcactgctgttgcctctccttcaccaatgccttgactgagactgggcacacaggatttcaattaatatttgctggactgaaaaactgcgtatgtgtgaagacccttggtacaaagccagacttaaaccacctgtaggatcccccaccctcacccccaccccgagaaaacctggagcaagcccctgtgggacggacacagaatgacccctagggaatcaaggaaagggaggctaaaactcaaggggactgacttcacacccagtcttcacacactgcccaaatgtgttcattttgttgcagtgtctgaaatctcaccaactgagagattcctctaggttaacaaatctcctcttttcagaattaaggaaccgtttaaacctgtcaacaaccttaagagatgtacatttcatcattccattttacagatgagcaaacaggctaaatggcagagttacttttacagtgtcacacaatggacgtaaagcacaggcctgactcagaacctttaatcctacaatgctgcctccccactgagaggggaacaggactaatcttcatccatacctcaatacacatgagttagtttccaatacccttctacagaaacacctaaaacaagctttctcaaagacggggcttttgtttggggtgacaggcaagcaacaagtagctgaagcacacgaacaccgtggaggaaggatctgaagttcagaccatggatttggggtgcctgatggaaccaagcctcaaagacaaaccacagatttcacaacactgcagaggaccagctcttgctccacaacagcttgcctccccttcctctttctacccttccacgtgaccctcacggttctctccaccagaaaagaggctaccattgttagttgccagtctggcaacactgtgcatctcaaccacagtgactggcacagagcaggaacgcaaatatttactgaatgaacccaagacaaaagttgtttctacggccaagctgggaccctaactgccatttttaacacagtagagatgagatatgcaccttaagcacctgattactggtgtaaaacggacttttcaaagcctagtctgagttgcggacaggctacagtaaaagccttatgtgattatttttccccagccagactgtctcaaagaagaaaacagcttagcactttggcatacaaatacagacctcagaggggcataatatgttagtatcttaagagtgtacaagcaaatcatgactttatttaggttgcctactttaggtcatcctaacatgaacagcagtttagaaaagaaaaatcccctctcagcattctcagggtgacaatgagggtggggataatggcagatatctcccaaaagttcagcgtgggccaaaacccaaaaaatcatattccacgatgtgcaaaaggtttctttcaaaccatgactaataatttaaacaaatacatgtttacaccaaataatcaactaaacaaagtccttgttcataggaaaacatgacattaagccgaatggtttcaaagacaattcttgaaaattttacctatttcccttttggtcggcacccgtgacctgaaaagccttggctagtagttccgattagtgtcagatcctcataatgtgacattttcaggcgtcaaattacagtaaaactactagggcaagaacaagagccaaaagcaacagggaagatgtccattttccatttacaccccccccccaatttaccacttaagaaaaacggcacgtttttatattagaaaagggccgcatccttccagatctagcgcagccttaagtccgtgatttgaggaacctgccgcttccaaaatacaggctgagacgtcctccccatgaagtagttttgcgctcttgcaccacctcctttgtctacgctgtccctgcaaactcctagctcaatgccctccagcaaacgagctgcctgaacgcaaagatgaccgttccaagtcttttttaaaagaagggaaaaacccagtcacgctcctggagcctggttcccacgggagcaggccgggctgtccacgacggaagcctcgaccctggctggggctgtcggccgggcagcgcgggagagccagggccagagccggggccgggaaccctagtcccgccgcctacgcgggatgcagcgaccaccgcccgccgcccccgggccggcactcacctccgtggaggggcagcggcgccagcacctggccgcggacctcggccttgggggagtcaagcccgtagcgcccgcggtcgatgcgaaacgtgagcggggcgccgcggccgggctcctgcaccgtcacgttgatgagcgccgtgtagtactcctggctcgcgttgtctgcccgtgccggccacaggctgcaggtcagcagggcgagcgcggcgagccgggcagggcccgcccgccccgcgcagctcatcgtccctccggcagccgccgctgctcgcggaccgggctccggggccggcgcctagaggcggggcgggcgcggcccgggcggcggcgggagcgcgcgcgcgcggcctgcgcggggccgagcccgagcgcggccctcctggacgccgcggccccgccgctcgccgccctcacgtccactgcccgcctgtggggacgcgcccatgggccctcggcgagggcggcgtctcaggtcgcacgcgggcgtctcttcggggtcccaggagggttgtagaagcgtgccccctccatccccccgggtcggtcccaccgaatgggaggcgcctcgcaaggacgcggcgggggaggggaagggcggcacgggaggaagcgccccgaggagggtcagcggaacacaaagtccctctcgcg

SEQ ID NO: 726 - DNA, 6488 bp, Homo sapiens
gtgtacttaaacatacccctctactttttgtcgtttatttctatttataacaaactcttgtgttgagggctcttgatggacggcagcaagggagctgctctgctgcatatgaaaccccgacccagagcccctctactcatgcgatgtgtagttgacagccacttcacaaacattttcagctacagaaaatatattcaaggaagaatgttaaaaagtttccttataacctacaaggggttctctctagatgtaaacaaatctggatgaaatattttaatccaagtataccatttcccacgtcgtaaatcttctgggctggtgggagccaatccagttacacactggaaggggagtgagggtcccagggcttccccacacctcacaaggcccacccttgtttccactgaccctctctttgacctgaaacccccaattgcctccacaggcaaaacaaaactcaaatctctctagactcaaagacttaagactatgccaacctatttgtttgtaattacactgctcaaggctcctgtttcctctccttcagccattctccagagcgctcctcaagagattttaagtctctcacagccagactgtatttcccttggtcaagaagcaaccacggaatattctacctgcaggagataacaaatgttgactaatttatgtatgagaccattctatagtacttttgcagcgaattaccccctattctgaaggttaatgtttttccttctgatgatctagacggggtccacacactacagcattcagcccaaatccagcccatgagcagagaatcttttttaaaaacaatcctttaaaaatataaaaacctaagactatgtgacagagatcatatgtggcctgtaaagtctaaaatatttactgtttggctctttatccaaaactgctgatagtgcctctggacaagagcgtaaaagatgagtcatggcgtaagggaataactgagaggtcacgtagaaacctggtcagcctatgaggaaccttgaggcacgatgtttctttatcccagtaattcggcaactcgactccaagcacccaattttgtggatgaaccccaaggagtctgtcaactttcaaaatcacggcagctgtctgccacttgccagacttattttgggtgagtaataataaatagagaaataagtaatagttagaggttgtaataaaaagctatttaatgtttgatagacaaattgaagtccataaatctccttgaataaagatgctaaaaatgttattcttgttttttaaatagtttcgtttttacaaagttctgtacataaaaataaatatacagaaacaaaccccatcaactgtccacatcagtaatcctcactggtgggctcaccattgataaggaagacatcattcaacgcaacctgtcacagagactgtcctagcagcaaggatttctaacctcaaaagaacattactaggcctcttttatcaagattgctaatcatctagaggcctttacctaccaactagcaattaaccatgaaatcaatgaatgcaatcactgtctccaagtagaatgtgaccaatgacctcatgcctagaggcaacatctataccttttgctgactggagccctgacatatgcaggtgtagttaggaacagaaatcaaccccacctccccttggctagtcactgtgaaaagcgtgcgtaaggcaattgaatcgagggttaagggttcatcttgctaatgtcaaaagtgacactaacaagattcttagcctcatccgccagatgacgggcctctgcgtccaggtctccaggagcaagctccgcctccttcaccagacaacgggttataacctgggaggacagaaaagcagcacaacagtattgataaaaatctgaaaatctgggaacattgtatatccacaataaaattatgagagtgacacgcaaagcactgcaaagatacagatcctaagggacatttaaaaaaaccttttagctatgtgaaaaaaaaaaaaacctttatattgtgattgccatttgaactgattgtctggtggggaaaaaagtcattcagcttctttgtcccaacctccgaaacacatgcaaaagggtcaccaaaaaactctctcaagagggcctgatttaagtatatgaatcctcctatcacagtgcttactaaaactcatacattcaaataagggctgttcacgctacagaaaacagattaaaaaaaatcaagagtcaaacttgtcacttctaccagtcagaacggggtcttctgtatccttccctacccccaaccaccccactccctcatgagcttcccaaagtcagtgcacaactggtaacctggttgagtgctaaggttctagggccacccagaacttaaatgttacttttactccttacttatagtggaatctttgggcaattaaacactgtgcctcagtttccttatttgtaaagccaggctagtcaaaagtcccagctcagaaatgctggggatgctgaaagaggccgtgcaggcaagcacaccctgcattccatcttctacgatttccattcctctcctaaatatcacctctatgtgtctaaaaataagcttccggcaggaccatttaaaaatagcattttctttccagatgcatcaccttctctacagcaagccaggtttagtcttctgacacaaaggggattacagctcagcgtttaaggtcagccaagtctgtggccctgctgccttggagcccatgccccagtctttcctcagtcctcaaagacaccatcagggcctctgcggtgcccctctcctcctatggaggatacaaaatcttccgccttggttcctacagtgttctagtgtgtttgttctttccttcctcagcagtaacttgcaactcttagccagaatcaccaaggattgcttattttcgtttgtgagtcccatcttcccagatttgaaattctcagggatgggatgaagacagactgctgtggcatcatccagagtccccggggcagtgctgcacacaggaagcagctttggatgagcatctgtctgctactccttgttatttgcaagaaacaaggtggtcccagccagaaagaccaaaaccactgtgttccagctccttgacactcatctgaagattggcagacaattcctcaccctacttagctctccctctacggggctgcagaaggatcaagttagaatactataagtacaatccttctaagtacttagtgaggacctaggaggtgatttgcatctgtttcctttattgaatcttcacaatcctaaggaattagtcttaatttatggacaaagaaacaaacaatcttgttcctaaaaggtaactatatcctgtaagtgttgaaaatctgttaacatttgacatcagtggtgcttacctcctccccgcaaaggctttctgtccgatttccgtttcaggacagatgaagtggaaggcccaggactgtcttcctcctgtttgaacacacacagtagtgtaagaagcaattaaaacattctacttggcaatcttcatctaccgcatgccagccggccgaggtctccagtcacctggggcttctttgcatttcctttgtaactttttccttcttgcatgctgtcccacatttcaatcttctgtctccttttttcttcttcaagctgagaaacaatcacattttacagaaagaattcagaagctgccatttctctcaaagacaaagctaactctgataattcttaatttaaatgtctttcagaacaaacttcaccctcgttttctttagttaataaaactgttgtgatctggtagtgtgagtttaactcacatagagcagctttggtttttgtacactattaaagaaagcaaaatgtttcatgaaaaagattactgactccattcttctgaaactcactcctgtcaggacatttttggtaatggggaagacacaggcacatgcacacacacactcacatgctccctgctccagcctgtccctccttttgtgctctggacctttcatggtaatatattcacacatctagtgttccctaacaatcgtgtattcttcttgatatcaccaatacttacatggtaggaactgaaatgcttattgaatctaatgggataggacctggtcctagaagcttatagacaacacagacacaggcatcgttagccactaaacctcagacaatttctatgcacacattcaaactgaaaccagttcatacttgtttcagtttttccttatgcttttcaacttgcgcatttagttcttcttgcattttcagtcgagcagctgctaaagcttcttgtcgtttaacaacaacatcaggttctaaaatgtcagaaaaaaatggagataaagcactgtgtacaatataaaatagaaacttttgagtgtccatattattaaaagtataaagaggtatggatatcagacaatgaaacaacatatttttacataagtactcctaacccctctgcatacattttactgcttcagggggcaggggtctgttgctgagccacggattttagcccgaaatatctacatcaccagaaatctgttagaaatgccaatttctgagttcccctgagcaattccgattcataaagcctgggatagtggccacacagagcacatcttggatacctcagtgacacccacagtctctaggctgactagaatcctggaagactaccaaggaaatataaagttttctaaatcattatccatcccttaattagcgcagaagattcttaagtatttgtttctacagaaaagaaaaatccttccaaatagcattatgaatagaaatgaactcatttctattcataacgtctactcatagagtctcgctctttgcaacaaggctagactccatctcatagaaaaaaaaaaaaaaaagaaagaaaagacagtctcactctgttgcccaggctggagtgcagtggcacaatctcagctcactgcaatctccagctcccaggttcaagcgatttctcctgcctcagccaccctaatagctgggattacaggtgcccgtcaccacgccccactaatatttgtatttttagtagagacagggtttcaccatgttggccaggctgttctcgaacccctgacctcaagtcatcctcctgcctcggcttcccaaagtgctgggattacaggtgtgagccaccgcgccccaccgagaaccatatacttcctactttttttttttttttttttttaaagacaaggtctcaatcaattgcccaggctggagtgtagtgtggcccgagcatagcccactgcagctttgactccctggactcaagtgattatcccgcctcagcctcctgagcagctgggactacaggtgcgtgccgccactcccggctattttttttttttttaaatagagacagggtcttcctgtgtggcccctcttacttttactaagagactaactcttaatataaaggaggtgcaaaaccaccgctttcatttcggttatcaggcactaacccacagcagccgcagctcggtccagctgcctctgcctcaaggctcttagccgggcggaaagcttctgaaagaccacgtagagaaggatgcagctgaagacgatgtaccagccataggtggccagcagggagcccactgaaaagaaaaacagttttcaaaaaactaaaaatgacactactagttgacctttccataagactcaacaaacacaaagtgtaactcctgccctcaaagccttcatggtctaggctgaggaaaaagcctcctaagtagatcgttaaaacacgaactcaagaagtgcgacaattcagggatcactgagaagtgagacttcccaaccatctggggagtcgggggcagttagagtgtggagggcacagcaactgggttttgaagaatgaagagcaactaatctgaatcaggaaggcaaaggcctttcagagccacatagaaaggggtgacagcgcggggagtcaggagtgtgtatggggctgtgtgggacgggtcccagaggcaaacgccaacggccgagtgaccccagtaactaccacaggaagggcttggttcgcaaaaaagacttgcgcaaacaagggacagccgagccgcccagggaagtgcggctcccgagaagcctccgcgcaaggtccgggcctgctgcccaaggtccgcgtaagcgccaacgcccgaccgttcccaggcctcccaggctccggcgcccggtgcagcggcggacgacccacccatcatggctgcgcgtcgcaaaagtggcggcgcgcgcccggctgccccgcaacgactcacccgtggtgtgcaggaagcgcagcccctcggtctccagggccggccgcgcggacagagactcctcttggcgttccatgaccgccgccgccgccgccgcccagccctgccgccgcgcctccagccgggcgcttccggtgcgctcctacgcacacgt

SEQ ID NO: 727 - DNA, 5312 bp, Homo sapiens
atagttagaggttgtaataaaaagctatttaatgtttgatagacaaattgaagtccataaatctccttgaataaagatgctaaaaatgttattcttgttttttaaatagtttcgtttttacaaagttctgtacataaaaataaatatacagaaacaaaccccatcaactgtccacatcagtaatcctcactggtgggctcaccattgataaggaagacatcattcaacgcaacctgtcacagagactgtcctagcagcaaggatttctaacctcaaaagaacattactaggcctcttttatcaagattgctaatcatctagaggcctttacctaccaactagcaattaaccatgaaatcaatgaatgcaatcactgtctccaagtagaatgtgaccaatgacctcatgcctagaggcaacatctataccttttgctgactggagccctgacatatgcaggtgtagttaggaacagaaatcaaccccacctccccttggctagtcactgtgaaaagcgtgcgtaaggcaattgaatcgagggttaagggttcatcttgctaatgtcaaaagtgacactaacaagattcttagcctcatccgccagatgacgggcctctgcgtccaggtctccaggagcaagctccgcctccttcaccagacaacgggttataacctgggaggacagaaaagcagcacaacagtattgataaaaatctgaaaatctgggaacattgtatatccacaataaaattatgagagtgacacgcaaagcactgcaaagatacagatcctaagggacatttaaaaaaaccttttagctatgtgaaaaaaaaaaaaacctttatattgtgattgccatttgaactgattgtctggtggggaaaaaagtcattcagcttctttgtcccaacctccgaaacacatgcaaaagggtcaccaaaaaactctctcaagagggcctgatttaagtatatgaatcctcctatcacagtgcttactaaaactcatacattcaaataagggctgttcacgctacagaaaacagattaaaaaaaatcaagagtcaaacttgtcacttctaccagtcagaacggggtcttctgtatccttccctacccccaaccaccccactccctcatgagcttcccaaagtcagtgcacaactggtaacctggttgagtgctaaggttctagggccacccagaacttaaatgttacttttactccttacttatagtggaatctttgggcaattaaacactgtgcctcagtttccttatttgtaaagccaggctagtcaaaagtcccagctcagaaatgctggggatgctgaaagaggccgtgcaggcaagcacaccctgcattccatcttctacgatttccattcctctcctaaatatcacctctatgtgtctaaaaataagcttccggcaggaccatttaaaaatagcattttctttccagatgcatcaccttctctacagcaagccaggtttagtcttctgacacaaaggggattacagctcagcgtttaaggtcagccaagtctgtggccctgctgccttggagcccatgccccagtctttcctcagtcctcaaagacaccatcagggcctctgcggtgcccctctcctcctatggaggatacaaaatcttccgccttggttcctacagtgttctagtgtgtttgttctttccttcctcagcagtaacttgcaactcttagccagaatcaccaaggattgcttattttcgtttgtgagtcccatcttcccagatttgaaattctcagggatgggatgaagacagactgctgtggcatcatccagagtccccggggcagtgctgcacacaggaagcagctttggatgagcatctgtctgctactccttgttatttgcaagaaacaaggtggtcccagccagaaagaccaaaaccactgtgttccagctccttgacactcatctgaagattggcagacaattcctcaccctacttagctctccctctacggggctgcagaaggatcaagttagaatactataagtacaatccttctaagtacttagtgaggacctaggaggtgatttgcatctgtttcctttattgaatcttcacaatcctaaggaattagtcttaatttatggacaaagaaacaaacaatcttgttcctaaaaggtaactatatcctgtaagtgttgaaaatctgttaacatttgacatcagtggtgcttacctcctccccgcaaaggctttctgtccgatttccgtttcaggacagatgaagtggaaggcccaggactgtcttcctcctgtttgaacacacacagtagtgtaagaagcaattaaaacattctacttggcaatcttcatctaccgcatgccagccggccgaggtctccagtcacctggggcttctttgcatttcctttgtaactttttccttcttgcatgctgtcccacatttcaatcttctgtctccttttttcttcttcaagctgagaaacaatcacattttacagaaagaattcagaagctgccatttctctcaaagacaaagctaactctgataattcttaatttaaatgtctttcagaacaaacttcaccctcgttttctttagttaataaaactgttgtgatctggtagtgtgagtttaactcacatagagcagctttggtttttgtacactattaaagaaagcaaaatgtttcatgaaaaagattactgactccattcttctgaaactcactcctgtcaggacatttttggtaatggggaagacacaggcacatgcacacacacactcacatgctccctgctccagcctgtccctccttttgtgctctggacctttcatggtaatatattcacacatctagtgttccctaacaatcgtgtattcttcttgatatcaccaatacttacatggtaggaactgaaatgcttattgaatctaatgggataggacctggtcctagaagcttatagacaacacagacacaggcatcgttagccactaaacctcagacaatttctatgcacacattcaaactgaaaccagttcatacttgtttcagtttttccttatgcttttcaacttgcgcatttagttcttcttgcattttcagtcgagcagctgctaaagcttcttgtcgtttaacaacaacatcaggttctaaaatgtcagaaaaaaatggagataaagcactgtgtacaatataaaatagaaacttttgagtgtccatattattaaaagtataaagaggtatggatatcagacaatgaaacaacatatttttacataagtactcctaacccctctgcatacattttactgcttcagggggcaggggtctgttgctgagccacggattttagcccgaaatatctacatcaccagaaatctgttagaaatgccaatttctgagttcccctgagcaattccgattcataaagcctgggatagtggccacacagagcacatcttggatacctcagtgacacccacagtctctaggctgactagaatcctggaagactaccaaggaaatataaagttttctaaatcattatccatcccttaattagcgcagaagattcttaagtatttgtttctacagaaaagaaaaatccttccaaatagcattatgaatagaaatgaactcatttctattcataacgtctactcatagagtctcgctctttgcaacaaggctagactccatctcatagaaaaaaaaaaaaaaaagaaagaaaagacagtctcactctgttgcccaggctggagtgcagtggcacaatctcagctcactgcaatctccagctcccaggttcaagcgatttctcctgcctcagccaccctaatagctgggattacaggtgcccgtcaccacgccccactaatatttgtatttttagtagagacagggtttcaccatgttggccaggctgttctcgaacccctgacctcaagtcatcctcctgcctcggcttcccaaagtgctgggattacaggtgtgagccaccgcgccccaccgagaaccatatacttcctactttttttttttttttttttttaaagacaaggtctcaatcaattgcccaggctggagtgtagtgtggcccgagcatagcccactgcagctttgactccctggactcaagtgattatcccgcctcagcctcctgagcagctgggactacaggtgcgtgccgccactcccggctattttttttttttttaaatagagacagggtcttcctgtgtggcccctcttacttttactaagagactaactcttaatataaaggaggtgcaaaaccaccgctttcatttcggttatcaggcactaacccacagcagccgcagctcggtccagctgcctctgcctcaaggctcttagccgggcggaaagcttctgaaagaccacgtagagaaggatgcagctgaagacgatgtaccagccataggtggccagcagggagcccactgaaaagaaaaacagttttcaaaaaactaaaaatgacactactagttgacctttccataagactcaacaaacacaaagtgtaactcctgccctcaaagccttcatggtctaggctgaggaaaaagcctcctaagtagatcgttaaaacacgaactcaagaagtgcgacaattcagggatcactgagaagtgagacttcccaaccatctggggagtcgggggcagttagagtgtggagggcacagcaactgggttttgaagaatgaagagcaactaatctgaatcaggaaggcaaaggcctttcagagccacatagaaaggggtgacagcgcggggagtcaggagtgtgtatggggctgtgtgggacgggtcccagaggcaaacgccaacggccgagtgaccccagtaactaccacaggaagggcttggttcgcaaaaaagacttgcgcaaacaagggacagccgagccgcccagggaagtgcggctcccgagaagcctccgcgcaaggtccgggcctgctgcccaaggtccgcgtaagcgccaacgcccgaccgttcccaggcctcccaggctccggcgcccggtgcagcggcggacgacccacccatcatggctgcgcgtcgcaaaagtggcggcgcgcgcccggctgccccgcaacgactcacccgtggtgtgcaggaagcgcagcccctcggtctccagggccggccgcgcggacagagactcctcttggcgttccatgaccgccgccgccgccgccgcccagccctgccgccgcgcctccagccgggcgcttccggtgcgctcctacgcacacgt

SEQ ID NO: 728 - DNA, 29779 bp, Homo sapiens
agctggttgggacccgggaaggcctccctcttaaggtctttcccacacctctgcaccttgttacctgactttcggcttcaggatccgcagcgtgcacccgcgttccgtgagtgccctataggcagtcagcatgcccctctgcgtgtccctgtgttacggggacgccggctgggagccgcagagctatctcagaactagggcgctctcctttgggcacctccaggccattttcctttcattcgagcccacagggttagagataaaccctcactccgttgcttggggacaagggcttcactccctgtcccgagcttgcggctgagcttgagggtggctgggtcatcctggccccccactggatgggaattggctgctctggtgatttctgtgacatcccagaccccaactgtggggctctggagcggactgcgcttcacttcgtggggagggtgtttccacctaggccactcttatttctcttcacatccccagatctgtcttctgagactttgcccttctccaggaagagcactcaggagaccaggaaaatggccacagggctcctgagagccaaaaaagaggtgagaattaactgtaattctatcttggctgtcaacagaatgggtcccattaccttttcttgtcctggaggctgccttgttggtattgggcaaagtcattcctagccctagtcattcctagtccatagaacaaggaggattttgatatagtcttgtagagcgtccgattctgtcgctgttcagggcgccacttgtaacctgcacggacctggtggactgaacaaaaggaataaaagacaagaaacaaaaaagtatatttggaagaaggggtcgggggcactttgtctctagtggacaagggccctgagctttacacaaccctcccgtatttattggtaaaacagataacaagttagggggtggtgattgtcaggtaattgtcagttggccgtttggttcgcaattgcaagactgcatccttccaacaataggcgctagatttcctggtagatcacttcaaggagccaggcgccaggcagtgatggctctcagcacatcttttggtggcagtgtgcgtttgctcacatcctgcattcatgataaacagtttaccgtttaatcatataacctccagtggaatgctgagttggtcacaatccctttggtcttttcggctccaaacatagtctgacctgaattttacctttgagttcattcctagtcctggaagagtgcctcgttctaacaggagtcttccctcagcattcctttctgctccatccttaccgcagtcactcatgaagtagttaattgtgaacaacacatatggagcagtttaaataaaagtaaagagacatacatgcgtaattgttcagtgatgtggatgaagggcagggacagcacagatgcctgtgatttcaaatggttagggaggcctcctagaagtagggctgtctcaattgcccctgactggtttgttaagttggagattggggggaaggcattccagtgggaggcggcaaggaagcatagatagtttcagaggctggactctcagtgtggaaggattatggtggccagtggacttgcttaagattgaattttttttttttttttttttgagaccgagtctcactctgtcatccaggctggagtgcagtggcgccatctcggctcgctgcagactctgcctcccaggttcacaccattcttctgcctcagcctcctgagtagctgggactacaggcgcttgccaccatgccaggctaattttttgtatttttagtagagacggggtttcaccgtgtcagccaggatggtctcgatctcctgacctcatgatccacccacctcggcctcccaaagtgctgggattacaagtgagattacaccacacccggctacctatgcatatttaaaaatcaaccttggccaggcgtggtggctcaggcctgtaatcccagcactgtgggaggctgaggcaggcgaatcacgaggtcaggagatggagaccatcctggctgacacggtgaaaccctgtctctactaaaaatacaagaaattagctgggcatggtggcaagcgcctgtagtcccagctactcgggaggctgaggcaggagaatcgcttgaacctgggaagcgggggttgcagtgagctgagatcgcaccactgcactccagcccgggcaacagagtgagactccatctcaaaataaataaataaataaatatacatatgttaagatacagactatctattcacacatagaacaaggagaatttcgatatagtctgacctgaattttacatttgagagcactttcagcttctggcaattgggacatttccaaaattccagattccctgcttctctgaaaataaatctgccctaaatctgcactgttctttggtgtcagacaatttgagctgaacaacgtctttatcatttggacgtgaccttcagagtatcagctgcactttctgcagtgtcctttatactgaggttgaaaccattgactacctaacatttcacccccctctcatttttattacctacctgacccctgaagggtttgccttttccacctctcggtcagggtggggacaaatcagaaaatgctgagtgccaggctgagcagggtagactttgtctttgagtaagctgagttttgaaggatgttaagaagggacttgacataaggaagtcaatggtatgtgggaaatagtgattgactgtgtataaggacttaaggggaagcgttcttcttttttttgaaacggattctcggtctgtcttccgggctggtgcgatctcagctcactgcaccctctgcctcccaggttcaaacgattctcctgtcccagcctcccgagtagctgggattacaggtggcgccaccaggcccagctaatcttttgtatctttagtagagacgggatttcaccatgtttgccaggctggtcttgaactcctgacctggtggtccgcctgcctcggcctcctaaagtgctgggattacaggtgtgagccacagcccccggccgaggggaagcttttctaagccctgagattggtgacgatgatgcccctgacttaattgaatgcaattaacattcattaagcaccaacacagttgccaggctgtttaacagtcatttttgatatgggttaacttggttatttcagatttgccttgactatccttatcaagaaatctgagtggaatttagacaggaaaagagatttcttaattctggactccagtggtggggattatgcattcctggatgttatcagagcaacactgagaattctgtttctcatttctaaaatagttaattcatttgagagtgttaataccaggaatacataagaaatccaattcaggacatttcccaaggtaacattgaatattttttgtgcgtactttctcttttctttgaggcggagtcatgctctgtcacccaggctgcagtgcagtggcacgatcttggcttactgcagtctccgcctcctgggttcaagcgattctcctgcctcagcctcccgagtagctgggattacaggtgcatgccaccacgcccggctaatttttatgtttttagtagagatggggtttcgccatgttggccaggctggtttcaaactcctgacctcaggtgttccacccacctctgcctcccaaagtgctgggattacaggtgtgagccactgcacccagcctttttgtgtgtactttcttcaccactcccagtgttaccagggaagcattctttctgattggctgggaaaagtcagaagtttgtggtagctgacttttcctgtgccacctccttcattctcagtaggtctacccggaactgcctcctgtatataaacaacttgttcttcaatgtagctttttaacatagtatttactcaggaaaaattaaagggcatgagcatttaaatagttgtttaagatgaaacctctgtgtctctcatgcctagcacacatgaaatgtttggtgcatgaaggaatcacaaccttaagtaaacgatttgaaggaactaagtaacaaaggagtttctgttgtttgctttggtttgttattttgggcatgtggttaatcacatgtttcaggagcgttgggtagaatttccagatactcttgatatgcatggcatctgaattatacaaaataatcaaagcaagactatcttaggacattaggtattactgccaaggacctttgcctgagaggataaattaaaatttgtgttaaatttgtaacaatgagatgaactggcaggcacattatgttattttttttcttagcatttttccttttccttggtgccatacaacaaacttgagtgtctgctatgtgcagaacactcagtagattacagttaatgatgggtaaaacacagtctgcacactcaggagtcttccattttattttaggattcctttctcatttggatttaatttaattttatatgcgctcacacccctgcaaacatattttgacaggccctaatggtaaaatcataatggagtaaagttactggcagtgtatctacccagctctatttttaaaggtgtagaaacagccaacacttatcccactgaaaataatttccatagtaatccattgaatggatgaactcatccattgtttcccaatttttggactcctgtttccaatgtttaactgttgcaaataatacttctatgatcagctttgtacatgaaattcttatataggtttttattctcatacaaaatatgacaaggtgaatagacatgactgttttgaagcattgggcacccacagcagttggagatttgaaccctgccagttttttttttttttttttttgagacagagtctcgctctgtcactctgtcccactgcatcaggctgggatgcagtggtgcaatcgatctcgcctcactgcaacctctgcctcccaggttcgagcaattctcttgcctcagcctcttgagtagctgggattacaggtgcccgccaccacaccaggctaatttttgtatttttagtagagacagggtttcaccatattggccaggctggtctcaaactcctgacctcaagtgacccacctgccttggcctcccaaagtgctggaattacaggcatgagcaccgcggctggccctgaaccctgccagttctaaagaatttgaacttccaattacttctttcttttctgagactcccttcttcaccatgtgtttctttatactgtgcaatttttattttattttattcatttattattattattatttttgagatggagtttcattcttgttgcccaggctggagtgcaatggcatgatctcagctcactgcaacctccgcctcccaggttcaagtgattctcctgcctcagcctcccaagtagctggaattacaggcatgtgccaccgtgcccagttcattttgtatttttagtagagatggggtttcaccatgttggtcagattggtcttgaactcctgacctctggtgaactacccgcctcggcctcccaaagtgctgggattacaggtgtgagccaccacgcccagccctactgtacaacttttatttgcttttattttaattattacactgtgcagattttgattaccggggtagacctgccaacttaggtctctttcttctctcacatgaaagctcacatagtatcctgatttgtttccaaatgttgacatggtcctttgccacccactacatgtttctgtaatcctcgttttccccaacattgcagtaacatcacttttcagaaacctttagtgcctcatttcagtgtcttagatatttaggacagtcttcatttcaaatattgtatcctgttgtctgatgtcatgttctgattattcagtctgaaagtgtgtttattgttaccacaggggagtcatcttatgtgtacttttttttttttttttttttttgagacggagtctggccctgtcgcccaggctggagtgcagtgtcacgatctcagctcactgcaagctccgcctcctgggttcacgccattctcctgcctcagcctcccgagtagctgggactacaggtgccgaccaccacgcccggctaattttttgtattgttagtagagacggggtgtcaccttgtcagccaggatggtctcgatctcctgacctcatgatctatccacctcggcctcccaaagtcctgggattacaggcgtgagccaccgcgtctggccttgtgtacttttaacttagatacatttactttttatccactcagctgaaaaaagaggagaaaaataaaagtaggtcaggtcaatctgtttcctttcccatttaatgaattcatgcccaggagtgagtgagaaatgggaggactgaatctgctgttctccaagactagcttaggagtttctgacatcatgggcatcccagcaagccaacggtcacattagtcaccacgtatttttcatatcacgtgatccctctatcagtgtatcagcctttgctgtataatgaacaatcctaaacatcaatggcttaaaacaaaatcacttattagcacataatttggtaggttcatattttgggctggccgcaggtaggttttgcagatttcacctggtcttgtcattttgctgcagtcggctggcattttgaccagggctggaggactatccatgtgtgacaggaagctggttggctggggtgcctagtttcttcttggttctcttccatgtgggcttgggcttggtcaaatggtcttgggtttctctatgcaggaagagaggacagccccaattaacaagtagttttaacgttttggcttttgtcatgttcactgatgtccttttggccaaaggaagtcacatggccaagtccagagtcgtcatagaacgggataacataagggagtagatacagggagacatgatttattggtcccaatgattcatacccttaccatgtgcaagattaactcacccccctcccaagatccccaaaagtttcatcttgattcaaaagtccagtatcttatgtgtaacagtctggatgtagctaaagcttcttcactggatcctttttgagtcagatacctgtatactaaaaaggcaagtcatttgtttccctccaccccaaacattccctacctaacatacagtggtgagagagagatactgcagtagatgctcccattcagaaaggacaggaattaagcatagaggaggcctctccattttgaactgtttcagatcctttggacttccttgaaagctctatgggtttcccatgtaccagatttgggactgctctattaaacaaaagctgaaatcacagtcagacaggcctcacatctttggcaaggtgtcggtgctatgggacaatgcccataagaatctcagaagcctttttgtccagcgtggagactccactaggcatccccttaacacttcagaggttctaaagtttgggtcttttagccaaacttttgattcgaactttactctgagtttatttttttattttgagacatgtgctggctggagagactgaagatgtaaaataattttatttccaagctagcaagtcctgacttgtctatatttcctctgaattacgcttgcaagctgtataattgcttcttcagctcttctgtttctggacattattatatgtcactagaaacatccaactgaattttttttttttttttttttgagatgaagtttcactcttgttgcccaggctggagtgcaatggagcgatatcggctcactgcaacctccacctcccaggttcaagcaattctcctgcctcagcctcccgagtagctgggattacaggcatgcgccaccacacctgggtaattttgtatttttagtagagacggggtttctccatgttggtcaggctggtctcaaactcccaaccttgggtgatgcgcctgcctcggcctcccaaagtgttgggattacaaatgtgagccaccacgcctggcccaagtgaaacttttaacaggctttttggagatctctttagctagatccaaaaattcatcaggtatattttctgttttccaagttcatgcaggcaatagctttgctaatatataatactagttgccttgttcaagctgccatatcagtttcatcactcctttcccagtccccactagcagtttgtttactggttttccagcctgtgctaatagttttcctggatgctttccaagcctctgcccatgtcctgctcccaaagctaatgccacatgttttaggtattttgttatggcagcacttcacttctgtgtaccaacttagtggcctaaagaacatagcggcttaggcctggtacagtggctctcacctgtaatcccaacactttgggaggccgaggcgggcggatcatgaggtcaggagttcgagaccagcctggccaacatagtgaaaccccgtctctactaaaaatacaaaaattagccgggtgtggtggtacacacctgtagtcccagctacttgggaggctgaggcgggagcaggagaatcgcttgaacccaggaggcagaggttgcagtgagccgagaccacgtcattgcactccagcctaggtgtcagagtgagactatctccaaaaaataaagaataaataaaataaaaccaaaaaaaaaaaaaaaccaaacaaacttagcagcttaaaatgaaatcattttttcaaaatcctgtgggtcagcaagtaggcccggcatggctgagctgatcctcttggcatcctcatgtggctgtagttagctggctgctcagctacagctggatggtctcaacctgtctggtggttgacagcttggttggctgggatgcttcaattcctggttcttctccatgtggcctcttcagcaggcaagctcaggttattcacatggtggtctcaaggtttcttgcacagcgagaaggccagccctgaactcagatgcctctcaaacatctgcttgcatcatgtttgctggtgtcccactggataaagcaggtcccatggccaagcccagggttaatttaggaggagactgcatgaagggtagaaacagggaggcatgattcactggggccatcactgtacccatccactggttagatacaatgcttttggccgcaagcaacagtaaacctaatttaggctgttctaaacaataagtaacttagcctatataaaaagaagttcacagagagagtgcactttggggttggtccttcagctccataagcttcccaaggactggggtgctttcatctctgcagtctaccctgttctctacagtgtcagcctcatccaggctggttcccctcaaagccataggatgtctgccaatagcaactttgtttaattctcacaatggccccataaggtaagtactattataatatcgattttataggaaattgagacacagatattaagatatcaacgcaaagtcataggggagggaggagagaggggactgtaatttgaacacagtttgtctccagagtttgtgcttttagccactgagtagttgttaaactttagtgtgcatcagaattacttggaagccttgttcaaacattgctgggctccccccgcaatttctgattcagtagccctaggatggggactgagaatttttatttctaacaagttcccaggggatgctggtgctgcaggttcagggaacacacattgagccagtgcactaagccctgctgcctcttttgggtaatctgtgcccatgtttctgagcatcaggaaaagtgcttaattcctgtgactccatcttacaaatgacgaagtcttttgctagaatcctacggtaaggcttcttgtggcctgttggttaccattcatttttcatatatttatttttcagctggcaagcagatgaattaactcccccaagcttctagctgtgtttctactcagtgggagagatttggagtgaatcatgagggtcaaccacacagtgtctacaatgctccctacatgcatggttcacagacaaaccatgagttgttccggggctggaggaataacggttgtattaaatgtgttaaagtaacactaattgctctgtgatgtagctccttcgtgggagattttcaaggggtgtatgtgtgtatgttctgagaaggggttgtaaaagcaaatcacaacagggactaggcagatacctgaatagcctttttctctccagtgtttaatgatgaacagtttcagacatatggaaaaaaccaggaagccttgtacattgaacactcacatacccatcacctagattctcagtgagtacctccttctcatgaacttttcctgatcctcaatcctacagtgacctctccctcttgagattactctgacccagtgattcacaaccatcacactacttttaggagcctttgaaagtacaaaagccccatcccctggttttacggatttgtggtgggactcaagaatccataatttaaaacaccacccaggtagctctaaaatatagccagagagagatgaggtatgagaaccaaagccctcactcatctgtgctcttctcttgcgattaagtacattgggactggctgggtttggggacagctatcgatataactgagtgtaggtagagtcttaaggccatttcatagtccagccagtgtagaatagtggagctggtaggggacaggaaatgtagggaggattccctgggaagggtacagtgtggaattagttttagagacacaatgtcataccctcaaggagtgatggaggcattctgagaaggggatgcaaaatcaaagagacaaggcatgtacctaaatgaatgacgctggtgaggcagtctccaatagtgtgttgcggctgatagacccccagcatgagtcaccgtcagccaactgtggtcctacagcagtgcaaagcccagggtggtcagatttatggatttttaacataacccatagattgagattttcatatgaaatcttccaacatttaattgatataaacacaagttttaaagcagtatatgggtcaaattaaacccctctatggactgcagattgtacctaaagagaataagtgttgggcagggaagaatcccagtgctagatttccagactcatttggaaatctcaccgaacttccatgccaaggacggttatatattcccatcctccaaagtacagctttctaggtagcagaggttcgtttgaaactttgttgcttgtctaataataataaatcatttttggttatttaaaaatatttgactgctaagtgtttgcagattctgttgtagacaccagggcaatcacagtgatccagccatgcacatggaactgatgtcttagtgggaagtcagaaaatagaaatgaatataatgtattatcttagagttaaggcaacacaataaagcaggagaggggaatgaaacccgcatgagagcatggaattttacatagaacggccagggactgcactgggcattttgtctgagcccttcacagtaatcctaatcctcaccacaagctgtgagataagcactgttatttttagttcgcaggagaaactgacgtgctgagcagctaattcagtgcctgaggttacactagttgtggacagagatgggttccaaatccagatagtatgggttgaatccacgctcttcatcaccacccactttccctccttaggcctgagcaggcacgtggcagcatttggtagaggaaggagtgagccctgctgtaggaactatatatattggtgagttatttgcccccaagccccagaggcaccactgcttcaagtagaacaaatagtgagaccaagtagtctcagaaaattttcaaactcagcaagataattctttactatttagttgtacttgtgtggtgtcttcttctccctgcctagttttgaaacgccctctaggtaagggctttggttttgtttgctcttatcctccctagcagctagcctgggatattgacagtaagtaacaggtgcataaatgatgctggctcggcagagataggagaataatggtctttcactccttggtgccaaggtcacaatccaaagtagggtctagaaatctttcctacttccctcagggaagccttttgacctctcattctttttttttttttttgagacagagttttgctcttgttgcccaggctggagtgcaatggcgcaatctcggcttaccgcaagtaactgggattacaggcatgcgccaccacacctgactaattttgtatttttagtagagacggggtttctccatattggtcaggctgatctcaaactctcgacctcaggtgatccgcccaccttggcctcccaaagtgctgggattacaggcatgaaccaccgggcctggccttgacctctcattctaaagtgtgggagggaaagacaggctcctgggtgagcagaggtgtgttttgtgttaaaggcgttcgtggcattcagggatgtggctgtgtacttcacccaggaggagtggaggttgttgagccctgctcagaggaccctgcacagggaggtgatgctggagacttataaccatctggtctcactgggtaagaatggcctcccttggcacttaaaatctgccctacagagtattttccactcatcgtgaggaagggctacctgcagagcacctttcccttagagttgagcttgaaaacaatttacttttttcctctgggtaaatctggatttagtagaattgaaagcagacagattgatttattcatgttatggatgacactacatttccaggcctgtttcccaaggcttgtgctctctctttattttgcttcaaacccaggaaatttttcatacaccaagtgttcataatatgccatctttctgactggagtcacctttccttagtcaacccttctacttcagagagagaactattcataggtcttttttatcctctgggtttcctcacccatttcagctctgagttctagaatgccctcttgagcccataaccaacaatgtcctcattttcttccctatgaacagaaattccatcttctaaaccaaaactcattgctcagctggagcgaggggaagcgccctggagagaggagagaaaatgtccactggacctctgtccaggtgagtgttgagtgtggggtagacgggataatccacagcttggcagataggaaggaggaggcatctctcagatactgggaagaagctcttcttcaggcctcctaagccaagagaaacgttgcctgacatggtcttctttccggaacataatcttcagttgagggagggacttccctggttcccttgtctcttccctacaccaggaagcctcccttcctcatttgtcttctccgtaatgcttagtctttcctcattcactgtcttctttctcacctgatcttaaaaattgcatctacccatgaatgttaagtctacgacacttctagatactttctagctactcttatgctaagattaattgattaactccacctctccaattcccataacttattacacaatacttaagctatgactaataataaaatacatactcatgtgccaatgtcccagcttaagaaataaaaaatgacctaaacagtcgaaacccctatttccccttccctgatggtatcctctacccatccctccaatggaattgtttttcagtattagggatttgtaattctcatgcatggctttatcatttccttcatatgtatgaatcgctaaatcatctatattgttgtttggcatattttaaaactttatatcaatgtcatcatattatgtatgtattttgttttcttccctgagactaattttgtactatgttggtatatgtagctctgcttcattcatttttgtggctatataatattgtattttatgcataattataatacaattcatttatccattccatttttgttggacagttacagttctaacagtgtattcttttgacccactaaagaatgttgctgtgaaccttctcatagatatgtccttgggcacataagcacccgtttatctaggatatgtacctaggaataggacagctgagtaaaagaatatgcacctggtcagtctgacaaggtaatgccaaactattctccaaagttgttgtattagtgttctagggctgccacaacaaagtaccacaaactgagtggcttaaacaacagaagtttattttctcacagttctggaggctagaagtagagatgaaggtgttggtagggttggttccttttgagggttgtgaggaagaatctgtcccatgcctctcctctagcttctggaggtttgctggcaatccatggcgtggaggagcagagtcccagtctctgccttcatcttcatatagcattctccctgtgtgtgtgtctctgtgtccaaattttccttgtttgtaaggacattattcatactggattaggacccactctaatgacctcatcttaactaattacatctgcaacaaccctgtttccaaataagttcatcttttgagatattaggggtttggactccaatatgtcattttttggggaaacagaactcaacctatagcaattgcttacactcacatagcattttattgtttgaggattctagttgccctacatccttcctaatactttgtgtggtcagactttaggttttgatcatcttttgggtatgaaatggcctctcatagtagttgtaatttgattagttttgagtttgagcatctttttatatgttcattccttgactggccttggtgtttgctcttctgtgaagccttttcaattcttttgcttttcttcttgttgatttgaatttgaatttttaaaaataaatcattgaggtgaactctttatcagatgttccaatctgtggcctacctccttgctttttttatttttttttattgagatggagtcttgctctgtcacccagccaggagtgcagtggcatgatctcagctcacagcaacctctgcctcccaggttcaagcgatcctgctgtctcagcctcctgaatagcggggactacaggcgtgtgccaccatgcctggctggtttttgtatttttagtagagacggggtttcaccatgttggccaggctggtcttgaactgctgacctgaagtgatccacctgccttggtctcccaaaatgctgggattacagacgtgagccaccacgcccggcccccactggcctttttttttttttttttttaatacagagtctcgctttgttgccaggctggagtgcaaaggcgcaatctcggctcactgcaacctccgcctatcaggttcaaggattacagacgtgagccaccacgcccggcccccactggccttttttttttttttttttttttttaatacagagtctcgctctgttgccaggctggagtgcaaaggcgcaatctcggctcactgcaacctccgcctatcaggttcaagcaattctcctgcctcagcctcccgagtagctgggactacatgcatgccaccacgcccggctaacttttttgtatttttagtgttagccaggatggtctccatctcctgacctcatgatccgcccacctcagcctcccaaagtgctgggattacaggcgtgagccactttacctgatgccctgcttgctatttaaacaaactgtgaaataatttgtctcaatttataaaaataatacagagagtttccatttactcttcaccctgctttccccaatgataatatcttatataaccacagtacatttcaaaaccaggtaactgacattggtacagtactattgagtaaactaaagactttattcagattcagatttcatcagtttttgcatgtactcttttttttaattgttgctctatagtagtatgaaatttcattacataaataagatttatgtagccaccatcaccacaataaagatgtagaactcttctatcactacaaagaaaactctcctgtgctatcttccctccaatcttaacccctggcaactactgatctgttccccatcactataattctttttgcttttttttttttttttttttttgagacagaattttgttcttgtcccccaggctggagtgcagtggtgcaatcccagctcactgcaacctcggcctactggactcaagcgattctcctgcctcagcctcctgagtagctgggactacaggcatgtgccaccatgcctggctaattttgtatttttagtagagacggggtttcaccatgttggccaacctagtctcgaactcctgacctcaggtgatccacccacctcggcctcccaaagtgctgggattacaggcgtgaaccacttgtgcccagcctcaaattttatttctactaaaatatataattattcttatgctacatttcttcatgtgtcagtctttttaaatttgtgtattttaattaatttgtccacttaacctcagcagttaaatttgttggcataatgttcataatattcccaaatttctttaaaagtgtgtatatttctctagtggtgcttcctctttcattccccatattgtgatttaaaacattttgggggtattttatctaaaggtttattaattttatggatttttgcaaagagtcaacttttggtttcattgattttctgtagtattaatctatatcccatttaagtgatttttatttgtatctttttctgcattctactttctttgggtttaatttcctcttcttcttacttcctgaggtagaagcttaggtcattggtatagaccttcttttctaatacaatcacatatatatctgtacatttatttctaagccttgctttagctgaatcctacaacttttggtgtgttgtgttttctttatcatttagttcatgatattttctaattttcttattttttaacctattggttgtttagaagtgagctgcttaatttccagatattcaggtattttctaaatgttttatttttattggttttcaatttaattgtattttgttgagagaatgtattctgtatattttcaatctttcaaagtctgttgagattaattttatggcacagcatatgatctatttttgtgaacatcctatgagctcttaaaaggaatgtgtattctgcagttgttgagggtactatcctataaatgtcagataggtcatattggtaatatttttcagatgattgatatccttactgagtttttgatcttatttttctatccattactgcaaaggtgtgttaacatatcattgtggatttgtctatgtctctgtagtgatctctaaggttttgattcatacagttagtaattttgctatgaggcacatgtacattaataattgttacgtcttcttattgacctttttatcattatggaatttcctcctttgttttttagcaataccgcttgtcttcaggtctgttatctgatattaatatagctactccaggcttttttttttttgagacagagttttgcttttgttgcccaggctggagtgcagtggcactttctcgggcgtggcttggagatgccacgaccaaacacctcttaaaggcctcctggcttcaagtgattctcctgcttcagcctcctgagtagctgggattacaggtgcccactaccacgcctggctaatttttttcctatttttagtagagacaggatttcaccatgttggccaggctggtctcgaactcctggcctcaggtgatccacctgcctctgcctcccaaagtgctgggattacagacgtgagccaccatgtctggcccattccagctttttaatatttactctttccgtggcatacctttgtccattctttatatttcaatctttttatttgcgtctttgtatttaaaatgagtctcttatagacagcatatagttgatttttttcttctttatccagtttgccaatctctacgttttgttggagtattgaatgcattagcactcaaatgttattgttgataagtaaggttatttctacttttgccagatttttctttgttttctccaatgtgtttttacttgctctgttttctttagcctacttttgttttaatgttttaataaaatactttttagattcttttttcttttttttttttttttttgagacatagtctcactctgtcaccgagactggagtgcagtggtgagatcttggctcagtcatcctctgcctcctgggttcaagggattctcctgcctcagcttcccgagtagctgggactaggggcgcacgctactacgcccagctaatttttgtattgtcagtagagatgggatttcaccatgttggccaggctggtctcgaactcctgacctcaagtgatctgcctgcctcagcctcccaaagtgttcagattacaggcgtgagccaccgcgcccggctcctttttcgatcttcatgttaatttctctcagctatctagctatgtatctgccttgtgtgtgttcatgacttttccagggcttacaatatgtatttttaacttaaaccaattagagttattatttgtttaaggtaatgtaagaatctcacaagagtatgtttacattcccctcatcttcagtgctgttgtcatatacattatttctgtaaacatcctaaacccaatactacagtgttaaaatttttaagccatcgtatagtaatacgtatttttaaagaaattaaggtaaatgtatgtagaaatatgtgtgtgtgctttatatctgtcacatttcttatgctcttcactccttaatgtagatacaagttgccatctgataccattttccttcatcctgaaagacttcctttaacatttagtacagttacctggcattggattttccattttaatctgaaaagattattttctctccagtttgcgaaaattaactggagatagaatcgctggttaacatatttttctctggcattgcagtgtcttctggctttcatagttttgtaatttttgttgagtaattattatattgttcttttatattttgatcttctctggctgtcttcaagattttctcgttatctttggccttcagcagtttgaccgtgatgtttctatgagccgttttctttgtgtttctactacttaagcattatgaagcttcttggctctctaagttttattttctattcactgtgagaagtacttggctattatttcaatatttttcctgtcccttttactctttcctctcattctaggactcccaatttacctgtatattggactgctggaaatatgtttctgaagattcatattgtctcataagcttctgttcatttttcttcagtcttttttctcttttttgaggggtgggtggatatatgtaatttctattcttttattttcaaattcactaatctttcttctttttctgtttgctattaaacctgtctagtgaatttttaaatttcagttgtttttttctttccccctcccctcctctcccctcctctcccctcccctcccctcccctcccctcccctcccctcctcttgtttctgtgggttttaggagtgctctcaggcaagaaagccacaaacaaaattattacccctttctgttgcaattttttgagcataaactcttccccatcttctggctggttatgtatattttccagtgcctttgagtagttatttgttatattttatccagtcttattattttctgctgcagggttcttgtgaccatttcagtctgctggcattttcgttagtgggcttcctcatacttatttttgaattgatttttggaaattgcttcaaaattacagaatatttgcaaaaataaaaatagtagaataaatatatatggtgcagtgagttgtatgtggtttgtccccaccacaactcatggtgaaatttaattgccagtttaacggtattgaaaggtggtggggcctttaagaggtgtttggttgtggcatctctgccctctcgaatggcttatgcagactgggttagttcttttggactgggttggttctcgtgagatcaagttgttataaaacaaggcttcctctgatgtttggcctctttgcatgcacttgctttcccttcctctttctgctgtgatttgaagcagcatgagaccatcaccaaatgggctaccatccaacctccagaattgtgagccaaataaacttttttgtaaattacccagtctcaggtattctgttatagcaatacaaaacagattaagacatatggcatatatgttattatataaatggcatcataaaatgacctactattttacttagtttgctttatcatttattcatgtgctcttttgcatgcatacccttcctccttccttcccctttctcagtacatatgtatgtatgtgtatatgtatatgtatgttcatatgtgtttgttttgtttttgtctttgtttttgtttttgttttttgagacagagtctcgctctgtcacccaggctggagtgcagtggcacgatctcggctcactgcaacctccgcctcctgggttcaagcgattctcctgcctcagcctcccaagtagctgggattacaggtgcacgccaccatgcctggctaatttttgtgtttttagtagagacagggtttcaccatgttagtcaggctggtcttgaacacctgacctcatgatctgctcacctcggtctcccaaagtgctgggattacaggcgtgagccaccacccccggcctgtaagtgtttgtttctgtgaattttctaagaatgtcgatattgtctcatataaccacagtgtggttatcagcctcagtaaacttaactttgatacagtcattttgcctgttatctaccattcgtattataattttgtcaacatatagaataatatggttttttactttccagaacataatctagtccaaggttagttagttcattttcatgtcatgtctataattattattaagggaagggaattattatttcaataatctttctctgtcttttataacattgacatttcatttgtttatttaattttagattcagagtgtacatgtgcaggtttgttacatgggtatattatgtaatgctggggtttggggcttctattgaacctatcacccaaatagtttacatagtacctgataggtagtttttcagcccttacctccatcctttttcccctgttttggagtccccagtgtctattatttccatctttatgtccgtgtgtacccattgtttagctcctacttgtgagaacataggttatttgattttctgtttctgcattgattcacttaggatgatggcctctagctgcatccatgttgctgcagaggacatgatttcattcttttttatggctgcatagtatttcatggtgtgtgtgtaccacattttatttatccagtccactattgatgggcctatacgaagattccatgactttgctgttgggaatagtgctgcgataagcatacgagtgcaggtgtcttctggtagaacaatttattttcccagtcttgggattgttggattgaatggtagttctatttttagttccttgagaaatttccatactgtttgccatacaggttgaactaatttacatgaccaccaacaatatataagcattccctgttctgtgcatcctcactaacatctgtttttttgtttgtttgtttgtttgtttaactttttaataatagccattctgactggtgtgagatggcctatcttcttgtgggttttcttttcccatccttcactggtaccaagatctctttgtggttgtaatttgtatttctctgatgattagtgattttgagcattttttatgtttgctccctgtttgtgtaccttcttttgagaagtatctgtttatgtcctttgctcactttttaatgaggttatttgggtttttgttgttgatttgtttaagttccttatgtttctgcatattagtcctttgtaagatgcatggttcgcaaatgctttctcccattctgtaggttgtctttttactctgttgattgtttcttttgcagtgcagaagctcttttgcttaattaaatcatatttgtccatttttgtttttgttgcaatcgcttttgaggacttagtcataagttctttgccttggccaatgtccagagaagtttttcctagttttcctttaggaattttatagtttgaggtcttacatttaagtctttcatccatcttgagttgatttgtgtatatgagggggaagggtccagtttcattctcttgcatgtggctggacagttttcccagcatcatttattgaatagggtgtcctttccccattgtttatttctgtcagctttctcgtagatcagttggtagtaggtgtgtggttttatttctgggttctctgttctgttccgtagatctatatgtctatttttgtacttacaccgtgctgtttcagttaatatagccttgtagtatagtcaaagtcaggtaatgtgatatttccagctttgttctttttgtttaggattgctttggctagtcaggctttgttggtcccatatgaattttagaattgttttttctagttctgttagaatgttagaatgacaaatgatgttggtaatttgataggaattgcattgaatctgtagattgctttgggcagtatcatcattttaactatattgattcttaacaatctatgagcatagaatgtttttccctttgtgtcatctgtgatttctttcatcagtgttttgtagttctcctcgcagagacctttcacctctttggtttgatgtattcttaggcattttgtgtgtgtttgcattcgtgtggctattgtaaatgggatcttgttctttatttggctctaagcttgaatgttactggtgtatagaaatgctattgatttttgtacattgattttgtatcctggaactttactgaatttttttttttaatcaggtttaggagtcttttggagggacctttagagttttctaggtataggattattttctaggtataggattttctaggtaaaggattcttggcgaacagagataatttgactccctcttttcctatttggatgccttttatttctctgtcttgcatgattgctttctctaggacttccagtactaagttgaatacgagtggtgagagcagacatccttttcttgttccacttcttagggggaatggtttcagctttcgcccattcagtatgaagttggctgtaggtctgtcacagataactcttcttattttgaggtatgttcctttgatgcctagtttgttaaagatttttatcatgaaggggtgttggattttatccgatgctttttttacatctattaagatgatctttttttttttttttttttttttttgtttgagacggagtcttgctctgtcaccctggctggagtgcagtggcgcgatctcggctcactgcaagctccgtctcccaggttcacactattctcctgcctcagcctctctgagtagctggaactacaggcgcccaccaccaagcctggctatatttttgtatttttttagtagagatggggtttcaccgtggtctcaatctcctgacctcgtgatccgcccgcctcagcctcccaaagtgctaggattacaagcatgagccaccacacctggccggtttttgtttttaatcctgtttatgtgatgaatcacatttattgaacactgacattttagaatacaattcctcagttctcactttttttttttttcttttttgagatgaagtctcactctgttgcctaggctggagtgcagtggcgcgatctcggctcactgcaacctccacctcctggtttcaagcagttctctgcctcagcctcccgattagctgggactacaggtgcgtgccaccatgcctggctaagttttgtatttttagtagagacaggatttcaccatcttggccaggcttgtcttgaactcttgccctcaggtgatccacccaccttggcctcccaaagtgctgggattacaggcgtgagctaccgcgcctggccagttctcactttttaaaatagctttactgaggtataatttacatgccataaaattacttattgtatgtatacagttcaatatatatatattttttttttgagatggagtttcactgttgtagcccatgctggagtgcagtggcacaatctcggctcactgcaacctctgcctcctgggttcaagtgattctcctgcctcagcctcccgagtagctgggattacaggcatgtaccaccaggcctggctaattttgtatttttggtaaagacagggtttctccatgttggtcaggctggtctcaaacttccgacctcaggtgatccgccacctcagccttccaaagtgctgggattacaggcgtgaaccgccgcacctggcctgtgtgtgtacagttcaataatttttagtaaacttatagagttatatgattgtcacctctattcaacatttctgtcacaccagaaagttctcatgtgcccatttgcattcatccgtcctcccatcagaggaaaccattgatttgtttactgtctatagatttgctgtttctagacgtataagaatggcattgtgaaatatatagtcttttcttttttttttttttagatggagccttgctctgttgccaggctggaatacagtggtgttatatcggctcactgcaacctctgcctcctgggttcaagcaattcccctgcctcagcctcctgagtagctgggactacaggtgcacaccaccacacctggctaattttttgtattttagtagagacggggtttcaccatgttggccaggatggtctcaatctcctgaccttgtgatccacccgcctcagcctcccaaagtgctgggattacaggcatgagccaccatgcctggcccttttcattgtttattaaccatttgcatatcttttttagtaaaatgcctattcaattcttttctttattttaaaattagattgtgttcttattgaattgtaagaatttttagtatattctagacacaagtcctatatcaatataggattttcagatatttctccctgtctgtggcttatcttttcattttctcaatggtgtcatttcaggcacaaaagttttaaatgctgattaagtttaacttaccaatttttaaaatgggttgtgcttttggtgttgtaactaagaactttattcttaactcaaggttatgaagattttcttcactggtttcttctagaagttttacagttttagctcttacatttagagctacaatccattttagttaatttttatgtatcaaatgaggtgaaaatctaaattcattttcttgcatatgaatattcagttgtccttacaatctcatataaagagtatccttcctcccattgaattaccttggcacctttatcaaaaatcagctgactgtgaatctaagtgttcatttctagtctcctgattttgttccatgatctccatcttcctcctatgacagtagcacactatcttcattactgtagctttatattaagttttgaagttagaagtatacactccccaactttattttctttttcagaaattgttttgtctattttatgtcctttgaatttcaatgtaagttttaggatcagattgtgaatttccaaaagggaaaaaaaccaaaagcctgctgtggttgtgataccatgattatgttgaatctgcagataaattttggtgagaatcaccatcttaataatagtaagccttccaatctatgactgtctccctatttatttggagctttaacttcattcaacaatgtttgttaattttctttttaaaaatctttcttcttttcctcctttcctttccttttctctttctcttctctttctttcatcccactatgttgcccaaactggcctctaacttctggcctcaagcaatcctcccacctcagcctccttaagtgttgggattacaggcatgagccaccgtgcccagccttaattttcagtttacaaactttgtgctactttgtcacatttattccttagcattttattatttttatgctatcgtgaatagtattgttttctcagtttcatttttagaatagtcattgctagtatatagaaatataattattttttatatatttatcttatatgacctaagtacaattatgacttctagttgcttttttgaaattttatgcttacaaaattatataatctgtgaacaagagattttttttacttcttcctttctagttaagatgcctttcatttattttctcctcattttgtttgtcttctccttttttttttttttttttttgagacagagtctcactgtgtcaccaggctggagtgtggtggcacgatctcagctcactgcaacgtccgcctccggggttcaagcgattctcctgcctcagcctcccaagtagccgagactacatgtgtgtgctaccatagccagctaatttttctatttttagtggagacagggtttcgccatgttggccaggatggtctcaatctcttgacctcgtgatctgcccgcctcggcttcccaaagtgttgggactacaggcgtcataagtttttgagaacacgtgcaatatttgccacttcttctttcttcttctccttttccttctcctcctcctcctccttcttcttccttcctttctctttctcttttctgtgtctccctcttttgaattcaaccccttaaaaaggtaaaaaccatttttagctggcaggccatacagaaacaggtttcaggctggatttggcctgtcaggtgagtttgccaactcctgcaatagaaaatgtaatgcatagggctagacacagtggcttatgcctgtaatcccagcactttgggaggcttaggctgacctgaggtcaggagttcaagaccagcctggcaaacacggtaaaactctgtctctactaaaaatacaaaaattagctgggcgtagtcttggacgcctgtaatcccagctactcgggaggctaaggcaggagaatcgcttgaaccctggaggcggaggttgcagtgagctgagatcgcaccactgcactccagcttgggtgaaagaaagactccgtttaaaaaaaaaaacaaaaaaacaaaagaaagtgtaatgcatgaagtgaaatgaaaaatagatgctgggaaggatgtctaactgggagatagcttgtgatgtaaatatgtaaatatattatgaatgaccagtgggcaaggcaaaattgcctacacagccctacctatggcccctctgaaaatgttctttcttcagcagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattctgagcccataaaagacccagactcagctgcagtgaggagagaaatcaccctgctgtgggggttggggaccactccctgcatcccctctccactgagagctgttcttttgctcaataaaattcttttctacccatcctcacccttcaa

SEQ ID NO: 729 - DNA, 69247 bp, Homo sapiens
tggtttgtaactccgctttttattttctacaggatttaaaagacaaatgcataaaatgtaattataaatctgttaggtggtgtacaatgaataaagatacaatttgttacatcaataacctaaaaagagtagacctatatagcagtagaattttggtatgtgattgaagttaagttgaaataaattcaaatcagaatgttataactccaggatgttatatgtaattttcatagtaaccaaaaacgaaatctacatagaatatacacaaaaggaaatgagaatagaaacaaaacttgtcactacaaaaaaaatcaactaaagataaaagaagtaaataattgagaaaatgactggcaaaaatcagtaactgacgtattaaaactttccatgctacataaatctggaaactctatttcacatgaaactggagctgaaagagacaaatatttacttataaagttaaaagttatatggaaaaccaacactaattttttttagaaaaaattatggaaaataaaaatatgccttatagtatcatataatatcatgttttatagctcttggaaaatagaaaataaaatgttctgttagcatgaatccttctgtgccctcaaaaaccctatggattataccattattacctaaaaagtctattctcaaatgcagcacaatgataatttttataaggtagatgttatttttaaatatggaataatattggtgatttcagtttcagttttaataacattggattaagatgaaagaatgagaagataaaggtccctcagcaatataactcacaaacatgttcagaagcagtaagaagttacattaattatcttttgaaagtcaataatctacatttttaatgtatgcatatggcatagctaatgtactattgctgggtccatttattcaatgaataattgctgctatgcgtcagacatttttctaggcctaggaatggatacataagtgaacaaagcaaagattctggttcttgtagagtttccattaaaagatcatttagtaaaatttttcttcccccaaattataaaatctgtaagatgatttaacaatatgtataaaagtcattgtgggtcaggcacagtggcttataccaggtgtggtgactcagcgctctgtcacccaggctggagtgcagtggcgcaatctctgctcactacaacctctgcctcctggctacaagcgattctcctgcctcagctttccgagtagcagggactacaggtgcacaacaccacacccggctaacttttgtattattagtagagatggggtttcgtcatgttggccgggctgttctcaagctcctgaccgcaagtgatccgcccacctcggcctcccaaagtgctgggattacaggtgtgagccaccacacctggccttattttctacaactttgataactttggcatataccccaaatctgtaacacataatattatcattcaaatgcaactctttctctagcttttgaattctttattctaatatcagttttaagtctgacacaaaagcatgggagttcttatcaaattccaaccttttatcataaaaactgtcaagaaattatcagtagtagaacttaaaaaggaaaataggcctattaattagatttgtataacttaacattttatgcctatgagtccccaacaaagcctccagcttctatttggatataaaagttaaaagtcactactggatccaaaagcaggactatggtaaataaatttctccacctaaccagctccttttacatgatgctacgtgtttcttttgttttttcattttggcaaatattgattgaaagtcatatttgtgttagtgtacgtcctaagtgccaagatacagaatctgaaaagagggacacaggatctgccttctgggagttcatacttttttttttttttttttttttgaggcggagttttgctcttgtcacccaggctggagtacaatggtgagatcttggctcactgcaacctccacctccggggttcaagtgattctcctgcctcagcctcccaagtggctgggattacaggtaccggccaccaaacccagctaatttttgtatttttagtagaggcagggtttcatcattttggtcaggctggttttgaactcctgacctcaggtggtccacccgcctcagcctcccaaagtgctgggattacaggcatgagccaccacaccccgctaggagttcacactttagttggggaaaatatacaataagcaagccaatttttaaaatgagaacttcagagttaaatgctacaaagacaatctcacaggaagttgcgatgtagaatgatagggctctcagaatagtaagagaaactattatttcttacgatgtttgtctttctttgtatcggtgctcagctgagtctgcagtgcttcggaggcagctttcattttataaaaatctatgatttctccttccagttgttttttctcttcctcgagcttccttatctcctcctgttgaatcattttaagatgctcgaacttgtcctgcagctgtgaaaccaatgtgcagttgtgacaccaaagcacagtgtggctgaacacccaaaagaatatgcttttttctaaatatcaaacaaacccaaatcatcacagtagagcatgatcttaataacaacctcaaaaactcaggagtaaacactgagatatggaatttttcttttctttcttttttccttttttgagatggagtctcactctgctgcccaggctggagtgcagtggcgcgatctcagctcactgcaacctccatctcctggttcgagtgattctcctgccttagcctcccgagaagctgggactacaggcatgcaccaccatgcccagctaatttttgtatttttagtagagacggggtttcaccatgttggccaggctggtcttgaactcctaacctcaggtgatcctcccgctttggcctcccaaagacttttttttaatatagaagcaaggtctcactatgttgcccaggctggtctcaaactcctgagctcaagtgatcctcccacctcagcttcccaaagtgctgggactgactggatgcagtggctcatgcttgtaaactcagcactctgggaggccaaggcagaaggatcgcttgagtccaggagttcaagaccagcctgggcaatgtaacacaatagtaaacttcaacaggagagagcatctgtaaaattgaatatagatcatctgaaattatccagtgagaggacaaagaaaaaaagaataaaaaagagaaaagaaggctgggcgtggtggctcacacctgtaatcccagcactttggtaggccgaggcaggcagatcacaaggtcaggagttcaagaccagcctggccaacatagtgaaaccccgtctctactaaaaatacaaaaagtagctgggtgtggtggtacatgcctgtagtccaagctatttgggaggctgaggcaggagaatcacttgaacccaggaggcggaggttgcagtaagccgagaccgtgccattgcactctagcctgggcaacagagagagactccatctcaaaaaaagaaaaaaaaagagagagagaaaagaaagccaatgagacaccattaggcaaaccactgtcaggttatgggagtctgagaaggaaagtagagaaaggagaagaaagcttatataaagaaagaatggctgaaaactctctaaatcatgggaaagatttagacatccaaatccatgaagcttaaagattcctaaagaggttcaaaccaaatagatactcaccaagtcacaatataatcaaatagtcaaaagtcaaagattttttaaaatgttgaagaggcaagagaaaagtggcatgacatagacaagagaatcttcattagactatcagcagatttctcagaaggaactttgcaagtcaggagagaatcaaataatacattcaaagtgctgaaagaaaaaactgccagcaactaatactatgtctgacaaagctaaccttcagaaagaaagaagaaataacatgtttcctcgacaaacaaagctgagggaattcaggaccactaggtgtaccttaaaagaaatgcttaagggagtttttcaagtaaaaatgaaagaatgcagctgggcatggtggctcatgcctgtaatcccagcattttgggaggccgaggtgggtggatcacctgaggtcaggaggtcaagaccagcctggccaacatggcgaaaccctatctctactaaaaatacaaaaaattagccaggtgtggtggcagctgctgagattgcaccactgcactccagcctgggtgacaagagccaaactgcatctcaaacaacaacaacaacaaaaaacttgaggcctggcctcctactcccctcccactccccttctccaggcccaagccaccttggctgaggagggggctgaggaagtgtgagcccctgccaggaacccctgcccagaccatgtactcggcccacaggcccctgatgcttgcattcagcaaggcctcccgtggcctcggcatgttcaggtagaggaacgtggaacctcgctctttggctgtgttcccctggtactccatctccttcctgacccctccctgcagccacgcaaagcccagcaacctgccagacactcagtggcctccaactagacaaaagaacctgctgagttggcagctgttgctcatgagcgtccaccaggtgggacagggagtgctgaccctgggcggccccctgaagccacctgccctgaaagcccagggcccagaaccccacacactttgggggtggtggaacctggtaagggcccaccttccaccatggaggaggagccctgggcccctcaggggagcccctgctggacagtgagacagagaatgaccacaatgatgctttcctctccgtcatgtctcctgacacccagttgcctctaccacccaaatgatgtcaggcccagtctctcagtgccctgcccaaggaacagaactcatcttctgagaaggatggacgcagccccaacaaatgggacaaggaccacatccggcagcccgtgagtggcactcatgatcttcagcaagcggcaccaggctctggcagggcccaccagtgtcaccccaaccaggacaactggaccgtcagccagatcctgggcgagtggtggtacactctggggcccaatgagaggcagaagtaccatgacctgacctcccaggtgaaggtggcccacttgcaacaaggaccgaaagaagtccaggcccggagactcacacctgtaatcccagcactttgggaggctggggcgggcggatcacctgaggtcagaagttggcctggccaacatggtgaaatcccgtctctactaaaaatacaaaaattagccgggagtggtgttgggcaacaaatcacaaaggaagacagaaagagaggaacaaagaaactacaaaacagtcagaaaacaattaataaaatgataatagtaagtccttacctataaaaattactttaaaagtaaatagattaagcccactaatcacaagacacaaagtagcagaatgaataaagaaacaattctcaataatatgtggcttacaagagactcacttttgccttaaggacacacttagactaaaagtgaaggaatagaaaaacatggctgggcgcagtggctcatgcctgtaatcccagcactttgggaggccaaggcaaatggatcacttgaggtcaggagttcaagaccagtctggccaacatggtgaaacgccatctctactaaaaatacaaaaaaaaaaaaaaaaattagccacgccttgtagtgggcacctgtagtcccagctactcaggaggctgaggcaggagaatctcttgagtccaggaggtagaggttgcagtgagctgagatcgtgccactgtactccagcctaggtgacagagcaagactcttgtctcaaaaaaaaaaaaaaaaaaaaaaaaggaaaaagaaaaagatattccatgcaaattataggcaaaagaggacagggcaggtatacttattgcagacaattagacttttggtcaaatgttgtcataagagacaatatcactatataataataaagaaatcaatttataaagaggttataacaatcatcaaatatatgacaacattggagcacctaatatataaagcaaatattaacagaaatgaaggaagaaacttacagcaatatgagaacagtaggggactactgtatcccactttcagcaccagatagtccatccaaacagaaagtaagtagggaaagagtagatgtgaataactatagacccaatagaccaaataggcatagatagattatttcactgaacagtagaagaatacattcttctcaagggcacaggaacattctccaacatagatcatatattgggccacaaaatgactcttaacaaattttaaaagtttgaaatcatattatgtatctttttatcataatagtataatattagaaatcaataacagaaagattttattattgaagcactattcataatagccaaaatttggaagcaacctaactgtccacaacagatgagtggatgaaaaaaaatgtcacatatacacagtggactactattcagccataaaaaagaatgagatcctgtcacttgcaacaacatggatggaactggaggacctcacgttaagtgaaataagccaggcacagaatgataaacttcacacgttctcacttacttgtgggagctaaaaattaaaataattgaactcagtcaggcgcagtagctcacacctgtaatcccagcacttcaggaggctgaggcaggtggatcacctgaggtcaggagtttgagaccagcctggccaacatggtaaaactccatctctactaaaaatacaaaaattagctgggtgtggtggcacatgcctgtaatcccaaccacttgggaggctgaggcaggagaatcgcttgaacccaggaggcagaggttgcagtgagctgagatcccacagccgcacaccagcctgggtgacagagcgagactttgtctcaaaaaaaaaaaaaattaaactcatggagatagagaatgaaatgatgattaccagaggctgggaagggtggtaggggtggggggaagtgaggacatttcttggtacaaaaatatagttagaaagaataaataagacgcagtatttgatagcacaacagggtcactatacacaataataatttaattgtaccttttaaaataactgagtatcattggatttcttgtaacacaaaggacaaatgcttgaagggatagatatcccatttaacttgatgtgattattacacattgtatgcctatatcaaaatatctatcgtaccccataaatatgtatacctactaggtacccatagaaattaaaaattaaaaaatatacatctcttgacacaaatgaagataaaaaacaacatatcaatagttatgggatacagcaaaagcagtttaagagtgaagtttattgcaataaatgcctatattaagaaaaaatagattaaataatgtaatttcacacctcaaaagaaaaagaaaaacaaaccaagcgcaaagtcagtaaaagcaagaaaatagtaaaaatcacagcagaaataaataagatatagactagagaaacaatagaagaaaatcaatgaactaagtgttttttaaaaagataaataaatgaacaacccttagaaaaactaagaaaaaaagagagaaaactcaaacaaataaaatcagaaatgaaaggtgacacataaccactgacaccaaagaaatacaaatgatcatgagactactatgaaaaattataagccaacaaaatttgataacctaaaaaagaaattggatatccttggttaataaattcttataaccacacgatctacgaagactggatcatgaagaaactgaaaatctgaaaagactactaataggtaaggagatttaatcagtaacaaaaaatgctaccaaagaaaaggccgtactaggtgactttactggggaaggctacaaaacatttaaaatggaaataataggccaggtgcagtggctcatgcctgcaatcccagcagtttaggaggctgaggtgggcagatcacttgaactcaggagttcgagaccagcctgggcagcatagtgagaccccatctctactaaaagtacaaaaaaatagccaggcacggtggtacatgcctgcggtcccagctactcgagaagctgaggtgggaggatcacttgagcctgggaggtggaagttgcaatgagctgagatcgtgccacttcactccagcctgggtgacacagcgagatcttgtcttaaatagataaataaaatggaaaaatacaaaaatacttcccaaagtcttccaaagaatggaagaggagagtatggtttctttttttttttttttctatgagacggagtcttgctctgtctccaaggctggagtgcagtgcagtggtgcgatctcagctcactgcaaccttcacctcctgggttcaagcgattctcctgcctcagcctcctgagtagccaggattacagccgcacaccaccacgcccggctaatttttatatttttagtagagatggggtttcgccaagttggccaggctggtcttgaactcctgacctgacgtgatctgcctgcctcggcctcccagagtgctgggattacaggcatgagccacctcgcctggccaggagaatacacttctaaatgcattcgaagaagacattattactctgatactacagccagaagaggacactatgagaaaaaaaaattataggccaacatttgtgatgagccaactaggaaatcctcaacaaaatactagcaaactgaattagatcgcacattaaatatcagatggccaagtggaatttattcttggaatgcaaggatgattcaaatacacaaatcaataaatgtgaccacatgcagaaaaaaaaattagatctttatctcaaaacatatgtaaatctcaactcaaaatggatgaaagacttaaccgctataagatctaaagctgtacaactactttaaaaaattagggataagttccttaacttgggtctgacaatgatttttttggatacaaactccaaagcatagacaacataggcaaaaatggacaaataaaattatatcaaactaaaaagctcctgcacagccaaaaaaaaaaatcaacagactaaagaaacaaactatgaaatgtgagaaaatatttgcaaactgtacatctgataaggggttaatgccccaaatatacaagaactcaaataattcaatagtatgaaaacctcattccgaaaatgggcaatgaaactgaactttttttttttttttgagatggagtctcactctgctgcccaggctagagtgcagtggtgcaatctgggctcactgtaacctctacctcccgggttcaagtgattctcctacctcagcctcccgattagctgggactacaggcgtgtgccaccacatctggctaatttttgtatttttaatagagacaaggtttcaccatgttggtcaggctggtctttaactcctcacctcaaatgatccgcccacctccacctcccaaagtgctgggattataggcgagagccactgcacccggctgaacctgaacattttttaaaagaagacataaaaggcaaatagggatatgaaaaaaatattcaacctcattaatcatcagagaaatgccaatttaaaccacaattagatggcacctcatatctgttagaaaaacagaaagataagtgtttacaagaatgattttatagaaagataagtatttacaaaaaaaggtaagtgtttataagaataattttataaaacaatgataaaaaagtaaatcagtacagctattatgaaaaatatgggtattcattaagcaactgaaaatagaataaccatatggttcagcaaccccactaatagttatgtgttcaaaggaaataaaatcagtatgtcaaagagatatctacactttcatgtttattgcagcattaattgacaataatcaagacatgtaatcaaccctaagagaacacatagttgagatatggaaaagaaactaatctccagagagaaagaaaaaagaagcagacgtacaggaataaggttcataactaagggaagtgaggtgggagagaaagagaaaatttaaatggttgcttcggtttctggtcacttcctagttttggtttaagtcttcatgaggccaggcgcgatggctcatgtctgtaatcccagcactttgggaggccgaggcaggcggatcacgaggtcaggagatcgagatcatcctggctaacacggtgaaaccccatctctactaaaaatacaaaaaaaaaaaaaaaaatttagttgggcacggtggtgagcgcctgtagacccagctactcgggaggctggggcaggagaatggcgtgaacccaggaggcggagcttgcggtgagcccagatcgcgccactgcactccaacctgggtaacagagcaagactctgtctaaaaaaaaaaaaaaaaaaaaaaaaagtcttcatgagatccagctatgtctcttgtccttagatgtcatgacgtacccttgtatacatccaaactttttcctttatacctaagctaatggtttggttttttttgttttttttttttgagacggagtctcactctcgcccaggctggaggcagtggcaccatctcggctcactgcaacctccacctactgggttcaagcgattctcctacctcagcctcccgagtagctggaattataggcatgcagcaccatgcccagctaatttttatatttttagttgagacggggtttcaccacgttggccaggctggtcttgaactcctggctttaggggatccgcccgcctccatctcccaaagtgctgggattataggtgtgagccaccgcacccggctggaatttttattacttataattcaactgtctttgaatgagacatctggcctatagcacctaattactactattctgttcttatgaaaaaggaagtttatgttccaatttacctaattaaactaaatgttcttaaactaaagccacctacacttgagagaaagaaattatggtttcaaaaatatgtcttcaccaaaaacgtatttgtggcaaataattaaaacgatattaatagcttttttccccattttattagaaatggcatggaataacataatttaccaacttaaaattttctcattaatcaaggccagcattagtcaacatttgctttttataaaagtgaagacaattttctagtgcattaatagcattagacagtacaagactcttctcagagtaaatagcttgggtttgtcacaaattaaactttatgcatgaaaatttaaattataaataaaacataatttttataaaattatcttcagggttatttaaatgggaaaattaagttctctagaaaaaacactacagactataattttgtaaaggctatattcaagtctacatggtaaaaagctactttttgaaaaatagcaagtatcctccaaaaacatcaagtaaactcttgagattaaaacccccaaattaatagggcacctaaaaattaatacaaattatatcaaactgtcagtactaacctctttttcagcttctttaaatgttgcttctttctccttgactcgctgcataaatctctgtttcaactcttcttcttccctctgacattgatcatagaactcttgtcttttggcttcaaagatttcttgaaaactaaagagaaatgttttcttagtcttatattaaaatgaggtaggaggatcgcttgaacccaggaggcggagtttgcagagaatcaaaatcgtgccactgcacgtcagcctgggagacagagtaagactccatcataaaaaaataaaataaaatgaaaaataaaaacacactagtataaacatgtaaaaaatatatattgtatgttacatcctatataaggaaatttaccaacattctctcatgtttagcagcacaaaatggaaatttccatatcataagatgtaaaaaccaaggcacaatacttaagatcagagtatatagacagtatatgtaaagaatactagaattttccaacacttatatgagtgaattcttatccccaccactttccaggatatcatacattttcatatcttttgacaataacattcagggaaacctctaatgtatgagacgattttcaaaaatcctctaaaataaagcaaaaagtctttcaaaatatcatcattcatttaagatagttaaattttgggtgtctacaaagaacaatgaatgatataactagattatatacactacagtgccatgtttttgcaacacaagtcctattcttcttttttttttgagacagagtctctctttgtcgcccagactggagtgcagtggcacgatctcagctcactgcaatctctgctgcccaggttcaagcgattctcctgcctcagcctcccgagttaactgggattacgggcacccgccaccacgcccagctaattttttttgtatttttagtagggacggagctttaccatgttggccaggctgatcttaaactcctgacctcaggtaatctgcctgtctcggtttcccaaagtgctgggattacaggcgggagccactgcacccggctctattcttcaagttagagcaaacacctgctctcaaacttttctcatttaacttccaggatgctgcactactgcttttcagctggttcctccatcaaactcttcttaatgtcttttgtcaaactttgctaatatttttccatctttttctttatcctttctttttttttctttttttttttaagatggagtcttgctcagtccgccacgctggaagtgcagtgaggtgatctcagctcactgcaacctccgcctccagggttcaagcgattctcctgcctcagcctcccaagtggctgggatacaggcgtgtgccaccatgcccggctactttttgtatttttagtagacacagggttttaccatgttggccaggctgctctcaaatacctgaccttagatgatccgcccgcctcagcctcccaaagtgctgggattacaggcatgagccacagcgcccggcctatcctttctttcacataatacagatacatttcatataaatacaaaaaatggaacaaaatactgggttttttcatcaatatacatttcagcatatatacatattgaatacacatatttcagcataaaaatgagatctcgcattatattgttcctactatctctaccttcgtcaaaagatcataaaaacacctaacattcaggtgttttctttatgatggctcaagatgggagaagtataattattctcatatccaaattatcataccttgtgtttgtagggactcctaaattatccatttggttgtgctagcaatatttttactcacctaactggctggttgtttggacccacatctgtaaagcccattttctgcagtttttggtacctataacattcatagtgctgagtgtgggttttttcttttagattttccatattggtacaaagaagcatatctcggagcttaacgaagtcacagtgattttcattttccactagtaaaaaaataataatgaatcaacaacattcagtatcaatccctgacaatcagtaagtgttcatgaatgaatacatgaataaaaaacacatttaaaataacacacaactgaacaatttgattaatagctataattcttttaagcatgtaagtgtggttgtactatacataccaaccataggcagagattatttataggttagcaaatttgctttaaacttattacctgaagaataagcaggaaatagtgaaataatattttatgtgcatatatgccataggtttttattaacaattgtgtagtatgttataaactacctctgggtattttggagtgctaacagaatatgtaatataacatcactagtgtaaataattttatcagagtaaattctgctagcaaaaaggccttacaattgaaaatactttagttacatatttccatttatatatcatatttaggagacaccgttagtcaatattcaaaatcaatcaacaaattcacatagctgttttaatgatacatacagactgacagtgaagacacggaaagatatttcatgcaattagaaactaaaagagaaggcacggaaagctatactcctatcacagaagatagactttaagtcaaaaactgtaaaatgatataaagaaggtcatcatatcatgatgaagaggtcagttcattaaaaaaataacaattgtaaatatatatgcacccaatatcacaacttctaaatatataaggcaaatattagcagacctgagggggagatagactgtattacaataatagtaagggacttagataccctactttcagcaatggatagattatccagacagaatatcagtaagaaaatatcagatttaaactacactttagaccaaatagacctaatggacatatgtggaatatttcatccaacagcaaagtaatacccatttttctcaaacaaacacaagacattcttcaggatagatcatatgttaggccacaaaataagtcttaacatattttaaaagactgaaataaaaatgtgagtgcacatgtcttttgacagatcaatttcattccactagggtacatacccagtagtggtactgctggatcatacagtaatactatttttagtttttgaggaaccttcatattatttcccaaaatggctgtaccaacttaaattcccaccaatgatgtttaagaattcccttttttcttagaaatatatatacactgctggtgggaatataaattagttcagccattgtgaaaagtagtttgataatttctttttttctttttttgagacagagtttcgcttttgtcacccaggctggagtgcagcagtgcgacctcagctcactgcaacctccgcctcctgggttcaagtgattctccaacctcagcctctcaagtagctgggattacagaagtccaccaccaggcccagctaatttttgtatttttagtaaagatggagtttcaccatgttgaccaagatggtttcgaactcctgacctcaggtgatccactctcctcagcctcccaaagtgctgggattacaggcatgagccaccacgctcggcctgacaatttcttaaagaagttaaaacagaactaccatttgacccagtaatcccattaccaggtttatatccaaaggaatatatattgttctatcataaagacacaggcacgtgtatgttcattgcagcactattcacaataacaaagacatagaatcaatctaaatgcccatcaatggtagactggatagagaaaatgaacatatacactatggaatactacacagccataaaaaaagaacaagatcgtgtcctttgcagcaacatgaatggagctgaagccattatcctaagtgatgtaatgcaggaacagaaaaccaaataccacatactctcatttataagtaggagataaatattgagaacacatagacacaaaggggagaacaacagacactggggcctccttgagggtggagggtgggaggagagtgaggacagaaaagctactatgcttacttttttttttttttttttttttggttagtatatgtgctgctaaagtgagcaattttttttttttgagatggaatctcgctctgttgctgaggctggagtgcaatggcacgatctcggctcactgcaacctgcacttcctgggttcaagtgattctcctgcttcagcctcttaagtagctgggattacaggagcgcgccaccacacctggctaatttttgtattttttagtagagacggggttttgccatgttggtcaggctagtcttgaactcctgaactcaggtgatccacgtgcctcagcctgccaaagtgctgggattacagactcaagccactgctccagccagtactatgctaattatctctgtgatgaaataatcttttacaccaaacccccatgacatgcaatttatctatataacaaatttgcacatgtacccctgaacctaaaataaaaattaaaaaaaaaaaaaaaagaattctctcttctccatatgcttgccagcacttgtaatggcttgtctttttttttttttttttgagacagagtctcactctgttgcccaggctggagtgcagtggcgcaatctcggctcactgcaagctctgcctcctgggttcacgccattctcctgccccagcctcccaagtagctgggactacaggcgcccgtcactacgccaggctgattttgtgtatttttagtagagacagggtttcaccgcgttagccaggatggtctccatctcctgacctcgtgatccacctgcctcagcctcccaaagtgctgggattacaggtgtgagccactgcgcccggcctgtctttttgataatagtcattctaaaagacatgaagtgatacttcatcatgtgtttaattcgcattttcctgatgttttagagatgctatttttttcatatttcttttgccatttgtatttcttcttttgagaaatgcctgttcagatcctttgcccatttttccttgtgttatttgttttcttgctattgagttgttagagtaatatcaaaaatattatatattttggacatttgccccttatcagatgtataagttgcaaatattttttccaatctctaggttgtatctttatgctattaaattgtttcttttggttttgttgctggtgtttttgaagttctttttttttttttttttgaggcagagtcttgctctgtcacccaggctggagttcaatggcacgatcttggctcactgcaacctctgcctcccgggtttaagcaattctcctgcctcagcctccctcccgagtagctgggattactggcacccaccaacatgcccagctaatttttgtatttttagtagagacagggtttcaccatgttggtcaggctggtctgaaactcctgacctcaggtgatcacccgcctcagcctcccaaagtgctgggattacaggtgtgagtcactgcaccctgccagcttttgttataaatccgctctcctgtggcaggagtgcacagaccagggatcatgaagaccctcgagtcaaacctgggtgtcaggcctggagttggcttcactatggacacatccaataagcccaaaactagggtaacagtgatagcacagcttgacctttcccttctgccttttccttgtacagactgagttctgttcttggatgcaggacatcttttgactgttgcaatttgaagattcttatgtttattttcttcttcttcctcttccactatcatttcatctacttgtatcacctttcgtgtttcagcagatgtcaggggtgtttgaatagctcccgcggtgatatccaggtcagctgttgctgcctcttccaagccctgtttgtttcctccaagggagaagtagttgagccattcatgccattcatctttgcgcagtgccttggggagccgcaggatctggatgttgtagagtttatccacctccttgaagaggttctgcctgtcagactcaattggcttgattcgtatttccactttgcagtcgaagtctttaagaaaggaggcgagcttccacctccctaaggagttggtcttggccacccaactactgccctttctaggagccatggtgttgggtggaggctgcagggagcgatggagatggggaaggaaggcaaactcttctccaattttaaatcaagttttacagttctttttttttttttttttttttttgagatggagtcttgctctgttgcccaggctggagtgtagtggtgtgatctcagctcactgcaacctccgcctcccaggttcaagtgattctcctgcctcagccccccaggtagctgagactataggcatgcaccaccacgcctggtttttctgttttttagtagagaaggggtttcaccatgttggccaggctggtcttgaactcctgacttcaggtgatctgcccacctcagcctcctaaagcactgggattacaggtgtgagccaccgcacccagcatttttttttttttgagacagagtctcgctctgtcactcaggctggagtgcagtggtgcaatctcggctcactgccacctccgcctcccaggttcaagtgattctcctgcctcagcctcctgagaagctgggattacaggcgcccgccaccacacatggctaagtttttgcatttttagtagaaatggggttttgccatgtgggccacgctggtctcaagctcctggcctcaagtgatccacccgcctcagcctcccaaagtgctgggattacaggcatgagccaccgtgtctggccaagttttacagttcttagtgtgcaggtattttacttccttgtttagatttattcctaagcattttatttttcagcattattcacaatagctaagatatggaagcaatctaatctaaatgcccatcaacaagatacacaataaaatactatagagcttttaaaaagaatgaaatcctgtcatgtgtaaaacctgaatgaaactgtaggacattatgctaagagaaataaaccaggcacagaaggacaaatactgcataatctcacttatatgtggtaactaaaaatgtcaatctcacagaaatagagagtagacaggtggtgactggaggaaagtggggagactgagggatgaggaaatggaaaatattgatcaaacggtacgaagttttagttagactggaggaataagcttcagtgatctacggcactgtatggtgactacagttaataataagctactgtatatttcaaaattgctaaaatggggagtggggtggagcaaggtagctgaatagaacctctcatcagtcatccccctacataaacaccaaattgaacaaatatccatgcaagaaaacaccttcataaggatgaaaaatcaggtgagcaatcatagtacctgattttaatattatatcaagaaaagaggcactgacgattatagtaaagagagtcttgcatagcctatgccatctgacattcatcccccagcagcaccatactaaacagagagagaatctgtgtgttttggggagggagagtgaagtgattgtgggactttgcattggaactcagtgactgccctgccacagtgctacacaacatagggcagaattctgctagtgcccacgacaggagccttttttttttttttagatggagtctcgctctttcacgcaggctggagtgcagtggcgcaatctcggcttactgcaacctccacttcgcaggttcaagtgattctccggcctcagcctcccaagtagctgggactacagctgcacaccactatgcccagctaatttttgtatttttagtagagacagggtttcaccatattggtcaggctggtcttgaactcctgacctcaggtgatccacccgccttggcctcctaaagtgctgggactataggtgtaagccaccactcctggccaaagggagcatttaacctagctcccactaaagaggaataccccatgccagagatagataggaacttaagttccagctacctccaccactagttaattaaagtgccctggggtcctgaataaatctgaaaggcaatcaggccccaaggtctgcagtccttgggcaagtccagttactgagcttgctcagagccagtggaataggaatgcgtgtgacccagcaagacaccagttttggtggccaaggagtgcttgtatcacacctcccccaactccaggcagtgcagcccgaaaagagactccttccacttgtgggaaagaaaaggaagattagaagagaactttatcttacaacttgagtagcagctcagccacagtaaaacacacaagagagtccttccacttgtgggaaagaaaaggaagattagaagagaactttatcttacaacttgagtagcagctcagccacagtaaaacacaccactaagcccattcctgaagcccccaattccaggccctacttcctggacatttctagacctactctgggacagaagggaacttgctgcactgaagagatggacccagcccagcaggactcaccacctgctgactaaagagcccttgggccttaaacatcagtagtagcaaggcagtagttgccatgggccttgggcaggacccagtaatttgctggtttcatatgtgacccagcacagtaccagctgtgatggccacaggagtgatgatgtcacccttccctcaactccaagcaacctagcacagacagagagactccttctgtttgggagaaagtgagaaaagagtttgagagattctgcctcataatccagggaattctcccagatattatccaagaccactgaggcagtacgagtctgctggcgtcacagtgttactgggcttggggtaccacctaatacattccctttgaatacttagaaaaccttctcaaatagaataggcacaattgagcccagactgcaaagattacaataaatatctaactcttcaatgcccagacatagatgaacattgacaagcatcaagaccatcccagaaaacatgacctcaccaaatgaaccaaatgaggcactaatgacaaatcccaatcacatatctcaggacagatatatgtaacctttcagagatctcaaaatagctgttttaaaagagctcagtgaaattcaagataacacagagaagaaattcagaattctattagcattattatatgccaacagtgaacaatctgaaaaagaaataaaaactaatccaatttatgacagctataaaataaaatacctagaaataaacataaccaaagaaatgaaaaatctctacaatgaaaactataaaatactgatgaaagaaattgaaaagaatgcaaaacaatggaaacacagttcatgttcatggattggaagaatcaataatattgttaaaatgttcatactgctcaaagcaatctaaagattcaatgcgatccctatcaaaataccaatgacattcttcatagaaaaagaaaaagcaattctaagatgtatatggaaccacaaaaatacttaaagcaattctgggcaaaaataacactggaggaatcgcattacctgacttcgaattatactacaaagctatagtaagtgaaacagcatggtaccggcataaaaacagacacaaagaccaatggaacagaatagcgaacccagaaataaatccacacagccacagagaactcattttcaacaaaggtgccaagcacatacattggggaaaggataagcgcttcaataaatggtgttgtgaaaactggatatccatttgcagaagaaagaaactagacttttatctctcaacacatataaaaatcaaatcaaaatggattaaagacttaaatctaagacctcaaattatgaaacgactacaaaaaacattggggaagctctttaggacatttagtgagtaataccccacaagcacaggcaaccaaagcaaaaatagacaaatgggatcacctcaagttaaaaagcttctgcaaaacaaacgaaacaacaaagtgaagaaacaatacacacaatgagaaaatatttgcaaactatttatctgacaaaagattaatagccagaatatatttaagaagctcaaacaactcaataggaaaaaaatctaataatttaatttaaagtgggcaaaagatccgaatagacatttctccaaagaagacatacaaatgtcttcttttgtcttattgataataactgttttaacatgtgtgaagtaactgctcattgtgggtttttttaaatgccaaacaagcaaatgaaaaggtgctcaatatcactgattaccagagaaaggcaaataaaaactacaatgagatataatctcaccccagttaaaaaagcttttatccaaaagacaggcaataacaaatgctggtgaggatgtggagaaaaaggaatccttgtacactgttgataggaatgtcaatcagtacagtatctatggaaaacagtatggagtttcctcaaaaaactaaaaatagaactaccatatgatccagcaatcccactagtaggtgtatacccagaagaaaggaaagtagtatatcaaagagatagctccactcccatgtttgttacagcactattcacaatagtcaagatttggaagcaacctaagtatccatcatcagaggaatgaataaagtaaatgtggtacatatacatgatggagtactattcagccataaaaaataatgagatcctgtcatttgcaacaacatggatggaactgaggacattctgttaagtgaaataagcaagacacaggaagacaaacttcacatattctcactcatttgtggagctaaaaattaaaacaattgaacccatggggataaagagtggaatgttgattaccagaagctaggaaaggattggggagggagagaagtggggatagttgatgggtacgaatatatagttacatagaatgaataagatctagtatttgatagcacaaaagggtgactacagtcaacaataatttattgtacattttagaataactaaaagagtatagttggattgtttgtgacacaaagaaaggataaatgcttgagttgatgggtactctatcctgatgtgattactacacactgaatgccagtatcaaatatctcatgtgccctataaatatacacacctactaggtatccacaaaaattaaaaattaaaaaacacaggcccagtgtggtggctcatgcctgtaatcctagcattttgggaggctgaggcaggcagatcacctgaggtcaggagtttgagactatcctgaccaacaagccaaaaccctgtctctactaaaaatacaaaaaaaaaaaaaaattacccaggcttggtggcgcatgcctgtaatcccagctactgaggaaggagaattgcttgaacccaggaggcaaaggttgcagtgagccaagatcacaccattgcactccagcctgggcaacaagagctaaactccatctcaaaaaaaaaattaaaaacacaacaagctgtaacttcacccatgctaaaatggctattatcaataagacaaacaagtgctggtaaggatgtggaaaaaagggaacccttgtacactgttggtggcaatgtaaattaggataaccattatgaaaaacggtatggagtttcttcaaaaaattaaaaataaaacaactaccatatgatccagccatctcactactggatacattacctcccaaaaatgaagtcagtatgtcagagagatacttacactaccattattcacaagaaccaagatatggaagcaatctaagtgtccatgaatagatgcatgaagaaaaaaagtgtggcatatatacgcaatggaattcagccttaaaaatcaggaaattctatcatttgcagcaacatggatggaactggatgactttacactaagtgaatacgccaaacacagaaagacaaatggtaaatgatctcactaatagatcaaatttttaaaagttaaacttgtagaaacagagagtagaatggtggttacgtgagttaggtagagggtatgtaggagagatgttggtcaaaggatacaaaattttagttaggtaagaacaagttaaagagatctattgtacaacatagtgaccatgttaataacaatattttatatatatatatatattttttttttttgaaaaggagtctcgctctgttgcccagctggagtgcagtggcgtgatctcagctcactgcaagctccacctcccgggttcacatcattctcctgcctcagcctcccaagtagctgggactacaggtgcccgccaccatgcctggctaatttttttgtatttttagtagagattgggtttcactgtgttagccaggctggtctcaatctcctgacctcatgatccgcccgcttcagcctcccaaagtgctgggattacaggcgtgagccactgcgcccggccaatattttatattcttgaaaattgctaagatagatgttaagttttcatcacaaaaataattgagataacacatatgttaattatatcaatttagccatcccacaatgtatatgtatttcaaaacatcatgttgtacataagtacataaaattttatttgtcaattaagattaattaatgaaaaataatttgtatggctctctcctgtgtttgtcatgtccagaagattgaccacaatatatggtttattgtgattaatactgtgaccaaattttatgtatcaacatatagtatagatatatattttataacatatactaacatgtaatacaacataataaatattaaaacattaagttttaagtatgcttaacaaattttaaattttctaatatgtcaattttttaacaacatcatttgaggctggacacggtggctcatgcctgtaatcccagcactttgggaggccgaggcaggtggatcaccggaggtcaggagttcaagatcagcctcactaatatggtgaaaccccatctctactaaaaatacaaaaattagcccggtgtggcggcaagcgcatgtaatcccagctactcggaaggcttaggcaggagaatagctggaacctgggagacagaggttgcagtgagccaagatcatgccactgcactccagcctgggcaacacgagtgaaactctgtctcaaaaaaaaaaaaaaaaaaaaaatcatttggaaaccagtacaagtagaaatcttccattccccaataattatatgaaccacaagtatatgaaccagacaataaattactgcttactacactattctaactcattatgatgctaaataataatataaatgtcaaaggtataatctctagccaaaggtaaattgtactttcttgttttaaaaagtttataactcttttttctagtgaccagtttaaaatggtttctacattaggtagtaatgagtttatgtaacatgtctacacactagtatttttgcttccattttgttgaaagtgctttccagcactctcagtgtcatgatttatacagagagataatatgtacatggcacattgggagcgttgggatagacaaagaggttcttcccagcctctgtagattttggcttaaagcagcgttcagcaaacttctatgagaatgaatcatagtcaaagtaagcattagtttaaataaaacagagtttgtgttccccattagtaactgttaacttacagattagcaagagttaccaatattagttcaagttaaaatgttattttgagactatgagtgatacacatatatttaacttaatcattccaaagcctgccctctgtcatttttaccttgcaaaactccccaagggtagtgacggcctctgaccatcctttttccaactttcacttcatctgtactccctaccacagcaaagggtaacagcccctagaaaacaagaatgacatgaattgaattctctagcaccattagagcttactctattactctcattcctgttataaaaatgacaggccagcgcggtggctcatgcctgtaatcccagcactttgggaggccgaggtgggcggatcatgaggtcaggagatcgagaccatcctggctatcatggcggaaccccatctctactaaatatacaaaaaattagccgggcatggtggcgggcgcctgtagtcccagctactcgggaggctgaggcaggagaatggcgtgaacccggaaggtggagcttgcagtgagccgagatcataccactgcaccccagcctgggcaacagagcaagactccgccacacacacacaaaaatgacagagatgatgatattgtaataaatttaattagacagggatctaccctgcatctcattttaagacttgacagtatgcactaattggtttctgtcagcataagtctcaggctgtgcacacaattggaaactgtctactgagccagagcctaaagcaaggtatcctgctgtgggaaacacatagaaaaaagattttcagtaggcatcatttttctcacactatgtttaccctgaaccatctttaacctgaatgttgaagaaataacatgcaaataacttttaactctggtataaaagttaaaagacaaaaatattaaaaacaactacaactattataataattaatggatacacaatataaaatactttaataagcaatactgtatatgtctcaataaattatgtttgtttttttgagacagagcctggctctgtcacccaggctgtagtgcagtggcatgattttggctcactgcaacctccaccttccaggttcaagcaattctcctgcctcagcctcccgagtagctgggattacaggtgcctgccaccatgcctggctaatttttgtattgtttagtagagacggagtttcaccatgttggccacgctggtcttgaactcctgacctcaggtgttctgtccacctcagcctcccaaagtgctgagattacgggcgtgagccaccacgcccatcccaaataattttttacattttacattacttagcatttcaattcagaaatctattagtgtttgaggtatcttaaaataaaggaggtgtaaattataagaaaagagaaatggaagacatggaattaacagttatcagttacagttacctgttacattctagactctgtgtttcagatccttcacaaagattttggcacttacacctcagaaaaaaagccttaatagaagtgtcattgatcccatagcatagataacagtctcagggaagatgagtgaattgtgcaggatcttttggcttttaagtagagaagctaggatggaaatctaaatctgtatactttcaaaatgtatcatctttcggctgggcatggtggctcatgcctataatcctagcactttgggaggccgaggtgggcggatcacctgaggtcaggagttcgagaccagccttgccaacatggtaaaaccccgtctctactaaaaatacagaaattagcggggcatggtggcaggcacatgtaatcccagctacttgggaggctgaggcaggagaattgcttgaatccaggaggtggaggttgcagtgagctgagatcgcgccattacatctcggtctgagaaacaagagtgagactctgtctcaaaagaaaaaaagaaaagaaaattatcatctttcaaatttaagctaatattttaggtatttactagcctaaaatatttacacagataaagagtttcatcatctttattactgccctgattccagaaccagagacaacacagcattcgcatccaacccccatctacctgtttttgaggctaagtccttggcaagtctatttgagagttggaggctcccttttaccactcaagacctacttgtgaaataggggccctgccttggatgcagcaaacagagaagatgggggccctgaccatccttgcctggttcatgaggcagtggctcattgtgtggggaagtaatccaaagaacctcagactggtgctcctcctcactgagctctcagttaccagtgggtgcctgaagcttcagggcagggtgggtaacctgccattgtttccacccacaattccagaaccctgcctcagagattttaccttggaggagaaacaggccatgaaatggagaaaacccattcaaaaaattatatgtaatcccaagggacctgaatagccaaaaaaatattgaaaagaaagaccaaagttagaggtctcacacttctagaattcaaaacatattacaaagctacagtaatcaaaatagtttggaagtagcataaagacagacatgtagaccaatggaatcaaatacagagtccagggttaatccctccttacctattcttctgttgatggatatttgggttgcttccatctctcagctactgtggataataatgcaatttatatggctttacaaatatctaagtaagaccctgctttcaattctttcagagaaagaggattgttagatcatatggtaattttattttcaactttggagaaaccacctatattagtctgttttaacgctactgataaaagatatacccaagactgggaagaaaaagaggcttaattggacttacagttccacatggcaggggaggccttagaagcatggtgggaagtgaaaggcacttcctacatggcagcggcaagagaaaattaggaagaagcaaaagcagaaacccctgataaacctgtcagatctcgtgagacttattcactatcacaagaatagcacaggaaagaccagcccccataattcaattaccttcccctgggtccctcccgaaacatgtgggaattctgggagatatgattcaagttgagatttgggtggagacacagccaaaccatataaccaccatactgtttttcatagtggttctagatgagaaaaagataaaactctattgaaaaaatcagggactatctaaataaatggagagacattccatgtacatggatagaaagactcaatattgtcaagatgtcaatgttccataacttaacctatgtattcaccacaaccccaatcaaaatttcaccaaattattttgtgaataataacaaattaactccaaaatttatatgaaaaggcaaaagaactagaatagccaatgcaatattgaagaagaacaaaattggaagacatactattcaacctcaggattcactgcaaagccatagtaatcaaaacagcgtggcatgggcaaaataatagacaaacagatcaatagagcagagcagagagcccagaaatatgcctacacaaataaagttaactaatatttgacaaagaagcaatgggaatttaatggagacaagatattcttttcaataaacagtgctggaactgaatactcacatgtaaaaataagaatctacaaacagaccttacatatttcacaaaattaactcaaattggatcataggcctaaatgtaaagcataaaacaataaaattcctagaagataatgtagagtcctaattagagaaagggagtcaggctggtgggagcaggggaaagcaaaaaaaaaaaaaaaaaaaatcagataagctacaagtctgcctttcttcaccatccagaacacacggccctcctgcacaaataactcacaatcttcctgtgcctagctatcagcagaccctcggctgatacaaaaaattgcaagttagctcactgccactgatagtggcaggaggcggacaaatgcctaggcagataggggcaagtccccagggaaaccccacttccaacccaaggatagtttaaagcctgaaagccaagttacaagtcaaatccatggactggattgagaacctgtcttcctgcttggtgcactttcctctggctgatctccacccttcacctgttttacatatacctacacttcctaattgtttttttcacattgttgtgcccacctttgggtggtgcctttgttttaacctttttgcatactcacaaaccaatcagcatgcactcgcctattctgagcccataaaagccctgggcttagccacacaaggagagaaacagcccccaggtcccctctccactgagagctgttccatcactcaataaaattcttctgtcttcctcatccttcaattgtcagggtatcctcattcttcttggttgtgggacaagagctcatgaactgctgatctcagatagaagctttaacacaggcaggctggggcatgctggcccagccacaggctgagccactgtgcaagccagaatgggccaaatggatggggctacctgtgtggcaggtagcgcgcccaagcaaggcccaggtgggggtgtcactggctggaggtccctggctggcaaaatgattgagaggaatcctgcatcacaaccttggcattatcagcactacacaaagccctcttcagcatacagcctaagaactagcctataaaatctgcagcaatcctttgtttgtttgcagtcagcttctttcttgcaagctgcctgttgcctccctagcaatgtattttcctactttctgtaataaatctaccttccttacctacagcaaggtaaattcttttttttttttttttgagagagagagtgtctcactctgtcacccaggctggagtgcagtggtgcaatcctggctcactgcaacctctgcctcaacaaggtaaattcttttatgcctgcaccaccaggccagatagtcatcactcccttgcaacagataacataaaaggaaatgcaggtgactttgaatttagcaatgacttcatcgatataacactgaaaacatcattgatgaatggaaagaatcaatgagttgaacttcattaaaactaaaacttctgctagcaaaagacactgttaaagataacaagataagccaccgactgagagaaaatctttgcaaaacacacacttgataaaggactgatgtccaaaatatacaaagaactcttaaaacccaacaaaaaaatgaacaactcaattaaaaatgggcacaagatccaaatagccacctcaacaaaaaagatattcagataacaaattagcatgtaaaaaagatgatcaacatcatacatcctcagggaattgcaaattaaaagaaaaatacatggtactacacatttattaaatttccacccactgaatctaaaataaaactcagtaattttttttaggccaagcacagtggctcacatctgtaatcccagcactttggaaggctgaggtaggcggatcacctgaggtcaggagttcaagactagcctggccaacatggtgaaaccccatctctactaaaaatacaaaaaaaaaaaatagccaggcgtggtggtgcatgcctgtaatcccagatacttgggaggctgaggcaggagaatcgcttgaacccaggaggtggaggttgcagtgagccaagatcacgccactgcactccagcctgggtgacaagaatgagactccatctcaaaaaaacaaacaaacaatttttttttttaatttccaaaatcccaaacactgacaacaccaaatcctggcaaagatacagagcagcaggaactatcactcattgccagtgggaatgcaaaatggcagtaaccacatcgtaagactggtagtttctttcgaaactaaacgtacttttaccatatgatcaagaagtgcactcatcagtatttatccaaataagttgaaaacttgcgtccatacaaaagcctgcacacaaatgtttatagcaactttactcataattgctaaaacttgaaagcatccaagatgtcctttaatcagtgagtggataaacaaactgtggcatacctaaacatgaaatattatttaataatgagaaatcagctatcaagccacaaaaaaagacacagagaaaccttaaatacatatttctaagtggatgaagccaatccaaaagttctacatgaactataattccaactatgtgatattcccaaaataaaaaattacggagagtaaaaagatcaatagttgccaagggtaaagggaaaagagggagacaaatgaataggtcaagtacaggtgatatttagggcagtgaaactatggtgaatgttactgcagtatgggatagaggtcattagacatttgttgaaacccatacaatgttcaacacaaacaatgaagactgttgtcagatacgaactttagtttataacttaccaatattgcctcatcaagtgtaacaaatgcaccacacttaatgcaggatgttaataatagaagaaaatcaagggagggcattaagatctctgttctttccactcaatttttctacaaccataaaactactaaaaaaacataaaagtattttacatttaaaaagaaggatggggccgggcgtggtgactcacacctgtaatcccagcactttgggaggccgaggcggttggatcatttgaggtcaggagtttgagaccagcttggccaccgtagtgagacccccacctctactaaaaatacaaaaattggccgggcatggtggctcactcctgtaatcccagcactttgggaggccgaggcgggtggatcacgaggtcaggagatcgagaccatcctggctaacacagtgaaaccccatctctaatcaaaatacaaaaaattagctgggcgtggtggcaggcgcctgtagtcccagctactcaggaggctgaggcaggagaatggcgtgaacccgggaggcggagcttgcagtgagccgagatcgagccactgcactccagcctggcgacagagtgagactccgtctcaaaaaaaaaaaaaagtcacaattatttatcatatttattacctcaaataattattattttctttgctttttggggggtgagaacatgtagatctactcttttaccaaatttcaagtatacaatgttgtatattgttaactatattcacactgccatacattagattttcagaacttactgattttgcaaactgaatctttgcataccctgacctatatcacaaagagaattttgaaagcagcaagagaaaaacatcttgtcccatataagggaggctgcgtaagactatcaatggatttctcaaaagaatcttgcagatcaagaaacagtgggatgattcaatgtactggaagaaagagaaagaccaaaaggaatactttaccccagaaaagctgtcctttaagaataaaggatgggctgggccaggtggctcacgcctgtaatcccagcactttgggaggctgaggcaggcagatcacctgaggtcaggagttcaagaccagcctggccaacatggcaaaaccctgtctctactaaaaatacaaaaattagccaatgtgatatagggtgcctgtaatcccagctactcaggaggctgaggcaggagaattgcttgaacccaggaggtagaggttgcagtgagccgaggccatgccattgtactccagcctgggcaacaagagtaaaacactgtcccagaaaaaaaaaaaaaaaagaataaagaacaatgctgccatctgatcttttcagctgtggcctggcacccttctgagagcccggctcccagatacttgcagtctgccctggcactgctgtcactttagcattctgcagttgcctgagcattcttcctgcccctgcctaagttttctgccagctgtgtgggggccagcctgcccctctctatcacagccagcacctgaaccctgggtacctgaggacacatatgccagcctgcttctgatccagtccctccagtacttatgcatgccatccagagcaccatatagggatctgagaatcaagaaaatggctagcccagtacaccattggcacatgatcgctctctctggagactaaggctgtgctgacccagctagccaacactgcaacagctgaaatccaccctcatgtgctgaaaggtgaagctgcttcccctttgtacacaaaggagcagcgttcctgcatgagagaacaggcaagccacagggctgtctgtattggcctgagggaagaggtcctaccctgaggttgctcctgtgaagagccacaagacaggcattttcaatggctcttggctacgttatgacctagagatagatgactgggtctgtatgaactgagagtcatgaactctgggacaggggtaggatagggaaacacatcatgttcctacctacacaggaggtagagctggtacagctcctccctccctacagagacctgtgagcatttcaccaggagctgcaccagccaccctctaaaggctactgttcacgttcatcattgagatgttggtgggtaagctttgtggtccagctctgcccagctgtgtcttcccctctgggctgaacaggcaactcagagtctaggcattacatagaccagcctatcacctgaaacaacagacaggaaatcacagtaaacaaagatcaaacacacaccatctgcttctgccatagctggctcttactcataagtgccacttactggcatggaggttaaactacacaaatcaataaaaagtctactgacagaagggcacagggctaaagaaacaaagccaaagccccctacccaatatatgctgtagttacacccacaaggaggaaaaaccccatctaaattaaagtaaattcaaaaataagaagtgacaactttcccagatgagaagaaaccatcataagaagtttggcatcatgaagaaaaaaaaaaaagcagaatgttttgacactaccaaaggacacactagctctctcgcaatggatcctaaccaaaatgaaaattctgaaatgaaagataatgaattcaaaatatggattataaggaagttcaatgagatccaagacaaagctgaaaatcaacacaaagataccagaacaatgcagaatgtgaatgaagtacagatatcttaaaaaaaaaacaattgaatttctagaaatgaaaaacacactgaagggttgggttacagatgaaagctttttttttttttttttctttttgagacagagtcttgctctgtcgcccaggctgcagtgcagtggcgccatctcagctcactgcaagctccacctcccgggttcacaccattctcctgcctcagcctcctgagtagctgggactacaggcacccactaccacgcccggctaattttttgtatttttagtagaggtggggtttcaccgtgttagccaggatggtctcgatctcctgacctcgtgatccgcccatctcggcctcccaaagtgctgggattacaggcgtgagccactgcacccggccagatgaaagctttaacaataggctagactaagcagaagacagacagaaaataggatcccagtgccttttggcttgtaaactttcttctgagaagtcggctgttagtctaatgtgatttcctttataggtgatttgaaaattgtctcttgcttctttcagagtattttccttcaagttgcctttggatagtctggtgaagttcatcttgcaaaatattttcaggtattttccgagcttctcgtatctggatgtgtacctctctagcaaggccaagacaatttttctgattattccctcaaatatgtttccaatctttttaccttttcctcttctctctcagaaatgcctacaactcataagtttggttgctttacataatttccgatttattgaactcttgattatttatttaaatttacttttttttttgtctgtgttagttcaaaaaacctgttttgttttttgaaaagataagaaaattgatatggtgctaggccgggcacggtggctcacgcctataatcctagcactttgggaggccaagacaggtggattgcctgagctcaggagttccagatcagcctgggcaagatggtgaaaccccgtatctactaaaatacaaaaaatcagctgtgcatggtggcaggtgcttgtaatctcagctactcaggaggctgaggcatgagaattgcttgaacctgggaggcagaggttgcagtgagccaagatcgtgccactgaaccccagcctggacaacaaagcaaaactctgtctcaaaaaaaaaaaagaaagaaagaaaagaaagaaaattgatatggtgctagctagattaaccaagaaaaaagacagaagattcaagtaagcacaagcacaatcagaagtgataaaagtgacattacaactgataccacagaaaacaaaagatcatcagagactaatatgaatatctctatgcatacaaactagaaaacctagataaaatggttaaattcatccctccctgctcggatgtggctggagctggaggtgcagagggccagagatgctgcagaccttccacccagagcagcttggaggcagtgaataacagctcttcaagtctgcaacaaaaaatggcctcttccagagaattgtttgaacctgggaggcagaggttgcagtgagccgagatagcgccactgtgctccagcctgggtgacagaacgagactccatctcaaaaaaaaaaaaaaaaaaaaaaaagcctcttcatagcttaaattacaaaagtaaactaaaagacttacatgcttttggccaggcgcggtggctcacgcctgtaatcccagcactttgggaggccgaggcgggcggatcacgaggtcaggagatcgagactatcctggctaacacggtgaaaccccgtctctactgaaaatacaaaaaattagccgggcgtggtggcgggcgcctatagtcccagctactcaggaggctgaggcaggagaatggcgtgaacccgggaggcggagcttgcagtgagcagagatcgcaccgctgcactccagcctgggcgacagagcgagactctgtctcaaaaaaaaaaaaaggacttgcatgtttttttctttactccaactcattccttacatgtaggctcaatcttttcagtatttgctttactggttcagcaaaagccaggaaatacaactttgtggtaatcagaatgttatccaactgtatatatatatatatatatatatatatatttttttttttttttgagacggagtctcgctctgtctaccaggctggagtgcagtggcgcgatctccgctcactgcaagctccgcctctcgggttcacgccattctgcctcagcctcccgagttgctgggactggaggcgcctgccaccacacctggctaattttttgtatttttagtacagaaggggtttcatggtgttggccaggatagtctcgatttcctgacctcatgatccgcccgccttggcctcccaaagtgctgagattacaggggtgagccaccacgccaggccccaactgtatattgtttaccttattgtaaatattggtgaacagtggtcaataatagttttatattcctttaaaaaaaaagaaaatgggtaaatacctggaaacatacaacctcctaagactaaaccaggaaaaaatagatatcctaaatagaccaataacaagtaatgaaattgactcactaataaaataatttcaaacaaataaaaacaagaacagataggtttacagccaaattttgccacaagtataatgaagagctggtaccagtcttactgaaactattccaaaaatttatggaatttttggattggaagaatcaacatcattacaaagaccacactaactaaagcaatgtacaaattaaatgcaattcctatcaaattaccaatatcattttttcacagaattagaaaaaacgatcctaaatatcatatggaaccaaaaaagcattcaaatagccaaagtactcctaagcaaaaagaactaagtcagaggcatcatgtgtctgacttcaaattatactataatgctatactaaaaaaaacagtatggcattggtacaaaaacagacagattaatggaatggaataaagagtccattgctaggaaggatacagcttaaaaagggagaaaaaaattgtgaaagaaaagagaataaagaaccagtaataaaatcacatgcctacaaccaagtgatgtttgacaaagttggcaaaaataaacagtggggaaagagcattctattcaataaatggtgctgggaaaattggctacccataggcaaaagaatgaaactgaattcccatttctcatcatatacaaactttaactcaagacgtattaatgacttaaatgaaagaccagaagctataaaaatcctagaagaaaatttaggaaaaactcttctagatattggcctaggaaaataattcataacttagacctgaaaaggaaatgcaacaaaaccaaatatacacaaatgagacttaaactaaagagcacagcaaaagaaataatcaacagagtaaacagacaacctacacaataagaacaaaatatttgcaaactttgcatctgacaaagaactaatatccagaatctaaaaagaacacaaacaactcaacaacaacaaagaataaacaacctcattaaaaaagactgcaaaggatatgaacagacatttctcaaaagaagacatacaagtggccaccaaacacatgaaaaattgctcaacatcaccaatcatcagagaaatgcaaattaaaaccacaataaaggcagggcgcagtggctcacacctgtaatcccagcactttgggaggccaaggcgggtggatcacctgaggtcaggagttcaagaccagcctgaccaatatggttaaaccccatctctaccaaaaatacaaaaattagctgggcatggtggcaggcacctgtaatcccagctactcggaggctgaggcaggggaatctcttgaacccaggaggcagaggttgcagtgagatgagatcataccactgaactccagcctgagtgacagggcgagactctgtctcaaacacacacacacacacacacacacacacacacacacacacacaaaataagatataaacacaacagatgttggtgtgaatgcagagaataatgaatgcttattcactgttggtgggaccataacaacctctatgaaaaacagcatagagatttctcgaagcactaaaaatagagctaccatttggcccagtgattatactactaggcatctgaaagaaaagaaataattatataaaaaagtcactttcactcatgtgtattacattcctactcataatagtaaagtcatggaattaacctaaatgtccattaacagtggactggatttattttaatatggtatatatacaccatggaatactatgcagccataaaaatgaaatcatgctctgtgcagtaacatggatggagctgggggccattatcctaagtgaaataactcagaaacagaaaatcaaataccacatgttctcataagcaggagctaaacaatgagtacacaaggacataaaaatggaaacaatagatagtgagactccaaaagggagagactgggaggaggccgatggtcaaaatattatctattggtagtgagatgtgatcacgccactgcacaccagccagggcaacagagtgagatcatgtctcaaaaaaaaaatgatctgttgggtacaatatttactatttcaggatagttacactagaagccaaacctcaccattatgcaatatatctatttgacaaatatgcacttataccctctgaatctaaaataaaaaacaaaggaattctatagtagtaaacacctacatctttttttaaaaaaagatctcgcctgtgtggtggctcacgcctgtaatcccagcactttgtgaggccgaggcaggcagattgcccaaggtcaggagttcgagaaagcctggctaacatggtgaaaccccatcctactaaaaatacaaacaaattagccggatgtggtggcgcacgcctgtagtcccagctactcgggaggctgagggaggagaatcacttgaacctgggaggcagaggttgcagtgagctgagattgcgccactgcactccagcctgggcaacagagagagactccgtctcaaaaaaaaaagatctcaaataaacaacctaactttacacacacacaaacacacacacacaaatagcagaaggaaagaaataacaaagattagagcataaataaatgaaatagagaataaaaaaaattttaatcggccaggcacggtggctcacacctgtaatcccagcagatctcttgaggccaggagtttgagaccagcctggccaacatggtgaaaccctgtctgtactaaaaacacaaaaattagccaagtgtggtggcatgctcctgtaatcccagctacttgggaggctgaggcaggagaatcacttgaagccgggagatagatcttacagtgagccgagattgtgccactgcactccagcttgggcaacagagtgagactctgtctcaaaaaagaaaacaaaacaaaaaattaatcaatgaagctaagagttgatttggggaaaaaaactcaaaatcaaagcccttacttagactaagaacaaaaagagagaatatgttaataaaataagaaatgaaagagaagacattacaacttattacagaagtttatttcttacagaaataaacagaattataagggactactatgaacaattatacaccaaccaacttgacaacttagaagaaatggtgaaattactagaaacatataaactaccaagatggaatgaagaataaatagagagcttaaagagaccaataacaaatagagaaactaaagaagtaatttttcaaaactccaaaatatagcctaggaccagattacttcatgggtaaattctaccaaactttcaaagaaaatttaatataaaacatcctcaaattctttgaaaaaatagaaaaaagaggtaacaccttcagagtcattttatgaggcagcatccccttgatatcaaagcaagaaaacacactttcaagaagaaaattataggccaatatccttgaggaacatgctgtatgaattaaatctaaataaatctgtttacaaagaatcgattctcagcagaagctttacaaaattaaaaaaattaaaaattctcacactggattctggataaacactcatttctagcctctttgtcagatatgttactgaaacttacactaactgaggagttcgcttgagcagcagtttcttcatctgttgggagctgatatatctggatgccattgctaatcaattcactcattatcttattcttaaacgtctgtaaatcatttttagaaatagtgtctgctttggcaatcagtggtataatattcacctatgaagaaagaagacaaacaaaatctcatcattgttcatctcacagtttttttgttttttgttttttgttttgagacggagtctcgctttgtcgcccaggctggagtgcaggggcacgatctcggctcactgcaagctccgcctcctgggttcacgccactctcctgcctcagcctcccgagtagctgggaccacaggcacccgccaccacgcccggctaatttctttttgtgtttttagtaaagacggggtttcaccgtgttagccaggatggtctcaatctcctgacctcgtgatccgcctgccccggcctcccaaagtgctgggattacaggcgtgagccactgcgcccagccatcctatagtttttatagtaaagccttcacaatctctgacaacaaattgcataactaggtaatcactggctgtcatgcttttcttaaaaattattttccaaaattatcaatacttttgaagattgatcttttatccaaattcaggtttagaagtctcaaccttgtttctcttctaaaaatcccttatacctctacacatatggagttagtaaaatgtaaatagtaggacaatgtaaattattttatttatttatttatttatttatttatttttcagacagagtctggctctgttgcccaggctctggagtgcagtagcgcgatcttggctcactgcaagctccgcctcccaggttcatgccattctcctgcctcagcctcccgagtagctgggactacaggcgcccaccaccatgcccggctactttttggtatttttagtagagacggggtttcaccgtgttagccaggatattctcgatctcctgacctcgtgatccgctcgcctcagcctcccaaagtgctgggattacaggcctgagccaccgtgcctggtctatttaatttattttcaattttatttcttattaagctgagtgataaaagacaaattcaaagaactttcctcaaaattgtggaagggattttgtccttctactttttacatcactttttccatcaatcaatcttaattaatgtcccattttcactctcttgccccgcctagatgtgtttgcagatagatttgctattgtttttcaaagaccacctaaaaagaatatagatgtttttgattaccatattctttctttttttgaggcggaatcttgctctgtcgcccaggctggagtgcaatggcgcaatctaggctcagggcaacgtctgcctcccgggttcaagcaagtctcctgcttcagcctcctgagtagctgggattacaggtgcccgccaccatacccggttgatttttgcatttttagtagagacagggtttcaccatgttggccaggctagtctcgaactcctgacctcaggatacaaccacttcagcctcccaaagtgttgggattataggcatgagccaccacacctggcctggttaccatattctaaaggccgtgtgtgtatgtatgtgtgtgtgtgcgcgtgtgtgtgtataagaacaccttgcaaacaaatatgttcatttttcttttgtaaaaagacataatttccacattgaaagttaaatatttgcatatttgaggttgaatttttacccacaaagttttttcctagtgcttcaatatgagcactcctgccttttgcatttgcacttaaataactaaactttttaggaaataacaatatacaaaattatataatgttttattactgttaaaatatcttattaaattatagctccacaaaatcaatatctgtaatatagtagaaatacataaatataaattttaggcagactgcttttgttttagattgctcaaaacacgttttttaaaaaatccatggacagaccgggcgcagtggctcacgcctgtaatcccagcactttgggaggccaagactggcagatcacctggggccaggagttcaagaccagcctgaccaacatgaacaaaccccgtctctactaaaaatgcaaaattagccaggcgtgttggctcatgcctgtaatcccagctactcaggaggctgaggcaggagaatcgcttgaacccaggaggcagaggttgcagtgagccgagattgcgccattgcactccagcctgggcaacaagagcgaaactccgtctcaacaacaacaacaacaacaaaaagagtgtatattcctgactattgaaggtactactaattaagaacttgaagcagctcttaatttaactagaaatctaatttatttcaactacttaatgacatctgagattaagtacaaagtctcttttcagtttgaacaatatatagtaaaagttgagattcctcggataaaaggaacccaacttagaactttttctctcttcaactaaataaagatgtcttcaactaatttaagttgaagacagcatgttttgttagggctgagtgcagaaaagaatctgataatatgacaatttcctttatatgtatattgcttttctatatttaaaaaagaaaatatacttttaaccttttttttttttttgagagagagagagagagggtcttgatctgtggccctgtctgcagtgcggtggcatgatcacagctcactgcagcctcaacctcccgggctgaagcgatcctcccacctcagcctcctgagtagctggaactacaggcacgtgctgccatgcctggctatttttttgtattttttgtagagacagggtctcactatgttgttctagctggtctcaaacttccaggctcaggcaatcctccctcctcagcctcccaaagtgctgggattacaggcgtgagccaccatgtctggcccttctaaattttttatgaaaaatgattttagacttatggaagagttgcatgaatattacagagaaagaaattgaggcatcataattttcccaaagccacacagtgagcaagtaacagggtcaggtttgtgaaagcaggcagcttgaacccactacccatgcttttttatttatttttttttttggagacagagtttcactcttgttgcccaggctgaagtgcaatggcgtgatctcggctcaccgcaacctctgcctgcgggttcaagcaattatcctgcctcagcctcccgagtagctgggattacaggcatgtgccaccacgcccagctaattttgtattttttagtagagacagggtttcaccatgttggtcaggctgttctcaaactcctgacctcaggtgatctacctgtctcggcctcccagagtgccgggattacagggtgagccctggctcccagccctccccatgtttttaatcacagaaagcgctagacatttttcccaaggtcacagacacctagcaagtgataaagcaaatattcaaaagctgcttccactgacaagtcctgtgacctttacatattcaaaaattaaaattccttctgtatggataaatctgagcttcataaacattcaacggactgattttctgtacaataaaaccaaactacaaaaaactgctgaataattagaaaaattaatcaaatgaacagagtctcatatcgattttgagattttgctgaagccatggggcttaagcagcctattgaaaggaagtcctcgtgtgtcccaggtttttgctggaaagaattatgcttttcttagctgtttctatataacaagcagtagctgcctgcaggctcttgtatctgaatcctgtctgatatgatctgtaaccaggatcacaaaagctttctgtttcacaccatcagtggtactagtcaaacatcagtgggattatttcacagtatcatatagtaaattttattttaaaaatacaggcatcccccattttccacagtttctctttcttccttttctttccttcttttttacttccttccctccttctttcttttcttccttccctccctccctccctcccccctcccttcctccctcccttccttcctttctttctttctctctttctctctttcgctctcttttctttcaacggggacttgctctattgcccaggctggaattgcagtgacatgatcttggctcacagcagcctggaactcctgggctcaagcaatcccacaggtgcacaccaccatgcctggctaatttttctatttttttgtagagatggggtctcactacattgcccaggctggtcttgagctcctgagctcaagcgatgctcctgcgttagcctcccaaagtgctgagattacaggcttgagccacagagcccagcccagtttcactttccacaatttcccgtaatcaacagcagtccaaatatattaaatgaaaaattctagaaatacacaatgtagaagttttaaattgcatgcaattctaaatactgtgatgaaatgtcatgttgacccactccttctcaccctggatatgaattatctcactattcacctcattttatctcaacatgtaggcattgtattatctcacatcatcataagaagagtgagtacagtataataagatattttgaggccaggcgtggtggctcacacttgtaatcccagcactttgggaggctgaggcaggcggatcacctgaggttaggagtttgagaacagcctggccaacatggggaaaccccatctctactaaaagtacaaaaaattagccgggcgtggtagcgggcacctgtgatcccagctactcgggaggctgaggcaggagaatcacttgaacccgagaggcagaggttgcagtgagccgagattgtgccactgcactccagcctggacaacaagagcaaaactccgtctcagaaaaaaaaaaaaaaaaaagatattttgagagacgcaggtaactttcacataacttttagtacagtgtattgttataattgttctattttattattagttactattgttagcttcggtctgcatctaagaaactaacaataataactaataataaaagagaactgcatctcatttataaataaatctttatgataggtatgtatgcatagaaaaaaacagtatatatcaggctctgtaccatgcatgctttcaggcgtccactggggatcttgtaacttactcccaagggtgctactctataggcaaatggccatgatctgggaggtaagtcaaggttgaaatctatcaaatgtgagttgtctcccccagcaaccaaaaaatttgtatgttgaagcctcaaccccccagtacctcagaatgtgacctcaactgagataaagccttcaaagaggtgattaaaaagtgagactgggtcaggtgcgatggctcacgcctgtaatcccagcactttgggaggccgaggtgggcagatcacctgagattaggagttcgagaccagcctggccaacatggtgaaaccttgtctctactaaaaatacaaaaattagctgggtgtagtggtgcatgcctgtaatcccagctacccaggaggctgaggcaggagaatcccttgaacctgggagacggaggttgcagtgagccaagatcacaccacggcactccagcctgggcattaaaaaaaaaaaaaaagtgagactgttacagtggggcccaacctaaactgactggcacccttataagaagataaaatgtgaggccgggcacagtgactcacgcctgtaatcccaacactttgggaggccgaggtgggtggatcacctgaggtcaagagttcaagaccagcctggccaacatggtgaaactcatctctactaaaaatacaaaaaattagccgggtgtggtggtgggcgcctgtaatcccagctactcaggaggctaagataggagaactgcttgaacccaggaggcagaggctacagtgagctgagattgcaccactgtactccagcctgggcaacaaaagcgaaactccgtctcgaaaaaaaaagacaaaatgtggacaccccggagacactaggaaaaacaccatgtgagaacacagagataaggtggtcatctgccagacaaggacagagatttcagaagaaagcacatcttctgacaccttgatcttggacttctgtcctccaagactgtaggaaaatacattttcattgtttaaaccacccagtctatggcattttgatatcccagccctaacacactgatgcaaatgcctcaaatattaacagaaaaagataattaggatatatacatatattacaaaatgacaggtacagtcgtgcaccacataatggcatttcagtaaatgatgggccacacatatgatgttgttcccataatattataatactgtacctttgctttttgttgttgttattatttatttattatttatttatttatttactgactcttgctctgtcgcccaggctggagtgcagtggcgcaatctcggctcactgcaacctccgcctccctggttcaagcgattctcctgcctcagtctcatgagcagctgggattacaggcgcctgctacaacgcccagctaatttgctaattttctgtatttttagtagagacagggtttcatgatattggccaggctggtcttgaactcctgatctcaggtgatctgcccacctcagcctcccaaagtgacgggattacaggcgtgagcctccgcacctggctatttagagatctatttattgaatttctggattcaggggatatatgtgcaggtttgttacttacatatattgaatattagtgaggttttggtctctcgtgtgcccatcacccaaatagtgagcattgtacccaataggtaatttttcaaatctcaacctcctcccacccttcccctttataaagggcccagcgtctattatttgtctaatactgaaactttttttatgtttagatacacagacaaggctgggcgcagtggttcacgctttgggaggctgaggcgggcagatcactcgaggtcaggagttcaagaccagcctggccaacatggcaagactccgtctctattaaaaatacaaaaattaggccgagcacagtggctcacgcctgtaatctcagcattttgagaggctgaggtgggtggatcacccgaggtcgggagttcgagaccagcttgaccaacatggagaaaccccatctccactaaaaatacaaaattagccaggcatggtggcacatgcctgtaatctcatctactcagaaggctgaggcaggagaatcgcttgaacccaggaggtggaggttgcagtgagcccagatcacgccattgcactctggcctgggcaacaagaatgaaactccgccaaaaaaaaaaaaaaaaaaaaaaattagccgggcatggtggcacaggcctgtcaggcctatagtcccagctacttgggaggctgaggccagagaatcacttgaacccaggaggcagaggttgcagtgagccaagattgtgccactgcactccagcctgggagacagtaagactccatctcaaaataaaataaaataaaatagatacacagatacttaccattgtgttataattctacagtattccgtacagtaccatgctgtccaggtttgtagcctaggagcaataggccataccataaaaggctatagcctagatgtgtagtaggctatatcatgtaggtatgtgtagatacactctaagatgtttgcataatgatgaaatcacctaaagatatgtaactacacttgcatgcaagtgccttcaagatgtcttattatctcaaaattaatattacatcatgaaaggttgagaccaggaacaatggctcatgcctgtaatcccaacaactctgggagggcaaggtgggtggatcacttgagccagaagttcaagttcagcctgggcaacatagtgacaccctgtctctacaaaaaatacaaaaattagccaatcttggtagcacactcctgtcccagttgctcggatggctaaggtgggaagattgcttgagcccaggaggttgaggctgcagtgagctatgatgacgccactgcactctagcctgggtgacagagcaagaccctgcctcaaatacaaaaaaaaaaaaagaaaaagaaggctgggcacggtggctcacacctgtaatcccagcactctgggaggccaaggcgggaggatcacgaggtcaggagatcgagaccatcctggctaacatggtgaaaccccatctctactaaaaatacaaaaaaattagccgggcgtggtggcaggtgcctgtagtcccagctactcgggaggctgaagctggagaatggcgtgaacctgggaggcggagcttgcggtgagatcgcaccactgcactccagcctgggcgacagagggagactccgtctcaaaaaaaaaaagatggtagatttaccaaacataccttactgtcaaggttcttcattgttaatagatcaagagacttcagggaatgtcctgtaggtgaaatgaagtaaagacacacgtggacgcgagaatcatggtactcaaacaaggaacgtttaatcttcagttcttcttgaagataggcctcaaattgggcatctatgtagtcaactattggttggtagctaaaaaaaaatttatacatttagcataacagactaataaaatctaaagcctgctttttgaccacttaatgagcagttaacatgtatgtaagcagtttgctatagtgatgaagaaaaagttcataacatgtccatacaaagatattaattctaaaccaataataaggctcatgctttactctatggttatgtaaaatgtaaacatagaggaaagctgggtgcatccgacaggggactagtatccagaatatacaaagaatgcaagcaactaaacaacaacaacaagaagaacaaataatcccattaaaaagtgggcaaaggacatgaatagacatttttcagaacaccaaaatacaaggcaaaaccacaatgagatatcatcttatctcagtcagaatggctattgttaaaaagataaaaaatggccgggcgcggtggctcacgcctgtaatcacagcactttgggaggccaaggtgggtggatcacgaggtcaggagttcaagaccatcctggctaacacggtgaaaccctgtctctgctaaaaatacaaaaattatctgggtgtggtggcaggcgcctgtagtcccaggtactcaggaggctgaggtaggagaatagcatgaacccaggagacaaagcttacagtgagccgagatcgcgccactgcgctctagcctgggcaacagagcaagactccatctcaaaaaaagacaaaaaataacaggccaagtagagtggctcatgtctataatcccagcactttggaaggccaaggtaggaggatcacttgaggccaggagtttgacaccagcctgggcaacatagcaagaccccatctatacaaacaatttttaaaattagccaggcatggtggcatgtgcctgtagtctcagttactcaagaggctgaggtggaaggattcacttgagcctgggaggtcgaagctgcagtgagccaagcttgtgccactgcactccagcctgggtgatggaatgaaaaactgtctcaaaaaataataataaaaataattaaataacataatttggcaagggtacacagaaatgggaacccttagacactgttggtgggaatgtaaattagtacaacgtctacggaaaatttgtacaaataaagttaaataaagaaataaggaaataagctaaaactaatagaagctatatttaaaattttttgctataactggctaaataaaaatcttgtaagaaagtcaattatatacaaaagtattaatcttataagaaaagaacattacttaggaaaatattaaaatctggaagaaaaggtattacttacacaaattagtctatggcaaaggaagtcaaattccttgaaataagaaaaccttttttaatttaaataagaaaacactcacctggcttctttgtctatttgatcaccataccctactgtctccacaacagtcaatttcaactgaacattgctttcctgaagttcatatgtctgaatttgaagtccaacatttgagtaaaaatgtgaggatttgttatctttcaagttagtattaaacaatgtgtctatcagtgtcgattttccaattccagtctcccctgtaatagacatagagtcattgtcatagggacataaaggggctaagaaaaagcaacactttgaattcctacggtggtttttaaaatcttagaaagttgaactcatagaagtagagagtagtattctggctaccagaggctgggggagcaggagaaaggaaaggtggagtagttggtcaaaggtacaaagtttctttttttttttttacttttattttaggttgggagtacacgtgcaggtttgttgtatcagtaaactcatgacatgagggtttgttgtacagattatttcatcacccaggtactaagcatggtaaccaatagttattttatctgatcctctccctcctccaaacctccaccctcaagtagacaccagtgtctgttattcccctttttgtgtccatgtgttctcatcatttagctcccacttacaagtgagaacatggcacatgttctcagccataaaaaagaaggagatcatgtcctttgcaggaacatggatggagctggaggccatcatccttagcaaaccatcagagctcattgtagcgctattcacagtagcaaagacatggaatcaacctaaatgttcatcaatggtagactggataaagaaaatatggtacatatacaccatggaatactacacagccatgaaaaagaatgagatcatgtcctttgcaggaacatggatggagctagaggccatcatccttagcaaacagtttcaaacaggagtagaaataagttttgagatctattgcacagcagagtgactatagtcaatgtattgtatatttcaaaataatcaagagagttaatttcaaatgtctcatcataaaaaaatgataagtaaaccgggtaatagatacattaattcacttgattgaatcattccaaattgtaaacatatagcaaaacctcacattgtatccatacatgtaaataactatgatttttcaattaaaaataatattaattttaaaaataaataaagggtctcaaatacttcaaagactgggatggccttgaaaatatacatgctaggccgggtgcggtggctcacgcctgtaatcccagcactttgggaggctgaggcgggcggatcacgaggtcaggagatcgagaccatcctggctaacatggtgaaaccccgtctgtactaaaaatacaaaaaattagccgggtgtattggcgggcgcctgtagtcccagttacttgggaggctgaggcaggagaatggcatgaacctgggaggcggagcttgcagtgaaccgagattgcaccactgcactccagcatgggcaacagagcaagactccgtctcagaaaaaaaaaaaaaagtatatatatatatatatatatatatatgtatacatgctagccctgattctctcagtcattaacataatggaaaaagaaagtatatactaagctacatcagacttttaagagcacaggaatgtgtcaatttttaacaatcactacaggtcgagtgtggtgtctcatgcctgtaatcccagcactttgggaagctgaggtgggcagattgcttgagcccaggcggctgaggctacagtgagccataatcacaccattgcactccagcctgggcaacaaagtgagaacctgtctcaaaaaataaaaggattacataatatggctaagatgagaatcactgtaaacatgaagatatatttgaattaatagcatcaatgttacactgcttaagataagttgaaatgaacattgggaaaaatgaaggaataattcaaatgaggtgtttgacacttacccacacagagaatattaaaagtgaatccttgtcggatagatctgctcaccaactgattgggcaaacattcaaaaccaaaatgtccaatcgtagttaaacaacgaatattattttctttttgcttaaataaaacaaaaatttagagttttgtgttagaataaaaaatgaagtcatttgaaaggaaaatgattatagtacatcaaataaattagaattgattatcatttgcttatcatacctcagacaagatgcaaatatattaagtaaatttgtgaaaatagaagtctgtgttcaaacacatagatttggctattatttttataaataaagtgaatctatctctcagcacactcaaagaggctctgtttctaaattttaaaagagacaggggacaggcacggtggctcatgcctgtaatcccagcactttgggaggctgaggcaggcggatcatgaggtcaggagttcgagaccagcctggccaacattgtgaaaccccatctctactaaaaatacaaaattagccgggcatgcttgtactaaaaatacaaaattggtggtgcatgcttgtaatcccagttactcaggaggctgaggcaggagaatcacttcaacccgggagggggaggttgcagtgaggcaagagcacaccactgcactccagcctgggtgacagagtgaaactctgtctcaaaaaattaattaattaattaaatagggaattaaggaaatactacaagaaactctaatgtattactgtaacataataaattatttcttccataagaaaaaagaaaaaaactttaacatcctttcattctgctgcagcgtattaatatattgagaaaatcccacacatgttaatccagatgcttctcaacttatgatgaggctatgtcccaagaaacccctcctaaattgaacatattgtaagtcaaaactgcatttaacacacataacaaaactgaacattatagctcagctttgcctgccttagacatgctcagaacacttacattagcctacagttgggcaaaatcaactaacacaaagcttatgttataataaagtattaaatatctcatgtaatttatcaaacaaagtgaaaaacagcactattatagagtcaacaatttaagttgaatgattgtaagctggagatcctctacatatgtgaggaaaccaaaatcaatttgaaatttttaaaaaatcaaatgatgtatacttcagatttgttatataccctctgaggacttgtgttatatcgaagaaatctactactaataacaccattctagaaaattagaaatccatcagtattacacacaaagttaccaactgatcatttttaaaaggttaaaagatcattcattttttatttttaagtacttctattttaaaaatgggaattatacaaccccctgcacaactataaacacattaaataccactttgcaatgacagctcagcatacttcacagttcttaacactattttatgaggaatacaaaatacctttttatttaaattaacccgctttaaaaatgttttagtatatgtgagaataaaggaattataaatcagtaggaaagattttaaggtagaagcatcaacaatcagctcagtagatgttgtctacatttattttgtacctttataaaacaagaacatgctaatcggcctgggaggcagaggttgcagtaagctgagatctcgactcactgcaacctccatcacccgggctccagcaattttccagcctcggcctctagaaaagctgggactacatgcatgcgccaccatgcccagccaatttttgtattttttgtagagaaggggtttcaccatgttggccaggctggtctcgaactcctgacctcaggtgatgcgcctgcctcggccttccaaagtgctgggattacaggtgtgatccactgcacctggctaatttttgtatttttgatagagacggggtcgcaccatgttgcttgggctggtcttgaattcctgagctcaaacaatcctcctgccttagcctccaaagggctgggattacaagcttgagtcactgagcccgatctactaacagagatttttttttttttttttttttgagacggagtctcgctctgtcgcccaggctgcagtgcagtggcacgatggctcactgcaagctccgcttcccgggttcacgccattctcctgcctcagcctcccgagtagctgggactacaggcacctgccactacgcccggctaattttttgtatttttagtagagatggggtttcaccgtgttagccaggatggtctcgatctcctgacctcgtgatccgcccgcctcggcctcccaaagtgctgggattacaggcatgagccaccgcgcctggcctactaatagagattttaaaacagctattataaatgtgcagagacataaaggaaagtgtgcatacacaatgagtaaaaagacaaaaatcccaggagaaaaacaaaaattataaaattaagataaaagcagaaagcatggccaggcacgttggctcacgcctgaaatcccagcagtttgagaggctgaggcagaaggatcacttgaggttaggagttcgagaccagcctggccaacatagtgaaaccctgtctctactaaatatacaaaaatgaacccggcatggtggcaggagcctgtaatcccagctactcgggaggctgaggcaggcgaatcccttgagccagggaggcagaggttgcagtgaactgaaatcggaccactgcattccagcctgggcaacagagggagactacatctcaaaaataaataaataaaagcagaaagcaaagaaataggaaataggtcttagaaaaaattaaataagcaaaaatttgctgctttgaaaagattgataagattgataaacacctagctggactaataaaaacacccaaaacagccaggcatggtggctcatgcctgtaatcccagcactttgggaggctgaggcagggagatcacctgaggtcaggagtttgagaccagcctgaccaacatggaaaaaccccgtctctactaaaaatacaaaaattagccgggcatggtggcacacgcctgtaataccagctactcaggaggctgaggtaggagaatcacttgaacctgggaggcagaggttgcggtgagccgagatcgcaccactgcactccagcctgggcaacagagcaagactccatctcaaaaaaacaaaaaacaaacaaacaaaaaacacccaaaacacaaattgctcatagcagaagtgggagaatattactacagaccacacagataacaaaattagactactgtgaacacattgatgaacacattttgccaatgattttgaaataactcttttgccaacaaacttgaaaataaataaatttcattgggaaaaaaaacaaattataaaaatgacacaatgggaaataggaaatctaaatagtcatatatctattgaagaaattatagccaaaaacctttccacaaagaaatcttcaggccctgctgatttcactattgaattctatcaacaagcagttaaaagaaaaattcacacaaactctctacaaaacagaagagggggtagttttttccaatgtattttatgaaaccagatataatggcaatataaacacctgacaggccaggggcggtggctcatgcctgtatcctagcattctgtgaggttgaggtgggttggatcacctgaggtcaggagttcaagacaacctgaccaacatggtgaaactccatctctactaaacacaaaaaattagccgggcatggtggcacgtgcctgtaatcccagctacctgggaggctaatgcaggagaatcccttgaacccaggaggcagaggttgcagtgagctgagattacaccatgcactccagcctgggcaacagagtgagactccatctcaaaaaaacaaacaaacgaacaaaaaacacctggcaaagacatcacaaaaagagaaaattatacattaatttctgtcatgtgcatagctgcaaaaattcttttttactactataattttaattgtacaactagtaagtgtgcaaataaatttttcttaacaactgaaatattgaaatggaagataatattccatttaactattccccacatcctatctccttcctcttttccctatttttatgatttttaggattctagacattaaaaaatacttttatatacacaaatatagaggtattaaattttaaaaacacatacatggccaggtacagtggctcacgcctgtaatcgcagcactttgggaggttgaggtgggcagatcaccagaggtcaggagttcaagaccagtctggccagcgtggtgaaacccggtctctactaaaaatacaaaaaaaaaaattagccagtcatggtggcggaggcctgtaaccccagctactcaggaggctaagagaggagaattgattgaacccgggaggcagaagttgcagtaagccaagatcgcgccattgcacgccagcctgggccacaagagtgaaactcttgtctcacaaaaaaaaagcaaacattctgcaacttgcttttttctactaaaattctatacatgttaatcagctagctttattgaggaataatttatatgtaataaaattcaccaactttatgtgcacaatttgataaattttaacaaatgtgtatagtaatgtaatcaccatcatgatcaccatatagaacatttctgacatccctaaaactttccctattagcccctattcagtcaatttgtaaccctcatccctcagccctggcaacctctcatctgttttcagttgctatagttttactttttctagaatttcatttagaagaaatcatactgcatggagtttttttttttatcttaacaaaacattaccaatcaattcacttgtatataaaaaagattatagattaaaacaattggcatttattctagaaatgcaaggttaattcagcactcaaaaatcaataaatgataaactataaaatactgatgcaagaaattgaaaaggacacaaaaaaatgaaaagatattccacgtgtatggactgaaagaatcaatatcattaaaatgttcataccaccgaaagcaatctacatatttaactcaatccctatcaaaataccaatgacattctccacagaaatagaaaaaataggccgggcgcggtggctcacacctgtaatcccagcactttgggaggccgaggtgggtggatcatgaggtcaggagatcaagaccaacctggctaacacggtgaaaccctgtctctactaaaaatacaaaaaagaggctgggcgcagtggctcacgcctgtaatcccagcactttgggaggctgaggcgggtggatcatgaggtcaggagatcgagaccatcctggctaacacagtgaaaccccgtctctactaaaaatacaaaaaattagccaggtgtggtggtgggtgcctgtagtcccagctactcgggaggctgaggcaggagaatgacgtgaacctgagaggcagaggttgcagtgagccgagattgcgccactgcactccagcctgggcaacagagtgagactctgtcaaaaaaaaaaaaaagaagaagaaaagaaaaaagaaatagaaaaaataatcctaaaatttatacgtacccacaaaagacacagaatattcaaagcaatgctgagtactctgggtacactgaaggaatcacattacttgacttcaaattataatacagaactacaataaccaaaacagcatggtactggcatgaaaacagacatatagaccaatggaacagaatacagaactcagaaataaattcagacatgtacagtgaactcatttttgacgaaggtgctaatagcatacagtggggaaagaagagtctcttcaataaattgtgctgggaaaattggatatccatatgtaaaagaatgaaaacagactcctatctcttatcatatataaaaatcaaataaaaatgaattaaagacataaatctaagctgtgaaactatgaacctactaaaagaaaagattggggaaactttccaggacattgacctgggcaaatatttcttggataatgccccacaagcacaggaaaccaaagcaaaaatggacaaatgggatcatatgaaattaaaaagcttctacacagcaaagaaagtgatcaacaaagtgaggagacaacccactgaatgggagaaaatatttgcaaactatcccccgataagggattaataaccagaatatgtaagaagctcaaataactcaataggaaaaaatctaataatccaatttaaaaagtggcaagtgattggaatacacttgtctcaaaagaagacatacaaatggcaaacaggtatataaaaaggtgctcaacatcattgaccatcagagaaattccaatcaaacctacaatgatatatcatctcacctgagttaaagtggtttttacccaaaagactggcaataacaaatgctggcgaaaatgtggaaaaaaagagaaccctcttacactgttggtgcaaatgtgaattagtatggagaacgtatggaggtacctcaaaaaactaaaaatagaactacctatgatccagcaatcccactgctaggtatatacccaaaagaaagaaattagtacattgaagagatatctacactcccatgcttattgcagcactattcacactaggcaagatttggaagcaacctaagtgtccatcaacagatgaatggaccaagaaaatgtggtacatatacacaatggaaaactattcaatcatcaaaaagaatgagatcttgttatttccaacaacatggatggaacctaacattatgttaagtgaaataagcaagtcatggaaagacaaacttcacatgttctcacttacttgtgggagctaaaaattaaaacaattgaactcatagagatagagagtggaaggatggttaccagaggctaagaagggtagtgggggtggtgaggggatggttaatgggtacaaggatatagttagatagaatgaatagggcccagtatttggtagcacaacagggcgactatagtcaacaataaattgtacattttagaagaatgaagagtacaattgaaatgtttctaacacaaagaaatgaaaaatacttaaggtagtggatactccatttatcctgatatgattattacacattgtgcgcctataacaaaatatctcatatgccccataaatatatagacctgctatgtacccataaaaattaaaaagtaagggctgagcgtggtggctcatgcctgtaatcccagaattttgggaggctgaggctggaagatcgcgtgagctcaggagttcgagaccaatctgggcaacatagtgaaaccctgtctctactgaaaataaaaactaaaaaaatagcagagtatggtggtacatgctcgtcgtcccagctactctggaggctgaggcgggagaatcacttaagcccaggagttagagtttgcagtgagctatgattgtgccactgcgctgcagcctgggtaaccgagtaaaaccctgtctcaaaaaaaaaaaatttaaaaatcaataaacatatttcaccatattaatagtataaagtaaaatcaccatatgactgactcaataagtgaaaaatattatatttgatgaattgaattgaatacccatttgtgatttttaaagtctattagtaaaataagaattaaagagaacttcatcaatctgataaaaactgtattagaaaaaaatttaaatctaacatcatacttaatagtaaacatctgagtgctttcttcacaagattgaaaataaagcagagatgtcagctgttgccattttatacattgtactggaggttctttttttttttgagacggagtctcgctctgtcgcccaggttggagtgcagtagtgcgatctcggctcactgcaagctccgcctcccgggttcacgctattctcctgcctcagcctcctgagcagctgggaccataggcacccgccaccacgcccggctaattttttgtatttttagtagagatgggtttcaccatgttagccaggatggtctcaatctcctgaccttgtgatccgcccacctcggcctcccaaagtgctgggattacaggcgtgagctaccacacccggcctgtactggaggttcttaccagtcaataaggcaaacaaaaagcataaatattcaaaagagtttgtcattttatattgaaaaaaggtagaaaatatacaagaatctacagagcatctaccagaactactaagagaacatatcaaaattacaagatacaaagtcaatatacaaaaatcagttatattcatttctagcttctgctcagagatgtggagagcagaaaaaagacatcactactaatactataggaataaaataatgaactaaggcaagatcacaactttttttttttttttttttgagacagagtctcgctctttcgcccaggccggagtgcagtggcactatctcggctcactgcaagctctgcctcccaggttcacgctattctcctctctcagcctcccaagtagctgggactacaggcgcccgccaccgtgcccagctaattttttgtatttttagtagaggtggggtttcaccgtgttagccaggatggtctcgagctcctgacctcatgatccacccgcttcggcctcccaaagtgctgggattacaggcgtgagccacggcgcccggtcagatcacaactttttaaaaactcatcctagtactgacgtttcaggtcgaccaattgttccagaatcgaaggagagacagaaacccacaggaaaagacaagatgggagcatcaacttttctaggcaagaaagacgcagacatcagtgagaagagttctaaagcaaggagcaaattgctagaacatgccttgcctgacaagtaaaaagtatgagccataaagaggaatcatctgtaggtgcttttttcttttcttttcttttctttttgagacagagtgtcgctctattgaccaggctggagtgcagtggtgcgatctcggctcactgcaacttccgcctccctggttcaagcaattctcctgactcaacgtcctgagtagctggggttatagccgtgccaccacgcccaactaatttttgtatttttagtagagacggagtttcactatgttggccaggttggtcttgaacgcctcacctcgtgatccacccacctcgccctcccaaagtgctgggattacaggcgtgaactaccacgcccaggcctgtagctgcttttttttgtttgttttctggtttggtttttatttgtccttatttggaaatctgtcattctaagtagagaatacaaggtatattaattatattttttaatttattaaggtttgatttaatgtatgtatttaatttttatttgtaatttcaacttttagattcagagagtacatttgcaggtttgttatgaggaaatactgaatgtgctgagttgggggtgtgaatgatcccatcacccaggtactgagcatagtactcaataggtagattttctgccctcaccccctccctccctcaccctctagtagtcctcagtgtccattgttgccatctatggcatgagtctcatactcatatgtctatgagtacccaatgtttacccccacttataaatgagaacatgtggtatttggttttctgttcatgtattaattaacttaggataatggcctccagcagcacccatgttgctgcaaaggacacatttcattttttatagctgcatagtattccatggtgtatatgtaccactttttcgttttttttttgatatggaatcttgctctgtcacccaggctggagtgcagtggtgtgatttcagctcactgcaatctccgcctcccaggttcaagcgattctcctgcctcagcctcccgaatagctgagatcacaggtgcccaccaccacacctggctaattttttgtatttttagtagagacaagatttcaccatgttggccagcctggtctcaaactcctgacctcaggtgatccgcctgtcttggcctccgaaagtgctggggttacaggcatgagccaccgcgcttggccatgtaccacattttttaatccaatctgccactgatggacacctaggttgattccatgtctcagctattgtgaatagcgctgagatgaaaacaagtgcaggccaggtgtggtggctcacacccataatcccaacacttcaggaggctgaggcaggcagatcacttgaggtcaggagtttgagagcagcttggccaacatggtgaaaccccatccctactaaaattacaaacattagctgggcgtggtgcatgcctgtaatctcagctactcaggaggctgaggcacgagaatcggttgaacccgggaagtggaggttccagtaagccaagattgtgccactgcactcccgcctgggtgacagagcgagactctatctcaaatttaaaaaaaagaaaacaggatgggcgtggtggcttacacctgtattcccagcactttgagaggctgaggcaggcggatcacctgaggtcgggagtttgagaccagcctgaccaacatggtgaaaccccgtctctaataaaaatacaaaattagccaggtgtggtggcgcatgcctgtaatcccagctactcaggaggctgaggcaggagaatcacttgaacccaggaggcagaggctgcagtgagccaagattgagccattgaactccagcctgggcaacaagaggaaaactctgtctcgaaaagaaaagaaaaggaaaaaagagaagagaagagaagagaaagaagagagagaagagaagagagaaaaggaaaggaagggaaggggaggggaggggagaggaagggaggggaggggagggaagggaagggaagggaagggaagggaaaggaaaggaaaggaaaggaagagaggaggggaggggaggggaggggaggggagcctgtgtctttttttttttttttttttttttttgagacggagtctcgctgtcgcccaggctggagtgcagtggcacgatctcggctcactgcaagctccgcctcccgggttcacgccattctcctgcctcagcctcccgagcagctgggactacaggcgcccgccaccacgcccggctaattttttgcatttttagtagagacggggtttcaccgtgttagccaggatggtctcgatctcctgacctcgtgatccgcccgcctcggcctcccaaagtgctgggattacaggcgcgagccaccgcgcccggccacctgtgtcttttttgtagaacaaaaaataatctgtagctccttgaaaactttttctccttgaactcaactagacattcagtgaaagattgataggactctgaaaaaaaaatatctctctcaagttacagaactgggacatgcaacagcagcaatgctggcaagaagctccactcacaactttctcctctacagaataaaaaagccttcatctatgggtgaagagccaggaagcactctcttagggcgctggtgaaagcacattgctgctgaaagtagggaacacaaagaaagcttgaagccctagaagatgtgcagaaattcacaatggattcagaaccatgtcagaagaagagaaagagaaggtcaaatccctggggcccagagggagagtgtttgcctaagactggcaatcaaataaaaaagtattctcacgtaccttcatcaccaggctaactgctgtcaagatacatattctttgcaagagatattgcaagagacatactctttctgaggcatagcacaaaaggaagacttaaggttgagggtgaaatcatcatcagaaaaacatcctctggcaaaccaaccccaccctcaacacaaggtatcaccagaggcattcaaagcccatagggtaggccaggcgcagtggctcatgcctgtaatcccagcactttgggaggcagaggcgagcagatcacctgaggttgagagtttgagaccagtctgaccaacatggagaaactccctctccactaaaaatacaaaattagtcgggcgtggtggcgcatgcctataatcccagctactcaggaggctgaggcaggagaatcgcttgaactcaggaggcagaggttgcaatgagcagagattgtgccactgcactccagcctgggcaacaagagtgaaactctatcccccgccaaaaaaagcccatagggtagtaagaatcacactatagcaacatcaaatctcaagcccagctttactcagagaaacacaaacctctgtactaaaggcctggtaaaagaaaaggcatgtcagtttcagacataaaatctacttatctcagtttctatggttctacataagatgtccagttttcagcctccaaaattagctgggcatggtggtgggctcctataatcccagctacttgggaggctgaggcaggagaattgcttgaacctgggaggtggaggttgcagtgagcagagatagcgccattgcactccagcctggttaacaagagcgaaactccatctcaaaaaaaaaaaaaaagtattgtcaagaccaatgtccaggacattttcccctatgttatcttctcagagttttatgatttcaggtcttacttttaggtcttttatctattttgagttggttttttggtatagtataagataatggtccaatatcattcttttgcatatagaaattcagttttcctggaaccatttagtgaagagatgatttttttcctcattatgtcctcttggtgcccttttcaaaaattagctaaccatgaatgtttggatttatttctgggagctctattgtgtttcactggtctatgtttctgtttctatgatggtaccatactatactgattactatagctttgtaatataattttaaatcaggatgtgtgatgctctgtgttcattgcagtatttttttaatagctaagatatggaaacttaagttctattatgatcctagtcactcttttttcaatccctcccttcacttcttttatccctctctcccttcctccctctctttctctcattctttgtttccactataaatggaactaccgtatgatctagcaatcccactactgggtatatacccaaaggaaaaaaaatcagtatatagaagagatctctgcatccctgtgtttattgaacctgtattcaccacagcaaaaatatggaatcaacctaagtgtccatcaacagacatatggattaaaaagttgtatatatacacatttaaatactatttggggccagacgtgatggctcacgcctgtaatcccagcactttgggaggctgaggcgggtggatcaccagaggtcaggagtttgaaaccaacctggccaatatgttgaaaccccatctctactaaaaatacaaaattatccaggcatggtggcgcatgcctgtaatcccagctacttgggaggctgcggcaggagaatcaattgaacctgggaggcagaggttgcagtgagctgagatcatgccattgcactccagcctgggcaacaagagtgaaactccatctcaaaaaaaaaaaaaaatacaatttggccacacaaaaaaatgaaaacctgtcatttgcattaacatggatggaactagaggtcattatgttaagtgaagtaagtcagacacagaaagacaaatatgtcactcatatgcatcagcttaaaaagttgacctcatagaggtagagtagaatgatagctaccagaggctgggaagggtgtgtgagtagtggggggatgaacagaggttggctggtgggttcaaacattcagttaggcagaagaaataagttctgatgttctatagcagagtagggagactatagtttataacaatgtattgtatatttcaaaatagctaaaagaggggatttgaaatgttcccaaaacatagaaataataaatattccaggtaatagatacatgaagcaccctgacttgattattatgtattctatgcatataataaaatatcacatgtaccccatcaatatgtattaatattacatatcatttaaattttttaaaaaacagaggggtccttggagaggtaattaggtcatatggctccacccacatgaataggactagtgcttttataacagaagcttgagggacactgtttgcttctcctgccatgtgaggacacagctagaagccatttttgaagcagagagtaagcccccacctgacaccaaacctgctggtgctttgatcttggacttcccatcctctagaactgtgaacaatgcatttctattgtatataaattaccaagtctgaggtattttgttatagctgcccaaacagactaagacacttgctaaagatttgttgctagcatttgcatatcagcatttgcataatgtttgactaattggcttttgggatcccttctaatcctaaaattttatgttttagagtcatgtgaacaaaggagtattaaccatgatttgttaaacaagaaagcccaaagataaaatggaatgagcataggccaatgtttcagtccctgagaaattcctctgatggttattcatgaaaagcaatgacaggccaggcgcagtggctcatgcctataatcccaatactttgggagactgaggcgggtagatcacctgaggtcaggagttcgagaccagcctggcccacatggtgaaaccctgtttctactaaaaaaaaatccaaaagttagccaggcatgaaggcaggtgcctgtaatcccagctacttgggaggctgaggcaggagaatcacttgaacccaggaggcagaggttgcagtgagctgagatcacgccactgcactccagcctgagcaacagagccagactcagtctcaaaaaaaaaaaaaaaacttgctctaacctcacactcagtaaagcaatcagcaagcagccatccaaccatttgctaaaataacttcattaaaaaattatttattgtcagtgcatacattctgcaaatatatccatcaaaacagcactgttcttctcatttattgggcgattcagaagttttactttgaatttctttggtgttaagtagaaatagtctgttgcactgctaacaaggtcatcggactcaaaaaacatgtaacaattatctaaatcaccattgatacttaaaactccaattagtataaaagctaattcatgcccaaacataacaaacaagactttatcttctatgcctacatcagttttccaagtcaatatttttaggctatataatcttattgaagtacaaaatgcagagttatatttgaaagatatacttaactgtatctccatcagcaggtatttgtgtgggcatagccattgttctttctgccatgctacactaaaagagctggaaatttaaaaaaataaacatttttaaaaatttcttacaaaggctatattcttactatataatttagataattagggggcataatatgggtatttttgcaagctttagtttttagttcacactattcatctgttttaaactgtggctgtcttgctagatgggcttctacatgatgaataatatgtaatattcaacttataatgtagagtaatacatttaaccataagcacacaaaaagcatcttaaagttaaactccctttggaaatcaagaggataagagcattcttcttctttaaatgactccatggtcgtaagaaaggaaagtagaaaattttgctttaaaaaatggttaaaaaaaaaacaaaacaagacactcacaagcacttaactttccagagtagcataccagaggaggcttaggcatttgaatttacccattgaaagagaattgtgaaagcagaccttaaaaaacctaaacaagttctttagacactgaactaaaataatgataattctcatttatgaagcatctattatacagctagcattgtgctaagggtttatgtgctttatttacctctgttagtcctcatagtagatctgagatgtatgtattttcattgccatatgccaggtgaaaaaattcagactcagaaagattaaataacttactttcccagggattcagctgtgcagcagacacaggtccgaactgattccaagctggtgtcctttctactgtccccagttgtggaccaaataaatattcactgt

SEQ ID NO: 730 - DNA, 122346 bp, Homo sapiens
taacaccggatgatggcgcagcgctgtgcacgcaggcgcagtgtggggcccttgcggtcgaagctcacgcggtaagccgctgcacgtgtgctacggcgggcggagggccgaaagtccagtatgtgggtccagggtcactcttctagagcttccgcaacggaaagtgtgaggtcagtagtagtttttgtggtacgtgcagtggtggccgcttcaaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaagtgggtacggcatcagtgccttcataatcagggcaagtcattttaaaataagatttaaaaactactctagaagtagcttcttggagtgtgtggagagatttccaaagtaattttaacttttactgaatttaagccttaatgctttccgtgggaatatatagtctccctaaaagttattacagcttttcagtcagttgaatttaaaaactgctttttgaccagtagaaaagaacccttgctttggagacattttcatgccacttacgaaaaatttttttaaaaaattaagttgtgacaaagtaatccatttttaaaattttatttttctgtgatgaggagttaatgttttccttttcataatgagagagcatttgaaactttagtatagtggtgttcctagacaacttttaaagctcttaaaaaattgcggtggcttaggcctgtaatcccggcactttgagaggccgaggtgggcaaatcacaaggtcaggagttcaagaccagcctggccaacatggtgaaaccccgtctctactaaaaatacaaaaattagctggacgtggtgtcacgcgccggtaatctcagctacttgggagggtgaggcaggagaattgcttgaacccggggggtggaggttgcagtgagctaagatctccagcctgagcgacagagcaagacttcgtttggggggaaaaaaaaaaaaacccataaaaaatctgtgttttaattttccttcaacacttatgaatggaaagtgcagtattttagtatattacagataaaattacatagtgtacatttattttggaatatttttgcatttgataaagtataatattatgtaattaaaattatttttgaagtaataggcaaaattttaggtatttttgcagtctttaatcccacggaatcttcaaaaatagtaaccaccgtgccttttacataaaatagactaccagtttaaagcatttgttctattacttgtaatgtttctctttgtttacattgtggaagtcctttttatgggaggatattttctaaaaaaagaatatgtacattgtttcaaagtattgatttatgtaagtgatcaaaatgtatatgagttcagtataagtttgtaaaagtttggctagagataattttaaggatagagattatatatgataaaattgcatctactacaaaatactcaaaagaattagttagtgaaggaaatattgagctcatttttaatatagagtttgaattttgataactgcatttaggacaaaacatttgtaagaattgaacatgatgtagtttagtcttcattcattattaatggtggattattgtaatctaatttaaggtattgttctagtttttcaggaattgttcaaatggatgaagatacacattacgataaaggtactgacactaaaaattattttggggtgtaagagctagatgatactgattaatttctaattttccttgtattgtgatttgattttagtggaagatgtggttggaagtcacatagaagatgcagtaacattttgggcccaggtaaatagcaaactggttgatatcccccctcacctcccccaatccagttcctccccaacaaaaacaaaaataaaacccaggaataaatacatttgtcattctcattgcctaatatttattgaattatttatcaccaggcattattaggagacaaatgttgacagctgtgatgttacttgactcattatgagtcaagtgttatgcccataatacaccaagtttgaaaaaagaaaattggcaagattgtgatttcagaattccactcaattctaggctgcttttgctggattctgagagcctgttgtatttgtgaagttatagccccatctaggggtcttttataagattgtttcttgaaggaggataagttaaaaatctcggtcgttttttctaatggcttaaatttgagatgtggtatttttctcattatagaattggaagcatgaatgaaacatttctgattttctgttgggagggtgtcagttaggtaaggttactcagttttaaatacaaagcaagcactgaagggctgtgttccacaatttaagaaggtaaattcctctgatgcacagaacgacctgctaatttttggttttgtaaactatacatgatacggaagggaaagaaattacgtttctctatactccctacagcatgggaactccttttggtggggggtgaggtgaactcgtaatgtgggaaataaggagaatatatgagaagaaagttctagaagaatatgattaacccagagttcttaaatatatagtcatgcatcacttaatgactgggatacatacagagaaatgcatcattaggcaactgcgtcgctgtatgaacatcatagaatgtacttagagaaacctggatgatatagcctaccacatacctaggccatgtggtgtacctgtacctcatgttactgtactgaatgctgcagacaattgtaacacaatattaagtctttatgtatctaaacatgaaggtacagtaaaaacatattataaaagattaaaaagtggtacacctgtatagggcactcaccatgaatggagcttgcaggattagaaattgctttgggtgagtcattgagtgagtagtgaggaatgtgaagtcctgggacattactgtacactactgtatactttataaataccatacacttaggctacactaaatttataaaaatatttttcttcaataaaccttagcttactgtaacttttaataaacttttgactcatttgtagtaacacagcttaaaacaaacattgtagagctgtgcaaaaatattctttacgtccttattctaaagctttcttctctttttaaacttttaatttttttttactttaaaaactttttggttaaaaacgaagacaagatcttcaatatcactgtctttcacttccgcttcttgtcctactagaaggtcttcagggtcagtaatgtgcatggagctgtcatcttctgtaataaaaatgcccttttggaataccttcagaaggacttgaggcggctgtacagttaacttttttaaataagtaggagtacactaaaataagaaaaattatagtaaaaaaaaatatatatatacacacacaccagtgacatagttattttcattaccaagtattatgtactgtacataattgtatgtgctgtgcttttgtgagactggggcacggtaggtttacaccagcatcaccacaaatatgtgagtaatgcattgttctatgatgttacaatggctaggactacactaggcaataggaatttttcagcttcattataatcttacgggactactgtagtgtgtgtggttcattctttgaccacaatgtcactatgtggggcatggctgcatgtaaaaaaaaattgtagaagggtgatgttatagaaaacttggggcaaattcgtgtgtctgcttatgcacatatatttggcaaatttgtttctgcttatgcatattctctaaaggttgctcacacgttctggttccatgcccattgtctctgtattagtgacaactgcatcactctcaacagtgtcccagggtggatgataaattatatttaagcttattatacagaaacatcatttatcagtgtaaaaagattttctagactagtgctgtctagtagaaatatatgagccatgtaagtaattttaaaacatttttggcagccacattgaagaaactaaaaatagcaggtgacattttaataagtacattttatttaactcaatatatccaaaatattgtttcaaaatataattagcataaaaatgtgaacaggatagtttatatttcctttttaatattgtctttgaaatccagtgtgtatattagacttacagcatatctccttagactagccatatttcaagtgggtattggctattgtattcactagtgcagctctagactttgatttcagtttactttatttgtgaatatgttgattgaatttggagcaaattcaagagtcagcagttttttttttgtaaaggatcagatgatgagtattttaccatttttaggccatacagtttgttttgcagctattcaattctgccaacatagtgcaaagcagccatagacataatgtgaatgagtgtgtgtagctgtgatgcagtaaactttatttactaaaacaggcggctgtaatttgccaacctctgagttaaaccatgaagttgaggctcttgtagaagaacgtttaaaacaggaaacatgcgcatgaaaagattaaacattaaaactactaatggtatataaatgaatgtagtggttatttcaataagcaaattggcaaatttggttggggttatggtgggatataggcatagagaagactagagatttggaaatacgcgtaggcagattaggatgaaaatctgctcacgtgtattctccatttttttttgccctgtgggcttctgccttataaaccacttataagcaaacacttcagattggatgagtggcagctgaaggaatctgacgtatttgactccacctgtttctttgaaagaacaagcttctggtcaggcatggtggctcatgcctgtaatcccaacactttgggagacctatgtgagaggatcgcctgagcccaggagtttgagaccagccttggcaacagtaagaccttgtcgctacaaaaaaaaaaaaaaaaattagccaggcatggtggtgcatgcttgtgttcccagctatgtgggaggctgagggtgggaagattgcctgggcccaggagattgagactgcagtgagctgagattgcaccaaacaaacaaacaaacaaagagctcctatttgttttagtctgtatagtgaaaaaatatagttatatggaatattttgattccaggggtttgttcacaaaggctgcttctcttgtttctcagggtcagtttaaattcagttcctgttctatgctgagactttgatattcatcatgatgttctttgaactgctctttcagagttttttttcagtcatcacggataatcatgttctttctagcattattgaatattttgttggtatatttctttagaacatatatatatatttaacattttattttgaagaaactttgacttacaggaatgttgcaaaattagtacagaggctagaatgtggctctgtatactcttcacccagcttcctttaatgctaatgtgttatataaccacagtacagtgatcaaagccagggaattaacattagtacaatgctattaactaaactacagcccttatttaaattttagcagttttttgtctttttgtgttccaggatccaatacagaatcccaaattgtatttagttgtgtatccttggtttcctttaacctctgaatgttcctcagtttttccttgtatttcaagacttttgacacttctgatgaatattagttattttgtagagtatcttttaatttgggtttgtttgatgatttcttatgaatagattagcaagagttccacagaagtgatattgtagtcctctcagtatatcatattggggtttcatgatgtgatataccttcttattgatgataaccttgattcacttgggtaaggtggcaacttccaggttttttcgctgtaaagttactcttttcttttgtaattaattaatgttttaggagacttattgtggctgtctaatccagtttctgttcaacttttcacccacgaattttattgtttattgctctagtgcttgcctaatgatgattttctattcccctcattccttccacatttattaattggaattcttctgtaaggaagagctgtctcttctctgccatttatttattcaattatttatattaatataaactcaaggatatttattccgtgggttataatcctatgctatcataatttattttgttgtttaaattattcagccttggccattgggacaaagttcaccaaagaatacagattggtacttgtccttaaacgtctcctattctttttttgagcacttttttttttttttttttcaagacagggtctccgtcaccaaggctagagtgcagtagtgtgctcatggctcattgcagtctcgaacttctgggctcaagcaatcctcccacctcatcttcctgtgtagttggaactataggtgcacactaccatgcccggctaatcttttgtattatttttgtagagacaggatttcaccacattgccaagctagtctcaaactcctgggctcaaaaatgatcctcccacctcggccctccaaagtgatgggattacaggtgtgagccatcgcaacctgcttttttttttttttttttttttttttttagcatttctttactttctggcaccatcaaatgtcccaggatcatcttttatttcccagtttgagctctgcaatcaaatcaatctttaaggaatcctttccatatgatttaattatatttggtatcttgtttgaattctacctaatttgaacacattgggaagtaaactttttctatggcctagtctcatttcttataaataactcatttaaattatgaaaaaatacaggcataagaagttgatttaatttctaatggcctaaaatcttttaagtttatcatgcttagaaccctcaagcgtgtaacactgtaaaataatattttactgtatcttatactatatctaatctttctagagtatcaatagaaataaggatatcatgaagattggttgctcactgtctgaagtttgcccccaggccagttcagttttggggaatcttgacccaaacaaggtgagccatattcttgaatataattatttcattcctcctgtcagctttcctgtgtcttagatatttagtttttggagttcctggtatatttgaaaagaagaggctgatttttggaatttgtataaactactgttatggtatatttattaattcaaaaatacttatggactgaatattactcagtcttgaaatttgacgtaagctacaacatggatgaatcttcaggacattagctaaataagccagtcacaagaggacaaatactgttatggttctacttgtatgaagtacttagagtagtcaaaatcatagagacagaaaaagtgagtgatggttatcagggactgggggaagattgaggatgaggagttattgattaatgggtgtagagtttcagttttacaacatgaaaagagctatggagatggatgatgaatggtggcgaaggttgcagaacagtatgaatgtacttaatgccactgaactgtatacttaacaatggtcaagatagtcaattttatgttatgtatagtttactacagttaaaaataggaaaagtagaattaaaagctacactattctagccaaaaaaacaaaagtgaagaaaacgtatgtactgtctgccatgtacctggcactgtattaagcattaagtaagtatgcagtggtgaacaaactagattccttgcatttgactttgattcacaaaaaatttgtaagatgcatctttatgcagagcaatttggcttttttcttttttactgagttataacttgtatacagtaaggtatatatctcttaagatcctaagtatatagcttggtgagtttttacgtgtgtatgtatccatgtaaccaccatccagatcaacatatggttctatcatttcagaaaattccttcgggccccttctcagtcaattcttagtcagtagtttctccatcagaggtataaccctcattttgatactatcaccatagattcgtatgtctgttcttaaatcatggagtatgtagtttattgtatgtatctggcttcttttgttcaacataatttctgagattcatttatattgttgtgtgtattagtgtattggtagtctgttcttttttaagctatttaacattcattgtataaatataacacaatttatcgatctgttctcctttgatgggcatttggattttttgcagtttttaactactctgaatgaaactgccgtgaaatccttatataagtcttctgctggatgtattgactcatttcttttgcacatatatctagagtagaattgctaaattgtagggtagacatgtttctgccaaagtagatactgccaaacagctttgcaaaagtgttgaaccaatttacattcttatcagcaatttatgagagttatagttcctcgatatcctcaccagccccctgctttgctagtgtactgaggttgtgttttaatatttttattagccctttggaaggggtcttgtgaagtacctattcacatcttttccccatttttaaattaggttatttgtcttgattgatttgtaggcattctgtatgtttttttcactttaattttcatttttgtttctacctcttaaagtcaatgataaagtcacaactgtaaaatgaatgcatttaaaaaataaaagatatatttcaatgacaaaaagtatgcaatgatcatgaaaatctactgtacactttgccaaggccaaagaatgaaagacaatatgaaaaagccaatcttcaaatatatcctcaacaaaaactccctcctaaatagtaaaattatcatttaagaatatttgtctttacacatctaaacagaagctctaaccaaaaaaaaagtgggggaaagggcagatgataactctccacaagttttccagatataaacatgtggtcaccaggaattcaagattaaacttctaaagcaacatttaactcaaaataaagtgaacatttctgacaggtgacaacagtagtatgaaactgatttttcctttcctaaatagaaatgagatggggcatttcagtaatcatctaagaataactgtagaaatactcccaattctaccaccccacccactggtataaaacagataccttccatgaaagtatctttcacattactgaaatatcctcacttacttgggacaatttcatgcttagatgagtataaacacttgtttttaggtgtgtggaattattggagctgagatttttgaaacaatatctgaatcttagcagagatataataatactttcactatacattgattgggcttccttaaccaaatctgagcaactactgtaataacaatgctggtggtagtccatgatactctcaaattttttccctttaagaaatatataatccatgtaatactagtaaatatgttacattgtacaccttcttaacaaagaatgtctgttttcaggccttactaggaaaacaaacaaacaatggcagttactgcctgtttttatcactgataagctacaataaagctcaaatgatggatggtttacgtgtgtgatattaagtacaaaatgaaagccattataattttaccaaaagaaacacgaaaaatatgggaagaagtgaaatgaacatggcatgggtcccaaagattacgatatgtttcagaacaggattttgaaaacaaacaatttctgtgaatatttcttatactagaaagatccaaagcaaatctaggcaagcttagccctaccttgtcaaagataaatactcagataagttggaagttccgtttgctaaagtgcatctgggatcatatctaccctgctacttagagacagccaggaaggtggccatcactcatgctctttcactctttctgtgtcttatcaagagtcacacgtaacaatttttttttcaaaccaaatgctttatatagtgaactacaggaaaaacaattctaaatacacttttaaaatgctagagagttaagataacctcattaaagaaaaaatactgaaaatgtaaagggtccatacaaactaagagctgtattaagtgtatactttctattttaataattcacttggctgtgctcttaaaatgagagaagcagatattttacccatgtcttctggcaagagattcaaaagcagaagtagcaggactgtaaaatttcataaaatttgtgggattttttaaagctaaattattcaatatcttgtacagttttgtacccatatattaccccggaatatatgtacagcatcccagcaacagtgactgcaacaaaagtaaggtaaataggtctacaaagcatttgatttccttattagagaaagtttttatagaggaaatgcaaacaactgcaattcagatcacattatataagcttgatgattatttaaaccttatataaaattaaatctaacccttaccactacaaatctgtaaggaatcagaaaaggatttatagtacacaagtcttgattactgtttcattccactttgatatcactctgagctaaaacagcattcttccaagatttaaagaaaaatagattttataaaagggattcttttacattattattgttactgacagaaacaagttttgcttttttccactataattcgctctgatgaaagaaataattctctctcttaactcctaacaaacgctacattttcaagactaagggaattactggtggcattctttctccttgatctaaactatttgtctctaaaatatgtcaagtaagcttttaaagattcaggaaggggcagcgttgtgatttttttctcagtaaattttgaggtggctcctctggcttcattgcttcactgtgatctttttcttcctcttctttgttatcttccattttttcatcctcctctctgtccagaggctgaggaataagctgattacccacaaatatgtatgtgttagttctctgtttaactctctttttttttttccttttgggtggagccctttgcggaatccccttggcctgcatctcatcatttatgaaatttctaagtgtgcgtcgaatgtaaatacaagccaagccctgtggattcctgacagcacagggagggagtcccacagaatctggtttaccattatcattcttacttggctgcacaagtggagcaaatgacacaataaggatatttttcctttcccaagtgttttgtccagttctgcgttaactgatcctctacaggcatgatcctctacattcatttgatcttcaatcagtgataccctttcttccacttgatcaaatcagctactgaagcttgtgcatgcgtcacgtagttctcgtgccatggttctcagctccatcaggtcattaaggacttctctacactgtttattctagttagccattcgtctaatttttttcaaggtttttagcttctttgcagtgggtttgaacatcctcctttagcttggagaagtttgttattaccaatcgtctgaagccttcttctctcaactcatcaaagtcattctccatccagctttgttccgttgctggcgaggagctgcgttcttttggagaagaggcgctctgatttttagaattttcggcttttctgctttggtctctccccatctttgtggttttatctactttttgtctttgatgatggtgacgtacagatggggttttggtgtggatgtcctttctgtttgttagttttccttctaacagtcaggaccttcacgtcctcagctgcaggtctgttggagtttgctggaggtccactccagaccctgtttgcctgggtatcaccagcggaggctgcagaacagcaaatattgcggaatggcagatgttgctgcctgatcgttcttctggaagcttcgtctcagaggggcacccggctgtatgaggtgtcagtctgcccctactggggggtgcctcccagttaggctactcgggggtcagggacccacttgaggatacagtctgtctgttctcagatctcaaagtctatgctgggagaaccactactctcttcaaagctgtcagacagggacgtttaagtctgcagaagtttctgctgccttttgttcagctatgccctgcctccagaggtggagtctacagaggcaggcaggcctccttgagctgtggtgggccccacccagttcaagcttcccggtggctttgtttacctactcaagcctcagcagtggcggacgcccctcccccagcctcgccgccgccttgcagttcatctgagactgctgtgctagcagtgagcgaggctccgtgggcatgggaccctcggagccaggcgtgggatataatctcctcgtgtgctgttggctaaggctattggaaaagtgcagtattagggtgagagtgtcccgaatttcccggtaccatctgtcatggcttccctttgctaggaaagggaattctctgaccccttgcacttcctgggtgaggcgatacctgccctgctccgtgggctgcacccactgtctgacaagccccagtgagatgaacccggtacctcagttggaaatgcagaaatcacccgtcttctgcgtcgctcacactgggagcttcagactggagctgttcctattcggccatcttggaacctctctctcctcttttctttataaatcttgattttacttttatttgctgaaacagtctaatgccaattctcctttctatattaatggagaatgagcatgcagataagtgtctctatatgattccttgacagatttctttcagagactatgtctataaaaattagcccatctgagacccatcattggagccaactcattcctcaatttttaaaattttttttatggggggattacaggtgtgagccactgtgcctgacctatgactgtgtttaatattgttataaattaagacatactccttttcttctattgaatataaaattaattaccttatcaaaaatttaaacaagtgtcagtaattaagtgattaatcagctacttctgattgttcataaatggattatactttgtcagttttccttagtgatctaaatggttctctccctctgccaccatgtagaagggtcataggctatgaatagtggagttgtgggaggagaagattgggcccaggcacaatgagagtgaatatatagttttcactatgtcatgagaacagataagtctatctgggatagatttacatgttttggtggttgtattacactaacagagccacgaacttcagattcttcactttgttgagtactgttatacctaggcgagttagagaaacgccacactctgagacgaattaagagtcctttatttaagctggcggccaaagagacggctaatgctcaaaattctctcggcccggaggaaggggcttgattaactttcataccttggtttaggaaggggaggggaactcaaatgcagtaattctacagaagtaaaaacatgcaagaatcaaaagaagcaaatggttacagagagataaacaatttaaaagacaaatggttacaaaaagcaaggtaccaggtgcagggctctaaatccttcattataattagatataaatgctatgccggacaggaactcaaggctttatgttgttatctctttgaaaaaaatcctgggaacttcatacattgtttgtgccagtaccttatcagttaattgggctcctttgaaatgctgaggatctgcttacacaggtcaactccttgcggaaggaggttgggtaaggagcccttagtgtcttgtaaattaaggggtcaattggagtttgtccggctttcccagctagagagagtcttacttgagaagcaaggctaggtgattaaagagacaaacaggacaaaatttaaagtagcgagttagagtaaaaacaaggttaggcattacagtaccagctctattcttggacacaagtgttcccagccctgcctcacctggtttgcaataaaccattgcatatctgtcgcttaccttataccaaattattaatcatattgtgatgttattacaaagccttaattaaagatgatgcagtcttttgcagggattgaaattggttaggactgttgattgtcagctatttttgctacttacccctgtcttcttaccagggttgagagagagtaccgtactattactgctctctcttgccctttagttgtttaatgttagctgaagaaaccggagttaattatgaattgaatacacttatcctttgtagcttttgaattgttatttatttatttgtttgtctgaatttatgtgttctttattgttttggtgaataggtttggtgtttaggtttcataaaataaatctgtggatttgtcctagttcagagtgatacattgaaattaattttataatccataacttaaagcagtattcttcagccatttttctcattattccctcctaaggagcatttttagacctgttttctccctaatggcctaatgggccttctccccttcagatattttaatactacagatatacagtatataataactatgttatcagtagggttgaactttggagggctacagaccattgtagtgtttaagatttccaactctccataaggaccacttttattccccttagggatattgccccagttgagaatgtatgatttaaagctgttaaggccaggcatgggggctcatgcccgtaatcccagcactttgggaggccgaggcaggaggattggttgaggccaggagttcaaaaccagtcttgggcaacatagtgagaccctgtttctacaaaaaaaaaaaaaaaaaaaaaaaaagctaggtatggtatgtgtgcctgtaaccccagatatttgggaggctgaagcgggaggattgtgtgagcccagaagtttgaggctacagtgagctatgatcatgccactgcactccagcctggacaacagagtaaaaccttatctcaaaaaaagtagttatcagcctgcagtgatttttgtatccttcccaatccaatcatggcttacttcatttttgttactgtaaagaaatacctgagactgggtaatttataaagaaaagaggtttatttggctcatggttctgtaggctgtacaaaaagcataactccaacatagtatagttgagagttagacttaagtggcatgtacttcgcatgtttatgttttaaaaaaattataccaattatgtcttcagacattaaaatagtatgattttaagtgtttgatgcctgtgtcttctaaaaaaagtctttttgctttttatacaactctaacaagggactcagggtgcttccacaaatattagaaggtgaagaggagccagtgtctgtagattacatggtgagagaggaagcaaagggaggaagaggtgccaggctcttttcaacaaccagttctcttaggaactatgagtgaaaactcattcacttccacgagaatggcaccaagccgtttttagggatctgcctctactatccaatcacctcctaccaggcccccctccaacattgggaatcagattttaacatgagatttggtggatgatatccaaatgatatccatctaaatcatagacaccttcaggagacatttgacagtgtttggagacgtttttgcttgtcacaactggaagtggtgctactggcatctagtgtctagaggccagaagggatgttggtaaatatcttacaatgcacaggacagaggacagccccactctgccactcaacacagactcatctggtcccaagtgccagtagtgctaaggctactttgaagttcgagaaaatgaaagccagcctgggcaacatggtgagaccttgcctctacaaaaaaaaaaaaaaaaaaaaaaaaaaaatacaaaacttagcccaggcgtggtggtgcgtgcccatgttcccagctaccgtggggactgaggtgggaggatcacttgagcttggagaggttgagtcagcagagagccatgactgctgcactgcactccaggcctggcgacagaatgagaccctgtctcaaaaaaaaaaaaagaaaagaaaatgattgaaagtacataaattttctctttattcttttattaaacatcattcaattgagatataaaataaagtacagtattaaagatattatctaatttagttttatctacttaataggactaatgtccttatacgtaaagtaaaaagtatgaaatctttcttgcttggtaggaaatatgaattccactatagttgagagttagacttacgtggcatgtacttgccatgtttatgttaaaaaaaattgtaccaattatcgcctcagatattataatagtgtgattttaagtgtttgatgcttgtgccttaaaaaatttttttttttgctttttatacccctccctcctcattttggagatgcagaatagcataatgaactctgaagtcagaagtttgaatcttggttctgcagtttactagtttatgtctttggatacatagtggcataaacaaagtacctgcctgataggattgtgagaattaaatgagttatatataaagtacttattgacatataggaagagcttaaatgctaacctttattctgatctgttcaccatgctttaaatgccaagtaattttgctttcttttctctttgtagatttatggtggattattttctgaagatcagtgttggtacagatgcaaagtactgaaaatcatcagcgttgaaaaggcaggaaattaagtgttcagtttttttttgctttaagaaatatttattgtggttcaaaaatttgatgcttatttagcccttcattgcttattcgtagtactgatacctggttcagtgattaaaacacagaagaaattaattgctaaaaaacatgttgttttataatcacctcagattattcaagaatagattatataatatgtaggttatttttggtgactagttatttttacctcagttcttttttttttttttttttttttttgagatggagtctttctgtgtcgcccaggctggagtgcagtggtacgatcttggctcactgcaaactctgcctcctaggttcaagctattctcctgcctcagcctcccaagtagctgggattacaggcgcccaccaacacactggctaatttttgtatttttagtagagacggggtttcaccatgtttgtcaggctggtcgaacttctgacctcaggtgatccgtccgcctcagcctccgaaagtgctgggattacaggagtgagccactgtgcccagcctgcctcagatcttaataattatatttggttcttgagtaacttttaaatgttcattttattaagctttataagtaggagaagaacattttgattgattcttctgaagttaggtatatcttttatttagttgatgtgaatattgttaataataatgattggcttgccactttcttatgcctgggttaaatgtggtgagttttctttgtgttaagcttttttttttttttttttttttttttttgacattgtgaatttgtggaggatttttaagaggatttagggagacagaattctgaatagctgtttggtgacagttgcatattgcaggctgggtgaaagcacctctgtaagatttcctttggtgttttttctacacctcctttctgtacttaaattataatatgtatgtttttactgaaccagggaaagtggttcaggataaaagagaaaaagttaaaaatatgtatgtttcagaaatattttctttggtgtgataagatgctaagatgtgacaatttgattaatattctgaatagcttggtttaaaaaaatttcattttttgctgtcatagaaaatggtttattttagtggaatggaactttctaattgacctttctcccataatttgacaactggagatgatattttacatatgtttttcagttggctttaattttttaaattaaagggcagcatgatgtttgaccttgtaataactatttttcttttttactttttaaacagatgtagagctggaggtaagggtggtgaatctgattagtttacatggtctacctggagtgagtttaattgtgtcaaaggaagtttgataactttgcctttcttttcagattttattctttccaacttgaaattgaattgaatgttgattgattttaacattaggagaaacaggagagggctgtaagcttcataggctgatgtttatttaaaatatcaattgtctaaaaacaaaaagcaccctaatgagaaatggtactgttggaatttaactagtaacaagtaaagaaatcactgtaatttcatggactgtggattttttttttattttgaagatattagaaatctgtttctgaatgtattttgtcattttgaggtaagaatgctattttgatatacaggtcattaacagagagcagcaaattggtggtttctttggaaacatttaatctggggtcagtattcgtatttgtctcttattttttccagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcaggcaagtcacgtattttaaatatttttgctaatgaaagtaaaactatgtgcttgaaacaaaatgtaggtatagttaaatcttactttaatataaaagtctgtataaattagtgaaaaataggaattataattagaaagcaattatatatttatgctcatctttgctaggtaaacattgaacagataagaatgacatacacatatataatatatgtaaatagtttccttctgatgtaaatgtttaaaaggatagtctctttttgtttttttttttttttttgagacagagtctgactctgttgcccaggctggagtgcagtagcgtgatctcggctcactgcaacctctgcctcccaggttcaagcaattcttctgcctcagcctcccgaatagctggattacaggcctgtgccaccatgtccagctaatttttgtatttttggtagagttggggttttaccatgttggccaggctggtctcgaactcctgaccccaggtgatccacccaccttggccttccaaagtgctgggattacaagcatgagccactgcgcccagccaaggatagtctcttatatgatggagaaaataatgaatacagttatttctataattgttttgggaaagtatttattaaataaaagtgatctttacctagtcctggccataaataccacaaatttgaaattaatggggttataattaatcagattgtattattttggcagaggctcatactgtttgatgtaataattggcagtggatgttttgcttatgtggattctagtttatattactttccattgaattttgggttggtaacctaattctggaagacgttcgataatttcaggggtagtcttacaggaattctacctcttttaaaatctgttatacaaagatgattcttttggtaaatggtaatgctggtgagagatattacattggaaagtaatcagatttgtaattcttatttataatagcagctcaagtagctcatgtggaaaacagtttaatcattgtaagcattataaagaaattaattaaaattgcctctatttttctttgagaatcttgtaggtgtgttgggtatagttttgtctgctatgtagttacttataaaaaacatttctgtacatgaaactcaggctttcataaacatgaaatatagatattataaaattacaccccaagtttctggtttaaaatctaaagtttgttactttcttctttaatataaatgctttgaccaaggttggggaggcttgttttggatttcttgcatgcataaaactctaaaatcttgtttacggaccttagaatattatctgctctcactttgttttacatatagggaaattgtagtctagaataattaaatgacttcaagtcgtgaagctaactagggaagagctaggcctagaactcaagtctgttgttcttttcatagtaaaatgcacagatttgtgttgattgaaacacacatgaatcaagggggaaaaagacattaaaaaaagttaattttagaactgaattaataaactgcagctgagaatgtttttgtatgtttcaaagattctttatatatggtactgtatataaacatttatatatatatatatatatatattttttttttttttttttggttgggggttgaagtcttgctctgttgcccaggctggagtgcaatggcatgatctcggctcactgcaacctccgcctcttgggttcaagcgattctcctgcctcagtctcctgatagctggaattacaggcacccgccaccacgcatggctaatttttgtatttttagtagaggtggggtttcaccatgttggccaggctggtcttgaactcctgacttcaagagatccccctgtctctgccttccaaagtgctgggattacaggcatgagccacccggctaaacatttgtatttggatgcttagttcagtaaaaagatcattgattagagttaagctaattggcacacaatgttttctggaaaaaaatgagctattcttgaatagctctgcttagaaagtccgtgtttagttattaattctcagcccaaagctcaactctaatcttctatatgaagtctttgctaatacccacttacccggtcctctgtggtgttttagtcactccgtatataaagcctataaagttgtaattttttcctcccctacaagcttagtgagtttggtagagataagtattcacttttctgtgcctaatttccctgccaggtaggtgttagatgagcattagtttatctaacatttgaataaatagatgaacagcagggattcagtaacaacacaaatacctccttccttccccttttccagaaggtgtcctgggcactgaaattccttcacatttttttaactaacactttcacgctatgctgcagcacagtcagaattgatgctcagaatggtagtttgctgaagatcgagagaatattacattactagtcctacatgcctgactttaaaaattatatgtagggtaagggaatgagagctagagcttggaatttgtgtttaacaatttaaaggccttttagcttgttttctaatatatacaggcagaattcagaggaataaagtagaaagcaagtgatcctttcttgtttctgaatgaagcttaccagtttggaaaacagaatgaaatatatttctaaaaagtgacattcatcttttttaatgattgaaagccttatgttctaaaccagtgaccagatttattttaaaaagttaagttttgtccagtgcggtggctcatgcctgtaagcccagcactttcggaggctgaagtgggtggatggcttgagtccaggagtttgagaccagcttgggcaacatgggaaaaccctgtctgtataaaaaatacaaaaaaattagctgggcatggtggcgcatgcctgtagtccccgctactcaggaggctgaggtgggaggattgcttgagcttgaggggtcaaggctgtgagaccctgtctgaaaaaaaaaagataaaagttaagttttataccttttaaatgcctaaatatattttttaagtgcaggtatatatctccagctcataagggttagtggaaaatatatttcttatgataaaaattaaatgtttatatgtattatatataaagagaaaacatacatatttttggtatagtattaaaacacccatgtatcatatactctgtcattctttttgttagttggaactgaggaagactcagattttatttcaagttcagggttctgtgtttatgattatatatgattcagggagaatctgtttgaaccacttcatactaattgtgattggtgactgtaactaaaatgaatttgaattcagagagaaatctaaaattagatttctgcataaaaattctatgcaaggagtaatggacctttagaacattcagctttaggtaattgaaacttttgtagacaataggttatttccatttgaattcacgtattgcccaaagacagggtttcttgaaatattaataattccacatataccagcaataattttcaaagacttcctaggggcagaagttgttcttgaattttagatagacttttgataataagagttgaaagcaagggtttttatgtgaaagaggttaactggaaaactacatctaattgattaaaatcctaacatatatttcagttagttatattttgaggttgttagctttgcctgcttgatcccatttgattggtgataacttctggactgtatttgttatttatactgatataattgatataatatattgatataatatattgaattcttggtgaattcaaacctcttgatataatgtgtgtatttctgaattttatgccttggaaaatttataaaacctgtgtttttgttaacctaaagtattataggaattttatgccttgaaaaatttataaaacctgtgtgtttgttaacctaaagtattttcgtgttttgtggatttaaaaaattattttttcagctaggcacagggtgtgtgcctgtaatcacagctacttaggaggctgaagtgggaggattgcttgggcccaggagttcaagaccagcttgagcaaacatagcaagaccccatctaaaaaattctttttttttttttttttgggtagtgatagttggtgattcttgagcatatgtagtttgagtctccttctctgccccttcagatgcatccttgtaggcccaggtatcctcaacctgttgttaaaataaatgtgtcagctgggtgcggtgtctcacgcctgtaatcccagctctttgggagactgaggtgggcggatcacgaggtcaggagatcgagaccatcctggctaacatggtgaaaccccatctctactacaaaatacaaaaaattagctggtcatggtggtgggtgcctgtagtcccagctacttgggaggctgaggcaggagaatggtgtgaacctgggagatggagcttgcagtgagccgagatagcgccactgcactcccacctgggcgacaaagccagactccattcaaaaaataaaaaaataaaaaaaaaatgtgtcccaatgaaataattttttttgtaatcctatgtatttcatacatttaaaaacattctgagaaaaagtccaaagatttcacctgactgataaaggagccccatggccacaaaaaggttaagaattcctacatcggtctcaattttaccctctatactactgtgtagttgaagagaaaatagttcttaaaaatgttatttagtttcttggaccttgacttccccacaccccctatttcttttaaaaatgtgaccggtttgtattttgtggtttttagtgtgtttttacactcttgtttgtctgattattacgggtatgatgtcctgttcggtttgctttgtttgcataaactatattgttttttgtatttatagagtgggaatgtagctaaaaatacagctccaccttctaagagagatacgtttcatcagatgatgtccctatttcaaggaagttgtgaaccagtaaatttgagctgtacctacccattttgtgttttaagtttatgctttatatattccgaaaaagaatacttacttttaatttcctttatagtacgcacagggtgaaattcaggaaaataacctagagaaatttgggaagagcagttagattgtgtcaaagtaattttagtaattacagttttatggaggagtagataagttcttattaaaattaagtctcaatatgttccaatcccaaatatgttttaggtgtatctttgcttagttctattgatagatattcagtagctcaaagttagcaagcacctaatttctcatatgccagttgtacagttgtagccctcttaagcaaaagtctatttaagagagttttgaatgtagaaggccaggcgaggtggctcacccctgtaatcccagcactttgggaggccgaggtgggcggatcacttgaggttaggagtttgagaccagctcaactgacacggtgaaaccccatctctactaaaaatagaaaaattaggcaggtgtggtggtgtgtgccagtagtcccggttactggggaggctgaggcaggagaatcgcttgaaccggggaggcagaggttgcaatgagccgagattgtgccactgcactccagcctgtgcgacagagtgagattctgtctcaaaaaagaagaaaaacaaagttttgaatatgtatttgtgacacctcacattttataatttcagtttgttgatttttaaagaatttgttcgtattttgtgctttcggtttgtggctttttttgcttctgctcgtcttactttaaaaccagagttcctgactctgcctctaaaactttcaaagttttgtaaaatcgagtaccttttctagatatcagagattcatttttatgcgctattgcttttcaggagaccattatatttagttggggccaaagtaatcaatgtaatctgctgggttaaaaaaaactattctaggatatttacttagtatacatttttagatttataaaggtggctgcctgtacaagtatttagctctacttgattttagcaagtgtgtaattggaatacattcatatacgtggagatgcatatttgcatattatagccaacagcaaagtaatatagagattttagaatgaagaaatatgatgcttggaaaaaatgggtaggaacaaaataagggaagagaaacatgttggtgtagctggtttatgttttcttctttcttagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaagtaagaatttagtcttcactaatttctaattgatggtagaggtccctgtcatagtagaatagaagttaaggcttatgcttttggaatcctttactgtgtcagtgattttaagggctgatgctgatatttctgtttttctcaaatgtattcctctctgctttagcagggatattttcattaaaagctattttgaaagaaaaataactcctgaattattttaaagtttacataccaacttttcatgccaactatttggaatacacttatcaaaaataaaaatctgctcctaaatctgaattattcaggcaaagtcagaatttcagataagatttgaagttcttcctatggctttaggaatattttaaagagtttcaggaaattgcctttacttttttaataaaagtgaggctctttcttcttcttgtgaaaacttgtgatggagtttgattattccgaatactttactttttagataattttaaattatcaacttgaagcagaaatccagatttgatatttatatgtatcaaaacagtcttctatatcatggtccaagccatgatgctgtatcttggatgacatagctgtttgatgggatctcatcagtgctttaggagctaaactgtcaaatgggggtgggaggcggtggacggggggatcacaggggatcacaggacggggggatcacgggggggggatcacaggagggactggaaaaaaactaatacagaaatgctttttactttgttctctgtagttgatagtgctatgaagaagttggaatatttttttttgagaattagaggcattattgaattacgacttcagttataaaatcttgtttgcattaaattattttttaatattatgaactaggtaaatattttagttttcaaaattaactttcagatatattgtggcataaaaggaccaagataacttagatttgttttctgtgtcagccttatacagtttgtttgtcaaaataaatgaatttgtttttatagggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcaggtatgttcagtggcttaaggtgaagagtgtccaactgggaaatctgtgtactcatctgctgctatttatttttctgtcactttcctttccttccccacctcattctctcctttgctaatccctgtatttgtttataggtgaattttttttcatatactccagactaatcatctttggatttcattggatgtttgcaaatttaataatttctcatttacatttccctttatgttctaaaaacttttcaactaaggcaattttcaaacattctaaaaggagagagacttgaataattaattctcatgtgcccatcacccagtttatacaattataacacatggccaatctttttaaaaatttacacttcctggattattttagaagaagtcccattcatattatttcatagtcttcagtatgtatgactaatagaaaaggactttaaaaaaccgtaataataatactattcatacttaaaagtaaacaataattccttaatattatttatatccaggcagtattcaaatttgccatattgtgtcatgaatgccacatgattgtaggcatgttgattgtagttttctccaatcaggatcccagttaggcacatacattgcattttggttgatatttctcttaaattgctttaatgtgtttccttgtgttgcttaactggattcttgatctccacgtgtgtcttcttttatggtaatcacgtctccagatttgctcagattttagttcagaaattttcccccccagggatacagtgtggttgataagtgtgtgtgtgtgtgtgtgtgtgtgtgtgtgtgtatgtgtgtttaacaccaaatctgttgttcctgcactagttcctccaattctctgacaccaactgggtgtctaataattcagctccattctgacactacattacctgtacttagcatataccctacaagttaaggactcagttccataaagctgcctctactttagatgccagccacaaatggggtccccaggctacttgcatatctacccccccactataaattcggggtttcccatgaccctccctcaggttagataattcactagaactactcacagaactcacggaagtgctatacttacagttttattattaaggatataactcagaaacagccaaataaatggaagatatatataaggcaaggtactggggcaggaggtacagagcttccatgccctttctgagtgtgccaccctcccaggtcatggatgtgtttatcaacccagaagctccccaaatctcattcagagtattttggttttgtttgtttgtttgttttgagacagtcttgcaacatcttgctctgttgcttaggctggagtgcagtggtgtaatttctgctcactgcaacttctgcctcccggactcaagcaatccactcacttcagtctcctgcctagctcggactataggtatgtgccccattcctggctaatttttgtgttttcttttctttttttttttaaactcaaacttgccttatttatatccccaatggcatgatctcggctcactgcaacctctgcttcccaggttcaagcgattctcctgcctcagcctcctgatagctggcattacaggcacccgccgccatgtctggctaatttttgtatttttagtagagacggggtttcaccatgttggccaggctggtttcgaactcctcaggtgatccacccacctctgcctcccaaagtgctgggattacaggcatgagccactgtgcccagcccacattttctttatccagtctatcattgatgggcatttgggttggttccaagtctttgccattgtaaatagtgctgcaataaacatatgtgtgcatatgtctttatagtagaatgatttataatcctttgggtatatacccagtaatggtattgctgggtcaaatggtatttcttgttctagatccttgaggaattgccacactgtcttccgcaatggttgaactaattcatactcccaccaacagtgtagaagtgttcctatttctccacatcgtctccagcatctgttgtttcctgactttttaatgatcgccattataactggagtgagatggtatctcattgtggttttgatttgcatttctctaatgaccagtgatgatgggctttttgtcatagttttttggccgcataaatgtcttcttttgagaagtgcctgttcatattctttgcccactttttgatggtgttgtttttttcttataaatttattttaagttccttgtagattctggatattagccctttgtcagatggacagattgcaaaaattttctcccattctgtaggttgcctgtacactctgatggtagtttcttttgctgtgcagaggctctttagtttaattagatcccatttgtctattttggctcttgttcccattgcttttggtgttttagttatgaagtccttgcccatgcctatgtcctgaatggtattgcctaggtgttcttctagggtttttactgtttggggttttacatttaagtctttaatccatcttgagttaatttttgtataaggtgtaaggaaggggtccagtttcagttttcttcatatggctagccagttttcccaacaccgtttataaaatagggaatcctttccccattgcttgtttttgtcaggtttgtcgaagatcagatggttgtagatgtgtggtgttatttctgaggcctttgttctgttccattgatctttatatctgttttggtaccagtagcatgctgttttggttactgtagccttgtagtatagtttgaagtcagatagcgtgatgtctccaggtttgttcattttgcttaggtttgtcttggctatacgggctctttttggttccatatgaaatttaaagtagttttttctagttctgtgaagaaagtcagtggtagtttgatgggaatagaattgaatctatcaattactttgggcagtgtggccattttcatggtattgattcttcctgtccacgagcatggaattgtattttctgtacagtcagggtttgctgtgttgcttaggctggtctcaaacttctgggctcaagcaatccttcctcttttggctccagagttgctgggactacaggcgagccaccatgccttgctaaattaatgaactttaaacacatttgacatgttttaatccactgaagccattttttttctttttgatgcacacattatcccctttgaagtctttttaaattagcttctgtgtccttttgacatcataacagctgatattcataatggataaatcaccattattaagtttttcattaatctgtgacctaatgatttttgcagccatcgatggttgttgtctgcaagcatgttttcatcaggtgctgtatttcttttttttgtttttattattatactttaagttttagggtacatgtgcacaacgtgcaggtttgttacatacgtatacatgtgccatgttggtgtgctgcacccattaactcgtcatttagcattaggtatatctcctaatgctatccttcaccactccccccaccccacaacagtccctgatgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacattaactcatcattttttttggccaggtgctgtatttcttagctggaaaatttcaactatttagtcatgctgaagcctagtttgttcagtaaaggcaagataaatactttattcattccctttatatgtacatgttttcagaaaaataagtttattccctaggattgtccagtgttgaccagcaagggttatttgttctccttaagtattattatgaactaatgaattttaaacatatttgagtgttttaattcactgcagccattattctttttgatgcccatcttatactctttggaagtctctttaagttgttgctctgtccttttgatgtgattccagtagtctgatagcttccttgttttctggtgtcacaagatgttccatactcatctgcatttcctaccctaatcctggaaaagttatttctccaagctatagttctttttagtggcaagaggtatttagataccagactttgggtgctagggatatatatagctattgctttagtctttgcttctaggttatagaatgtctaattgatagggttaggaaatattattttctaatgctatattgagatatcatttacatatagtaaaaatgcacaaatactgtgtagaacttgataaattttgacgtatgtatactctcatgtaacctgaatcaccctcatcaagattggctgatgaaactatcattaatcagatatttcacctagtatcaagctctaccaataatttcagggacacaggtaacaaagagactcctttgttccagagcaggtgccccagtctctgaccagagactagaatgtctgctgtggctactgctgccaggcatcaaacaatgtctctaaactctcataagggtgccatctgtagtattgtaactagagagggtggggcccctctcaggtgagcagtgtggatatgaagcagtggggagtgtgttctactcaagtgtaagtctcacagcagcctatagcagagctttgggtgttgtcccaggtgtgcataggagagcctggcttttctgccccttcttggctgggcagcagctgcagtcatgtcagcctaaagtcaggccaaagttgggccacagctcagaattaaactctccaagtgacacttttggcctgtgccctgggatactggggcaccaccctggtgaacagcatgggcaaaaagctgtgggaagtgtagtctgattgtgtctcagtttcacagcagcccattgcagggctgtgggtattctatagatatgtgtggggtagcctggtttccctgttggtcctttgctgggcagtgactggggctgtgtcagcccaaactcaggccaagggcaggactcagcccagcattgaactcagaaaatggtgccttgggcatggggctagagagaatgagtcaccacccagccaagcagcatgagcaagaaggtgtatggagtatgatctacttatgtctcagtctcaacagcagcttgtagcagggtgacaagtatcctcctgggggtgcatgggcatgcttgttctccctctccttttttggagcagtacagtggctgcagccatgtctataggtccctggtatctaaactcttaaagtggctccctgctgaggctgctccagacttgggtgcctgtgggattctgtgtggattccttttctggaacaatgtctttgtgtgatctttaggcagctccatatgtgaggtgtgaggccctagtggatcgagggtttctcctatagccaatgttgtaaatgcttgtttcagagctctggggatttttctcttactgtttccctgcgtacagtagcctttcccagctctcagctggtttctggctaggcatgcttcctcaaaccctctcctttcttacttctggggctttctctctcttctctggtgaatccaaatattcattcttagtctgttcaaaatgtgtctacttaactatttctgattcttccctgtggaaaaggcacacactatctagttggccatcttgattattttctctctcactcattgtttatcattgtggtttggtgtgtttctgtagtgggaacatttgattcctttcttgttttacttgtgtgtttgctttactctgtgggttttatacttttttttttttttttttgagacagagtcttgctctgtcgcccaggctggagtgcaatggcacggtcttggctctctgcaacctccacctcccaagttcaagcagttctcctacttcagccccctgagtagctgggattataaggacctgccaccatgcccagttaatttttgtactttttagtagaaacggggtttcaccatgttggccaggctggtcttgaattcctgacctcaggtgatctgcccacttcggcctcccaaagtgctgggattacaggcgtgagccactgcgtccagctgggtttttaactttcatgtgtttttatgatcacagattgtgtattgccctcccttaagcatctcttgtagggatggtctagtgctgatgaattccctcagcttttgcttgcctgggaaagactactacttcttcattcatgaaagacaactttgctggatatagtattcttgactagcagtttcctttcagcgctttgaatatattgtttcattctctcctgtaaggattttactgagaaatttacagttaatctgatgggggtttccttataattgatgacacgcctttttccttctgtttttagaaatatctttgtctttgacttttgacaggttgactgtaatatgctgtggagaagacctttatgaattttatctgtttaggcatctctgaacttcttttatttgaatgtctaaatctcttgctagacttgggaagttttcagctattttattaaatataagaagtttttgatccctttttttctctttttctgtgacattgaaaattcaaatacttgtttgcagtgtggtgtctcatatgtcttgtaggcttttttcattcttttttgttctttttttaaatttttgattgactgggttagttcaaaagtcttgtcttaagttctgaaattctttcttctgtttgatctagtattttttgttgttgtttgttttgttttgaggcagggttttgttttgttgcccaggatagagtgcagtggcacaatcacagctcactgcagcctccaacttctgtgctcaatcagtgctcctgcctcagcttcctgagtagctgggactacaggtgcatgccaccatgctgagctaatattttaaatttttattagagatgaggtcttgttatgttgaccaggctcttctcaacccctgagctcaagtgatcctcctgcctcagcctcccaaagtgctgggattataggcgtgagccatcatgccaggcctagatctagtatattgttgaagctttggaatgtattttgtatttcattcggtgaatcctttagttctaggatttctttttttttttttaatgatacctatttggtaaatttctcatttataacctgaattgtttttctgatttctttatattatttttcagaattatcttttatctcactgaacttatttaaaatcagtattttggatttttcatctggaatttcagaatttctttttgattatgatctgttggtggagaattactaacttcctttggagttatattttcttgtcttctcatgtttcttttgttacattgatatttgtgcattgggtgtaacagttgcttcttccaattttttggaaataattttgtaggggaggatcttttcctgaagatgtacccatggtgttggttgggtagggccctttggctttaattctgggttcatgcagtagcatagtctttgtatgattcctttggatgtgaatagtcagtggcgtttgtgatttcctcaatggcttagggtgtggttgttagtgggggctgcggagaagttttgctgggtaaaggaatgccatgtttgccagtcctcagaccccaatggtggcaatgccaggccaagtatgcttgtccttggtttccaggacagcacatgctggcactactgttagaaagcccaggttggccagtgcttgggtttccaggagtcttgcttgggtgctagtagcagcagtggtgggccagacaggtgagtgtgttcttgggctcttaggcagtgggcacgatgtgggtgatagtagcaatggcttgacaaccctgtgctttccaagtggtctacactggtgttagtgctggctgtgatgtgctgagtgggtcagtcaggcccacaggtagcatgtgcaagtggatgccagctgtgttggtagtggcaggttgggtaggcctgaccttgggcccttgggaggagtgttgaggtaccaatggtggactgggctgggtgatacccagggccttgggtggtgtgctcagacactggtgagaggggttatggagctgggtagagtggacctgtcctcaggtccaggtggtgagtgcagactctgattgcggtaggcaggtgcaggatgatgcccaggtttccagtggaatgcttgagtgggggtggcagtggttgctttgcagccctgtcactggggagggtgaggttgctttcactggcagcagatgtgtggaggtggctggtgaacatgtactttgctcttacatttgctccagtggaggcagtttgcaagggcagcagctgcaggtgggaaagtttgtcctttgggtgtgtgaaaatgtgcagcagctttgctgcttagggcagcggggtcactgtaaatggctcacactttgacactggtggcagcagcagctagcattgcctcaggttctgggttgggtagccctcccttgggtcatgtgaagatgcatggctacccttctgctggtggggttggggttcctgccagtggcttgcagtttggcctcaggtgtggcagcagctagtgacaatggtggttgtgggatggggtagcctttcctctgggtccgtgaaaatgcatggttgcccttcttgggcgtagagtggctgccagtggcttgtgttttgattctgtggcagcagcagccagtagtggtggtggctgcaagcaggatagcatttcctcagggccatcaagatgtatggctgttcctctgccgtagggaacagggttgctgccagtggctcctacctcttcgcgggtacttgcagccagctgcagtggtggctgtgggcaggagatgtcagctttgctccagggttgtggagttgtaggggatgttgggccctagaccatgatgcagtctacttggggctgggcacacaaaatggcagcatgctgtagttgcttaggattggggggtgggtgtatgggacccaacatgagctccctgtatggagcaatatacttgtgtagtctctgggcagctctctgtgtctcagagcacatgaggatcaaaggtccctttcgtggctagaattgcaggagtttgcagtgagaatatgggccactggggtctctcatttaccccttctatgcattgaggagcctgtccaggctcccagccaagaaggctgcttctcttctttctccttccttcctttatgtgtttcctgtcacttctctgttgaagtcccatttctctcttagatgatctatttgaagtgtgattatctacttgctattttggctcttttctcagagggaggcaaataacagtggcctctagtgagtcatcttgaagcccctgtctgaaataatgtaatctaacaaacacgtttttgtgtgttatatttattgtatactgtatctttacaattaagtaatctagagaagggaaaatattattaagaaaatcataaggaagaagaaatgtatttacgttttattaagtcttaatcctcattgtcttcatgttgagtaggctgaggaggaagagcatgggttggtcttgtctcacaggtgacagagatggaagaggtggagggataaataagttaaataattttaacttaatattatttaattttaaaataagttaaaattatttaacttactaacttatttaaaaataagttaaaattattttaaaataaattaaactttttacttttttttctcaataagttatacaaggtgtaccaggcaggcacaccttgtgtaactttttgagaaaaatctgtttgtaagtggatctgtgcagttcaaacctgtgttgttcaggcatcaactatgtttcttttcatacattgttggattcagttttctaattttttggagggtttttacatatatgttcgtgacatatattggtttgtggctttctttttgtgtaatgttgttttctgatttcagtattagggtgatgctggcctcatggaatgagtttggaagtatttcctctgcttctattcaatgactgagaattggtatagttttttccttaaatgtttggtagaatttaccagtgaacttatataggcctgacattttctgttttggaaggttattaatggttgattcaattttaaaaatagaaataagtctgttcagattatttttttatttttatttttttggagacggagtctcactctgttgcccaggctggagtgcagtggcgcgatgtctgctcactgcaagccccacctcctgggttcacgccattctcctgcctcagcctcccaagcagctgggactacaggcgcccgccaccatgcccggctaatttttgtatttttagtagagacggggtttcactatgttagccaggatggtctcaatctcctgacctcgtgatccacccgcctcggcctcccaaagtgctgggattacaggtgtgagccaccatgcccggcctgttcagattatttttgtgtgagctttggcagattacgtctttcaaagaattagttcatttaatctaggttatcaaatttgtgggacttgagttgttcataatatttttaagttttaatttccattggatctgtactgatgccctctctttcatttctgatactggcaatttgtgtcctctgtctttttttcctttattagcctggttatagtgttaccaattttattcatcttttcaaagtatcaacttttggttttgctggtttttctctcctgatttcctgttttcaaattgattgatttatactttcctatttttgcatattaagatttaatttgctaaaggagatttaatttcctaagaagcaaacttagattattaatattagtttcttttcacttctaatatatacgcatttcaatgctgtaaatttttgtcaatgcactgcctgtgctgcgttctacaaattttggtaagttgtatttttatcttgaaagtatttttaaatttgtcatgagatttcttctttgactcatgtgttattagtaatgttggttaatccttacatgttttgagatttttttcaattatctttctgttattgatttttagcttattctactgtggcctgagagcagacattgtacggtttctattcttttaactctgttaaggtgtgttttatggcccagaatgtggtggcgtattttggtgaatcttccatgtgatcttgacaggaatgtatattctgctgttattggatgaagcatagttcacccttgaacatgagtttgaactacatgggtccacttatatgtggatattttaaataaaagttacatcagttatgcctgcctctccagcctccccttccacttcttccctctctgccatcggtgagataggaataccaacctctcctcttcctccctgtcctcagcctgctcaatgtgaagatgagggaggatgaagaccttaatgatgatccacttccatttaatgaatagtaaatatatcttctctttatgcttttcctaataacattttcttttttttggcttactttactgtgagaatacagtatataatacatataacatacagaatacttgctaactgatggcttgtcttatcaataaagcttctggtcaacagtaggctattagtaattagctttctgtggaatctaaagttatacataaattttcaagactgttgggggttggcacccctaacacttgctttgttcaagagtcagctgtagtctgtagatgttaattatcaactgtacactatagatgttaattatatccaatttattggtgttgagttcaaatgtatctttactgatttttccatgctagatctgtccacctctgatagagggatgttgaagtcatttttgatttccgttacagtgttttgatatctaacatttctttttggttcattcttaggatttccatctctttgcttacattgcccgtctgttgttactacatgctatctactttctccattatgatgcgtagcatattaatcataattgttttaaattcattgtctgataattccaacatcccgtctacatctggttctgaatgttttctttcttcaaactgtagtttttgccctagagtatgccttgtaattttttcttttcttttcttttcttgttttttttttttttttgagacagggtcttgccctgttgtctagtctggaatgcagtggcgtgatcttggctcactgcaacctccacctcccggactcaagtgatcctcccacctcagcctcctgagtaactgggactacaggtgtgcaccaccatgcctggctaatttttgctttttttttttttttgggggtagagaccattttgtcttgttgcccaggctggtcttgaactcctgggctcaagcagttgacccacttcagcctcccaaagtgctggaattataggcattagccactgtgcctagctgtaattttttcttgataactgtatatgatatatcaggtaaaaaagcaattggtttaaatatgtctttaataatgtaattgtaagatgtacgcgggagtgatgtgttgtatagtcctgtgattaggtctcagtctttttgtgagtctatgtctctggcccatgaattcacaagcatttctcaattttttcctccccctttaggtgggataggatggctagagtaggatggaattgggtatttacctcctcccatgtggaaggatagagctggctggagttggatatttccatcccccaggtcagttaggctttgatgaaacctcagcaggttaggctctgcttaactggtttcttttcagggtagatcttattaagaagtacagagtgctctgggatatttcagaatggtttgtttccccccccgccactgctggaaacatgaggggattttactgcgatgatatgtatgatactgtatttactgtgagaacctgatctagctcctggaggtaaaattcacaaaagcatgggggcccccatgactggatgcccctggagctttcaactctcagtcgtgcccacacctagtttccagcagtttgtcagcagtccaggttttcctatctaggcactgcttcctgtagaaatttctgttccagtatgttgtgattctctgtatccctgtctgtctgtttaattttaggagtagcagttttcccagtgaccctacctatctcaccttttcttacagatctgagaaaagttgttgatttccactttgttcagctttttaatatgtgttaggatggcatagtgacttccaggctccttacatgtgaaaccaaaacctgaagtccccatattattgttttaaatcttttgttcttttgtaatatacttttagagataaagatttctttctaagcattgctttatttacaaaccacaaattttgatatgttttgtttattatttagtgaagcatatttacaacatttcctcgtgaatcctagtttgaaccatgagctacttagaagcatgttgcttaatttccacaaatttgaagatttccccaatatacattttatttttttcttggtacatagtatttgtatatgtttactggtgtatgtgtgatattttgtcatatgcctagaatgtgtaatgatcaagtgtaggtatttaggatatcgatcacctcaaggatttatcatttctgtgtgttgggaacatttcaagacctctcttctagctattttgaaatatacaatacatcattaactgtagtcatctgctatcaaacattagaacttatcccttctatctaactgcgtgtttgtacttattaaccaaactttctttattcttctatccctaccacatccttcctagcctctggtatctatcattccactctctacctccatgagatcaactttttttagctcctacatattaacaagaatgtaaaatattttctttctgtgcctggcttatttcacttaatagaatgacatccagttccatccatgttgctgcaaatgacaggatttcattctttttttatggctgaatagtatcccattgtatatactgcattttcttgatccactgatggacacttaggttgattccatgtctttgatgttgtgatagtgctgcagtaaacttaggagtgcatgttaattcctttcttttggataaatactcagtggttcctgcaatatattttgttactgatttctaatttaattttattggtatcagagagcatactctgaatggtttcagtccttttaagttgattgacatttgtttcattacccagcatatggtctgcctggaaatgtttcatgcatttttaaaagttatgtgtatcctatagctgttgggtgaagtgttttataaatattaggctgaattggttgatagtggacttcaagtcttttagaccctgacagattctttctctacttattcaatcaactactgagagagaagtactgaaatctaaatattattgtagttttgtctgttttattcccttttgttctattagattttgtgatttttttaaaaaaagttctattattatgcaaatatacatttagaattgttggatctttttgatgaattgacccatttatctttatgaaatgtctctctttattgcttagaaaatactccctgtgccaaagggagttgttgcttgacattaatacaggcatatttgcatatagtatttttattcgaagttcctagagcagtcaaatctgtagggacccaaagttgaatggtggtttctgggggcttgggggagggggaggggagatagggagtagtgtttgagagatagagttttaattaggaaagatgaaaaagttctggagatggatggtgctgatgattgcacaacaatatgaatgtacctaatgcaacagaactatacattttaaaatggttaaaatgataaattttatgttatgtatattttaccacaatttaaaaaaagacatagcaccaaaaaaagatgatgaatgaataaattccaaaaagctgtgccaggagtgataatgtatagtttgtttagaatcattgaagccttcattctttatttaattgaagcagttaaaaataaatattaatttgaaataaaaatcagcagctagattctattatattttattcaaatttggaatttttttttttttttttgagacagagtctggctttgttgcccaggctggagtgctgtggcacaatctcgcctcgctgcaacctctgcctccctaactcaagccatcctctcaccttagcctcctaagtagctaagctacaggcatgcaccaccacacccatgtattttttcgtagagacggggttttgccacattgtccaggctggtctcaaacttctgagctcaaaccatctgtcctccttggcctcccaaagtgttggaattacaggcatgagccactgtgcccagccaaaaattatttaaattatagcagaaatacagtttcctatttgggtctcacgagaatgtgtttattctttgtttcagcaagagaaggcagctgctgtggatttgactaaccacttagaatacactctgaagacctatatagataccagaatgaaaaatctggcagctaagatggaaatactgaaagaaatgaggtaggtaaaagcatatttttcagaaggatattttaaactaatttttaatcaattggtgctttgtttaaattgtgtgcttgccatttttgctttaaaatttaacctttgtatttttatgacttcaaagagagaaagatagttatttctgagatgaattttatactgtttttgtcaggtttctactgtcactgcttggagctagagtgttctaaggttataactgagactgaaattgaaaaaacagcaacatagcttttaagtgatagtttgatgggaaactaccatatccagttattttgcttggggttattttcaggagtacagcatgtccttgaataacgtgttttcattcaacattatttcattataacattgaagaagaaaatcaattcctagctggagccccactgtctgtgtggagtttgcacattctctccatatttgggtggttttcttggaatactgtggtttcctctcacatcccacttaggtgaattggtgtgtctgtattgtcccagtatgagtgagtgtgtggatgagggtgagtgtgccctgcaatgcaagggtgtcatgtccaggattggttcctaccttaatgctctgagctgctgagatagatgtggccacctgcaacccctggattggaataagcgggttggaaaatgaatgagtgaatgagtatatacagattatcataaaataaaaatttgtgaagtatgcaagaatcatacagatgcctttgcaataagcgatgtgacatgaaagcattcagcaagcccactacgtttgttattgtttgtttttgaacctgtggtggtagggggcgcttcttagaattttcgcttgcaaacatttattccttgatttaaccctactgtcacccactcattcaccaaagtttgggtaaataattatctttgttgtttttattgctttttcttaaatgtgtgtataggacacgtatattttagtgtttaatattagaaatgttttgggtctttatttggaagtgctgtttttgtgactaaaaatatgccataggaacttaactcttgtttagatcaattagcctatgatactatgggtttcttatatgtcttttctcttagacattgtaaattatctgtagaccaaaaattgaaggttcatttgataccatttcaaattctgcagactttcgaagttgccttttttatagtttaaaaaatttttaattttttcatattttttatgtcatgaaattagtatatccacagttgttttttaattaaaagtttatattaaattatgcatgtctgcataaaaatatgtggactgaaaaaaataagttatacatgattttatataaagttttaaaaggtaccccttcaaagccagtgctgtaaacactaacttttagaccattactattaaagtgtaactttttctcacaccagctttctaatttattgatcttcttctttttgatgtttttaaaaataggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtggtgagttgggaatttttctctattgtggtttttatctgttgaacataaggaagtgtttttttaatttcttctaaaaaaaataacaggatacatgtgcagaatgtgcagatttgttacataggtatacatgcgccgtggtagtttgctgcacctgtcctctaaattccctccctcacccccccatttcctaacgagccctggtgtgtattgtttccctccctgtgtccatgtgttctcaatgttcaactcccacttacgagtgagaacatgtagtgtttggttttctattcttgtgttagtttgccgaagatgatggcttccagcttcatccatgtcgttgcaaaggacataaactcgttcctttttatggctgcatagtattccatggtgtatatgtaccacattttctttatccagtctatcgttgatgggcatttgggttggttccaagtctttgccattgtgaacagtgctgcagtaaacatacgtgtgcatgtgtctttatagtagaatgatctatattcctttgggtatatacccagtaatgatattgctgggtcaaatggtatttctggttctagatccttgaggaatcgccatatcgtcttccacaatggttgaactaatttacgttcccaccaacactgtgaaagtgttcctgtttctccacatcctctccagcatctattgtttcctgactttaatgatcgtcattctaactggtatgagatggtatcttcttgtggttttgatttgcatttctctgatgattagtgatgttgagctttttttcatatgtttgttggccacataaatgtcttcttttgagaagtgcctcttcatatcctttgcccactttttgatggggttgtctttttcctgtaaatatgtttaagttctttgtagattctggatattagatctttgtcagatgggtagattgcaaaaattttcttctgttcaggagaacaggttgcctgttcactgtgatgatagtttcttttgctgtgcagaagctctttagtttaattagatcccatttgtcaattttgacttttgttgcatttgcttttgttgtttttgtcaagaagtctttgcccatgcctatgtcctgaacgctattgcctgggttttcttctagggtttttatagttttaggttttacatttaagtctttaatccatctagagttaatttttgtgtaaagtgtaaggaaggggttcagtttcagttttctgcatatgtctagttttcccagcaccatttactgaataggagatgctttcccaattgcttgtttttgtcaggtttgtcgaagatcagatggttttagatgtgtgatgttatttctgaggtttctgttctgctccattggtctatatgtctgttttggtaccagtagcatgctgttttggttactgtagccttgtagtatagtttgaagtcaggtagcatcatgcctccagcattgttccttttgcttaggattatcttggctatatggggtcttctttgaatccatatgaaatttaaaatagttttttctaattctgtgaagaatgtcaatggtagcttgatgggaatagcattggttctataaaattttttggccagtatagccattttcatgatattgagtcttcctatccatgaggatggaatatttttccatttgtttgtgtcctctcttatttccttgagcagtggtttgtagttcttcttgaagaggtccttcacatcccttattagctgtattcctaggtattttattctgtttgtagcaattgtgaatgggagttcattcatgatttggctctttgcttgcctcttgttggtgtgtaggaatgcttgtgatttttgcacatttattttgtatcctgagactttgctgcagttgcctatcagttcaagacgtttttggggtgagacgatggggatttctaaatataaaatcatgtcgtctgcaaacagacaacttgtcttcctctcttcctatttgaataccctttatttctttctcttgcctgattgccctgtcgagaacttccaatactgtggtgaataggagtggtgagagagggaatcgttgtcttgtaccagttttcaaagggaatgcttccagcatttgcccattcaatttgaggctgtgggtttgtcataaataactgttactattttgagatatgttccgtcaatacttagtttactgagagtttttaacatgaaggcatgttgaattttatcgaagccctttctgcatctattgagatagtcacgtggtttttgtcattggttctgtttatgtgatggattacgtttattgatttgcgtatgttgaaccagccttgcgtcccagggatgaagtggacttgatcgtggtgggtaagttttttgatgtgctgcgggattcggtttgtcagtattttattgaggattttcgcatcgatgttcatcagggatattggcctgaagttttctttttttgttgtgtcttttcccggtttgggtatcaggataatgctggcttcataaaatgagttagggaggagtccgtccttttcagttgttgggaatagtttcaaaaggaatggtatcagctgttctttgtatttctggtagaattcggctgtgaatctgtctggtcctgggctttttttggtcggtaggctgttaattactacctcaatttcagagtttttgttattggtctattcagggattcagcttcttccagaaggggtggccagcccctgcacacctgtgggcgtttctcgtcaggtggaacgagagacttgagaaaagaaagagacacagagacaaagtatagagaaagaaaagtgggcccaagggaccggcgctcagcatgtggaggacccgcgcccgccggcaaaggtctctgagttccctcagtatttattgatcattatctctaccatctcggagagggggatgtggcaggacaatagggtaatagtggggagagagtcagcaggaaaacatgtgaacaaatgtctctgtgtcataaacaaggttagaaaatgtgctgtgctttgatgtgcacatacataaacatatctggtgcattaaagagtagtattgccgtcagcatgtctcacctccagccttaaggtggttttctcctgtctcagtagatagaacatacaatcgggttttacaccgagacattccattgcccagggatgagcaggagacagatgccttcctcttatctcaactgcaaagaggccttcctcttttactaatcctcctcagcacagaccctttatgggtgtcgggctgggggacggtcaggtctttcccttcccacgaagccgtatttcagactgtcacatggggagaaaccttggacaagacctggctttcctaggcagaggtccctgcggccttctgcagtgttttgtgtccgtgggtacttgagattagggagtggtgatgatttttaacaagcatactgccttcaagcatttgtttaacaaagcacatcctgcatagccctaaatccatgaaaccttgagtcgacacagcacatgtcgtagggagcacagggttgggggtagggttgcagattaacagcatctcaaggcagaataatttttcttaatacagaacaaaatggagtctcttacgtctacttctttctgcattgacacagtaacagtctgatctgcctttcttttccccacactacctggtttagtcttggtagggtgtaggcatccaagagtttattcatttcttctagattttctagtttatttgtgtagaggtgtttatagtattctgtgatggtagttggtatttttgtggggtcagtggtgatacccctttaacattttttgttgagtctatttgattcttctctctcttcttcttagtctagctagtggtctgttttgttactttttttaaaaaacagaccctagattcattgatttttttttggagtgttttttttgtgtgtgtgtgtctctgtctccttcaattcttctctgatcttatttcttgtcttctgctagcttttgggttcatttgctcttgcctttctagttcttttaattgtgatgttaaggtgttgatatgagatctttctagctttctgatgtgggtatttagtgctataaattcctctcttaacactactttatctgtgtcctggagattctggtacattgtctctttgttctcattggtttcaaagcacttcttgatttctgccttaatttcattatttaccctggagccattcaggagcaagttgttcagtttccatgacattgtgtggttttgagtgagcaatactaaccttaaatgtaaatgggccaaatgccccaattaaaagacacagactggcaaattagctaagtggtcaagactcatctgtgtgctgtattcaggagacccatcttccgcacaaaaacacatacaggctcaaaagaaagggatggagggaaatttaccaaacaaatagaaagcaaaagaaagcagaggttgcagtcctagtctctgataaaacagactttaaatcaacaaagataaaaaaagacaaaggcattacgtaatggtaaaggaaacagttcaacaagaagaggtgactattctgaatatatatgcacccaaggagcacccagattcataaaacaagttcttagagacctacaaagagacttagattcccacacaataataatgggagactttaacaccccactgtcagtattagatcaacgagacagaaaattaacaaggatattcaggacttgaacttagctctctatcaagtggacctgatagacgtctgcagaactctctaccccaaatcaactgaatatacattcttctcagtgccacatggcacttattctaaaattgaccacataattggaagtaaaacactcttcagcaaatgcaaaagaactgaaatcataacaaacagtctctcagatcacagtgtaatcaaattagaactcaggaaatgttatctttctagaaagacaaggaactggagatattgtaatgatagtttgtgtaaaacctttaacttttacagtatcttcatattaataatttccttcatttattgccttataagaaaggtgtaatagacaactggtgattgtggataaggggtagcaaaatcttttccctttttgcatgaaaactttacctttggttaactccctctctttgttcccttggtaatgtgataaaatatttcaactgtgttactaggcaacattatttatggtaagtataacttatgattgtcaaactgcatctgtactgggagaaactacaaactacaaatacttgatgtggactcttgtaactaaacatgccccttgagggaccctggaagctatacctatggagttgttacaagagatactggcttttgagggacattaggcttgtaaaccagagtggctttcatacatgctaatgtggaacttttctggtctgagtggtgtgttttatgcatgtaagactctgccttactattaattagtgtctgagtcacctattgttgggaggtagttgtttgtgtgtgtgagtaggggtgtgaaaatgaaatattttacataaattctttattagcttaggtacaagtatatttatttcctgttgcagttttctttaatttattgtattgggctgaacagaacttcctgtttttcttgtaaaccattccctacaaccaccataactttccctagcacctgtgagctctatacttgttgtgtttggacttgttccatcttaaatatttgtggtttctgcctctgtggattataccctgtaaatcttactccctagtcatacctaggttgatcagttggcagcctgactgcctctgaatgagaagtatgagcaggataactaggcttttgaaaatgccaggaatgtttagtttggagaagggatttgattttggttattttacgtattagattctaactgatcacttctgattatgggagaaagaagatgacagcagaatgattaattttttaatttctatgaaacacaggcagtgtgtttataaacattttcttacattaacttttaaaatgggcatatttgctcccattttataagtgaggaaacaggcttacaagggtaaggaaattgttcaagattacctagttgtaattttttaaaattaaaaaattactcttttttttgaggtatggtctcactctgtcacccaggctggagtgcagtggcacgatcacagctcactgcagcctcaacctccagggcacaagagattctccacttcagcttcccaagtagctaggactacaggcggtgtactaccaaccatgcctggctaatttttttgtactttttatagtgacggggttttaccatgttgtccagacaggttttgaactccttggctcaagtaatcctcctgccttggcctcccaaagtcctgggattgcaagtgttagctaccatgcccgtaccctagttctaaatgttaatatggaacttgaacccagacatgtctgacagcaaagcctattgtttttccattgaaaccacactattgatattaaaatacttcttaatgtattttcatgtaagatgaaaagatgtaaaaaaacctgccttatttgtttttgtggtttgagcatagtgaaagtattcaggatggagctttagcacttactatcctatgagtacagatgtgactttttttgaaagcagaattttttttttctactactgcttgtgtttccggacttaaagtttacttgatagatggaagtgtagattattggctaaatatataatcataatagccactcaaatgaaatcgtcattttatttcccttattgtacttattttggtttagaattgataacttttattcaagtattttgcatagttctttaacttgattgccatgtggccatatgctttttttttttttttgagacggagtctcgctctgtcgcccaggccggagtgcagtggtgtgatctcggctcactgcaagttctgccttccgggttcgtgccattctgctgcctcagcctcccgagttgctgggactacaggcgcctgccactctgcccagctaattttttgtatttttagtagagatggggtttcaccatggtctcgatctcctgacctcatgatccgcctgcctcggcctcccaaagtgctgggattacaggcgtgggccaccgtgcccagatgttttttttttttaatgatgaaaacagtaggctttacttgaggtcttttcttttttatttatagttttaaaataatctggttgagcttatgcaagaaaaaatatcctaaaattcaggcttttatagttttatagttttataatgtattttatagttttatttatagttttaaaataatctggttgagcttatgcaagaaaaaatatcctaaaattcaggcttttatagttttatagttttataatacattttatagttttatttatagttttaaaataatctggttgagcttatgcaagaaaaaatatcctaaaattcaggcttttaagtgtatgtgccagacactgttataggtaatagagattaaaacttttttattttatttcattttattattattttacttttagggtacatgtgcacaatgtgcaggttagttacatatgtatacatgtgccatgctgctgtgctgcacccattaactcgtcatttagcattaggtatatctcctaatgctatccctcccccctccctccaccccgagataaaaatttttaaaagacatatcctttctttctttcttgggtacaggatggatatattaatatatagttttaatacagtatggtaagtgctataataaagaaaatgcatagagttcttggatatctttcacatatgtatttccaaacacagcctgttggacaaattggagggtttatcctggtgtttaagtgtatcttgaaggatgagtagctgaaggagttgagaatgggatgggaatagaaaagaggccatatgtaattagtaggaacttatataattttctgtaagaaaaacaaaaatttcattgttgcagaaataatgggaaaaataaaaattagatcagagttgttgaacttaaatgttttatttttaattaagagaaaggaagtttttttgtcattttgttgatctaaggagagaaatgtcctaagtgctataatgtttggagaatataaagttaattttggagatcactttttttcatataggtcatatgcggaaaagacctgatgtattaatgatggttattctttttttcttcctccagagtgaagggaatattttgattgcccaaagaaatgaaatgcagcagaagctgtacatgtcagtagaagattttattctggaagttgatgagtcatctcttaataaacgcttaaaaacattgcaggttggaattaaaaatatattaaatatacgttaaattgtaagtttatttaagaagtgaaattagcatttaccttaagactttagattgttctgtgatggttgcaaaagtttttcctgtttcctgaattctgatttctttttaatgggattaaaagtttatattaatatattttgtggctatgtttatatgcatatctatcttgcaaacaaggtaaaatggctagggactccagtattcactggggaaattaatggagacaggagcagtagcaggtatgtgggtccctatcgtccattgcattctagcagaaaatgtagtaggaccacatgttacagggagaagggatcaactctgatccataaattatagggtttttaggctccatgaccagggaagtttctccctgatgtgatcagaggctagagtactgtagtacatatagctatatgatatggtggaatcttgtcttcagctctgtcttgccagctcaggaatgactttaattcggggtgaatgaacatgacagtgttaagtaatttcacctaataatagtgtttctctctacttattcagatctttttttgtcctttaatattgtttaaaatttttctctataagtcctcatgcttttttcttcatttaacttttatttatttatgcttttgattgcttttatgaatattatcttgtcatttcctagttttgattgaatagaggaatactgttcatttttatgtactggtgtttctctgataactctgctgatctctcttttagttctcatttgtctgttgatactctgctttctgtgttttcaaatgttttcatttgaaatgttttcattttctaatgttttcatttgaaatgttttcattttcaaatgttttcatttcattttcaagtgttttcatttgaaaacaataactctttaatcttttctcttctagtccttttaccttttatgtatctttgaatttttactgctttggtcagttaccctagtactaagctgaccagtagctaatatcgatcttgttgtggactgcagggagtaagcttgctagaaatttggagaagaagatattcagggacatctgggcattgtttctttctgtcctgctggatgaagatgtagttttgatgatgcaccacatggcttaagaaccattggagccctggtttgaaacattttcttaattggaattgcataaatagtataagttcttccagaatgttgaagtaagccttgcatataaaagggcagtaatatagtaagaatttagctttccacaatgcagcttctactttgtcccttaaaggtttatttcttctcactgttagtaaatgtaggttaaggttctgtaattaagatcatctttaaacctcttttcttttaaaagttcaatgctagaagactttttgccttaactggcttgtctccacttctagtattccctcaggtcaccaaaatattctttaaacttctctttattttgctgagaaatagtttatatttttcaagtatccaagaaagatatttctataatgaaggtcaaataaatgaaagttcttgatttctgatttcctcagcattttatttagacttcttttgtggcatacaatacatgtttgattttttgtgactggtcttcttaagttcaaaaagaaattgtattctcggttttcttggtgtacagttttagatatatctaaaacttgcttaggttttggttggttcagtatatcagtctttgagatatttttgttacatatatctgaaatagataggtttgtccctatttgtccctattgttcttttggttcttgttcaaagtatttcagcgccacattgttgggtgttaaggtattcatgattgtaatgtatttaaaaatgtgtatcccccccatgacacatgtttacctatgtaacagaccttcacatgtacctccaaacctaaactaaaagtcaaaaataataataaaaatgttttctttttaactactatgtaatcttattttttcacttagattttaaaaaataaaaatttttttgtttgccttttaagttcgtatcccacctttctttttggttaacactgcaacatcttttctttttttctatttttattttatttatttttatttttcttgagatggagtctcgctctgtcgcctaggctggagtgcagtggccgatctccgctcactgcaacctctgcctcccgggttcaagcgattctcctgcctcagcctacctagtagctgggattacaggcacacaccaccatgcctgtctaattttttgtattttagtagagatgggtttcacgatgttgcccagggtgggctcgaactcctgagctcaggcagtctacccaccttggcctccaaagtgctagatttacaggtgtgagccaccgcacctggcttctccctttatttttaaccttttgtattcacgttttgaaataacctcttgataacacactaatggatttaatttttgaaagcacccaacgtatatcttttttgttggtaacttaatttacatatttataattactgttttattaaaacttatttctgtttatcatcgtttctttttctctctttttctaacttacacctcttatacttttttttttttttttgagatggagtctcactctgttacccaggttggagtgcagtggcacagtcttggctcactgcaacttctgcctcctgggttcaagtgattctccttcctcagcctcatgagtggctaggattacaggcaggcctggctaatttttgtgtttttaatagagatggggtttcatcatgttggccaggctagtcttgaactcctggcctcaagtcatccacccgcctcagcctcccaaagtgttgggattacaggcgtgagccactgtgcccggccactcttctaatactttagaacattcttatctgcctttggtgtctttcctctctttctctacctccttccccaaaccaaccagtgaacctaccacaattgtctaggattttagtcacgggttattatagatattgtgtgtgatagctcagttaaatagactttagagttatttttccattcttatttcataagtcgtttatctcttggctttctctgtatattggaatattttctctaagagtgctttcaaagaaatctttgtgtatttgattttgcgagttatttgatatttcaggatatctcatttcaatctcaaatacaaatagttgtttagctgactataaaatagcaagttcaaaggccatgtttcctttacacctttgacaataataatctattgtttcatttctatcattttatttctttatttatttgagacagagtcttgctctttcacccaggctggagtgcagtggtgccatctcagctcactgcaacctctggctcctgggttcaagcaattctcatgcctcaacctcccgagtagctgggactacaggcatgcaccactgtgcccggctaattttagtagagatggggtttcacgatgttggccgggctggtctcgaacttctgacctcgagtgatccgcctctcttggcctcctaaagtgctgggattacaggtgtgagccaaagtgcccagccttcttatttccataattgttatcagtctaatctttgttcttctgtgatcttttttccctctggaagttttaaaattttctcttgactttgttcttaagttgcatcagaacatgtttatgttttgactgaatctgagccagttcagtctgaggttttatatatttctttaattgtaggtaatacttgataattatttattgagatacttctctcccccattaattttttctcttattctgagacttctgatagatatttcagcttctatttctgttatctacatattttaatggctaatctattgtttaaaatctttttatcttatgtaggaggtgggttaaactaaataaataaatacaatctttttatcttgttggtgtctttttggagggatccttgacttaaccatgtagctaatgaattaatcctctagctgtgtcccttctgccatttagccaatccattgcattttgtatgtcaaagattatttcttttatatttaatatcttcagttggttattttttatttataagtacttggcttttgtgtttccaatattctttcttttgttgagaatatttattatgcttatttttgagttcttactgttatctgggccattgacactgattttgcttcctttttataaagtggcttagttttttatacttctttcagagtgcttgtgctgttcacaccattttatcctcttcttatctctcctcaagatctcatattcccttggaactataagctaccttagttctttgctgttgtgtagttatatgaagggcctagggaagagtgaaagtctggaccacaacttttaagactttggataggtttagggaatagaatggggttatttttatttttaagggtctagcttctgatgttgccatctgggattatctacttcctctttgcttctctcctgggtggtctgtcctactcttcagcaaacctctattccctctgcctcagctactgctcctttccaggcactaccacccttagatgtaaatgctgccagatattcaggggagaagtgaaggaaagagaatggtcaggggctggccagctcttctgtattggttatcagtttttgcctcatctgtgttcttgtgctgtacttgcataaacctgttgcctcttgatggtgctgctgtttttctttctgatgtgagggagagagaagagcctatgaaaaaagttttcttttcccacaggtaattctgtgctgtgacacagtccttctttcacttgtagggactttgttaattcaatgctaaacaccaaccatcctctgcctaagatttctcagagttttgtgattaaaaacttctgagatctcttaagctttttttcttatctctgtaaaatttctagggtttgatttctggagagagctagcaggctgtgcctatcttgtcttttccaattctttattacattaaaaaattttattgttactgttattttttttttgtgcacctgccccgacaaacccagccaggccaattcattaaaaaaatgcctttaagtacagtcaagggctgcatggtttggtcagtgatggactgcatatatggtggtggtgccataaaattatagtacttaactgtaccttttctgtgtttacataggcaatcattgttacaattgcttacattattcagcacagtaacatgctatatctaggagcagtaggctatagcatgtagtttggttgtgtagtaaatttataccatctaggtttgcatcagtacactccatgatgtttgcataatgatgaaattgcctcacgatgcatttcttagaagatatccgtgttgttaagtgatgcatgattgtccatatatatgtttaatgtctttacttaattagaattatttgtatattttagcgtgtagtttatttttatttggcaatcggtcttagaaactttcatgccaggacaaacagtagtgattcttatgatagacaaaggagactcagaagggtgattaggggtggagagtggtggatgttgagaaattacttaatgggttcaatgtacatttggatgatagatacactaaagcccagactttaccactacacaatatatccatgtagcaaaattactcttgtacttaataaatttatacaaaaagttagggaaaacagggtaatgtctacttaattaaaaaccataaggatataaagctttctatttgtaactaattcacttaataaactttactgttatggtccaaataaaccaccttctaggtagttttgtgttttcatctctatctgatgattctaagttgtatttatgaaattctcaagaatggggattcagcatactgcttttctaccccttagatcctaacacagtgctcgaatcctgaattagttaataaactttaataaacagaagtatatctctctgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtaataaaagctcctgcccggttgtgtttgtagcataaaccagggaatatatattttaaaaatcacgcgctttgttcaagagctgacatcatctacctactatgtatcagatttaaaattgccaccttaccagtcaaggttctttattagcttttagtcagattgctccttttattagtctcaaaaaaatcatatcggtcttgttcctcctttttctcagcttttcctaaggattgtcctctttcctcttttaaccatttatttattttcttacagtatgctatgtgtatgtaccttttcctttcagtgcataaattttatgagggtaggcacttttttttcctgcattcctagttcttttacattgcccagggtatagcttaatactctgcttcaggtattaaggcacgatgaatgctgattgaattaaatgagatatttcatgtgtttatttttgcaaatgaggtttttgacctatctgtggaaggatcactgatttcagaagacgcaatggataatattgatgaaatcctagagaagactgagtcaagtgtctgcaaagagctggagatagctctggttgtgagtatcgatattctttattattgcctcctttgaagcagtgtggtttcctttcatggttagaaagtattaaccaataatagagtttttcttgctagttagaaagtattaagactgatcttagctttcttctaataggcttgttgaaagagtaacaatgtctagttctaatccagacaccatgcaaagtcttattcttaggtgacatttttgttttaataggacatttcacataaaaaatctgtttaattctaagaaaactgctcttaatttgagtggacaatcttgtctatattttgattcttgaatgcgtcataccaaatgactataagaagagactccttagagtttgtgaaaacttaaaatctgagagagctctgaaagttgacacacaagatggagtggtcatcctctttctttctccattgtgtatattctttgttacagtgtcaaggtaaaaattagtgtagctactccaaagggtgttttgtaattttaattattgctcattgggactcttcccagttattcaggctgctttccaatgtttcagtggttaggcttctcattttacttgttttttcttttttttactttttataattttactcatattggcattaaaaatacattaagaagttttatattgttaaatagtcctgatgtagatagttttgtcagacttgattttagtagtagttgttaacaggtgatttctaaaagtaaagtgttgaaggtctatatattgtttatagttcttatatttagcatattagtatccctgatttccattaatgctcttattctacacagctttgggaataatggtgtaatacgggtaaagtttcccatatgaatggctttgctttttttagagagacagtgtcttgctctgtcgcccaggctggagtgcattgatgtgatcctagctcactgcagccttgaactccttaatctccctgcctcagcctcccttgtagctaggactacaggtgtataccactgtgctcagctaattaaaaatttttttttagggactggtctcactatgttgcctggctgccatatgaacatctttgatatctatctatcttctgactaggaaaacatttgtgtttaagaactgttttgaaatcactgcggaaatctgttaaaggcataattttgaagtttatctattgttattggaggccttagctgttttggatattcctttgtgtataattctatgtgtgtgatttcatttaggatcaaggtgatgcagacaaggagataatttcaaatacatatagtcaagtactgcaaaagattcattcagaggaaaggctcattgccacagtacaagctaagtacaaggacagtattgaggtttgattgtgctttctcttattgatcttataaattgatgatttgaatttttcagtacttaaatttttctattgttgtttaatactcagtgtcagtaaattgttattactagaattcactgtcaactggaaatggtgatttttgatgatataaatatatcaaattttttattgttttaaatattttattatgtccatgagaaccacaatttttaacatcattttctttttgcctgtatgagtctactgtagataatttgctatatacagaaagataagaaataaaacattgcttataattcccttagcctaagagatagttttagagtatttactcactggatgtgcatctgtatgtttgtgagcatatatatatgcattgcattgttttttaagttacttcaaacatactttcttcatttaatggtatattatgaacatttttctatatgatttttctatactgtcatcttgagtgactaaatcctcatccctatgtagatgtacaacaacattaacctttcatgtgtgttggacattaaggttacttccaatttttcctaccataaataacactgtacatatgtttgtgcataattttttgtttttatttctcagatttctaaattctataattactgagttaaaaggaatggacattattaattaaaacttgatacatattttcaaaccacttttgggaaagatgatttcagtttacatcctcactagaaattcctttttcatccatactaacaatgtgtgttttattgtatgtctcagtttgaaatattacttttgtctttgttactttgagtgctggaactgatattcttctaaatagaaacatggattaaaaaggaaatctattgaattgtcttgttgaaaattatagattttcttggtatttcagtctgaactcagtaaatactagttgaatcttaacagagaaataataaatgatcactgttcaataaatacttttcttatgtgtttgaaaatacgtaacttttgtttacttagtttaaaaagcagcttattgaatatttaaataagagtcccagtgtggatcacttgctatccattaagaagacattgaaaagcttaaaagctctactcagatggaaattggttgaaaagagtaatttggaagaggtaaggaaacagttgtttcttactgatctttatgtgcatctcattttacttggtctctgcttcataaaaataatgcataaatacactctttacaataagagagccattacattcacattttgttttatatactttatcttgttttctgtgtatataaataaaattgagattacagtaatagtgtaaaaattttcctatatcattaaatattctttaaaaacattttcctaggctgccttggttcttagtaacatgaacattttagaataattttaaaagctcttttagtttggactgttagaatgtttattgtaataccaacttgctacatgcaggtgacagggtaccccctcgaaggtagcgttttgtcataaagtatttttaagatcatggtatcttttgttaactccctttttatggatagatgtaatatttcttgcaagtattttaagttgcttttatatgataatagaactggagaggattaggatgccctaatctggactaacttcttcctttaggcttgaaactttgtgaataagatagtaaactttgtgttcctttgaggatttgatttatgtacaaggatctgtattatgccttaatccaatttgaattatctgtcttctacttctgagcactgaattgggggtggagcggaggactattctagaactaatatcatagttgaagaactttctagttttattctattctgggctttggggaagttgatttttttagtctgatttttcaacttttggagaaatctgacttttgttatactttaagttctgggatacatgtgcagaatgtgcaggtttgttacataggtatacacgtgccatggtggtttgctgcacccatcaacccgtcacctacattaggtatttctcctaatgctattcctcccctagacccccaccccctgacaggcccagtgtgtgatgttcccctccctgtgtccatattttctcattgttcacctcatcttatgagtgagaacatgcggtgtttggttttctgttcctgtgttagtttgctgagactgatggtttccagtttcatccttgtccctgcaaagaacacgaactcgtccttttttatagctgcataatattccatggtgtatatgtgccacattttctttatccactcaatcattggtgggcatttgggttggttcgaagtctttgctattgtgaacagtactgcagtaaacctacatgtgcatgtgtctttatagtagaatgatttataatcctttgggtatatacccagtaatggtattgctgggtcaaatggtatttctggttctagatccttcaggaattgccacactgtcttccacaatggttgaactaatttacactcccaccaacagtgtaaaagtattcctatttctccacatcctctccagcatctgtggtttcctgacttgtgtgtgtgtgtgtgagtgtgtgtgtgtgtgtgtgtgtatttgtatgttgcctatgttgttttttttttcattattatactttaagttctacagtacatgtgcacaacgtgcaggtttattacataggtatacatgtgccatgttggtttgctgcacccattaactagtcatttacattaggtatttctcctaatgctgtctctctccctgccaccccccaccccacaacagaccccggggtgtgatggtccccttcctgtgttcaagtgttcccattgttcagttcccacctatgagtgagaacatgtggtgtttggttttctgtccttgtgatagtttgctgagaatgatggcttccagttgcatccatgtccctgcaaaggacatgaaatcatccttttttatggctgcatagtattccatggtgtatatgtgccacatattcttaatccagtctattattgatgggcaactgggtttgttccaagtctttgctattgtgaatagtgccacactaaacatacgtgtgcatgtgtctttatagtagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacatcctccccactgtctgttgtttcctgactttttaatgatcaccattctaactggtatgagatcgtatctcactgtggttttgatttgcatttctctgatgaccagtgatgatgagcattttttcatgtgtctgttggctgcataaatgtcttcttttgagaagtgtctgttcatatcctttgcccactttttgatgggattgtttttttcttgtaaatttgtttaagtcgtggtagattctggatattaaacctttgtcagatgggtagattgcaaaaattttctccattttgtaggttgcctgttcactctgatagtagtttcttttgctgtgcagaagctctttagtttaattagatcccatttgtcaattttgtcttttgttgccattgcttttggtgttttggacatgaagtccttgcccatgcctatgtcctgaatggtattgcctaggttttcttctagagttgttatggttttaggtctaatatttaagtctttaatccaccttgaattaatttttgtataaggtgtaaggaaggtatccagtttcagctttctacatatggctagcccgttttcccaacaccatttattaagtagggaatcctttccccattgctttcccagttttcccaataacatttattaaatagggaatcctttccccattgcttgcttctgtcaggtttgtcaaagatcagatggttgtagatgtgtgacattatttctgaggcctctttgtgttccattggtctgtatatctgttttggcaccagtaccatgctgttttggttactgtagccttgtagtatagttaaagtcaggtagcatgatgcctccagctttgttctttttgcttaggattgtcttggctatctgggctcttttttagttccatatgaaatttaaagtagttttaaaaaaattctgtgcagaaattcagtggtggcttgatgggaatagcattgaatttataaattactttgggcagtatggccattttcatgatgttcattcttcctatccatgagcatgaaaattttttccatttgtttgtgtcctctcttatttcgttgagcagtggtttgtagttctccttgaagaggtccttcacataccttgttagctgtattcctagataccttattccctttgtagcaattgtgaatgggagttcactcatgatttggctctctgtttgcctattattggtgtataggaatgcttgtgatttttgcacattgattttgtatcctgagactttgctgaagttgcttatcagcttaaggagattttgggctgagacgatggggttttctaaatatacaatcatgtcatctgcaaacagagacaatttgacttcctgtcttcttatgtgaataccttttatttctttctcttgcttgattgccctgtccagaacttccaatactgtgttaaataggagtggtgagagtgggcatgcttgtcctggtgacagttgtcaaagggatgcttccagattttcccattcagtatgatattggctgtgggtttgtcataaatggctcttaatattttgagatgcattccatcagtacctagttagttgagaatttttagcaagaagtgtgtcaaattttatcaaaggctttttctgcatctgttgagatagtcgtgtggtttttgtcattggttctgtttatgtgatgcattctgtttacttatttgcatattttgaaccagcgttgcatcccagggatgaagctgacttgattttggtggataagctttttgatgtgctgctgaattcagtttgccagtattttattgaggatttttgcatcaatgttcgtcagggatattggcctgaaattttctttttttttgttgtgtctctgccaggtttttgtacgaggatgatgctggcctcataaaatgagttagggaggattccctctttttctgttgtttggaattgtttcagaaagaatggtactagctcttctttgtacctctggtggaattcacctgtgtatctgtctggtcctggactttttttggttggtaggctattaataactgcctcaatttcagaacttattgttggtctattcagggattcgacttcttcctgatttagtcttgggagggtgtatgtgtccaggaatttttccatttcttctagattttctagtcgatttgcatagaggtgtttattgtattctgtgatagtagcttggatttctgtgggatcagtggtgatatcccctttatcattttttattgtgtctatttgattcttctttattagtctggctagtggtctatctattttgttgatcttttcaaaaaaccaactcctggattcattgatttttttttgaagggtttttcatgtctctatctcctccagttctgccctgatcttagttatttcttgtcttctactagcttttgaattagtttgttcttgcttctgtagctcttctaattgtgatgttagggtgtcgattttagatcttttccgctttcacctgtgggcatttagtgctataaatttccctctaaacactgctttagctgtgtcccagagattctggtacattgtgtctttgttctcattggtttcaaagaacttatttatttctgccttaattttgttaattacccagtagtcattcaggagcaggttgttcaatttccatgtagttgtgtggttttcagagagtttctcaatcttaagttctactttgattgcactgtgatctgagagacttgtttgttatgatttctgttcttttccatttgccaggaagtgttttacttccaactgtgtggtcagttttagaataagtgtgatgtggtgctgaaaagaatgtatattctgttgatttggggtggagagttctgtaggtgtttattaggtccacttggtccagagttgagttcaagtcctgaatatccttgttaattttccatctcattgatctgtctagtctaatactgacagtagggtgttaaagtctcccactattattgtgtgggagtctaattctctttgtaggtctctaagatcttgctttatgaatctgggtgctcctgtattgggtgcatatatatttaagacagttaactcttcttgttgcactgatccctttaccattatgtaatgcccttctttatttttatttttttttatcttcgttggtttaaagtctgttttatcagataccaggattgcaatccctgcttttttttgctttccatctgcttggtaaatcttcctccatccctttattttgagcctatggtgtgtctttgcacgtcagatgggtctcctgaatatagcacaccaatgggtcttgactctttatccaatttgccagtccttgtcttttaattggggcatttcacctgtttacatttcaggtcaatattgttatttgtgaatttgatcctgtcattatgatactaactggttattttgcccattagttgatgtagtttcttcatagtgtcgacggtctttacaatttggtatgtttttgcattggctggaaccagttgttcctttccatatttagtgcttcctttaggagctcttataaggcaggtctgattgtgacaaagtctctcagcatttgcttgtctataaaggattttagttctcctttgcttgtgaagcttagtttggctggatatgaaattctggtctgaaaattcttttctttaagaatgttgaatattggcccccactctcttctggcattgtacagtttctgcagagaaattgctgttagtttgatgggcttccctttgtgagtaacccaacctttctctctggcttcccttaacattttttccttcatttcaaccttggtgaatctgacaattatgtgtcttggggttgctgtttttgaggagtaggtttttggtgttctctgtatttcctgaatttgaatgttgacctgtcctgctaggttggggaagttctcctggataatatgcttaagtgtgttttccaacttggttcccttttccctgtcactttcaggtacaccagtcaaacgtaggtttggtcttttcacatagtcgaatatttcttcaaggctttgttctttttcattttttttctttaatcttgtcttcatgctttatttcattaagttgatcttcaatgtctgatatcctttcttctgcttgattgatttggctattgatacttgtgtatgcttcatgaagttctcatactttgtttttcagctccatgaagtcatttatgttcttctctaaacaggttattctagttagcaattcgtctaaccttttttcaaggttcttagcttccttccattgggttagaacatgctcctttagctcggaggagtttgttattacccaccttctgaagcctacttctgtcaattcatcaaactcattctccatccagttttgttccgttgctggcgaggacttgtgatcctttggaggagaaaagatgttctggtttttgaaattttcaccctttttgtgctggttttttctcatcttcttggatttatctacctttggtctttgatgttggtgacctttggatgtgtttttttttgtgtggacgtcctttttgtttatgctgatgctattcctttctgtttgttagttttccttctaacagtcagtcccctctgctgcaggtttgctggagtttgctggaagtccattgcagaccctgtttgcctgggtatcaccagtggagactgcagaacagcaaagattgctacatgtcccttcctctggaagcttcatcccagaggggcacctgccagatgctagccagagctatcctgtatgaggtgtctgtcgtcccctgctgggaggtgtcttccagtcaggaggatgggggtcagggacccacttgaggaggcagtctgtcccttagcagagctcgagcactgtgctgggagatccgctgctctcttcagagctggcaggcagaaacattaaagtctgctgaagctatgcccacagccgccccttcccccaggtgctctgtcccaggaggatgggagttttatctataagcccctgactggggcttctatctttcattcagagatgccctgcccagaaaggaatctagagaggcggtctggctacagaggctttgctgggctgcggtgagctccgtggagtctgaacttcctggtggctttgtttacactgtgaggggaaaactgcctactcaagcctcagtaatgacagaggcccctcccccaaccaagctggagtgacccaggttgacttcagactgccatgctggcagtgagaatttcaagctagtggatcttagcttgctgggccccatgggggtgggatctgctgagcaggaccacttggctccctggcttcaaccctcttttcaggggagtcaacggttctgtcttgctggcattccaggtgcaaggggggtatgaataaatattccagcagctagctcggtgtctgcccaaacgtctgcccagttttgtgcttgaaacccagggcactggtgatgtatgcatctgagggaatctcctgctctgtgggttgtgaagactgttggaaaagcatagtatctgggccagaatgaaccgttcctgatggcacagtccctcatggcttcccttggctaggagagcgagttccccagccccttgcacttcctgggtgaggtgactccccaccctgcttttgcttgccctctgtaggctgcacccactgtctaactagtcccagtgagataagccgggtacctcagtttgaaatgcagaaatcactcaccttgtctgttgatctcgctgggagctgcagaccggagctgttactatttggccatcttagtatctggatccttgaaatctgacttttaaagtgtaaaccaaactatctgaggcaggtatcaatcaatttagaaagtttgttttgccaaggttaaggatgcatgcctgggaggcaggtctgtgcctttctcagagatgattttgagggcttaaatatttaaaagggaaaggatggatactggggaaagaggaagaaattttaaaaagatgtgagtagataagagacagatggtttgaattctttaatccttgatcacctttcagcaaatacactatttacatttgagagaggggtagaggaatagtcactagctcagtgaatctgcatttttacatcagaggaaggaatcagatatgcatttgtctcagttgagcaaagggatgatgacttagagttctgtcctttgtcctgcacctgagaaaataagccatcaatttaccttgtcagggtaaaattcaacagaactgttttagggtgaagatcctgagacccataaggaatttcctactgagcaaattgtgagagaggtgtgcagggtttttatggttgtagctatcttatttaggaataaaatgagaagctggtttgcctgacacagttcccagcttgactttttcctttggcttagtgatttaaagttcacaagatttattttcctttcacaaaagcatacatactttttaaggtggcttatgtattatcattggagacagttcacacatttactcatccttttgttttgtttttaactaaatatcatgtagaagacaattctagggaattcaggtgtattctggttgctattattaacatttcttttgttcgaatggcagttggccatctttatcttagagaaaatctacagcagatgaagagacaagaaaaatctgtataattgattttatgtctttactttttgtaattcctttttctaggtttcagaaaagtcattgttagaataaattgacctaagttaattcagcaagtattagaagggtcttttatgtgctaggtactgaaggatacatagaaaccacacagagtaatttactatagaacttgaattcttaaaagaagacttgttttctctatgttaataaaaaacactttttctttctgattcaagtcagatgatcctgatggctctcaaattgagaaaataaaagaagaaataactcagctgcgcaataatgtctttcaggaaatttatcatgagagagaggaatatgtaagtatttggttctttgaagttttacattaggttttactctagaaattgaatttaaatacccgttttatgaagtggactgtaatcacaaggctagaggtattatatagaaagtttatatatatattgacctggtaagatttttgtaaatttagaaataaatttcacatgacaaaatattctgaccattgtaccagtgtggaaataactgaaaattgtaaagaaggaaaaacatcacttgtaatatttccactcagtgataatagtagtaatcactgttaacttttgactttcttttagtatttttttgtttgtttttagaattgagattatagcacagacacacttttgcatattgccttttttctgtttaacataaaacctaaagaccttttccttacatcaacgtcattttcccataatgttgcagtgaaaacattaatggagcacataatttagttgaagaatgtaacaaaataagtctacctggttttgggggcaggagaagttacatcttttaagtctctatttttaccactgatttttgtgagcttgggaaaataagtcattgtattttttctttaaaatggaagaatattgtattttatatctgggagatgttaccaggaagaagttagttaagaaacagtgctttgaaagtaaaaatactgaccgggcatggcggctcacacctgtagtcccagcactttgggaggccgaggcgggcggatcacttgagcccgggagtttgagaccagcttgggcacatggtgagaccccatctctacaaaaaatacaacaattagctggtcatggtgtcatgtacctgtagtcccagctgctttggaggctgaggcaggaggattgcttgaacccaggaggttgaggctgcattgagctatgatcatgcctctgcattccagcctgggcaacagagcaagaccctgtctcaaaaaaaaaaaaaaaaaaaaagaaaagaaaagaaagtaataatattaatactgtgaaaacaataggtaagtgtcatgctttctttagcaaattcatctgcgtatatgtaaataccttatggaccttgggttaaaatagcgatcttgcaatgatttgacaagtgtttagaagttttgcttaataaatatgtgataagtggcttttctttcgtgagggtactcaattttcacatttatttcaaagttacttatgtagagctatgtgttttttctcttaggctttaaaaatttttcttaacgaaacagctgttattttaaaatgtcactgtgttcttaatattttgagaaataatgacagttttatgcctcaaattgaaatattatcagacattttcattttagtttggaagtgggtgaggactttgaccttgcaagatttgtgcttatgtatgtatccaaagcttaaaattggtaattaaatttttcttcaattagtaagatggtagtttagatgggttaaaaaaaaaaacttcagccaacttaaatttaaaggagcaatgaacaattcgcaaattgggcagctgaatcacagcatattcggagagactctggggatgctttgtggtcagaacaaattaatagacgaaaaaaggaaagtggctttcagaaattggcagcgaggtacagaaacagctatattggttacagattggtgtttgccttatttgaacacagtttgaacacttagcagtctgtaagtggttgaagtatggcggctgggattggccaagactcagctattgttataggtccacactgctaagttacattttcagtctcgtctgcctgttaagctaggttgcagttcatccacaaggactcaaatatagaagtacggagtccttctcaggccatgtttaatttgctttagcagatgcaaggtgagtcgtggttttcacttgttatttcttgaagtagaaggcaaaatcagtgattatgtatcttactggatatgttataaggtagatgctgatatattttcctgaagagcaacatgtcaaaattgaatatatattgatctacagttaaaaactttttttttttaactttaggagatgctaactagtttggcacagaaatggttccctgagctgcctctgcttcatcctgaaataggattactcaaatacatggtaaactttgtttcccttgcgaattactactcttcagagggtgttgaaaagtgataatattaaatttgtgtcagtgttaaacttatagtatcttttaaataaaaatactcctgatgaatattttatgggtattagaactttttcttatgaccctttaatagttgcatggtatatatttgtatttttatgtaaatttgcattatccgtttttctgctttcctcatcctcattcagtacattgcatgacacttatttgaattataggtgtttactttttgaaatgacaaaataaaattttaactgctatttcaagagttaggataaaaacaagatattgctagccctgagggatttgagcacaatgggttttttaagttaaagcagtctgggaaaaaattctagagaggttggttaaggtagagatgttgaggtgggtatggttttctaggtaggcaggattcaaaagctggagatcagcatattaaataggggccatagggagcaggattagtaaacactggtttactaatctgttagtcctgaatctgttagtcctgcgatttatattgccttctacagtgagggcctagatgaggtatttattcattaagattgtcacgaagtccattataatggcttaaatatggtacagagagggatatttgtgtagacatgtgagtttattctaaaaaatatttaagattaaagttccctaacttaaataattactctaaactctttctagactagactttaaaatgatgtgagttttttcttgcaactatttagcttagtgattaccttatgcagtgtgggcaaataagtatgtactgccacatgggacttgaaaattaatatttaaaaatatgctaatctactttattatggaagattataaaaggtttgactcatggtttattgaagtctttaatggctttctgatgtttaactgtaatgtatgcttaggaattttttgtaggttgattatgtattgtagaatacttaaatgtaccgacaagacttaaaaaaaaaacccagaaaacaattctacaatgcctcttactgaaactgcaccacagtaaaacttagctttgtttaaaatgttgatgatcatattttagtgtgaaaaattattccttttaaaaagtagcagaaatatctagtaaaattagttattgaaagccattttcacttttgaggactccaaacaggggcagaggtgttagaattacttcatggtagtcataatttttggactaatctttcccatttgatacctacatttttgtcattattttaccttatttattttttgtttttttacaaatgtttatttcagtagtttttggggtacaggtgttttgtggttacatggataagttctttagtggtgatttctgagattttagtgcacccatcacctgagtggtgtacactaacccaatatgtagtccctcattcctcacccccgtcccaatcagttgttactttagtattttttaggaaacataagtggtttttcaagtaaacattagggatcctaggatgcatgtctggttgattctagtcatttcctgaatctgttctaaaattatagcagtaattaaatgtatggtgattacactttgggtaggaggagtttaagagccaggaactggagaaagtacacagttttaaagattttaattttgttggtttttccagtacagttgatggtgtccaagtcatttaatatcgtgtaactaattattttgatgatttttaagtgctgggattgtttggattctttaactgtgataaaaacttgtgcctagaactctggtggtctccttacaatgagcttggaacgagatcttcttgatgctgagcccatgaaggaacttagcagcaagcgtcctttggtacgttctgaggttaatgggcagataattctgttaaaggtaagtctaacttcttcttacttgtgggagattcagcagcataaaggatagtggtgctgttacatttcaagaaagaaaaaacctcactgttagttttctaaagtgtataagttgactggcatgataattgtgcttgtagtttggttgccagaactaattttcacttttaaagtttccctcaattgaacaatgagaacacttggacacagggcggggaacatcacccgtgggggcctgtcatggggtggggggcagggggagggatagcattaggagaaatacctaatgtaaatgatgagttaatgggtgcagcaaaccaacatggcacatgtatacatatgtaacaaacctgcacgttgtgcacatgtaccctagaacttaaagtataataataaaaataagtatataaaagtcattaaataaagctttgtctcacaagaaaaaaaaataaagtttccctcatttccctaaatagaatatgtccttaataggatatactttcctttttttttgggtgaacttattatagtcatccaatatctttttaaaattcttgattttcttacatttctccttgaaatctcagctgtgttatcagtacaatcttctactctttaatttcttcttctcattgatctgggaaactgttaatcatgataataagataattaatttggccttagttgctacacattctagaatgtgtagcaggctacaggtagaattgcactttccttttccaaattatagcattcaaagaagatagaaaagtacttataaaattaaaaaataaaattagatttgatttaacttaaaataatgaattatgtttaaattggaatgatgtataattataatgagattttcatcttggaattacgagtgcctctttctttggtacaagggctattctgtggatgttgacacagaagccaaggtgattgagagagcagccacctaccatagagcttggagagaagctgaaggagactcagggttactgccattgatattcctgtttttatgtaaggtaaagttcttatgctaatctcttgcagaaaccattttatcttgcagaaactattttatttaaaataaattttagctccaggttttagagcagcagttcattccccttaacataaaagaaaaattatcccatagaatcaatgtatgctaaaaatatgttgaagaagtttttacttggagtcacattctctgttttgcttcttagtctgatcctatggcttatctgatggtcccatactaccctagggcaaacctgaatgctgttcaagccaacatgcctttaaattcagaagtaagtaaaaagcactatttatttccatggatgtattaaatgagaaaataacacctgatatttattcaggcatactacatgctatgtattttgtaaaattttgactcatggtattctatttgtcacctcaagcctgtgatagaagttatcgtgttatatagatgagaaaaagcgttaaagggattagattaagtgacttgcacagggtccgttagccagaggtagagctgggactcgaaattaagtctttctggttccaaagcccaaacttacaactgctaagctgtgctgtatgtgaactgcctaatatagcacttggtactgtaagtgcttaagtggcagctttaatttttgtcattgtaagtttaggattagtaataacagtaaaggaggccctgattcttcttatggagtaacactgtttcagtctcttatagctactttacatggttggtatttgtaatccaagtcttctttgagatgatagaacaggtgtcctcagaccccaggtcgcagactggtaccagtctgtggcctgttaagaacagggcggcacagcaggaggtgagtggcaggtgagcaagcattactgcctgagctccacttcctgtaagatcagtagaggcattagattctcataggagcataaactctattgtgaactgtgcatgtgagggatctaggttgcgcactccttgtaagaatctaatgcctgtgatctgaggtggaacagtttgatcctgaaaccaaccccctgcatccatggaaaaattgtctttcatgaaaccggtccctggtgcccaaaaggtatgattgtacacacacacacacacacacacacacacacacacacacacaaacacacacaggcacacatggtatcaccattacaaaatcaagccttcatctggtctttctctatgctgtattcttattaatggttcatttcgaggaaactttactcacttctagagcagtcttttaattagagaacagtttcaagattaaaatgatttgcctacttcctcacttcttttatgtgtacttatctataggaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtggtaagatatcatggttttacaaataggttctagactttatttaatattattaagcagtagttcagcacttatatataatataatactttattataggatctttgtcttcagttaaactgtgtcatgtagtataagcaactatttgccctcagctagatgctagaacagcaggagtattgtgtattttaaccataagtcttaggagctacctgacattatatactcaatggcattgacaacattaataattttgtcatcattaggaaacatttaattgctaggaaacatgtaaggaaactaggtggccatctcctaaacctctctccactggtgtccctccgtctatagatacaatttacatatacgtactttgctgttttttgattaataatgtgcatttttagaaaccggggaaccttggactttttagtttaaatcctgattcacctctaatggctgttaattcagtgtcatattacctcagaataggcagtttgtagagatagcaaaatcacacaatttaagagcatgttgtgatttttttgtcgttataatggaaacaattctctattttaattgagaaataaaaattgtatatatttatcatatacaacatgatgttttgaagtatgtatacaatgtggagtggccaaatcagtaattatttttctaaacattacagctttattgagatacaattcacataatgtatacaattcattaatagtttgtagtacattcacaaagtcgtgcagtgataaccagtattgaattccagaacattattaacattcccaaaaagaaaatccatactgattagcagtcactcaaatttcccacttcttctcaagcctggaaactacgaatacactttctgtctctatggatttgcctatttggacatctcatgtaaatggaatgatacaatatgtggccttttatgctaatttcacttagcatagtgttttcagagttcatccacgttattgactgtatcaaaatgtcattcctttttattgccaaattatatttcattgtatggatgcaccacattttgtttatatattcatcagttgctggacatttggttgtttatacttattggttatatgaataatgctgctatgagctttagcatacaatattttttgtgtggacatgttttcatttctcttgggagtggaattactgggttacattgttttactttttgaggagccaaactgttttccaaagtggctacatcattttatattcttcccagtaatgtatagggattttgttttctctacatccttgccaatattttttattatctgagcaattccctttgactagtatatgttataatgcttttatactttggtcatctgcaagtcatagtgtaatgctactggagtatatatagtcttaatggttttgatatggtagctcaaaaagatgagaaaatgaaactgcaactgtaatcaaaagctggattgtacaggatttatacagattgattttctgaaatatttactttattacattagtttaacaaaattaagatatcctaagaaatataactaaattatgaattttgaaagatctcaaccttcaggggttctggttagtttaccttttgagcatactatttgcataattatagatatgactacaataattactctttagtcattcgtcatctgttattattccccaaaacattgtttttaattttcagttaaaaatatttattctgaaatattgatcaaactcaccttttgctacattttccatgcaattttcagattgaagtggttatcaggaagataaatttgaaaagtagtctgaggtcaagatcattgcttttcaggccttatagtgcatacaactcacctggggttcatgttaaaatgcaaattaatattcagcatttctgcagtggatcatctgcatttctaacaagctaccagttaatgctgtagctcctggcccttggaccatactttgagaagcaaggatcaaaatcgtagctagaaaaaagatagcacttagtgacacatgctaggcattgtatctctgtaaggtagacattatttccattttacaaattaattcaggctcaaagaggtttacacctactatgtacccataaaaattaaaaataaattttaaaaatggacaaaaaagaggttaaagccctcggtcccacagcaaataaataggagagtggggaattgtaaccaagatctgcctgaatataggattcatgctattgtcactgatcatctttgacatgttagaaatggtatatttagagaatgatcagtaaggaaggaaagtgctttgtaggatttcagttcttaaatgaattatttagaattttcagaattagaacatggcactgctgctcactcttgtgaaatttattttttaaaaagagtatcaaatgtttaatcacagaataagtggttgttagtattaaatctgttcaagtctacaaagtgaatgtaaaaaaaagtcccatagttaatttattagactgattttaagagcaatttataatagcagaaattggtaaaaatatttgaaagcaagggaatgaaatatttaaaatgaatttgttttttgtattgattaaatgcagagtacttcacagaaagtcacctcaactgtgttgtatctgaaatatgtaaaatattgtttttgcagagtcagcgagcctcggtgaacatgatggttggtgacttgagtttgatgtcacctgagttgaaaatgggaaaacctgcttctccaggttcagacttatatgcttatggctgcctcttattatgggtatgttatttttttgttgaaatagatcatatatatatatatttcagtatataaagtgatgattttatagtgattctccttaaaaataaaaagcagcagacttttagtagaactttaagttttaacaaaaactattgatatgcttcctattacctattgtgtactttctacaaattggcttgatgtatattttaggtatcatgctattgtcttggttctgttgaagtcaagattaacagtgaagatgattttgtcctacattaatctgaaagcagttcatgcatatatggaaaataaatgttaaataagccttgggtatattcctgcttccagtgtagaccaaatagctgtttctcatccatagtttaagaattaagaagttggatggagctggagaccattatcctaagcgaatttactgtggatcagaaagccaaatactgcatgttctcacttataagtgggagctaaacactgagtacatatggacacaaagaagggacactggggtctacttgagggtggaggttgggagaaaggtaaggattgaaaaactacctgttaggtattaggctgattacctgggtgacaaaattatctgtacaccaaactcccatgacacactgtttacccatgtaacaaacctgcacatgtaccccttgaacctaaaataaaagttggaagacaaaaaaataaaaagcttgtttcatgttgtactgctattttacgtagagaatgcctctttttccaaagtcttgagtgtgacaaaaccttatctttgttgatcacataaataaaaataatctccttgttagaaaaacaagagttaagagggattaagtattaagagaaggaagactattcttatcagcccaggggccagcaagcattttctgtaaaggaccagatggtctctgttgcaagtactgagttctgctgctatagcatgaaagcagccatagacagtatgtaaacaaatcagtgtggctcttttccagtagtactttatttatggatattgaaatttgaatttcatgtagtatgcatgtgcatgaaatagtattccttcagtttgctattaaacatttaaaaatgtgaaaactacccttggcttgcagctgtacaaaaacaagtagtggaatcagtttggtgcagaggccatatagtttgctgatctctgttccaatcagtgtaataaggtcaaaaaaagaaataaaagtcatagagtttgaaaatgaagaaataaagctgtctttatttgcagatgacatgcttaattatgtagaaaatctttgagaatgtacataaaagctactagaacaaatgagtttagaaagatagcagttttaatttcaatataattgtgtttttatataagcaacaaataataggaaattaaaatttaaaaatcatttacaaaagtattaaaatatggaatttgtaggggtaaatttagtaaaagatgtgcaagagttgcacactattaaaactacaaagcattgttcagagaaactcaagaagacataaataaatggagcgatacaccatgctcatggactagaagacattgtatggatatcagttgttcttggcttatagattcgatgcaatttcaacaaaattgctggtagattttgcttattttttcagaaattgacaattagattttacaattaatataaaaatggagaggatctgagatagccaaaacaagtttgaaaaagaacaaaattgaaggacccaaactacctgattttatgacttaatagattctaggaaattaagacaatgtaggcctagagtggtggttcaaaactgtaatcccagcacttagggaggctgatgcaggaggattgcttaatgccaggagttgaagactagcctaggcaacacaagtgagcaccccctgtctctacaaaaaatagaaattagctgggtgtaatggcgtgtctgtggttctagctccttggtaggctgagacagaaagattgttggagtccaggagtttaaggctacagtaagctatgactgctccactgcactccagcctaggctacagagcaggaccctgtttctaaaaacacaagtgatactgctgtgaagttagatgtccagatgaatggagcagaatagagacaatataaatagactgcacatgtatgataactggcttttgacaaagatgccaaggcagttctctgggtaaaaggagaatcttcaacaaaaatgatacaggccaactcataccatatgtagagaataaattttgattcatttcttataccatgcacaaaaattagctcaaaatgtgtatcagacctaaatgtaaaacgtgagtctaaaacttatagaagaaaacataggatgaaatatttgactttcgatttggcaaagatttcttaagtaggacacagaaaacatcaactctaaaagaaaaaaatcatttggatttcatcaaaatggaaaaccttgctcttctaaagacattgtcacaaaaatgaaaggcaagctacagactaggagaaaatatttgcaaaacatatatctgacaaaaatattatatccagattatcaagagctcctacaatcaatactaagaagactgcccagttaagaaatgggcaaaatatttgaacaggtactttaccaaagaaggtgtccacatggcatgtaagcatgtgaaagatgctctgaacaccatttgtcattagggaactacagattaaaaccaaaatgagataccactatactactcactataatgtataaaattaaaaagatcgtaccaacggttgcttagatctgttgtacctagaactcatatatattgcccaggggaatgtaaagggaacaaccactttgaaaaacatttggcagtttgttaaaaggttgaacatattcctaccctatgacccagcaattccacttctagatatttagccaagagaaatgaaagcatatgtccacacaaagatttgtatgtaaatattgaaagaatttatgtgtaatagatgaaaactagaaacaactcaaagtccatcaacagatgaatggaaaaacagtctgctatgtatgtgtctatccattggaatactactcaggaataaaacgattgaactataaatataactcagtaagataggtgagtcttaaaataattctgccaagagaaagaagccagatgataaggtttggctgtgtctccacccaaatctcacattgaattgtaatccccatgtttcaagggtggggtcaggtggagataattgaatcatgggggtagtttcccccatgcagttcttgtggaagtaagtctcacaagatctgatgatttcataaggggcattttcccttttgcttggcacttcttgctgcccccatgtgaagaagaatgtgtttacttccccttctgccatgattgtaagtttcctgaggaatccccagtcatgctgaactgtgagtcaattaaacctctttcctttataaattacccagtcttggggatgtcttttattagtggtgtgagaagggaccagtacagtaaattggtacagagagtggaatgctgctgtaaagatacccgaaaatgtggaagcagctttggaactgcgtcatgggcagaggttggagggctcagaagaggacaggaagatgtgggaaagtttggaacttcctagagacttgttgaatggctttgagcaaaatgctgatagtgatatggccagtgaagtccaggttgaggtggtctcacctggagatgagggacttgttggaactagaataaacgcgactcttgatgttttagcaaagagattggtggcattttgcccctgtcctagagattggtgaaactttgagcttgagagagatgatttagagcatctggtggaagaaatttctaagcagcaaagtgttcaagaggtgacttgggtgcttttaaaagcattgttttgtgtaatcacaaagatatggtttggaattggaacttatgtttaaaagggaagcagagcataaaagttaggaaaatttggagcctgatgatgtggtagaaaagaaaacccgtttcctgggagaaactcaagccagctgcaggaatttgcataagtaacaagtagctgaatgttaatcgctaggacaatggggaaagtatctccagggcatgtcagaaagcttcgcagcagcccttcccatcacaggcacagaggcctaggaggaaaaaatggtttcatgggctgggcccacggtccccctgctgtgtgcagccttcagacatggtgccctgtgtcccacctgctccagtcatggctaaaaggggccaaggtacagctcaggccatggctttagagggtgcaagccccaagccttgttagcttccatgtggtttgagcctgaaggtgcacagaagtcaagaatggtggtttgggaacttccacctagatttcagaggatgtatggaaatgcctggatgtccaggcagaagttttctgcaggggtggagcccttatgaagatactctgctaagacagtgcaaaacggaaatgaggggttggggctcccacacagagccccaactggtgtactgcctagtagagctgtgagaagagggccacagtcctccagaccccagaatggtagatccactgacagatcacactgtgtgcctggagaggcaacagacactcaatgccagcccatgaaagcagccagaagcggggctgtagcctgcaaagccactggggcagagctgcccaaggctgtgggagcccactcttgcatcagtgtgacctggatgtgagacatggagtcaaaggagatcattttggagctttaagatttgactgccctgctggattttgaatttgcatgaggcctgtagcccctttgttttggccaatttctcccatttggaacaggtgtatttacccaatgcctgtaccccattgtatcaaggaagtaactaacttgctgttgattttacaggctcataggcagaaggaacttgccttatttcagatgagactttggactgtggacttttgacttaatgcttaaatgagttaaaactttgggggactgttgagaaggcatgattgtttttgaaatgtgaagacatgagatttggaaggggcctggggtggaatgataatggtttagctgtgtccccacccaaatctcaccttgaattttaataattcctgtgtgtcaagggcaggcccaggtggagatatttgaattacggggtggttcccccatactgttctcatgactttagccctatgcctgcatgtatatttaaagttgtctggtttcattgaaccagcaccctcatggaaataaactagcatgattttcatcaatgcttcagtaatctattctttatatcagaagggtgaaagtaaacatatcaagtttttttttttgtttctgggaggactcataagatatcccataagtgtggtaatagcagtttttattccacctatttcctttaaatgatagtaaaaagctccatgagtaaatatattgtctgattttctactcttatgtattgttgattaagtcctttaaaaactttatttttagattaacttgtacaatggacttttttttgtatacattctatgaattttaacacacctatagattagtgtaataaccactgccacagccaggatgcagaacagttccataaccctgaaaattcctgtgtgccatccctttgtagtcacagcctcctcccaacccttaaacgctggcaaccactgaccttttatcactgtgttttgtgcttttaagaatgtctcacacatagcaatatgaaccttaaatgtaaatgggctaaatgccccaattaaaagacacagactggcaaattggataaagaatcaagacccatcagtgtgctgtattcaggagactcatctcacatacaaagacacacataggctcaaaataaagggatggaggaatatttaccaagataatggaaagcaaaaaaaaaagcagggattgcaatcctagtctctgataaaacagaattttaaccaacaaagatcaagaaagtgtaagaagggcattacataatggaaaagggatcaacgcaacaagaagagctaactatcctaaatattatatgcacccaatacaagagcaccaagattcataaagcaagatcttagagacctacaaagagacttagactcccacacaataatagtgggagactttaacaccccaccgtcaatattagacagatcaacgagacagaaaattaacaaggatattcaggacttgaacttagctctggaccaagtggacctaatagacacctacagaactctccaccccaaatcaacagcgtatacattcttttcagcaccacataacacttattcagaaattgaccacattattggaagtaaaacactcctcagcaaatgcaaaagaatggaaatcttaatggtctctcagaccacagtgcaatcaaattagaactcaggattaagaaactaactcaaaactgcacaactacatggaaactgaacaacctgctcctgaatgactactgggtaattaacaaaattaaggcagaaataaataagttctttgaaaccaatgagaacaaagacacaatgtaccagaatctctgggacacagctaaagcagtgtttagagggaaatttatagcactaaatgcccacaggagaaagcgggaaagatctaaaatcgacaccctaacatcacaattaaaagatctacagaagcaagaacaaacaaattcaaaagctagtagaagacaagaaataattaagatcagggcagaactgcaggagctggagacatgaaaaacccttcaaaaaatcaatgaatccaggagctggtttcttgaaaagattaacaaaatagatagaccactagccagactaataaagaagaatcaaatagacacaataaaaaatgataaagcagaaatcaccactgatcccacagaaatccaagctaccgtcacagaatgcaataaacacctctatgcaaatcaactagaaaatctagaagaaatggaaaaattcctggacacatacaccctcccaagactaaatcagcaagaagtcgaatccctgaatagaccaacaataagttctgaaattgaggcagttattaatagcctaccaaccaaaaaaagtccaggaccagacagatacacagtcgaattccaccagaggtacaaagaggagctagtaccattctttctgaaactgttccaaacagtagaaaaagagggaatcctccctaactcattttatgaggccggcatcatcctggtaccaaaacgtgccagagacacaacaaaaaaagaaaatttcaggccaatatccctgatgaacattgatgcaaaaatcctcaataaaatactggcaaactgaattcagcagcacatcaaaaagcttatccacaacaatcaagtcagcttcatccctgggatgcaaggctggttcaacatatgcaaatcagtaaacataatgcatcacataaacagaaccaaaaacaaaaaccacatgattacctcaatagatgcaagaaaaagcctttgataaaattcaacacccttcatgctaaaaactctcaataaactaggtattgatggaatgtatttcaaaataataaaaggtattcatgacacacccacagctaatatcttactgaatgggcaaaaactggaagcattcccttgaaaactggcacaagacagggatgccctctctcaccactcctatttaacatactattgcaagttctgatcagggcaatcaggcaagagaaagaaagggtattcaaataggaagagagacagtcaaagtctgtctgtgtgcagatgacatgattgtatatttagaaaatcccatcatctcagcccaaaatctccttaagctgataagcaacttcagcaaagtctcaggatacaaaatcagtgtgcaaaactcacaaacattcttatacacccgtaacagacaaagagccaaatcatgagtgaactcccattcacaattgctacaaagagagtaagatacttaggaatacagctagcaagggatgtgaaggacctcttcaagaagaattacaaaccactgctcaaggaaataagagaggacacaaaaaaatggaaaacaaattccatgctcatggatagggagaatcagtatcatgaaaagggccatactactcaaagtaatatgtagattcagtgctatccccatcaagccaccattaactttcttcacagaattagaaaaaactactttaaatttcatgtggaaccaaaaagcccgtatagccaagacaatcctaagcagaaagaacaaagctggaggcatcatgctacctgacttcaaactatagtacaaggctacagtaaccaaaatagcatggtaccggtaccaaaatagatatatagaccaatggaacaaaacagaggccacagaagtaatgcctcagaagtatctacaaccatctgatctttgacaaacctgacagaagcaagcaatggggaaaggattccctatttaataaatggtgttgggaaaactggctagccatatgcagaaaactgaaactggaccccttccttacaccgtatacaaaagttaactcaagatgcattaaagacttaagacctaaaaccataaaagccctagaagaaaacctaggtaataccatttaggacataggcatgggcaaagacttcatgactaaaacaccaaaagcactggcaacaaatgccaaaattgacaaatgggatctaattaaactaaagagcttctgcacagcagaagtgaacacatcagagtgaacaggtaacctacagaatgggagaaaatttttgcaatctacccatctgacaaaggtctagtatccataatctacaaagaactgaaacacatttacaaaaagaaaacaaccccatcaaaaagtgggcaaaggatataaaccgacacttctcaaaagaagacatttatgtggccaacaagcatatgaaaaaagctcatcatcactggtcattagagaaatgtaaatcaaaaccacgatgagataccatctcatgccacttagaatggcactctttgaaaagtcaggaaacaacagatgctggagaggatgtggagaaataggaacgctttacattgttggtgggagtgtaaattagttcggccattatggaaaatagtgtagcgattcctcaggcatctagaaccagaaataccatttgacccagcaatcgcattactgggtatatacccaaaggattataaatcattgtactataaagacatgcacacttaagtttattgcagcattgttcacaatagcaaagacttggaaccaacccaaatacccatcagtgatagactggataaagaaaatgtggcacatatacaccatgcaatactgtgcacccttaaaaaaatgatgagttcatatcctttgcagggacatgggtgaaggtggaagccatcattctcagcaaactaacacaggaacagaaaaccaaatacctcatgttctcactcataagtgaacatgttctcactcataagttgaacaatgagaacatatggacacagggaggggaacatcacacagtggggcctgttggggagtgggggtctaggggagggatagcattaggagaaatacctaatgtagattatggtttgatgggtgcagcaaaccaccatggcacatgtatacctatgtagcaagcctgcacgttcttcacgtgtatcccagaacttaaagtatataaaaaaaagaaaaaatagaaaaaaatataaataaaaataatatcatattagtggtatcatacagtatataattttgtgagtctagcttctttcattcagcatgtgaatcatcttttgtgattcattcaagttgtctaatgtagtttttcccttttttgtttctgaatagtgctctgttgtatgtacataccaaatttgtttgttcacctgttgcagaacatttgcattgtttccagtgtctgactattgcagataaagctactgtgaacatgtgtgtataggtttttatgtgaacgtaagtttttgtttctctatggtaattacccaggagtgaaatttctgggtcagattgtaatcgtatgtattattctttaaggacctgccaaactgttttccagagtggctgtactgtttttgattttcacctgcaatttatgaaagtttcagttcagcatcattgtcggcacctcgtattgttattatcttctattttagccattctcataggtgtgtggtagtgtttcattgtggttttaatttctctaatagataatgatgttgagcatcttttagtttgtttattattggctttctgtattttctttggtgaagtgtctgtcttttgcctgttttttaattggatttttgttttattgctgtagagttttgggcattcataaatacattctagatagaagtcctttatcagatgtcatttgcaatgatttttttctggcctgtagcttttctttttattttcttttcagtgtcttttgcagagaaaagggttttaattttgaagtttaatttattattgttttctttttatgtatcatgcttttagtgttgtgtataagaactcttcgcataacccaaagacttgaatattttttcttatattttcttctaaaagctctatagttgtatggtttacatttagagctgagatctctttggatgtaatttttgtgtaaggtgggaggtttatgtcagggttcatgtttttgcatatggatgtccaattttacaacaccatttttttaagagagtgttattctctgttgaattgtctttgtatctttgtcagaaataaatcggccatttttgtgtgagtctgtttgtggactctttctgctgttgatctgtgtgtctatccgtttaccaacatcatactgtcttggttactgtatctttatagtatgtcttaaaattgggtagtatgattctttttcagattttagctattcagctatctttccttttttgtatatattttattttatattttacatcttaccttattttattttattgagacgtgtaaggtcagccgagagaaaggaaaaatagacctaaagtcaggcgcgtaagtttattgaacctgaggggctgcttcacctcactcagaggaggcagccctgagtttacaaaatgaggggtttatattggagaagggagtttgagggagttctttggtgtggccgcattccagggttgtttgctggttaattttgtcacatatcaccttgtgacatttgtggtagcagaactttcaggaaggtgtaggtaaagtttgtttattcttccaacgacctcccgctgtgcggtccagatggttcgtaattggggtttgtttatccagcaaggtctgataagtgaagtctgctggcttcactgtggtgcctagataagggcttagaaatgtaaagaggcttgggggaagggtggacagcacggagacgtttgaggggagcgccaagaagctttatggggcagtttgtctttaagacgcagtctcactctgtcacccaggctggagtgtactggcacaatcttggctcactgcaacctctgcctcccgggttcaaatgattcttgtgcctcagcctcccgaggagctgggattataggcacccgccaccacactcggctaatttttgtatttttagtagagatgaggtttcactatgttgaccaggctggtctcgaactcctgacctcaagtgatccacctgccttggcctctcaaagtgctgggattacaggagtgagccactgcgcctggctgcttttccatgtatattttacaaacagcttgtctgtgtgcacaaaagccctgctgtgattttgattggaattgcattaaatctgtagatcaatatggggagaattgacatctttactacattgagcctttaatttgtgaactccatttatttaaattttctctggtttcttttatcaacgttttgttattttgggcttacagattctatacatgtgttgttagatttatacctaagaatttcatgtttggaagctattgtgttttttaaaaatttttgttttctagttggtcaagttcttttttacaacagtatttttttgatagtaaagttagtttggtacgaaaggctgtgtatactttgaccttcctcctcaaagaattgggcaatttattatgaaagcacatagtgtaaaatatataaaagggcaaaaagtcaagatccaagggctgtgcttaaaaaggtaatattcagagttaaactggaagcattatcaaaagattttatttacaaggccatgaagggattactgtcactttgtctttaaaaaaattttagaaatagcaataataaaaaagtaatagtttgatagcaaagctctagaatactaactagatattttgggcatatcaaagatactgtggttttagatcatttttcttatgagatccagattaaatgaagtgttctgaagactgcctacagaaaattcaaaacaatggacaattcaagtgttgtgggttattaccttcagtaataaaccatatctttttttaaacgtttaaattaggtttgggggtacatatgcaggtttgttatatagataaactcgtgccacaggggcttgttgtacagattattttgtcacccagatactaagcctagtacccaatagttattttttctgcccctctccttcctcctaccctctgcccttaagtaggccccgtgtctgttgttcccttctttgtgttcatgagttctcaacatttagtgagaacacagagtatttggttttctatatcttttaactgaaatacatggactatagttttatcatgacaccatttgtattaaggttcttcactatatttttaggttattatggaaatcttaaaggtgttttctagaagccagtttttaaaaagtataacagttctgtctgatgttacattgaaaaagaattgtgtttctgtgtgtgttgaggagtactgctgtgaagaagttgaatataaagaagagaatggccccctttctttgtttatttttatttatttatttatttttaagagatggggtctcactatattgctcaggctggtctcaaactcctgagctcaagcgatcttcccacctcgatctcccaaagtgctgggattacaggcatgaactaccacgtctgtcccccttttatttattcagagacacattttcagtgttgctttccctaaaatgcattttttcctgctttatttttctgttaccatattatacacttatttatctttattattgtctgcttctaccactcgagtggaagctttttgggagtagcttatctatcttgtttgccactatatcctcaaatgcctagaactgtgcctggtgcaaagtgggcactcaaatattagttgaatgaatgtttaaattttagccacagttatatgctgaagtattaggctttaaaaaatagttccatgtttttttcctgagttcatttacttacctctcatttatggccccatgtacatcattttattctttaaaaccttgcatgaagattttattccgactcttaatatatttctaggagatgttagtggtcatactgatcacccagtgaacctaactttgcatttctggaccttcttaataacgtgagacccaaacctttatgtaatttcagtcacttccccaaaccaggattttgtgaatctctacaattgttatttttcaaaagtaatagagtccaatccattatatttttctcctaacaggatttcctgtcctctcatttactgtgtctgctaatcttaaatctccagtgggtttatttactgtctctcttttcttccagtttatcagcagccttctagcttttttctttatttactcattcttggaccctatcatacaattcccagactatgccttatattcccatttactcctgttcttctgtttagtctttttggaaaaaactcaattttagataagctatggcctgccatttgtgagtaaaacattctttctcatttctctctctctcttttttttttttgagacggagtcttgctctgtcgcccaggctagggtgcagtggtgtgatctcggctcactgcaacctctgcctcctaggttcaagcgattctcctgtctcagcctcctgagtagctgggattacaggcgcacgctgccatgcctggctaattttttgtgttttagtagagatggggtttcaccatcttgctcaggctggtctcgaactcctgagcacaggcagtccacctgcctcggcctcccaaagtgttaggattacaggcgtgagccaccacgcccagccccatttctcctttttaaaaagttttatttctatgcgtcaataacttttttaaaggcattacattttatttctttaacagagtgtgaccaaacatatttgtttttattttttatttttttattttttggagatggagttttgctctgtcacctgggctggagtgcagtggcactatacagctcattgcagcctcaatctgttgggctcaagtgatcctcctgccttagccccctgagtagctgggactacaggttgtatcaccactcttgactcatttttgaattttttttgtaaagatggggtttcaccatgttgcccagcttggtctcaaactcctgggctcaagcaatttgtccacctttgtctgccaacatggtgggactacaggcatgagccactgtgcccagcccatatttgttaatttaaggacattattatgtctctttataacatggtggtaacatcctcccttggtgagagcacatagaacatgtttggaactaactgctttagaaagttttatctcattacaccctcctaacaagcatgtgagggagtatgttattatccaaagtatagatatgagaattttgtgtgtcagagaggaagtacctgagtgatgccccatttcagaattttagtgtctcgaggctccatgcaagaccaccttctgccttcacatcacatattattaagcctggaaggcagtcttcactgaagccaatgatgaacaactgatgaagggaacccagggctgggaaataagttaccagtaaatgtcatggcattgaccactatgaagtcccttgtatcatattattccccttttaggcatctttaggcttgtctcctatgtgctgtttttttaagaagttctctgcttacaaagtcttgcgtggatgtatttaatacttttgtttggaatacaggtacacttttcacacgtgatacctggttttcatgtgtaatccaaaaataagagacaatgggaaagttatgttccatatgctgtcctttcttgaggaccagctcacgtgacttgtgataagctctcccaccttctctgaaccttagcagtgcctctcaggaatatgctaactaagataaatggagagaaaggaacatgggtagcagccccttaaaatctagaggttttatgattctaacatcataatgaagcagactggggaatagaactcattattgtagaattgaatgtaggaggattaagagatacaggttgggccgggcgcggtggctcacgccagtaatcccagcattttgggaggccgaggcgggtggatcacgaggtcaggagatagagaccatcctggttaacatggtgaaaccccgtctctactaaaagtacaaaaaatcagccgggcgtgttggctggcacctgtagtcccagctactggggaggctgaggcaggagaatggtgtgaacccgggaggcggagcttgcagtgagcagagatcacgccactgcactccagcctgggtgacagagcaagactccgtctcagaaaaaaaaaaaaaaaaaaaaagagagatacaggatggacggactcactaatctctttagtacccttccctgtacaggaatttcgtgtattaatatttctgaaactgctttgagagccaatcaagaaccttagactggtcattcctgtcttatcagatccaaatgcagagaacttggaggaggttcacctttcaaggtttttgtttttgttttttaagatagtctatttacccatatttttattcttattctttttaaaatttctaatgtttcagcatttctccttttatcatttttatcctaataacttcttttggccattctttcaaggtaagtctactggtgacaaatttttagtgtcctttatctgagagcatcttgatgtcacctttatttctgaagaatattttcactgggaatagaattctggattggtagttctttttcttttagcatttggaaaagattgtgctactttctttaggtgtccatggtttctgatgagaaattcactgtcatttgaatcatttcctttataggtaatattacatttctctctaaccagtttcaagatttttgttttctttagttttaagtttattatggtatgtagtggcatgtgtttctttaagtttattctgtttgaggttttctcagcttcttcagcctgtgggcttatgtttttcaacaaatgtgggaagttcagcaattatttactcaaatgcattttagccccccaccctttctcctctttttctaggactctgattatacaaattttctgtcttttattgtctcacaggttcttggggctctgtttatcagggtgtttttttttgtaatgatggttgttcaaatgggttattttctattttttcatcttcagattcattagtgctttcctgtcatatttattctatcattcagtccacctaatgagttttaacatttttgattactgtttttctgttataaaatttccaattgattcttttttatatcttctgtcttctgtttctttgctttctattttaaaaatttaagtgtgtttgtaattgctctatgcagcatttttatgatggccgttttaaaatccttctcagataatcacaacatctgttctatttggtgtccggtggttgtctttttctcagtcaagttgagattattctggttcttgatataaagtgattttttattgtaccctaaacatttgggttattatgttgtgagactatgaatcctttttaatatatatatatatatatattttttgtaggcagccaccctgtttaggtatagtatgcagttccagatggggttagatatgtagttccccactgggctctgctgacatcaccccagcaaaagtggaatgcccagttgtactgccttacttctccttgctgctgacagatgggagtgtaaattcagcactttattgagttcttttgacaccgggagaccaggaggagcaaagtgttagctataactgtttcaccaccaccttattccaccttcttgtgccttgttgctacctggtgagagtggaagttttactccccagtgggtcctgccaacaccgtggggagtgggcaatgaaaaactgaatgctgactcgtactacttcacactgctttgtttcactttttttggctgctgggtgggagtggaagtaagccctgttctgagtcccactgacagtatcccagactgtagagtgacagctagtgctgtttctcactgctgtcttctgcctctgttgatgggtggaagtagaagttcagttccctgtttggcttcatggataccatgctagtggaggaagcaaagggatgacttcccatgacttgttgctgctgggtagggctgaaagtccagctcctcactcagcactactaatactacggatgggatagggggcagtttttcgtttggtgtgtgactggaatagggtatattacctattacagttttctgttctgctaggccaccctcttcccagtcctgtggctacaggaagcaggcttttcttggagcttttgtgtgtgtgtgtgtgtgtgtgtgtgtgcctgtgtctgttggcatttctgggtggcagacttctcaaggaccccatcagagatataggggggcaaaaagaaagcccagggaactcaccattatattgttcctcaagtggcaaggtcctagctacttcaccttcttctttccatcttttagggttttcctgtgttgtattatagctagagttgtttgttttttttaagaggaaaggttgatgtgaaatgtgactactccttggctggaaccccttgcatgctcttgtaccttgggagctgaatgctgttgcactgcattactttaattgagcccttggtgctttcttttggttctttgacctcctcacagccacctcattctcacattcctctcaacaattattttaaaccttttcatcaattctccacttaaatcctatcctcattcttctcagatgatcttacttcttattttactgaaaaacttgagatcatgttatgtgcttttcatcaaatttgagcacttacaaattacagtcatccctcagtatacacagggaattggtttcgggacccccacatatgccaaaatctgcgcaaagtcccactgtgagtattgtggaacctgctaatacgaaaagtggaccttttatatatgcaggctttatgtcttattaatagtgtatttttccatccatgtttggttgaaaaaaatctgcatgttagtgggccaacacagttcaaatctacattgttcaagggactacattatctgtttacccagtcttctatctttgcctcctatttcagagaattaaagtgctccttccccagtgcaagtaattcagtaccgtaacatacaatatggggttgtaaccttggagcggtaggctacatgtatagcctaggtgtgtggtaggatatatcatctaggtttgtgtaagtacatttgttatgatgttcacacaaggatgaaattgcctcatgatgcatttctgagaatatattcctgttatgtattcctgctgttaaacagcacgactgttgttttgtcagttactgagagttgaagtccctggctataattgtagacttgcctatttctcctttcaactctatcttgtggtttaaggtcatcttgtataatatgtacatatttaggattgttatgtcctcttagtagattgatacttttatcattatgtaatatccttctttttctgtagtaattttctttgctctaatgtctactttgtctgatattacagccattcttgtgtttcaacattaatgtttgcatggtatatcttctgccatccgtttactccaaaggtacctacattgttgaatttggagtaagtttcttgtaaataacatatagttgcattgttttttatttactcttgctgatctctgtcttttaattggggtttttaggccatttacatttagggtaattattgatattttagggcttaaatctaccattgtattactggttttgtttgtttcttgtttctttttctttttttcccttcctgtgcattacttgaaaaaattttctaccattgtattactggttttgtttgtttcttgtttctttttctttttttcccttcctgtgcattacttgaaaaaattttaagagtccatctttttatatatatatatatataatatatataatagatataaaatatataaattatatatataaaaatatataatatatataaaatagatattatatataaaatagatatatataaaatagatatatataaaatagatatatataaaatagatatatataatatataatatataaatatatattatatataaatatataaatatgtatatatatttgtatataaatatgtataaatatatatttgtatataaatatgtataaatatatattatatataaatatgtataatatatatttatatataaatatacataaaatatatgtatatatgtgtgtgtgtatatacacacacacacacacacacacctacatgatgtcttattttttttaaacaacacctgtactccagataaatatggtcaaaataaatgaaaaactcaagatgacattattcccatttgtctaaaggccgggtgttgtgtagatgataagcacctgccatttatgatgacaggtgatagatccaaagtaattgccagatttgttaatttttttccatttctaaatcatccataaagaaaatcacatatagggtcacatcatccttacagtagtttagcagagcaactgtgccatctagattgatgttttcaccagtaaaggactggtagtttttgaaattagcaagtatgtgcttgatttgttctgcagcttctgccataaaaggttttactctttctggtcttcattcttcaagtttgcctttgattgatttaatgtaatctttcatatacatcttgtaggcttcttttatgaagccagcttgctgcaagtgatggttcatgacaatatcaataccagtgattactgtgctttcagtaccttcacccttgggtccttcagtagaggcatttccaccaatgagcaagtcatcaatattaccctatgtcttactgaccatcttcctctccccctccaggcacagcctgtttgcagtatctcagatcttgtaattgtcagagataatcatgatggtggctggaggtagatgatagcagtgctcgcttatagcagaagcctggagcttggagcaagtatggtgcagttggaaaggcactccagggaataggaagcatccagaaaagtatattgtgtttttgagtgtattgcctcttacagttttcctagtggttggtttgggtattacaatatacatatgtggcttattacattctagtgatgtcagcatttcaccattttgagtgaagtatagaaacctcacttcctttgaggttcctttattctccccacttttaaatatcattgtcttgagtatcagatggtggtgtaattttggtttggatcatcatatatgattagaaaactcatgatgagaaggatagtctgtggtattagtcatatttctgtttttttccattgttatttcttccttcctgatgctccaagactcctttaaaaaattattttctttttgtttgaagtacttcctttagccactctttaagattgtgtctagtgacaaattcctttcgttttcccttatttgagaacatcttgatttcactttcattactgatggatagttttactggacatagaatttgtggtggttgagagttattttcttttaaaagttgaaaaatgtgctacttccttcggtctccataatttcatatgataaacgtttatcatacaaggtagtatttcttataggtagtgttttatttctctgtggttgctttcaagattttttctttgtctttagttttcccaaacatcttttttcattcctttcctttttttttttttttttaagatttttttctatttggggtttgcacatcttctttaatcttcttcaaaatttgggaacttttcaaccattattttcttaaacttttttttattaaatttctctagatttagggagaacaagtgcagttttgttacacaggtatattgtttaatggtgaagtctgggcttttagtgtaattttgaacagtgtacattgtactcattaagtaatttctcataccccacccctttcccaccctcccaccttttcgaatcttcagtgacttttattcgacattctgtgtccatatgcacattttatttagctcctacttataagtgagaaaatgcagtattgggctttctgattttgagttgtttcacttaagataatggcttccgattccatccatgttgctgcaaaagatatgattttattcttttttattgctgaatattctgttgtatgcatgtgtgtgtacatatgtatgtatgtgtatatgtgtactcacacacatacatacacaccaccgtttctttactcactcatctgtagtcactattttaaaatactcctttagccccattatttttttccttttcttctgagactctgaaagttggatcttttgttattgtctcacaggtccttgaggctctctgttcttttttttttttttttttttgtctgttttctctctgatcaggctgagcagattgtattgatctgttctgaagttcactgattttgtcttctgtcatttctgtcatttcaatttatcccatccagttttaagatttcggttattgtactttgtagttctgtaactttcatgtgattctttttaataacttttttctttgctgaaatttctttttatttaccttagagaaattataattgtttgttgaagcattttatgaccattgcttgaaagttcttgtcagataattatgtgattcattgtggtgttgattgcagtttctcgttgaagttgtggttttcctggtactttgtatgacaagtgatttttaattttatcttggacattttggatactattttaatagattctgggtcctactgaaaattttattttagcaggcagtcaccttgtttaggtttaaacagaggtcctggactactttttgaactgtggttttaacgacaatctaattttcagaaacttttcagttatattttgatctgcttgagttgttgcgtgctgctgggcctccagtggtccctgctgatggtgtttgagggaatgaaaggaacttttcaaggctgaactgcctggtgcttctaagtatgggaatggagaccctggtctatgggatgaagcttcttgagctgggtgctagttgtggcaggatctctcctttcctatgaccgatgcagaatacctccagaaccatcccttgttatggtgggatccccctacttatgggtgtcagagtgtatttactggaccagctgcttgtggtgtggttttcctttgttggtgcctgtggcctcgttggtgtctcaggtggtgctgctgctgaggatggtgaatgcttcccctggctgcttattgacagggaggtttccagttgaaccttcttgctgtttcttctggcctcacatggtggtgttgatggcaatcctattaaattcaagagaagaatgaatctacctgggctgctttctgttgcaggcttaggagttgggaaacatcagatctggctcacttatttttttttttttttcagttgggagggttataagacaacctgttactatgttgttcctctagtcctggggtcttcaactagtttttcttccttttttaaacctttcagtgttttcctttggttatattttatggtattttcaggttttataattgtacttaatggagaggaacaggaagagaccaaaagcccttttgctcattttttaattgcaatgggtggaacttatttggatctggatttaaataaactaaaaaagtaaactaatttgatatgagattactcaaattttgaaagctaggtattttgtataaaagtatttttcctataatgatatgattgtgtaaaaataaaagactgtctcttagagatatgtactaagatatttataggtgaaattatgaaatacataggatttgcctcaaagataatatatatgcgtttgttcatagggtaagagtggtcattggctgatggttgttagggctaggggatgaatatgtgggactcagaatacctttgtgtatgtaaaaaattctccatgtttttaaattaaatttaattaatttattttttgcatccccctgatttctgaagtttttttttaagtttagcttatatttcttgaacaaagtttagatattatggtagaaagaaacttgcctgatttattttctttgtacctaatttttgagtattggtgaggctaacataatataggctaccaagttctaacacgttttcttataaggtgaggaaatattaaagtgtttatagtgtgtacatcccctctgatcggtactttaggagccccaggaaccatttggttgcttgtaattagaatgaaagtgcttttaccctgtaagagagttaatgtgctttctttaagtaagctcttttctagtcaccaggatctgaagttccagagttgactcttctatagattggcgtattaatacattggacatttattcattcttactttctttcacagctttctgttcaaaatcaggagtttgagataaataaagatggaatccccaaagtggatcagtttcatctggtatgtgacctttttgacatttactggtttgaaacacatgcagtaatataaacttagatatctgactgaaagttgtcctccagtttttctaagaatccaaattaacatttgcaataaatgaagtattgaaaaaaattcaggtgccctacttaacaccacttaattaatacaccagggttactctgctgggttgtttgtcacacagattatataaataatctaacaattagggaagaatattgtttactatgtgtttcaagatcatattatagtaaaataatgttttattataacttagttttttgtaagtacctaactatatctttgtcattcacatatgtattcagccaacatattttgagtagctatttctgtgataggaattgaaccaggtgctaggattacaaggattgtggcattgagaatgaaatgaataatttagaaatgtgaacaagtaagtgattaacatctataagttgagtaattagcaagtactttgggggtactccatttaccctgatttgattattacacatcatatgcttgtattaaaatatctcatgtacttcataagtatgcccataaagatttaaaaataatgaagcccctaaaaaaagtacttggggggaagctgatttttagttctgcaaagaaagggggaattcagtatgactagatataaagaggataaatatggcagtaaatgagtctataagagtataatgatcagactctggaagttcttagctattttgagttaagattacaatgaaagagtacatataattttgttaaactcagtagttccttatttgaccacacaaatattgtataataccttctaatgtcccacgaaatcattttaaaaaaacataccttagaaatgatattaaggagctttgccacacttcttgggtagcagtaaaaagcatttcagacaacttttgtgagattataaaactttgtgttacacttcctgattatctctgtggaaggggataacaaagaaggttgactatggtttacagttttgaaaaggctatgataaaaatttattgctattagatagaaaaataccagaaattctgtattagaggttacaacttcaccaaaagtgcacatccagaacccttgctttcaggtttgatagaaaaattaccttgtaccaagttatcctgaaatttagtttaaacttaaaacttatattacagtttcgtgagtcaggaatctggacacagcttatttgggatttctgcttcagttaatttaaggttgcagttaagatgttggctgggctacagtcatcttaaagctcgattggagatgaatatgcctctaacctcacatgtttgttcataggattctgtttctttcagtttattagaatgaggacctcagttgttctctagttgttggccagaggttgccctcaatcctttgccctgtttccatcatggcagcgtgtttcattgaaatgtatacgcagagaaggcagtagactctgttcactaagacagaagtcacagtttttcatagcaaaatcatataagtgatatcccatagtttttgatagtattctctctaaagcaattctctaggtccaagaggaaagaattatgtaaagttatgaataacagaaggttggggtcttggggcaatcttagaagtctgcttactctaaaatgtaatctggccaggcatggtggctcacgcctgtaatcccagcactttgggaggccgaggtgggcagatcaactgaggtcagaagttcaggaccagcctgcccaacatggtgaaaccctgtctgtactaaaaatacaaaaaaattagctggatgtgctggcgggtgcctgtagtcccagctacttgggaatctgaggcaggagaatcacttgaacctgggaggcagaggttgcagtgagccgagattgtgccattgcactccagcctgggcgacagaacaagactttgtctcaaaaaaaaaaaaataataataataatctgcctgtaatctgcaagtaatcatgccttgctaggcatgcagctaggtatatgtataatgaaagtaaatgtaaatacacagtccccgtttaatgtgggtagctactcatggattcaaggattgtggcattgaaaatgagattaataatttagaaatttgaacaagtaagcaagatttataaattgagtaataagcaagttcaaattataaaaatcttggcttgtatagtatttgcttctgtgatctgagtcagttattagtgctgggaatggaattacctttacctacattttgtgttcacacatagctgcaaaacaagtcaaggctctgtagtcagcaccttacagataccataccacaaatggagaagaatataaatgtatggaaccatgtagttgagagagttattagaggataattaatacacccttctcatccttcagaatccctccaataatatccccaagagatggccttcagcctctgcttaagtagagtaatgctgattttggtagtttgtgtctaaaagttggtccattccatttaagttatctagcttgttggcatacagttgtacatattttctttataattatttttatttctctaagttcagtagtgtcccctttttcatttcagattctggcagtttcagtcttctctcttttttttcttcgttagtccaaataagtttaaatacctagcttttggttttattaatttttctgtattgtttttctgttgtctattttcttactttctaatctttattatttctatccttctgcttgctttagatttagtttacaacatatattacacagttatcacaccttataaaattaacaaattgtaatattatatttaaatttccctaattgtcttaaatatatttttaaatggttgcttttttgaaattagcatatcaacaagatctacctgtattgggttaatatatctcttaatctctgttgagctataaagttcccccacaactctttttctccatgccatgtattatgtgaaaaaaatgatttcattttccatactttggagttggctgattgcatccttatggtattatttcatagttctcttttccccagttgaaaaaagtggtagatacagaggttaattaaatttacattcagtttttacaggcagtatattttatattattgtgtcatatgagggggatcatttggtgtttgattgtcacagtaagattgatcagtgtgttcaggcagaaaattttgtatgtacaggggtatatttttagtttttctatcccattggtttgtttattcatatcccagtgcctcactcatttaactaaaatagactttatagtagctttttaatacttatagggctagttccttcttcactgcttttttgttttgttaaaaaaaaaaacaacaaaaagcaacaaaaaaataaagtccgaagtcccaggttggagtgcagtggcacgatctcagctcactgcagcctctgcctcccaggttcaagtgattctcgtgcctcagcctcccgagtagctggtactacagtcacatgccaccacacctggctaatttttgtatttttagtagagatggggttttgccattttggccaggttggtcttgaactcttgacctcaagtgatccacctgcctcagcctcccaaagttctgggattacaggtgtgagccactgctggccctcattgctatttttaaaatcagctttcatggctattcttggttgtcattcttctaagacatctttataattaacttgtttggtctcaaggaaaaaaattatatttttattggattaatataaactttttaagtcaacttagggaaaattgtcccatttgttatgagagtcatttttgttgaagaccataataagacttttgttcctgatctacttttgtggttttcaggagcatgtgttattttttctcatttggattttgtaatatttaattgtttgcacctagggaaggtaactatctttaaatgttcttaaaaacatattctgtagagtacagacattggcattcattcatttatcaaatatttactgaatgtctgctatattcagatactgttttttgctactttctggagatgaagtgacaaactaaaatttcaaatcttaaggatcttagagtgtaatgcagacactagcagtaaacagatgatttctttcctttttttttttttttgagacagtcttgcttggttgccaaggctgaagtgcaggggcacgatctcagccactgcaacctctgcctcccaggttcaagcgattctcctgcctcagcagcttgagtagctgggattactggcatgcgccaccatgcccagctaatttttgtatttttggttgagacagagttttgccatgttggccaggctgatcttaaactcctggcctcaatgatccacttgccttggcctcccaaagtgcctgcctgaccagcagttaaacagattatttttattcagtctgatatgtgctttggttggagtaatcataagaggcaaataaaaggtatactaaggtgtcaaataatggaatagcaacattacaggatcatttacatgttctaatacaaataatgtcctttgaaatggagggatataataaattctagctcccataatgatggtgataatgatagcagcagtagaggtgatcctagagagtgatcacttaaaaaccaaaaccagaaatagttgactagatgaagaaatttacccttccagacagagaagcttcagtgtgacattttaatagtgtcaaattctgaccagtaccttgttaaaagagggagaaggaagtaataaaatttatttgttcgtatttcacttgtttttgagagatttcagctatgatttttttccttttacactttttccccataattcaattccattgtttcagtattggaggcattccatttcaccaaaaagtacagtcgtccctctgtatacacaggggattggtacagataaaatctacgcatacccaagtcctacagttggcccagtggaacctatgcatatgaaaaatcagccctttgtatctgtgggtgttgagtcctgagaatactgtgtttttgatctgtttggttgcagatgtggaaactgcagatagggagtgctgactgtacttacttatttcatattgatacataatatttgtacatatttatggggtatatgtgatattttgtaacttgtatggaatgtgttaatgacagtcggtatttagggtatccattatcttatttattatttctatgttttgggaacatatcaagtcctctcttctggctattttgaaatatttaatacattgttaactggagtcatcctactctgctatcaatcactagtacttatttcttctgtcaacctggttgtttgtacccattaaacaactctcttcacccccttccacctcacccacattctcttagtctctggtatctgtcattcaactctacctctatgagatcaactgttatagctccgacatatgagtgagaacatttgatatttgtctttctgtgcctggcttatttcactttacagaatgactgttccatccttgttgctgaaaatgacagaatttaattccttttttatggttgaacagtattccacattttctttatatttctttaatagtgttccacattgtctttttccatttgtccattgatggacgcttaggttggagtccttacctttgtaattgtgaatagtgctgcagtaaacatgggggtgcaggtttcatatactgatttcctttttattttgatgaatatcaaatattttgacacttaggttgagtccttacctttgtaattgtgaatagtgctgcaataaacatggggatgcaggtttcatatactgatttcctttttattttgataactatcaagtagtgggattactggattgtatgatagttccatttttagttttttggaaaatatttgtactattttccatagtggctatactaatttacatttccactaacaatgtataacagtttcctgttctccacatctttgtggagatttttcaaaatagtatttggctattttttgtcattttttaaaatagtggcattctagctgatgtaaaatgatacttcattgtggttttgatttgcatttctctgatgattagtgatgttgagcatttttcatatacttattggtcatttgtatgccttcttttgagaaatgtctatttatgtcctttgcccactttttaatggaattgttttccctgtcgagtttcttgtatattctggatattagtcctgtgttggatgaatagtttgcaaatttttccttcaattcaacaaattgtctcttacactctgttgattatttcctttgctgtgcagaagcattttagttaagtatagtcccatttgtctctttttgtttttgttgcctgtgcttttgaggtcttagccataaaaatctttgcctaggccaatgtcatgaagtgtttcccttatgttttcttctagtatttttatagtcttgggttttacatttaagtctttaatcaatcttgaattgatttttatatatggtgagaggtgagggtctactcttactcttttgcgtatggctatccagttttcccagcaccatttattgaagtgggtgtcttttccccagtatatgttcttggtgcctttgtgggaaattggttggctgtttatttctggggtttcaattctattctataggtgcatatatctatttctatactaataaaacgctgtgttggttactatagccttgtaagatattttgaagtcagtgtgatgcctccacctttgttctttttgctgataactgttttgactatttgtgctcttttttagttctacatgaaatttaggatttttttctatttatgtgaaaaattacattgctattttgatagggattgctttgaatctgtagatttctttgggtagtatgggcattttaacaatactaatcttctgatccaggagcatggagtgtctttccatttgttagtgtccttttcagtttctttcatcagtgttttgtagctttctttgtagatatcttccacctctctgtttaaatttcttcctaggtaatatatttattttgtagctgttgtaaatgggattactttcttgatgtctttcttagctagttcattattggtttatagaaatgctactgatttttacatgttgattctatatcctgcgatttactatattaatcagatctaaaagctttttggtggagtctttaggtttttctagatagaagattatgtcatctgcaaagagggacagtttgactttttctttttctttttttattattattatactttaagttttaggatacatgtgcacaacgtgcaggtttgttacatatgtacacatgtgccatgttggtgtgctgcacccattaactcgtcatttagcattaggtgtatctcctaatgctgtccctcccaccaccccacaacagtccccggtatgtgatgttccccttcctgtgtccatgtgttctcattgttcagttcccacctgtgagtgagaatatgtggtgttcggttttttgtccttgcgatagtttgctgagaatgatggtttccagcttcatccatgtccctacaaaggacatgaactcatccttttttatggctgcatagtattccatggtgtatatgtgccacattttcttaatccagcctatcattgttggacatttgggttggtttcaagtctttgctattgtgaatagtgccgcaataaacgtatgtgtgcatgtgtctttatagcagcatgatttataatcatttgggtatatacccagtaatgggatggctgggtcaaatggtatttctagttctagatccctgaggaattgccacaccgacttccacaatggttgaactagtttacagtcccaccaacagtgtaaaagtgttcctgtttctccacatcatctccagcacctgttgtttcctgactttttaatgatcaccattctaactggtgtgagatggtatctcattgtggttttgatttgcatttctctgatggccagtgatgatgagcattttttcatgtgttttttggctgcataaatgtcttcttttgagaagtgtctgttcatatccttcatccactttttgatggggttgtttgtttttttcttgtaaatttgtttgagttcattgtagattctggatattagccctttgtcagatgagtaggttgcaaaaattttctcccattttgtaggttgcttgttcactctgatggtggtttcttttgctgtgcagaagctctttagtttaattagatcccatttgtcaattttgacttttgttgccattgcttttggtgttttagacatgaagtccttgtccatgcctatgtcctgaatggtattgcctagttattcttctagggtttttatagttttaggtctaacatgtaagtctttaatccatcttgaattaatttttgtataaggtgtaaggaagggatccagtttcagctttctatatacggctagccagtggtcccagcaccatttattaaatagggaatcctttccccattgcttgtttttgtcaggtttgtcaaagatcaggtagttgtaggtgtgtggtattatttctgaggcctctgttctgttccattggtctatgtctctgttttggtaccagtatcatgctattttggttactgtagccttgtagtatagtttgaagtcaggtagcgtgatgcctccagctttgttcttttggcttaggattgacttggcaatgcgggctctttgttggttccatatgaactttaaagtagttttttccaattctgtgaagaaagtcattggtagctcgatggggatggcattgaatctataaattaccttgggcagtatggccattttctcgatattgattcttcctacccatgagcatggaatgttcttccatttctttgtatcctcttttacttcattgagcagtggtttgtagttctccttggagaggtccttcacatcccttgtaagttggattcttaggtattttattctctttgaagcaattgtgaatgggagttcactgatgatttgactctctgtttgtttgttattggtgtataagaatgcttgtgatttttgcacattgattttgtatcctgagactttgctgaagttgcttatcagcttaaggagattttgggctgagatgatggggttttctagatatacaatcatgtcatctgcaaacagggacaattggacttcctcttttcctaattgaatgccctttcttccttctcctgcctgattgccctggccagaacttccaacactatgttgaataggagtggtgagagagggcatccctgtcttgtgccagttttcaaagggaatgcttccagtttttgtacattcagtatgatattggctgtgggtttgtcatagatacctcttattattttaagatacatcccatcaatacctaatttattgagagtctttagcatgaagcgttgttgaattttgtcaaaggccttttctgcatctattgagataatcatgtggtttttgtctttggttctgtttatatgctggattacgtttattgattttcatatgttgaaccagccttgcatcccagggatgaagcccacttgatcatggtgggtaagctttttgatgtgttgctggattcggtttgccagtattttattgaggatttttgcatcaatgttcatcaagaatattggtctaaaattgtcttttttggttgtgtctctgcccggctttggtatcaggatgatgctggcctcataaaatgagttagggaggattccctctttttctattgattggaatagtttcagaaggaatggtaccagctcctccttttacctctggtagaatttagctgtgaatccatctggtcctggactttttttggttggtaagctgttaattattgcctcaatttcagagcctgttattggtctattcagagattcaacttcttcctggcttagtcttgggagtgtgtatgtgtcgaggaattcaaccatttcttctagattttctagtttatttgcgtagaggtgtttatagtattctctgatggtagtttgtatttctgtgggatcactggtgatatcccctttgtcattttttattgcatctatttgattcttctctcttttcttctttattagtcttgctagcagtttatcaattttgttgatcttttcaaaaaaccagctcctggattcattgattttttgaagggttttttgtgtctatatgtacttcagttctgctctaatcttagttatttcttgccttctgctagcttttgaaggtgtttgctcttgctcctctagttcttttaattgtgatgttagggtgtcaattttagatctttcctgctttctcttatgggcatttagtgctatacatttccctctacacactgctttgaatgtgtcccagagattctggtatgttgtgtctttgttctcgttggtttcaaagaacatctttatttctgccttcatttcgttatgtgctcagtagtcattcaggagcaggttgttcagtttccatgtagttgagtggttttgagtgagtttcttaatcctgagttctagttcattgcactgtggtctgagagacagtttgttataatttatgttcttttacatttgctgaggagagctttacttccaagtatgtggtcaattttggaataggtgtggtgtggtgctgaaaagaatgtatattctgttgatttggggtggagagttctgtagatgtctattaggtcctcttggtgcagagctgagttcaattcctggatatccttgttaactttctgtcttgttggtctgcctaatgttgacagtggggtgttaaagtctcccattattattgtgtgggagcctaagtctctttgtaggtcactcaggacttgctttatgaatctgggtcctcctgtattgggtgcatatatatttaggatagttagttcttcttgttgaattgatccctttaacattatgtaatggccttctttgtctcttttgatctttgttggtttaaagtctgttttatctgagactaggattgcaacccctgcctttttttgttttccatttgcttggcagatcttcctccatccctttattttgagcctatgtgtgtctctgcacgtgagatgggtttcctgaatacagcacactgatgggtcttgactctttatccagtttgccagtctgtgccttttaattgaagcatttagcccatttacatttaagattaatattgttatgtgtgaatttgatcctgtcattatgatgttagctggttattttgcttgttagttgatgcagtttcttcctagccttgatggtctttacaatttggcatgtttttgcagtggctggtacctgttgttccatgtttagtgcttccttcacgagctcttttagggcaggtctggtggtgacaaaatctctcagcatttgcttgtctgtaaagtattttatttctccttcatttatgaagcttagtttggctggatatgaaattctgggttgaaaattcttttctttaagaatgttgaatattggcccccactctcttctggcttgtagagtttctgctgagagattcactgttagtctgatgggcttccctttgtgggttacccgacctttctaaactctggctgccgttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatgctgaagagtgttttccaacttggttccattctcttcgtcactttgaggtacaccaattagacgtagatttggtcttttcacgtagtcccatatttcttggaggctttgttcatttctttttattcttttttctctaaacttctcttcacacttcatttcattcatttcatcttccgtcactgataccctttcttccagttgatcgcgtcggttactgagtcttgtgcattcgtcatgtatttctcgtgccatggttttcagctccatgaggtcctttaaggacttctctgcattggttattctagttatccatttgtcttatttttttcaaagtttttaacttctttgccattggttcgaacttcctcctttagcttggagtagtttgatcttctgaagccttcctctctcaactcgtcaaagtcattctctgtccagctttgttcagttgctggtgaggagctgcgttcctttgtcggaggagaggctctgatttttagagtttccggtttttctgctctgttttttccccatctttgtggttttatctacctttggtctttgatgatggtgacgtacagatgggtttttggtgtggatgtcctttctgtttgttagttttccttctaacagtcaggaccctctgctgcaggtctgttgtagtttactggaggtccactccagaccctgtttgtctaggtatcagcagtggtggctgcagaacagtggatactggtgaaccacaaatgctgctgcctgatcgttcctctgggagttttgtctcagaggagtacccggctgtgtgaggtgtcagtccacccgtactggggggtgcctcccagttaggctactcgggagtcagggacccacttgaggaggcagtctgcctgttctcagatctccagctgtgtgctgggagaaccactactctcttcaaagctgtcagacagggacacttaagtctgcagaggttattgctgtcttttgtttgtctgtgccctgcccccagaggtggagcctacagaggcagggaggcctctttgagctgtggtgggctccacccagtttgagcttcccagccactttgtttacctactcaagcctgagcaatggcaggcacccctcccccagcctcgctgccgccttgcagtttgatctgagattgctgtgctagcaatgagcgaggctccttgggcgtaggaccttccgagccatgtgccggatataatctcctggtgtgccgtttgttaagcccattggaaaagcgcagtattagggtgggagtgacccgattttccaggtgccatctgtcgcccctttctttgactaggaaagggaattccctgaccccttgcgcttcccgggtgaggcgatgcctcgccctgcttcagctcacgcatggtgcgctgcacccactgtcctgcacccactgtccggcactccccagtgagatgaacccgttacctcagttggaaatgcagaaatcacccgtcttctgcgtcgctcacgctgggagctgtagactggagctgttcctattcggccatcttggctccaccccctgacttgttctttttcaatttggattccttttatttttcttgcctgattgttctgactaggacttccaggactgtgttgaagagaagtggtgaaagtggagatccttgtcttgttccagttctttagaggaatgtttttctttttctttctttttttttgtttttctttttttttgagatggagtttcgttcgtgttgcccagctggagtgcagtggcgtgatctcagcgcgctgcaacctccacctcctgggttcaagcagttctcttgcctcagccttgccaagtagctgggattacaggcgcccgccatgatgcccagcaaattttttttttttttgtattttttagtagagacgaggtttcactgtgttggtcaggctgatcttgaactcctgacctcacgtgatgtgcccacctcggcctcccaaagtgatgggattacaggcgtgagccactgtgtctcactagaggattgcttttcttttccccatttagtaatgatgttagctgtggctttgttacagataggctttattttgttgaggtgtgttacttatatacctagtttgttgagagcttttatcataaagggatgttttaatctatgaaatactttttctgtgtctattgagatcgtttgccatatggtttttgctctttgttcagttgatgtgatggatcatgtcgctgatttgggtgtgttgaaccatcctagcatccctgggataaatgctaattaatcatggtgtattatgtttttgatgtgctgttggattcggattggtagtattttgttgaaaaattttgcatctgtgttcatcagggatactggtctatagttttttgttgttgttgtgtccttgtctggttttggtatcaaggtaatggtgggctgggccttgtagaacaagttagggagaattctcgcctcttgaacctttgcagtagtttgaggataattgatgttagttctttgaaagttcagtagaattcagcagtgaagctctgtggtcctggacttttctatgttgggagactttctcttactgaccaaatcccgttacttgttactggtctgttcatgttttctatttcttactgattcaaacctggtaggttgtatgtgtccaggaatttatatatttcctctaggttttccagttgttcatgtatagttattcataatagtctttatgttttgtatttttttgtttgtttgttttgagacagagtctccctctgttgcccaggctggagtacagtggtgcaatcttggctcactgcaagctccgcctcccgggttcatgccattctcctgcctcagccttccacgtagctgggactacaggcgcccgccacaacgcctagctaattttatgttttgtatttttgtgatatcaggcatagtgtcttctttttcatttctgattgtgtttattgcagcttttttaaagttttagtacagctagcagtttattgattttgtttatcttttaaaaaaattttttttgtggatcctttgtattttttttagtgtatttcacttagttctgctcccatcgttattcttcgttttctactaatatgtatcaggttgtttatttgtaatcttactccttttttgatagaagaatttattgctataaacttctcttttctcactgcttttgctatatctcatcagttttgttatgttgctttgattttcaattgttctaagacattttcttattccctctttaacttcttccttgaaccagtgattgctcgaagacattttctaattccctctttaatttcttccttgacccagtggtcattcagcagcacgttgtttaatttccatgttgtgtgtgtgtgtgtgtgtgtgtgtgtgtgtgtgtgttgtttttgagctgggggtctcactctgttgcccaggctggagtgcagtggtgtgatctcatctcactgcaacttctgcctcatgggtacaagcaattctcctgcctcagcctcttgagtagctgagattataggtgtctgccaccacactcatctaatgtttgtatttttagtagagacgaggtttcaccatgtcagccaggctggtctcaaactcctgaccttaagtgatccacctgcctccacctcccaaagagctgggattataggcatgagccaccgtgcctggccaatttccatgcgtttgtatagttttcagtttctcttgttgatttttagttttccattgtggtctgagatgatactggatatgattttaattttaaaacattttttgagctttgttttgtggcttaagatatggtcgtttcctatagaatgttccatatgcttatgagaagtatgtgtattctgttgctgttgggtaaagtgttctgtaaatatctgttaggttaatttggtttttaagtgcagtgtaaaatcagtttttttaaaattaattttctctctagattatctgtctagtggtgagagttgggtggagtctgtttctccctttagatctaataatatttgatttatatatctgggtgctctgttgttggatccatgtatatgtttagaattgttacattctcttgctgaattgatccctttattattatataatgaccttctttgtcactttttgctctttttgacttaaagtctgtcttacctgatacaagtatagttacacctgcttgcttttggtttccttttgtatggaacatcttttcccatctttttgcagcatacaattgggtcatttaaaaaaaagaaaaactcctttcaaccagtctatatcttttaggtggaaagtttaactggtttacattcaaggctgtcattgatacatgcatgagggttaatttctgtcattgtattaattgattctggttgttttgtgtatcttttgtttcttattttctctcttattcattgtggtttggtggttttctgtcgtggtaacacttgaattatttcttttatttgtgtgtttgttttaccagtggagtttatatgtgttttgtaatggtagatattgttctttcacttccaagtatacaactctcttagtagagacggggtttcactgtgttggccaggctagtcttgaactcctgaccgcaggtgacctcaggtgattccccccaccacggcctcccaaagtgctgggattacaggcataagccactgtgcccagccagatgatctatttgcagtgtgattatcggctcattattttggtgtttttttttgttgaggggagtaccagatacctcgtcagtcatcttgaaacccctccttcctgactgtatttattgaaaaaataagtccacttccttcttcattacagatttgtccttttgttcctttgttttgtaacacctgtttttccttgcaggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttggtttggttaatacacagaaatatctagaaatgttctgggactagttgagttgtatctttagtattcaggttgtgaaaaataaagatgtttggctatgcacaa

SEQ ID NO: 731 - DNA, 122346 bp, Homo sapiens; identical to SEQ ID NO: 730

SEQ ID NO: 732 - DNA, 122187 bp, Homo sapiens
gaaagtgtgaggtcagtagtagtttttgtggtacgtgcagtggtggccgcttcaaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaagtgggtacggcatcagtgccttcataatcagggcaagtcattttaaaataagatttaaaaactactctagaagtagcttcttggagtgtgtggagagatttccaaagtaattttaacttttactgaatttaagccttaatgctttccgtgggaatatatagtctccctaaaagttattacagcttttcagtcagttgaatttaaaaactgctttttgaccagtagaaaagaacccttgctttggagacattttcatgccacttacgaaaaatttttttaaaaaattaagttgtgacaaagtaatccatttttaaaattttatttttctgtgatgaggagttaatgttttccttttcataatgagagagcatttgaaactttagtatagtggtgttcctagacaacttttaaagctcttaaaaaattgcggtggcttaggcctgtaatcccggcactttgagaggccgaggtgggcaaatcacaaggtcaggagttcaagaccagcctggccaacatggtgaaaccccgtctctactaaaaatacaaaaattagctggacgtggtgtcacgcgccggtaatctcagctacttgggagggtgaggcaggagaattgcttgaacccggggggtggaggttgcagtgagctaagatctccagcctgagcgacagagcaagacttcgtttggggggaaaaaaaaaaaaacccataaaaaatctgtgttttaattttccttcaacacttatgaatggaaagtgcagtattttagtatattacagataaaattacatagtgtacatttattttggaatatttttgcatttgataaagtataatattatgtaattaaaattatttttgaagtaataggcaaaattttaggtatttttgcagtctttaatcccacggaatcttcaaaaatagtaaccaccgtgccttttacataaaatagactaccagtttaaagcatttgttctattacttgtaatgtttctctttgtttacattgtggaagtcctttttatgggaggatattttctaaaaaaagaatatgtacattgtttcaaagtattgatttatgtaagtgatcaaaatgtatatgagttcagtataagtttgtaaaagtttggctagagataattttaaggatagagattatatatgataaaattgcatctactacaaaatactcaaaagaattagttagtgaaggaaatattgagctcatttttaatatagagtttgaattttgataactgcatttaggacaaaacatttgtaagaattgaacatgatgtagtttagtcttcattcattattaatggtggattattgtaatctaatttaaggtattgttctagtttttcaggaattgttcaaatggatgaagatacacattacgataaaggtactgacactaaaaattattttggggtgtaagagctagatgatactgattaatttctaattttccttgtattgtgatttgattttagtggaagatgtggttggaagtcacatagaagatgcagtaacattttgggcccaggtaaatagcaaactggttgatatcccccctcacctcccccaatccagttcctccccaacaaaaacaaaaataaaacccaggaataaatacatttgtcattctcattgcctaatatttattgaattatttatcaccaggcattattaggagacaaatgttgacagctgtgatgttacttgactcattatgagtcaagtgttatgcccataatacaccaagtttgaaaaaagaaaattggcaagattgtgatttcagaattccactcaattctaggctgcttttgctggattctgagagcctgttgtatttgtgaagttatagccccatctaggggtcttttataagattgtttcttgaaggaggataagttaaaaatctcggtcgttttttctaatggcttaaatttgagatgtggtatttttctcattatagaattggaagcatgaatgaaacatttctgattttctgttgggagggtgtcagttaggtaaggttactcagttttaaatacaaagcaagcactgaagggctgtgttccacaatttaagaaggtaaattcctctgatgcacagaacgacctgctaatttttggttttgtaaactatacatgatacggaagggaaagaaattacgtttctctatactccctacagcatgggaactccttttggtggggggtgaggtgaactcgtaatgtgggaaataaggagaatatatgagaagaaagttctagaagaatatgattaacccagagttcttaaatatatagtcatgcatcacttaatgactgggatacatacagagaaatgcatcattaggcaactgcgtcgctgtatgaacatcatagaatgtacttagagaaacctggatgatatagcctaccacatacctaggccatgtggtgtacctgtacctcatgttactgtactgaatgctgcagacaattgtaacacaatattaagtctttatgtatctaaacatgaaggtacagtaaaaacatattataaaagattaaaaagtggtacacctgtatagggcactcaccatgaatggagcttgcaggattagaaattgctttgggtgagtcattgagtgagtagtgaggaatgtgaagtcctgggacattactgtacactactgtatactttataaataccatacacttaggctacactaaatttataaaaatatttttcttcaataaaccttagcttactgtaacttttaataaacttttgactcatttgtagtaacacagcttaaaacaaacattgtagagctgtgcaaaaatattctttacgtccttattctaaagctttcttctctttttaaacttttaatttttttttactttaaaaactttttggttaaaaacgaagacaagatcttcaatatcactgtctttcacttccgcttcttgtcctactagaaggtcttcagggtcagtaatgtgcatggagctgtcatcttctgtaataaaaatgcccttttggaataccttcagaaggacttgaggcggctgtacagttaacttttttaaataagtaggagtacactaaaataagaaaaattatagtaaaaaaaaatatatatatacacacacaccagtgacatagttattttcattaccaagtattatgtactgtacataattgtatgtgctgtgcttttgtgagactggggcacggtaggtttacaccagcatcaccacaaatatgtgagtaatgcattgttctatgatgttacaatggctaggactacactaggcaataggaatttttcagcttcattataatcttacgggactactgtagtgtgtgtggttcattctttgaccacaatgtcactatgtggggcatggctgcatgtaaaaaaaaattgtagaagggtgatgttatagaaaacttggggcaaattcgtgtgtctgcttatgcacatatatttggcaaatttgtttctgcttatgcatattctctaaaggttgctcacacgttctggttccatgcccattgtctctgtattagtgacaactgcatcactctcaacagtgtcccagggtggatgataaattatatttaagcttattatacagaaacatcatttatcagtgtaaaaagattttctagactagtgctgtctagtagaaatatatgagccatgtaagtaattttaaaacatttttggcagccacattgaagaaactaaaaatagcaggtgacattttaataagtacattttatttaactcaatatatccaaaatattgtttcaaaatataattagcataaaaatgtgaacaggatagtttatatttcctttttaatattgtctttgaaatccagtgtgtatattagacttacagcatatctccttagactagccatatttcaagtgggtattggctattgtattcactagtgcagctctagactttgatttcagtttactttatttgtgaatatgttgattgaatttggagcaaattcaagagtcagcagttttttttttgtaaaggatcagatgatgagtattttaccatttttaggccatacagtttgttttgcagctattcaattctgccaacatagtgcaaagcagccatagacataatgtgaatgagtgtgtgtagctgtgatgcagtaaactttatttactaaaacaggcggctgtaatttgccaacctctgagttaaaccatgaagttgaggctcttgtagaagaacgtttaaaacaggaaacatgcgcatgaaaagattaaacattaaaactactaatggtatataaatgaatgtagtggttatttcaataagcaaattggcaaatttggttggggttatggtgggatataggcatagagaagactagagatttggaaatacgcgtaggcagattaggatgaaaatctgctcacgtgtattctccatttttttttgccctgtgggcttctgccttataaaccacttataagcaaacacttcagattggatgagtggcagctgaaggaatctgacgtatttgactccacctgtttctttgaaagaacaagcttctggtcaggcatggtggctcatgcctgtaatcccaacactttgggagacctatgtgagaggatcgcctgagcccaggagtttgagaccagccttggcaacagtaagaccttgtcgctacaaaaaaaaaaaaaaaaattagccaggcatggtggtgcatgcttgtgttcccagctatgtgggaggctgagggtgggaagattgcctgggcccaggagattgagactgcagtgagctgagattgcaccaaacaaacaaacaaacaaagagctcctatttgttttagtctgtatagtgaaaaaatatagttatatggaatattttgattccaggggtttgttcacaaaggctgcttctcttgtttctcagggtcagtttaaattcagttcctgttctatgctgagactttgatattcatcatgatgttctttgaactgctctttcagagttttttttcagtcatcacggataatcatgttctttctagcattattgaatattttgttggtatatttctttagaacatatatatatatttaacattttattttgaagaaactttgacttacaggaatgttgcaaaattagtacagaggctagaatgtggctctgtatactcttcacccagcttcctttaatgctaatgtgttatataaccacagtacagtgatcaaagccagggaattaacattagtacaatgctattaactaaactacagcccttatttaaattttagcagttttttgtctttttgtgttccaggatccaatacagaatcccaaattgtatttagttgtgtatccttggtttcctttaacctctgaatgttcctcagtttttccttgtatttcaagacttttgacacttctgatgaatattagttattttgtagagtatcttttaatttgggtttgtttgatgatttcttatgaatagattagcaagagttccacagaagtgatattgtagtcctctcagtatatcatattggggtttcatgatgtgatataccttcttattgatgataaccttgattcacttgggtaaggtggcaacttccaggttttttcgctgtaaagttactcttttcttttgtaattaattaatgttttaggagacttattgtggctgtctaatccagtttctgttcaacttttcacccacgaattttattgtttattgctctagtgcttgcctaatgatgattttctattcccctcattccttccacatttattaattggaattcttctgtaaggaagagctgtctcttctctgccatttatttattcaattatttatattaatataaactcaaggatatttattccgtgggttataatcctatgctatcataatttattttgttgtttaaattattcagccttggccattgggacaaagttcaccaaagaatacagattggtacttgtccttaaacgtctcctattctttttttgagcacttttttttttttttttttcaagacagggtctccgtcaccaaggctagagtgcagtagtgtgctcatggctcattgcagtctcgaacttctgggctcaagcaatcctcccacctcatcttcctgtgtagttggaactataggtgcacactaccatgcccggctaatcttttgtattatttttgtagagacaggatttcaccacattgccaagctagtctcaaactcctgggctcaaaaatgatcctcccacctcggccctccaaagtgatgggattacaggtgtgagccatcgcaacctgcttttttttttttttttttttttttttttagcatttctttactttctggcaccatcaaatgtcccaggatcatcttttatttcccagtttgagctctgcaatcaaatcaatctttaaggaatcctttccatatgatttaattatatttggtatcttgtttgaattctacctaatttgaacacattgggaagtaaactttttctatggcctagtctcatttcttataaataactcatttaaattatgaaaaaatacaggcataagaagttgatttaatttctaatggcctaaaatcttttaagtttatcatgcttagaaccctcaagcgtgtaacactgtaaaataatattttactgtatcttatactatatctaatctttctagagtatcaatagaaataaggatatcatgaagattggttgctcactgtctgaagtttgcccccaggccagttcagttttggggaatcttgacccaaacaaggtgagccatattcttgaatataattatttcattcctcctgtcagctttcctgtgtcttagatatttagtttttggagttcctggtatatttgaaaagaagaggctgatttttggaatttgtataaactactgttatggtatatttattaattcaaaaatacttatggactgaatattactcagtcttgaaatttgacgtaagctacaacatggatgaatcttcaggacattagctaaataagccagtcacaagaggacaaatactgttatggttctacttgtatgaagtacttagagtagtcaaaatcatagagacagaaaaagtgagtgatggttatcagggactgggggaagattgaggatgaggagttattgattaatgggtgtagagtttcagttttacaacatgaaaagagctatggagatggatgatgaatggtggcgaaggttgcagaacagtatgaatgtacttaatgccactgaactgtatacttaacaatggtcaagatagtcaattttatgttatgtatagtttactacagttaaaaataggaaaagtagaattaaaagctacactattctagccaaaaaaacaaaagtgaagaaaacgtatgtactgtctgccatgtacctggcactgtattaagcattaagtaagtatgcagtggtgaacaaactagattccttgcatttgactttgattcacaaaaaatttgtaagatgcatctttatgcagagcaatttggcttttttcttttttactgagttataacttgtatacagtaaggtatatatctcttaagatcctaagtatatagcttggtgagtttttacgtgtgtatgtatccatgtaaccaccatccagatcaacatatggttctatcatttcagaaaattccttcgggccccttctcagtcaattcttagtcagtagtttctccatcagaggtataaccctcattttgatactatcaccatagattcgtatgtctgttcttaaatcatggagtatgtagtttattgtatgtatctggcttcttttgttcaacataatttctgagattcatttatattgttgtgtgtattagtgtattggtagtctgttcttttttaagctatttaacattcattgtataaatataacacaatttatcgatctgttctcctttgatgggcatttggattttttgcagtttttaactactctgaatgaaactgccgtgaaatccttatataagtcttctgctggatgtattgactcatttcttttgcacatatatctagagtagaattgctaaattgtagggtagacatgtttctgccaaagtagatactgccaaacagctttgcaaaagtgttgaaccaatttacattcttatcagcaatttatgagagttatagttcctcgatatcctcaccagccccctgctttgctagtgtactgaggttgtgttttaatatttttattagccctttggaaggggtcttgtgaagtacctattcacatcttttccccatttttaaattaggttatttgtcttgattgatttgtaggcattctgtatgtttttttcactttaattttcatttttgtttctacctcttaaagtcaatgataaagtcacaactgtaaaatgaatgcatttaaaaaataaaagatatatttcaatgacaaaaagtatgcaatgatcatgaaaatctactgtacactttgccaaggccaaagaatgaaagacaatatgaaaaagccaatcttcaaatatatcctcaacaaaaactccctcctaaatagtaaaattatcatttaagaatatttgtctttacacatctaaacagaagctctaaccaaaaaaaaagtgggggaaagggcagatgataactctccacaagttttccagatataaacatgtggtcaccaggaattcaagattaaacttctaaagcaacatttaactcaaaataaagtgaacatttctgacaggtgacaacagtagtatgaaactgatttttcctttcctaaatagaaatgagatggggcatttcagtaatcatctaagaataactgtagaaatactcccaattctaccaccccacccactggtataaaacagataccttccatgaaagtatctttcacattactgaaatatcctcacttacttgggacaatttcatgcttagatgagtataaacacttgtttttaggtgtgtggaattattggagctgagatttttgaaacaatatctgaatcttagcagagatataataatactttcactatacattgattgggcttccttaaccaaatctgagcaactactgtaataacaatgctggtggtagtccatgatactctcaaattttttccctttaagaaatatataatccatgtaatactagtaaatatgttacattgtacaccttcttaacaaagaatgtctgttttcaggccttactaggaaaacaaacaaacaatggcagttactgcctgtttttatcactgataagctacaataaagctcaaatgatggatggtttacgtgtgtgatattaagtacaaaatgaaagccattataattttaccaaaagaaacacgaaaaatatgggaagaagtgaaatgaacatggcatgggtcccaaagattacgatatgtttcagaacaggattttgaaaacaaacaatttctgtgaatatttcttatactagaaagatccaaagcaaatctaggcaagcttagccctaccttgtcaaagataaatactcagataagttggaagttccgtttgctaaagtgcatctgggatcatatctaccctgctacttagagacagccaggaaggtggccatcactcatgctctttcactctttctgtgtcttatcaagagtcacacgtaacaatttttttttcaaaccaaatgctttatatagtgaactacaggaaaaacaattctaaatacacttttaaaatgctagagagttaagataacctcattaaagaaaaaatactgaaaatgtaaagggtccatacaaactaagagctgtattaagtgtatactttctattttaataattcacttggctgtgctcttaaaatgagagaagcagatattttacccatgtcttctggcaagagattcaaaagcagaagtagcaggactgtaaaatttcataaaatttgtgggattttttaaagctaaattattcaatatcttgtacagttttgtacccatatattaccccggaatatatgtacagcatcccagcaacagtgactgcaacaaaagtaaggtaaataggtctacaaagcatttgatttccttattagagaaagtttttatagaggaaatgcaaacaactgcaattcagatcacattatataagcttgatgattatttaaaccttatataaaattaaatctaacccttaccactacaaatctgtaaggaatcagaaaaggatttatagtacacaagtcttgattactgtttcattccactttgatatcactctgagctaaaacagcattcttccaagatttaaagaaaaatagattttataaaagggattcttttacattattattgttactgacagaaacaagttttgcttttttccactataattcgctctgatgaaagaaataattctctctcttaactcctaacaaacgctacattttcaagactaagggaattactggtggcattctttctccttgatctaaactatttgtctctaaaatatgtcaagtaagcttttaaagattcaggaaggggcagcgttgtgatttttttctcagtaaattttgaggtggctcctctggcttcattgcttcactgtgatctttttcttcctcttctttgttatcttccattttttcatcctcctctctgtccagaggctgaggaataagctgattacccacaaatatgtatgtgttagttctctgtttaactctctttttttttttccttttgggtggagccctttgcggaatccccttggcctgcatctcatcatttatgaaatttctaagtgtgcgtcgaatgtaaatacaagccaagccctgtggattcctgacagcacagggagggagtcccacagaatctggtttaccattatcattcttacttggctgcacaagtggagcaaatgacacaataaggatatttttcctttcccaagtgttttgtccagttctgcgttaactgatcctctacaggcatgatcctctacattcatttgatcttcaatcagtgataccctttcttccacttgatcaaatcagctactgaagcttgtgcatgcgtcacgtagttctcgtgccatggttctcagctccatcaggtcattaaggacttctctacactgtttattctagttagccattcgtctaatttttttcaaggtttttagcttctttgcagtgggtttgaacatcctcctttagcttggagaagtttgttattaccaatcgtctgaagccttcttctctcaactcatcaaagtcattctccatccagctttgttccgttgctggcgaggagctgcgttcttttggagaagaggcgctctgatttttagaattttcggcttttctgctttggtctctccccatctttgtggttttatctactttttgtctttgatgatggtgacgtacagatggggttttggtgtggatgtcctttctgtttgttagttttccttctaacagtcaggaccttcacgtcctcagctgcaggtctgttggagtttgctggaggtccactccagaccctgtttgcctgggtatcaccagcggaggctgcagaacagcaaatattgcggaatggcagatgttgctgcctgatcgttcttctggaagcttcgtctcagaggggcacccggctgtatgaggtgtcagtctgcccctactggggggtgcctcccagttaggctactcgggggtcagggacccacttgaggatacagtctgtctgttctcagatctcaaagtctatgctgggagaaccactactctcttcaaagctgtcagacagggacgtttaagtctgcagaagtttctgctgccttttgttcagctatgccctgcctccagaggtggagtctacagaggcaggcaggcctccttgagctgtggtgggccccacccagttcaagcttcccggtggctttgtttacctactcaagcctcagcagtggcggacgcccctcccccagcctcgccgccgccttgcagttcatctgagactgctgtgctagcagtgagcgaggctccgtgggcatgggaccctcggagccaggcgtgggatataatctcctcgtgtgctgttggctaaggctattggaaaagtgcagtattagggtgagagtgtcccgaatttcccggtaccatctgtcatggcttccctttgctaggaaagggaattctctgaccccttgcacttcctgggtgaggcgatacctgccctgctccgtgggctgcacccactgtctgacaagccccagtgagatgaacccggtacctcagttggaaatgcagaaatcacccgtcttctgcgtcgctcacactgggagcttcagactggagctgttcctattcggccatcttggaacctctctctcctcttttctttataaatcttgattttacttttatttgctgaaacagtctaatgccaattctcctttctatattaatggagaatgagcatgcagataagtgtctctatatgattccttgacagatttctttcagagactatgtctataaaaattagcccatctgagacccatcattggagccaactcattcctcaatttttaaaattttttttatggggggattacaggtgtgagccactgtgcctgacctatgactgtgtttaatattgttataaattaagacatactccttttcttctattgaatataaaattaattaccttatcaaaaatttaaacaagtgtcagtaattaagtgattaatcagctacttctgattgttcataaatggattatactttgtcagttttccttagtgatctaaatggttctctccctctgccaccatgtagaagggtcataggctatgaatagtggagttgtgggaggagaagattgggcccaggcacaatgagagtgaatatatagttttcactatgtcatgagaacagataagtctatctgggatagatttacatgttttggtggttgtattacactaacagagccacgaacttcagattcttcactttgttgagtactgttatacctaggcgagttagagaaacgccacactctgagacgaattaagagtcctttatttaagctggcggccaaagagacggctaatgctcaaaattctctcggcccggaggaaggggcttgattaactttcataccttggtttaggaaggggaggggaactcaaatgcagtaattctacagaagtaaaaacatgcaagaatcaaaagaagcaaatggttacagagagataaacaatttaaaagacaaatggttacaaaaagcaaggtaccaggtgcagggctctaaatccttcattataattagatataaatgctatgccggacaggaactcaaggctttatgttgttatctctttgaaaaaaatcctgggaacttcatacattgtttgtgccagtaccttatcagttaattgggctcctttgaaatgctgaggatctgcttacacaggtcaactccttgcggaaggaggttgggtaaggagcccttagtgtcttgtaaattaaggggtcaattggagtttgtccggctttcccagctagagagagtcttacttgagaagcaaggctaggtgattaaagagacaaacaggacaaaatttaaagtagcgagttagagtaaaaacaaggttaggcattacagtaccagctctattcttggacacaagtgttcccagccctgcctcacctggtttgcaataaaccattgcatatctgtcgcttaccttataccaaattattaatcatattgtgatgttattacaaagccttaattaaagatgatgcagtcttttgcagggattgaaattggttaggactgttgattgtcagctatttttgctacttacccctgtcttcttaccagggttgagagagagtaccgtactattactgctctctcttgccctttagttgtttaatgttagctgaagaaaccggagttaattatgaattgaatacacttatcctttgtagcttttgaattgttatttatttatttgtttgtctgaatttatgtgttctttattgttttggtgaataggtttggtgtttaggtttcataaaataaatctgtggatttgtcctagttcagagtgatacattgaaattaattttataatccataacttaaagcagtattcttcagccatttttctcattattccctcctaaggagcatttttagacctgttttctccctaatggcctaatgggccttctccccttcagatattttaatactacagatatacagtatataataactatgttatcagtagggttgaactttggagggctacagaccattgtagtgtttaagatttccaactctccataaggaccacttttattccccttagggatattgccccagttgagaatgtatgatttaaagctgttaaggccaggcatgggggctcatgcccgtaatcccagcactttgggaggccgaggcaggaggattggttgaggccaggagttcaaaaccagtcttgggcaacatagtgagaccctgtttctacaaaaaaaaaaaaaaaaaaaaaaaaagctaggtatggtatgtgtgcctgtaaccccagatatttgggaggctgaagcgggaggattgtgtgagcccagaagtttgaggctacagtgagctatgatcatgccactgcactccagcctggacaacagagtaaaaccttatctcaaaaaaagtagttatcagcctgcagtgatttttgtatccttcccaatccaatcatggcttacttcatttttgttactgtaaagaaatacctgagactgggtaatttataaagaaaagaggtttatttggctcatggttctgtaggctgtacaaaaagcataactccaacatagtatagttgagagttagacttaagtggcatgtacttcgcatgtttatgttttaaaaaaattataccaattatgtcttcagacattaaaatagtatgattttaagtgtttgatgcctgtgtcttctaaaaaaagtctttttgctttttatacaactctaacaagggactcagggtgcttccacaaatattagaaggtgaagaggagccagtgtctgtagattacatggtgagagaggaagcaaagggaggaagaggtgccaggctcttttcaacaaccagttctcttaggaactatgagtgaaaactcattcacttccacgagaatggcaccaagccgtttttagggatctgcctctactatccaatcacctcctaccaggcccccctccaacattgggaatcagattttaacatgagatttggtggatgatatccaaatgatatccatctaaatcatagacaccttcaggagacatttgacagtgtttggagacgtttttgcttgtcacaactggaagtggtgctactggcatctagtgtctagaggccagaagggatgttggtaaatatcttacaatgcacaggacagaggacagccccactctgccactcaacacagactcatctggtcccaagtgccagtagtgctaaggctactttgaagttcgagaaaatgaaagccagcctgggcaacatggtgagaccttgcctctacaaaaaaaaaaaaaaaaaaaaaaaaaaaatacaaaacttagcccaggcgtggtggtgcgtgcccatgttcccagctaccgtggggactgaggtgggaggatcacttgagcttggagaggttgagtcagcagagagccatgactgctgcactgcactccaggcctggcgacagaatgagaccctgtctcaaaaaaaaaaaaagaaaagaaaatgattgaaagtacataaattttctctttattcttttattaaacatcattcaattgagatataaaataaagtacagtattaaagatattatctaatttagttttatctacttaataggactaatgtccttatacgtaaagtaaaaagtatgaaatctttcttgcttggtaggaaatatgaattccactatagttgagagttagacttacgtggcatgtacttgccatgtttatgttaaaaaaaattgtaccaattatcgcctcagatattataatagtgtgattttaagtgtttgatgcttgtgccttaaaaaatttttttttttgctttttatacccctccctcctcattttggagatgcagaatagcataatgaactctgaagtcagaagtttgaatcttggttctgcagtttactagtttatgtctttggatacatagtggcataaacaaagtacctgcctgataggattgtgagaattaaatgagttatatataaagtacttattgacatataggaagagcttaaatgctaacctttattctgatctgttcaccatgctttaaatgccaagtaattttgctttcttttctctttgtagatttatggtggattattttctgaagatcagtgttggtacagatgcaaagtactgaaaatcatcagcgttgaaaaggcaggaaattaagtgttcagtttttttttgctttaagaaatatttattgtggttcaaaaatttgatgcttatttagcccttcattgcttattcgtagtactgatacctggttcagtgattaaaacacagaagaaattaattgctaaaaaacatgttgttttataatcacctcagattattcaagaatagattatataatatgtaggttatttttggtgactagttatttttacctcagttcttttttttttttttttttttttttgagatggagtctttctgtgtcgcccaggctggagtgcagtggtacgatcttggctcactgcaaactctgcctcctaggttcaagctattctcctgcctcagcctcccaagtagctgggattacaggcgcccaccaacacactggctaatttttgtatttttagtagagacggggtttcaccatgtttgtcaggctggtcgaacttctgacctcaggtgatccgtccgcctcagcctccgaaagtgctgggattacaggagtgagccactgtgcccagcctgcctcagatcttaataattatatttggttcttgagtaacttttaaatgttcattttattaagctttataagtaggagaagaacattttgattgattcttctgaagttaggtatatcttttatttagttgatgtgaatattgttaataataatgattggcttgccactttcttatgcctgggttaaatgtggtgagttttctttgtgttaagcttttttttttttttttttttttttttttgacattgtgaatttgtggaggatttttaagaggatttagggagacagaattctgaatagctgtttggtgacagttgcatattgcaggctgggtgaaagcacctctgtaagatttcctttggtgttttttctacacctcctttctgtacttaaattataatatgtatgtttttactgaaccagggaaagtggttcaggataaaagagaaaaagttaaaaatatgtatgtttcagaaatattttctttggtgtgataagatgctaagatgtgacaatttgattaatattctgaatagcttggtttaaaaaaatttcattttttgctgtcatagaaaatggtttattttagtggaatggaactttctaattgacctttctcccataatttgacaactggagatgatattttacatatgtttttcagttggctttaattttttaaattaaagggcagcatgatgtttgaccttgtaataactatttttcttttttactttttaaacagatgtagagctggaggtaagggtggtgaatctgattagtttacatggtctacctggagtgagtttaattgtgtcaaaggaagtttgataactttgcctttcttttcagattttattctttccaacttgaaattgaattgaatgttgattgattttaacattaggagaaacaggagagggctgtaagcttcataggctgatgtttatttaaaatatcaattgtctaaaaacaaaaagcaccctaatgagaaatggtactgttggaatttaactagtaacaagtaaagaaatcactgtaatttcatggactgtggattttttttttattttgaagatattagaaatctgtttctgaatgtattttgtcattttgaggtaagaatgctattttgatatacaggtcattaacagagagcagcaaattggtggtttctttggaaacatttaatctggggtcagtattcgtatttgtctcttattttttccagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcaggcaagtcacgtattttaaatatttttgctaatgaaagtaaaactatgtgcttgaaacaaaatgtaggtatagttaaatcttactttaatataaaagtctgtataaattagtgaaaaataggaattataattagaaagcaattatatatttatgctcatctttgctaggtaaacattgaacagataagaatgacatacacatatataatatatgtaaatagtttccttctgatgtaaatgtttaaaaggatagtctctttttgtttttttttttttttttgagacagagtctgactctgttgcccaggctggagtgcagtagcgtgatctcggctcactgcaacctctgcctcccaggttcaagcaattcttctgcctcagcctcccgaatagctggattacaggcctgtgccaccatgtccagctaatttttgtatttttggtagagttggggttttaccatgttggccaggctggtctcgaactcctgaccccaggtgatccacccaccttggccttccaaagtgctgggattacaagcatgagccactgcgcccagccaaggatagtctcttatatgatggagaaaataatgaatacagttatttctataattgttttgggaaagtatttattaaataaaagtgatctttacctagtcctggccataaataccacaaatttgaaattaatggggttataattaatcagattgtattattttggcagaggctcatactgtttgatgtaataattggcagtggatgttttgcttatgtggattctagtttatattactttccattgaattttgggttggtaacctaattctggaagacgttcgataatttcaggggtagtcttacaggaattctacctcttttaaaatctgttatacaaagatgattcttttggtaaatggtaatgctggtgagagatattacattggaaagtaatcagatttgtaattcttatttataatagcagctcaagtagctcatgtggaaaacagtttaatcattgtaagcattataaagaaattaattaaaattgcctctatttttctttgagaatcttgtaggtgtgttgggtatagttttgtctgctatgtagttacttataaaaaacatttctgtacatgaaactcaggctttcataaacatgaaatatagatattataaaattacaccccaagtttctggtttaaaatctaaagtttgttactttcttctttaatataaatgctttgaccaaggttggggaggcttgttttggatttcttgcatgcataaaactctaaaatcttgtttacggaccttagaatattatctgctctcactttgttttacatatagggaaattgtagtctagaataattaaatgacttcaagtcgtgaagctaactagggaagagctaggcctagaactcaagtctgttgttcttttcatagtaaaatgcacagatttgtgttgattgaaacacacatgaatcaagggggaaaaagacattaaaaaaagttaattttagaactgaattaataaactgcagctgagaatgtttttgtatgtttcaaagattctttatatatggtactgtatataaacatttatatatatatatatatatatattttttttttttttttttggttgggggttgaagtcttgctctgttgcccaggctggagtgcaatggcatgatctcggctcactgcaacctccgcctcttgggttcaagcgattctcctgcctcagtctcctgatagctggaattacaggcacccgccaccacgcatggctaatttttgtatttttagtagaggtggggtttcaccatgttggccaggctggtcttgaactcctgacttcaagagatccccctgtctctgccttccaaagtgctgggattacaggcatgagccacccggctaaacatttgtatttggatgcttagttcagtaaaaagatcattgattagagttaagctaattggcacacaatgttttctggaaaaaaatgagctattcttgaatagctctgcttagaaagtccgtgtttagttattaattctcagcccaaagctcaactctaatcttctatatgaagtctttgctaatacccacttacccggtcctctgtggtgttttagtcactccgtatataaagcctataaagttgtaattttttcctcccctacaagcttagtgagtttggtagagataagtattcacttttctgtgcctaatttccctgccaggtaggtgttagatgagcattagtttatctaacatttgaataaatagatgaacagcagggattcagtaacaacacaaatacctccttccttccccttttccagaaggtgtcctgggcactgaaattccttcacatttttttaactaacactttcacgctatgctgcagcacagtcagaattgatgctcagaatggtagtttgctgaagatcgagagaatattacattactagtcctacatgcctgactttaaaaattatatgtagggtaagggaatgagagctagagcttggaatttgtgtttaacaatttaaaggccttttagcttgttttctaatatatacaggcagaattcagaggaataaagtagaaagcaagtgatcctttcttgtttctgaatgaagcttaccagtttggaaaacagaatgaaatatatttctaaaaagtgacattcatcttttttaatgattgaaagccttatgttctaaaccagtgaccagatttattttaaaaagttaagttttgtccagtgcggtggctcatgcctgtaagcccagcactttcggaggctgaagtgggtggatggcttgagtccaggagtttgagaccagcttgggcaacatgggaaaaccctgtctgtataaaaaatacaaaaaaattagctgggcatggtggcgcatgcctgtagtccccgctactcaggaggctgaggtgggaggattgcttgagcttgaggggtcaaggctgtgagaccctgtctgaaaaaaaaaagataaaagttaagttttataccttttaaatgcctaaatatattttttaagtgcaggtatatatctccagctcataagggttagtggaaaatatatttcttatgataaaaattaaatgtttatatgtattatatataaagagaaaacatacatatttttggtatagtattaaaacacccatgtatcatatactctgtcattctttttgttagttggaactgaggaagactcagattttatttcaagttcagggttctgtgtttatgattatatatgattcagggagaatctgtttgaaccacttcatactaattgtgattggtgactgtaactaaaatgaatttgaattcagagagaaatctaaaattagatttctgcataaaaattctatgcaaggagtaatggacctttagaacattcagctttaggtaattgaaacttttgtagacaataggttatttccatttgaattcacgtattgcccaaagacagggtttcttgaaatattaataattccacatataccagcaataattttcaaagacttcctaggggcagaagttgttcttgaattttagatagacttttgataataagagttgaaagcaagggtttttatgtgaaagaggttaactggaaaactacatctaattgattaaaatcctaacatatatttcagttagttatattttgaggttgttagctttgcctgcttgatcccatttgattggtgataacttctggactgtatttgttatttatactgatataattgatataatatattgatataatatattgaattcttggtgaattcaaacctcttgatataatgtgtgtatttctgaattttatgccttggaaaatttataaaacctgtgtttttgttaacctaaagtattataggaattttatgccttgaaaaatttataaaacctgtgtgtttgttaacctaaagtattttcgtgttttgtggatttaaaaaattattttttcagctaggcacagggtgtgtgcctgtaatcacagctacttaggaggctgaagtgggaggattgcttgggcccaggagttcaagaccagcttgagcaaacatagcaagaccccatctaaaaaattctttttttttttttttttgggtagtgatagttggtgattcttgagcatatgtagtttgagtctccttctctgccccttcagatgcatccttgtaggcccaggtatcctcaacctgttgttaaaataaatgtgtcagctgggtgcggtgtctcacgcctgtaatcccagctctttgggagactgaggtgggcggatcacgaggtcaggagatcgagaccatcctggctaacatggtgaaaccccatctctactacaaaatacaaaaaattagctggtcatggtggtgggtgcctgtagtcccagctacttgggaggctgaggcaggagaatggtgtgaacctgggagatggagcttgcagtgagccgagatagcgccactgcactcccacctgggcgacaaagccagactccattcaaaaaataaaaaaataaaaaaaaaatgtgtcccaatgaaataattttttttgtaatcctatgtatttcatacatttaaaaacattctgagaaaaagtccaaagatttcacctgactgataaaggagccccatggccacaaaaaggttaagaattcctacatcggtctcaattttaccctctatactactgtgtagttgaagagaaaatagttcttaaaaatgttatttagtttcttggaccttgacttccccacaccccctatttcttttaaaaatgtgaccggtttgtattttgtggtttttagtgtgtttttacactcttgtttgtctgattattacgggtatgatgtcctgttcggtttgctttgtttgcataaactatattgttttttgtatttatagagtgggaatgtagctaaaaatacagctccaccttctaagagagatacgtttcatcagatgatgtccctatttcaaggaagttgtgaaccagtaaatttgagctgtacctacccattttgtgttttaagtttatgctttatatattccgaaaaagaatacttacttttaatttcctttatagtacgcacagggtgaaattcaggaaaataacctagagaaatttgggaagagcagttagattgtgtcaaagtaattttagtaattacagttttatggaggagtagataagttcttattaaaattaagtctcaatatgttccaatcccaaatatgttttaggtgtatctttgcttagttctattgatagatattcagtagctcaaagttagcaagcacctaatttctcatatgccagttgtacagttgtagccctcttaagcaaaagtctatttaagagagttttgaatgtagaaggccaggcgaggtggctcacccctgtaatcccagcactttgggaggccgaggtgggcggatcacttgaggttaggagtttgagaccagctcaactgacacggtgaaaccccatctctactaaaaatagaaaaattaggcaggtgtggtggtgtgtgccagtagtcccggttactggggaggctgaggcaggagaatcgcttgaaccggggaggcagaggttgcaatgagccgagattgtgccactgcactccagcctgtgcgacagagtgagattctgtctcaaaaaagaagaaaaacaaagttttgaatatgtatttgtgacacctcacattttataatttcagtttgttgatttttaaagaatttgttcgtattttgtgctttcggtttgtggctttttttgcttctgctcgtcttactttaaaaccagagttcctgactctgcctctaaaactttcaaagttttgtaaaatcgagtaccttttctagatatcagagattcatttttatgcgctattgcttttcaggagaccattatatttagttggggccaaagtaatcaatgtaatctgctgggttaaaaaaaactattctaggatatttacttagtatacatttttagatttataaaggtggctgcctgtacaagtatttagctctacttgattttagcaagtgtgtaattggaatacattcatatacgtggagatgcatatttgcatattatagccaacagcaaagtaatatagagattttagaatgaagaaatatgatgcttggaaaaaatgggtaggaacaaaataagggaagagaaacatgttggtgtagctggtttatgttttcttctttcttagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaagtaagaatttagtcttcactaatttctaattgatggtagaggtccctgtcatagtagaatagaagttaaggcttatgcttttggaatcctttactgtgtcagtgattttaagggctgatgctgatatttctgtttttctcaaatgtattcctctctgctttagcagggatattttcattaaaagctattttgaaagaaaaataactcctgaattattttaaagtttacataccaacttttcatgccaactatttggaatacacttatcaaaaataaaaatctgctcctaaatctgaattattcaggcaaagtcagaatttcagataagatttgaagttcttcctatggctttaggaatattttaaagagtttcaggaaattgcctttacttttttaataaaagtgaggctctttcttcttcttgtgaaaacttgtgatggagtttgattattccgaatactttactttttagataattttaaattatcaacttgaagcagaaatccagatttgatatttatatgtatcaaaacagtcttctatatcatggtccaagccatgatgctgtatcttggatgacatagctgtttgatgggatctcatcagtgctttaggagctaaactgtcaaatgggggtgggaggcggtggacggggggatcacaggggatcacaggacggggggatcacgggggggggatcacaggagggactggaaaaaaactaatacagaaatgctttttactttgttctctgtagttgatagtgctatgaagaagttggaatatttttttttgagaattagaggcattattgaattacgacttcagttataaaatcttgtttgcattaaattattttttaatattatgaactaggtaaatattttagttttcaaaattaactttcagatatattgtggcataaaaggaccaagataacttagatttgttttctgtgtcagccttatacagtttgtttgtcaaaataaatgaatttgtttttatagggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcaggtatgttcagtggcttaaggtgaagagtgtccaactgggaaatctgtgtactcatctgctgctatttatttttctgtcactttcctttccttccccacctcattctctcctttgctaatccctgtatttgtttataggtgaattttttttcatatactccagactaatcatctttggatttcattggatgtttgcaaatttaataatttctcatttacatttccctttatgttctaaaaacttttcaactaaggcaattttcaaacattctaaaaggagagagacttgaataattaattctcatgtgcccatcacccagtttatacaattataacacatggccaatctttttaaaaatttacacttcctggattattttagaagaagtcccattcatattatttcatagtcttcagtatgtatgactaatagaaaaggactttaaaaaaccgtaataataatactattcatacttaaaagtaaacaataattccttaatattatttatatccaggcagtattcaaatttgccatattgtgtcatgaatgccacatgattgtaggcatgttgattgtagttttctccaatcaggatcccagttaggcacatacattgcattttggttgatatttctcttaaattgctttaatgtgtttccttgtgttgcttaactggattcttgatctccacgtgtgtcttcttttatggtaatcacgtctccagatttgctcagattttagttcagaaattttcccccccagggatacagtgtggttgataagtgtgtgtgtgtgtgtgtgtgtgtgtgtgtgtgtatgtgtgtttaacaccaaatctgttgttcctgcactagttcctccaattctctgacaccaactgggtgtctaataattcagctccattctgacactacattacctgtacttagcatataccctacaagttaaggactcagttccataaagctgcctctactttagatgccagccacaaatggggtccccaggctacttgcatatctacccccccactataaattcggggtttcccatgaccctccctcaggttagataattcactagaactactcacagaactcacggaagtgctatacttacagttttattattaaggatataactcagaaacagccaaataaatggaagatatatataaggcaaggtactggggcaggaggtacagagcttccatgccctttctgagtgtgccaccctcccaggtcatggatgtgtttatcaacccagaagctccccaaatctcattcagagtattttggttttgtttgtttgtttgttttgagacagtcttgcaacatcttgctctgttgcttaggctggagtgcagtggtgtaatttctgctcactgcaacttctgcctcccggactcaagcaatccactcacttcagtctcctgcctagctcggactataggtatgtgccccattcctggctaatttttgtgttttcttttctttttttttttaaactcaaacttgccttatttatatccccaatggcatgatctcggctcactgcaacctctgcttcccaggttcaagcgattctcctgcctcagcctcctgatagctggcattacaggcacccgccgccatgtctggctaatttttgtatttttagtagagacggggtttcaccatgttggccaggctggtttcgaactcctcaggtgatccacccacctctgcctcccaaagtgctgggattacaggcatgagccactgtgcccagcccacattttctttatccagtctatcattgatgggcatttgggttggttccaagtctttgccattgtaaatagtgctgcaataaacatatgtgtgcatatgtctttatagtagaatgatttataatcctttgggtatatacccagtaatggtattgctgggtcaaatggtatttcttgttctagatccttgaggaattgccacactgtcttccgcaatggttgaactaattcatactcccaccaacagtgtagaagtgttcctatttctccacatcgtctccagcatctgttgtttcctgactttttaatgatcgccattataactggagtgagatggtatctcattgtggttttgatttgcatttctctaatgaccagtgatgatgggctttttgtcatagttttttggccgcataaatgtcttcttttgagaagtgcctgttcatattctttgcccactttttgatggtgttgtttttttcttataaatttattttaagttccttgtagattctggatattagccctttgtcagatggacagattgcaaaaattttctcccattctgtaggttgcctgtacactctgatggtagtttcttttgctgtgcagaggctctttagtttaattagatcccatttgtctattttggctcttgttcccattgcttttggtgttttagttatgaagtccttgcccatgcctatgtcctgaatggtattgcctaggtgttcttctagggtttttactgtttggggttttacatttaagtctttaatccatcttgagttaatttttgtataaggtgtaaggaaggggtccagtttcagttttcttcatatggctagccagttttcccaacaccgtttataaaatagggaatcctttccccattgcttgtttttgtcaggtttgtcgaagatcagatggttgtagatgtgtggtgttatttctgaggcctttgttctgttccattgatctttatatctgttttggtaccagtagcatgctgttttggttactgtagccttgtagtatagtttgaagtcagatagcgtgatgtctccaggtttgttcattttgcttaggtttgtcttggctatacgggctctttttggttccatatgaaatttaaagtagttttttctagttctgtgaagaaagtcagtggtagtttgatgggaatagaattgaatctatcaattactttgggcagtgtggccattttcatggtattgattcttcctgtccacgagcatggaattgtattttctgtacagtcagggtttgctgtgttgcttaggctggtctcaaacttctgggctcaagcaatccttcctcttttggctccagagttgctgggactacaggcgagccaccatgccttgctaaattaatgaactttaaacacatttgacatgttttaatccactgaagccattttttttctttttgatgcacacattatcccctttgaagtctttttaaattagcttctgtgtccttttgacatcataacagctgatattcataatggataaatcaccattattaagtttttcattaatctgtgacctaatgatttttgcagccatcgatggttgttgtctgcaagcatgttttcatcaggtgctgtatttcttttttttgtttttattattatactttaagttttagggtacatgtgcacaacgtgcaggtttgttacatacgtatacatgtgccatgttggtgtgctgcacccattaactcgtcatttagcattaggtatatctcctaatgctatccttcaccactccccccaccccacaacagtccctgatgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacattaactcatcattttttttggccaggtgctgtatttcttagctggaaaatttcaactatttagtcatgctgaagcctagtttgttcagtaaaggcaagataaatactttattcattccctttatatgtacatgttttcagaaaaataagtttattccctaggattgtccagtgttgaccagcaagggttatttgttctccttaagtattattatgaactaatgaattttaaacatatttgagtgttttaattcactgcagccattattctttttgatgcccatcttatactctttggaagtctctttaagttgttgctctgtccttttgatgtgattccagtagtctgatagcttccttgttttctggtgtcacaagatgttccatactcatctgcatttcctaccctaatcctggaaaagttatttctccaagctatagttctttttagtggcaagaggtatttagataccagactttgggtgctagggatatatatagctattgctttagtctttgcttctaggttatagaatgtctaattgatagggttaggaaatattattttctaatgctatattgagatatcatttacatatagtaaaaatgcacaaatactgtgtagaacttgataaattttgacgtatgtatactctcatgtaacctgaatcaccctcatcaagattggctgatgaaactatcattaatcagatatttcacctagtatcaagctctaccaataatttcagggacacaggtaacaaagagactcctttgttccagagcaggtgccccagtctctgaccagagactagaatgtctgctgtggctactgctgccaggcatcaaacaatgtctctaaactctcataagggtgccatctgtagtattgtaactagagagggtggggcccctctcaggtgagcagtgtggatatgaagcagtggggagtgtgttctactcaagtgtaagtctcacagcagcctatagcagagctttgggtgttgtcccaggtgtgcataggagagcctggcttttctgccccttcttggctgggcagcagctgcagtcatgtcagcctaaagtcaggccaaagttgggccacagctcagaattaaactctccaagtgacacttttggcctgtgccctgggatactggggcaccaccctggtgaacagcatgggcaaaaagctgtgggaagtgtagtctgattgtgtctcagtttcacagcagcccattgcagggctgtgggtattctatagatatgtgtggggtagcctggtttccctgttggtcctttgctgggcagtgactggggctgtgtcagcccaaactcaggccaagggcaggactcagcccagcattgaactcagaaaatggtgccttgggcatggggctagagagaatgagtcaccacccagccaagcagcatgagcaagaaggtgtatggagtatgatctacttatgtctcagtctcaacagcagcttgtagcagggtgacaagtatcctcctgggggtgcatgggcatgcttgttctccctctccttttttggagcagtacagtggctgcagccatgtctataggtccctggtatctaaactcttaaagtggctccctgctgaggctgctccagacttgggtgcctgtgggattctgtgtggattccttttctggaacaatgtctttgtgtgatctttaggcagctccatatgtgaggtgtgaggccctagtggatcgagggtttctcctatagccaatgttgtaaatgcttgtttcagagctctggggatttttctcttactgtttccctgcgtacagtagcctttcccagctctcagctggtttctggctaggcatgcttcctcaaaccctctcctttcttacttctggggctttctctctcttctctggtgaatccaaatattcattcttagtctgttcaaaatgtgtctacttaactatttctgattcttccctgtggaaaaggcacacactatctagttggccatcttgattattttctctctcactcattgtttatcattgtggtttggtgtgtttctgtagtgggaacatttgattcctttcttgttttacttgtgtgtttgctttactctgtgggttttatacttttttttttttttttttgagacagagtcttgctctgtcgcccaggctggagtgcaatggcacggtcttggctctctgcaacctccacctcccaagttcaagcagttctcctacttcagccccctgagtagctgggattataaggacctgccaccatgcccagttaatttttgtactttttagtagaaacggggtttcaccatgttggccaggctggtcttgaattcctgacctcaggtgatctgcccacttcggcctcccaaagtgctgggattacaggcgtgagccactgcgtccagctgggtttttaactttcatgtgtttttatgatcacagattgtgtattgccctcccttaagcatctcttgtagggatggtctagtgctgatgaattccctcagcttttgcttgcctgggaaagactactacttcttcattcatgaaagacaactttgctggatatagtattcttgactagcagtttcctttcagcgctttgaatatattgtttcattctctcctgtaaggattttactgagaaatttacagttaatctgatgggggtttccttataattgatgacacgcctttttccttctgtttttagaaatatctttgtctttgacttttgacaggttgactgtaatatgctgtggagaagacctttatgaattttatctgtttaggcatctctgaacttcttttatttgaatgtctaaatctcttgctagacttgggaagttttcagctattttattaaatataagaagtttttgatccctttttttctctttttctgtgacattgaaaattcaaatacttgtttgcagtgtggtgtctcatatgtcttgtaggcttttttcattcttttttgttctttttttaaatttttgattgactgggttagttcaaaagtcttgtcttaagttctgaaattctttcttctgtttgatctagtattttttgttgttgtttgttttgttttgaggcagggttttgttttgttgcccaggatagagtgcagtggcacaatcacagctcactgcagcctccaacttctgtgctcaatcagtgctcctgcctcagcttcctgagtagctgggactacaggtgcatgccaccatgctgagctaatattttaaatttttattagagatgaggtcttgttatgttgaccaggctcttctcaacccctgagctcaagtgatcctcctgcctcagcctcccaaagtgctgggattataggcgtgagccatcatgccaggcctagatctagtatattgttgaagctttggaatgtattttgtatttcattcggtgaatcctttagttctaggatttctttttttttttttaatgatacctatttggtaaatttctcatttataacctgaattgtttttctgatttctttatattatttttcagaattatcttttatctcactgaacttatttaaaatcagtattttggatttttcatctggaatttcagaatttctttttgattatgatctgttggtggagaattactaacttcctttggagttatattttcttgtcttctcatgtttcttttgttacattgatatttgtgcattgggtgtaacagttgcttcttccaattttttggaaataattttgtaggggaggatcttttcctgaagatgtacccatggtgttggttgggtagggccctttggctttaattctgggttcatgcagtagcatagtctttgtatgattcctttggatgtgaatagtcagtggcgtttgtgatttcctcaatggcttagggtgtggttgttagtgggggctgcggagaagttttgctgggtaaaggaatgccatgtttgccagtcctcagaccccaatggtggcaatgccaggccaagtatgcttgtccttggtttccaggacagcacatgctggcactactgttagaaagcccaggttggccagtgcttgggtttccaggagtcttgcttgggtgctagtagcagcagtggtgggccagacaggtgagtgtgttcttgggctcttaggcagtgggcacgatgtgggtgatagtagcaatggcttgacaaccctgtgctttccaagtggtctacactggtgttagtgctggctgtgatgtgctgagtgggtcagtcaggcccacaggtagcatgtgcaagtggatgccagctgtgttggtagtggcaggttgggtaggcctgaccttgggcccttgggaggagtgttgaggtaccaatggtggactgggctgggtgatacccagggccttgggtggtgtgctcagacactggtgagaggggttatggagctgggtagagtggacctgtcctcaggtccaggtggtgagtgcagactctgattgcggtaggcaggtgcaggatgatgcccaggtttccagtggaatgcttgagtgggggtggcagtggttgctttgcagccctgtcactggggagggtgaggttgctttcactggcagcagatgtgtggaggtggctggtgaacatgtactttgctcttacatttgctccagtggaggcagtttgcaagggcagcagctgcaggtgggaaagtttgtcctttgggtgtgtgaaaatgtgcagcagctttgctgcttagggcagcggggtcactgtaaatggctcacactttgacactggtggcagcagcagctagcattgcctcaggttctgggttgggtagccctcccttgggtcatgtgaagatgcatggctacccttctgctggtggggttggggttcctgccagtggcttgcagtttggcctcaggtgtggcagcagctagtgacaatggtggttgtgggatggggtagcctttcctctgggtccgtgaaaatgcatggttgcccttcttgggcgtagagtggctgccagtggcttgtgttttgattctgtggcagcagcagccagtagtggtggtggctgcaagcaggatagcatttcctcagggccatcaagatgtatggctgttcctctgccgtagggaacagggttgctgccagtggctcctacctcttcgcgggtacttgcagccagctgcagtggtggctgtgggcaggagatgtcagctttgctccagggttgtggagttgtaggggatgttgggccctagaccatgatgcagtctacttggggctgggcacacaaaatggcagcatgctgtagttgcttaggattggggggtgggtgtatgggacccaacatgagctccctgtatggagcaatatacttgtgtagtctctgggcagctctctgtgtctcagagcacatgaggatcaaaggtccctttcgtggctagaattgcaggagtttgcagtgagaatatgggccactggggtctctcatttaccccttctatgcattgaggagcctgtccaggctcccagccaagaaggctgcttctcttctttctccttccttcctttatgtgtttcctgtcacttctctgttgaagtcccatttctctcttagatgatctatttgaagtgtgattatctacttgctattttggctcttttctcagagggaggcaaataacagtggcctctagtgagtcatcttgaagcccctgtctgaaataatgtaatctaacaaacacgtttttgtgtgttatatttattgtatactgtatctttacaattaagtaatctagagaagggaaaatattattaagaaaatcataaggaagaagaaatgtatttacgttttattaagtcttaatcctcattgtcttcatgttgagtaggctgaggaggaagagcatgggttggtcttgtctcacaggtgacagagatggaagaggtggagggataaataagttaaataattttaacttaatattatttaattttaaaataagttaaaattatttaacttactaacttatttaaaaataagttaaaattattttaaaataaattaaactttttacttttttttctcaataagttatacaaggtgtaccaggcaggcacaccttgtgtaactttttgagaaaaatctgtttgtaagtggatctgtgcagttcaaacctgtgttgttcaggcatcaactatgtttcttttcatacattgttggattcagttttctaattttttggagggtttttacatatatgttcgtgacatatattggtttgtggctttctttttgtgtaatgttgttttctgatttcagtattagggtgatgctggcctcatggaatgagtttggaagtatttcctctgcttctattcaatgactgagaattggtatagttttttccttaaatgtttggtagaatttaccagtgaacttatataggcctgacattttctgttttggaaggttattaatggttgattcaattttaaaaatagaaataagtctgttcagattatttttttatttttatttttttggagacggagtctcactctgttgcccaggctggagtgcagtggcgcgatgtctgctcactgcaagccccacctcctgggttcacgccattctcctgcctcagcctcccaagcagctgggactacaggcgcccgccaccatgcccggctaatttttgtatttttagtagagacggggtttcactatgttagccaggatggtctcaatctcctgacctcgtgatccacccgcctcggcctcccaaagtgctgggattacaggtgtgagccaccatgcccggcctgttcagattatttttgtgtgagctttggcagattacgtctttcaaagaattagttcatttaatctaggttatcaaatttgtgggacttgagttgttcataatatttttaagttttaatttccattggatctgtactgatgccctctctttcatttctgatactggcaatttgtgtcctctgtctttttttcctttattagcctggttatagtgttaccaattttattcatcttttcaaagtatcaacttttggttttgctggtttttctctcctgatttcctgttttcaaattgattgatttatactttcctatttttgcatattaagatttaatttgctaaaggagatttaatttcctaagaagcaaacttagattattaatattagtttcttttcacttctaatatatacgcatttcaatgctgtaaatttttgtcaatgcactgcctgtgctgcgttctacaaattttggtaagttgtatttttatcttgaaagtatttttaaatttgtcatgagatttcttctttgactcatgtgttattagtaatgttggttaatccttacatgttttgagatttttttcaattatctttctgttattgatttttagcttattctactgtggcctgagagcagacattgtacggtttctattcttttaactctgttaaggtgtgttttatggcccagaatgtggtggcgtattttggtgaatcttccatgtgatcttgacaggaatgtatattctgctgttattggatgaagcatagttcacccttgaacatgagtttgaactacatgggtccacttatatgtggatattttaaataaaagttacatcagttatgcctgcctctccagcctccccttccacttcttccctctctgccatcggtgagataggaataccaacctctcctcttcctccctgtcctcagcctgctcaatgtgaagatgagggaggatgaagaccttaatgatgatccacttccatttaatgaatagtaaatatatcttctctttatgcttttcctaataacattttcttttttttggcttactttactgtgagaatacagtatataatacatataacatacagaatacttgctaactgatggcttgtcttatcaataaagcttctggtcaacagtaggctattagtaattagctttctgtggaatctaaagttatacataaattttcaagactgttgggggttggcacccctaacacttgctttgttcaagagtcagctgtagtctgtagatgttaattatcaactgtacactatagatgttaattatatccaatttattggtgttgagttcaaatgtatctttactgatttttccatgctagatctgtccacctctgatagagggatgttgaagtcatttttgatttccgttacagtgttttgatatctaacatttctttttggttcattcttaggatttccatctctttgcttacattgcccgtctgttgttactacatgctatctactttctccattatgatgcgtagcatattaatcataattgttttaaattcattgtctgataattccaacatcccgtctacatctggttctgaatgttttctttcttcaaactgtagtttttgccctagagtatgccttgtaattttttcttttcttttcttttcttgttttttttttttttttgagacagggtcttgccctgttgtctagtctggaatgcagtggcgtgatcttggctcactgcaacctccacctcccggactcaagtgatcctcccacctcagcctcctgagtaactgggactacaggtgtgcaccaccatgcctggctaatttttgctttttttttttttttgggggtagagaccattttgtcttgttgcccaggctggtcttgaactcctgggctcaagcagttgacccacttcagcctcccaaagtgctggaattataggcattagccactgtgcctagctgtaattttttcttgataactgtatatgatatatcaggtaaaaaagcaattggtttaaatatgtctttaataatgtaattgtaagatgtacgcgggagtgatgtgttgtatagtcctgtgattaggtctcagtctttttgtgagtctatgtctctggcccatgaattcacaagcatttctcaattttttcctccccctttaggtgggataggatggctagagtaggatggaattgggtatttacctcctcccatgtggaaggatagagctggctggagttggatatttccatcccccaggtcagttaggctttgatgaaacctcagcaggttaggctctgcttaactggtttcttttcagggtagatcttattaagaagtacagagtgctctgggatatttcagaatggtttgtttccccccccgccactgctggaaacatgaggggattttactgcgatgatatgtatgatactgtatttactgtgagaacctgatctagctcctggaggtaaaattcacaaaagcatgggggcccccatgactggatgcccctggagctttcaactctcagtcgtgcccacacctagtttccagcagtttgtcagcagtccaggttttcctatctaggcactgcttcctgtagaaatttctgttccagtatgttgtgattctctgtatccctgtctgtctgtttaattttaggagtagcagttttcccagtgaccctacctatctcaccttttcttacagatctgagaaaagttgttgatttccactttgttcagctttttaatatgtgttaggatggcatagtgacttccaggctccttacatgtgaaaccaaaacctgaagtccccatattattgttttaaatcttttgttcttttgtaatatacttttagagataaagatttctttctaagcattgctttatttacaaaccacaaattttgatatgttttgtttattatttagtgaagcatatttacaacatttcctcgtgaatcctagtttgaaccatgagctacttagaagcatgttgcttaatttccacaaatttgaagatttccccaatatacattttatttttttcttggtacatagtatttgtatatgtttactggtgtatgtgtgatattttgtcatatgcctagaatgtgtaatgatcaagtgtaggtatttaggatatcgatcacctcaaggatttatcatttctgtgtgttgggaacatttcaagacctctcttctagctattttgaaatatacaatacatcattaactgtagtcatctgctatcaaacattagaacttatcccttctatctaactgcgtgtttgtacttattaaccaaactttctttattcttctatccctaccacatccttcctagcctctggtatctatcattccactctctacctccatgagatcaactttttttagctcctacatattaacaagaatgtaaaatattttctttctgtgcctggcttatttcacttaatagaatgacatccagttccatccatgttgctgcaaatgacaggatttcattctttttttatggctgaatagtatcccattgtatatactgcattttcttgatccactgatggacacttaggttgattccatgtctttgatgttgtgatagtgctgcagtaaacttaggagtgcatgttaattcctttcttttggataaatactcagtggttcctgcaatatattttgttactgatttctaatttaattttattggtatcagagagcatactctgaatggtttcagtccttttaagttgattgacatttgtttcattacccagcatatggtctgcctggaaatgtttcatgcatttttaaaagttatgtgtatcctatagctgttgggtgaagtgttttataaatattaggctgaattggttgatagtggacttcaagtcttttagaccctgacagattctttctctacttattcaatcaactactgagagagaagtactgaaatctaaatattattgtagttttgtctgttttattcccttttgttctattagattttgtgatttttttaaaaaaagttctattattatgcaaatatacatttagaattgttggatctttttgatgaattgacccatttatctttatgaaatgtctctctttattgcttagaaaatactccctgtgccaaagggagttgttgcttgacattaatacaggcatatttgcatatagtatttttattcgaagttcctagagcagtcaaatctgtagggacccaaagttgaatggtggtttctgggggcttgggggagggggaggggagatagggagtagtgtttgagagatagagttttaattaggaaagatgaaaaagttctggagatggatggtgctgatgattgcacaacaatatgaatgtacctaatgcaacagaactatacattttaaaatggttaaaatgataaattttatgttatgtatattttaccacaatttaaaaaaagacatagcaccaaaaaaagatgatgaatgaataaattccaaaaagctgtgccaggagtgataatgtatagtttgtttagaatcattgaagccttcattctttatttaattgaagcagttaaaaataaatattaatttgaaataaaaatcagcagctagattctattatattttattcaaatttggaatttttttttttttttttgagacagagtctggctttgttgcccaggctggagtgctgtggcacaatctcgcctcgctgcaacctctgcctccctaactcaagccatcctctcaccttagcctcctaagtagctaagctacaggcatgcaccaccacacccatgtattttttcgtagagacggggttttgccacattgtccaggctggtctcaaacttctgagctcaaaccatctgtcctccttggcctcccaaagtgttggaattacaggcatgagccactgtgcccagccaaaaattatttaaattatagcagaaatacagtttcctatttgggtctcacgagaatgtgtttattctttgtttcagcaagagaaggcagctgctgtggatttgactaaccacttagaatacactctgaagacctatatagataccagaatgaaaaatctggcagctaagatggaaatactgaaagaaatgaggtaggtaaaagcatatttttcagaaggatattttaaactaatttttaatcaattggtgctttgtttaaattgtgtgcttgccatttttgctttaaaatttaacctttgtatttttatgacttcaaagagagaaagatagttatttctgagatgaattttatactgtttttgtcaggtttctactgtcactgcttggagctagagtgttctaaggttataactgagactgaaattgaaaaaacagcaacatagcttttaagtgatagtttgatgggaaactaccatatccagttattttgcttggggttattttcaggagtacagcatgtccttgaataacgtgttttcattcaacattatttcattataacattgaagaagaaaatcaattcctagctggagccccactgtctgtgtggagtttgcacattctctccatatttgggtggttttcttggaatactgtggtttcctctcacatcccacttaggtgaattggtgtgtctgtattgtcccagtatgagtgagtgtgtggatgagggtgagtgtgccctgcaatgcaagggtgtcatgtccaggattggttcctaccttaatgctctgagctgctgagatagatgtggccacctgcaacccctggattggaataagcgggttggaaaatgaatgagtgaatgagtatatacagattatcataaaataaaaatttgtgaagtatgcaagaatcatacagatgcctttgcaataagcgatgtgacatgaaagcattcagcaagcccactacgtttgttattgtttgtttttgaacctgtggtggtagggggcgcttcttagaattttcgcttgcaaacatttattccttgatttaaccctactgtcacccactcattcaccaaagtttgggtaaataattatctttgttgtttttattgctttttcttaaatgtgtgtataggacacgtatattttagtgtttaatattagaaatgttttgggtctttatttggaagtgctgtttttgtgactaaaaatatgccataggaacttaactcttgtttagatcaattagcctatgatactatgggtttcttatatgtcttttctcttagacattgtaaattatctgtagaccaaaaattgaaggttcatttgataccatttcaaattctgcagactttcgaagttgccttttttatagtttaaaaaatttttaattttttcatattttttatgtcatgaaattagtatatccacagttgttttttaattaaaagtttatattaaattatgcatgtctgcataaaaatatgtggactgaaaaaaataagttatacatgattttatataaagttttaaaaggtaccccttcaaagccagtgctgtaaacactaacttttagaccattactattaaagtgtaactttttctcacaccagctttctaatttattgatcttcttctttttgatgtttttaaaaataggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtggtgagttgggaatttttctctattgtggtttttatctgttgaacataaggaagtgtttttttaatttcttctaaaaaaaataacaggatacatgtgcagaatgtgcagatttgttacataggtatacatgcgccgtggtagtttgctgcacctgtcctctaaattccctccctcacccccccatttcctaacgagccctggtgtgtattgtttccctccctgtgtccatgtgttctcaatgttcaactcccacttacgagtgagaacatgtagtgtttggttttctattcttgtgttagtttgccgaagatgatggcttccagcttcatccatgtcgttgcaaaggacataaactcgttcctttttatggctgcatagtattccatggtgtatatgtaccacattttctttatccagtctatcgttgatgggcatttgggttggttccaagtctttgccattgtgaacagtgctgcagtaaacatacgtgtgcatgtgtctttatagtagaatgatctatattcctttgggtatatacccagtaatgatattgctgggtcaaatggtatttctggttctagatccttgaggaatcgccatatcgtcttccacaatggttgaactaatttacgttcccaccaacactgtgaaagtgttcctgtttctccacatcctctccagcatctattgtttcctgactttaatgatcgtcattctaactggtatgagatggtatcttcttgtggttttgatttgcatttctctgatgattagtgatgttgagctttttttcatatgtttgttggccacataaatgtcttcttttgagaagtgcctcttcatatcctttgcccactttttgatggggttgtctttttcctgtaaatatgtttaagttctttgtagattctggatattagatctttgtcagatgggtagattgcaaaaattttcttctgttcaggagaacaggttgcctgttcactgtgatgatagtttcttttgctgtgcagaagctctttagtttaattagatcccatttgtcaattttgacttttgttgcatttgcttttgttgtttttgtcaagaagtctttgcccatgcctatgtcctgaacgctattgcctgggttttcttctagggtttttatagttttaggttttacatttaagtctttaatccatctagagttaatttttgtgtaaagtgtaaggaaggggttcagtttcagttttctgcatatgtctagttttcccagcaccatttactgaataggagatgctttcccaattgcttgtttttgtcaggtttgtcgaagatcagatggttttagatgtgtgatgttatttctgaggtttctgttctgctccattggtctatatgtctgttttggtaccagtagcatgctgttttggttactgtagccttgtagtatagtttgaagtcaggtagcatcatgcctccagcattgttccttttgcttaggattatcttggctatatggggtcttctttgaatccatatgaaatttaaaatagttttttctaattctgtgaagaatgtcaatggtagcttgatgggaatagcattggttctataaaattttttggccagtatagccattttcatgatattgagtcttcctatccatgaggatggaatatttttccatttgtttgtgtcctctcttatttccttgagcagtggtttgtagttcttcttgaagaggtccttcacatcccttattagctgtattcctaggtattttattctgtttgtagcaattgtgaatgggagttcattcatgatttggctctttgcttgcctcttgttggtgtgtaggaatgcttgtgatttttgcacatttattttgtatcctgagactttgctgcagttgcctatcagttcaagacgtttttggggtgagacgatggggatttctaaatataaaatcatgtcgtctgcaaacagacaacttgtcttcctctcttcctatttgaataccctttatttctttctcttgcctgattgccctgtcgagaacttccaatactgtggtgaataggagtggtgagagagggaatcgttgtcttgtaccagttttcaaagggaatgcttccagcatttgcccattcaatttgaggctgtgggtttgtcataaataactgttactattttgagatatgttccgtcaatacttagtttactgagagtttttaacatgaaggcatgttgaattttatcgaagccctttctgcatctattgagatagtcacgtggtttttgtcattggttctgtttatgtgatggattacgtttattgatttgcgtatgttgaaccagccttgcgtcccagggatgaagtggacttgatcgtggtgggtaagttttttgatgtgctgcgggattcggtttgtcagtattttattgaggattttcgcatcgatgttcatcagggatattggcctgaagttttctttttttgttgtgtcttttcccggtttgggtatcaggataatgctggcttcataaaatgagttagggaggagtccgtccttttcagttgttgggaatagtttcaaaaggaatggtatcagctgttctttgtatttctggtagaattcggctgtgaatctgtctggtcctgggctttttttggtcggtaggctgttaattactacctcaatttcagagtttttgttattggtctattcagggattcagcttcttccagaaggggtggccagcccctgcacacctgtgggcgtttctcgtcaggtggaacgagagacttgagaaaagaaagagacacagagacaaagtatagagaaagaaaagtgggcccaagggaccggcgctcagcatgtggaggacccgcgcccgccggcaaaggtctctgagttccctcagtatttattgatcattatctctaccatctcggagagggggatgtggcaggacaatagggtaatagtggggagagagtcagcaggaaaacatgtgaacaaatgtctctgtgtcataaacaaggttagaaaatgtgctgtgctttgatgtgcacatacataaacatatctggtgcattaaagagtagtattgccgtcagcatgtctcacctccagccttaaggtggttttctcctgtctcagtagatagaacatacaatcgggttttacaccgagacattccattgcccagggatgagcaggagacagatgccttcctcttatctcaactgcaaagaggccttcctcttttactaatcctcctcagcacagaccctttatgggtgtcgggctgggggacggtcaggtctttcccttcccacgaagccgtatttcagactgtcacatggggagaaaccttggacaagacctggctttcctaggcagaggtccctgcggccttctgcagtgttttgtgtccgtgggtacttgagattagggagtggtgatgatttttaacaagcatactgccttcaagcatttgtttaacaaagcacatcctgcatagccctaaatccatgaaaccttgagtcgacacagcacatgtcgtagggagcacagggttgggggtagggttgcagattaacagcatctcaaggcagaataatttttcttaatacagaacaaaatggagtctcttacgtctacttctttctgcattgacacagtaacagtctgatctgcctttcttttccccacactacctggtttagtcttggtagggtgtaggcatccaagagtttattcatttcttctagattttctagtttatttgtgtagaggtgtttatagtattctgtgatggtagttggtatttttgtggggtcagtggtgatacccctttaacattttttgttgagtctatttgattcttctctctcttcttcttagtctagctagtggtctgttttgttactttttttaaaaaacagaccctagattcattgatttttttttggagtgttttttttgtgtgtgtgtgtctctgtctccttcaattcttctctgatcttatttcttgtcttctgctagcttttgggttcatttgctcttgcctttctagttcttttaattgtgatgttaaggtgttgatatgagatctttctagctttctgatgtgggtatttagtgctataaattcctctcttaacactactttatctgtgtcctggagattctggtacattgtctctttgttctcattggtttcaaagcacttcttgatttctgccttaatttcattatttaccctggagccattcaggagcaagttgttcagtttccatgacattgtgtggttttgagtgagcaatactaaccttaaatgtaaatgggccaaatgccccaattaaaagacacagactggcaaattagctaagtggtcaagactcatctgtgtgctgtattcaggagacccatcttccgcacaaaaacacatacaggctcaaaagaaagggatggagggaaatttaccaaacaaatagaaagcaaaagaaagcagaggttgcagtcctagtctctgataaaacagactttaaatcaacaaagataaaaaaagacaaaggcattacgtaatggtaaaggaaacagttcaacaagaagaggtgactattctgaatatatatgcacccaaggagcacccagattcataaaacaagttcttagagacctacaaagagacttagattcccacacaataataatgggagactttaacaccccactgtcagtattagatcaacgagacagaaaattaacaaggatattcaggacttgaacttagctctctatcaagtggacctgatagacgtctgcagaactctctaccccaaatcaactgaatatacattcttctcagtgccacatggcacttattctaaaattgaccacataattggaagtaaaacactcttcagcaaatgcaaaagaactgaaatcataacaaacagtctctcagatcacagtgtaatcaaattagaactcaggaaatgttatctttctagaaagacaaggaactggagatattgtaatgatagtttgtgtaaaacctttaacttttacagtatcttcatattaataatttccttcatttattgccttataagaaaggtgtaatagacaactggtgattgtggataaggggtagcaaaatcttttccctttttgcatgaaaactttacctttggttaactccctctctttgttcccttggtaatgtgataaaatatttcaactgtgttactaggcaacattatttatggtaagtataacttatgattgtcaaactgcatctgtactgggagaaactacaaactacaaatacttgatgtggactcttgtaactaaacatgccccttgagggaccctggaagctatacctatggagttgttacaagagatactggcttttgagggacattaggcttgtaaaccagagtggctttcatacatgctaatgtggaacttttctggtctgagtggtgtgttttatgcatgtaagactctgccttactattaattagtgtctgagtcacctattgttgggaggtagttgtttgtgtgtgtgagtaggggtgtgaaaatgaaatattttacataaattctttattagcttaggtacaagtatatttatttcctgttgcagttttctttaatttattgtattgggctgaacagaacttcctgtttttcttgtaaaccattccctacaaccaccataactttccctagcacctgtgagctctatacttgttgtgtttggacttgttccatcttaaatatttgtggtttctgcctctgtggattataccctgtaaatcttactccctagtcatacctaggttgatcagttggcagcctgactgcctctgaatgagaagtatgagcaggataactaggcttttgaaaatgccaggaatgtttagtttggagaagggatttgattttggttattttacgtattagattctaactgatcacttctgattatgggagaaagaagatgacagcagaatgattaattttttaatttctatgaaacacaggcagtgtgtttataaacattttcttacattaacttttaaaatgggcatatttgctcccattttataagtgaggaaacaggcttacaagggtaaggaaattgttcaagattacctagttgtaattttttaaaattaaaaaattactcttttttttgaggtatggtctcactctgtcacccaggctggagtgcagtggcacgatcacagctcactgcagcctcaacctccagggcacaagagattctccacttcagcttcccaagtagctaggactacaggcggtgtactaccaaccatgcctggctaatttttttgtactttttatagtgacggggttttaccatgttgtccagacaggttttgaactccttggctcaagtaatcctcctgccttggcctcccaaagtcctgggattgcaagtgttagctaccatgcccgtaccctagttctaaatgttaatatggaacttgaacccagacatgtctgacagcaaagcctattgtttttccattgaaaccacactattgatattaaaatacttcttaatgtattttcatgtaagatgaaaagatgtaaaaaaacctgccttatttgtttttgtggtttgagcatagtgaaagtattcaggatggagctttagcacttactatcctatgagtacagatgtgactttttttgaaagcagaattttttttttctactactgcttgtgtttccggacttaaagtttacttgatagatggaagtgtagattattggctaaatatataatcataatagccactcaaatgaaatcgtcattttatttcccttattgtacttattttggtttagaattgataacttttattcaagtattttgcatagttctttaacttgattgccatgtggccatatgctttttttttttttttgagacggagtctcgctctgtcgcccaggccggagtgcagtggtgtgatctcggctcactgcaagttctgccttccgggttcgtgccattctgctgcctcagcctcccgagttgctgggactacaggcgcctgccactctgcccagctaattttttgtatttttagtagagatggggtttcaccatggtctcgatctcctgacctcatgatccgcctgcctcggcctcccaaagtgctgggattacaggcgtgggccaccgtgcccagatgttttttttttttaatgatgaaaacagtaggctttacttgaggtcttttcttttttatttatagttttaaaataatctggttgagcttatgcaagaaaaaatatcctaaaattcaggcttttatagttttatagttttataatgtattttatagttttatttatagttttaaaataatctggttgagcttatgcaagaaaaaatatcctaaaattcaggcttttatagttttatagttttataatacattttatagttttatttatagttttaaaataatctggttgagcttatgcaagaaaaaatatcctaaaattcaggcttttaagtgtatgtgccagacactgttataggtaatagagattaaaacttttttattttatttcattttattattattttacttttagggtacatgtgcacaatgtgcaggttagttacatatgtatacatgtgccatgctgctgtgctgcacccattaactcgtcatttagcattaggtatatctcctaatgctatccctcccccctccctccaccccgagataaaaatttttaaaagacatatcctttctttctttcttgggtacaggatggatatattaatatatagttttaatacagtatggtaagtgctataataaagaaaatgcatagagttcttggatatctttcacatatgtatttccaaacacagcctgttggacaaattggagggtttatcctggtgtttaagtgtatcttgaaggatgagtagctgaaggagttgagaatgggatgggaatagaaaagaggccatatgtaattagtaggaacttatataattttctgtaagaaaaacaaaaatttcattgttgcagaaataatgggaaaaataaaaattagatcagagttgttgaacttaaatgttttatttttaattaagagaaaggaagtttttttgtcattttgttgatctaaggagagaaatgtcctaagtgctataatgtttggagaatataaagttaattttggagatcactttttttcatataggtcatatgcggaaaagacctgatgtattaatgatggttattctttttttcttcctccagagtgaagggaatattttgattgcccaaagaaatgaaatgcagcagaagctgtacatgtcagtagaagattttattctggaagttgatgagtcatctcttaataaacgcttaaaaacattgcaggttggaattaaaaatatattaaatatacgttaaattgtaagtttatttaagaagtgaaattagcatttaccttaagactttagattgttctgtgatggttgcaaaagtttttcctgtttcctgaattctgatttctttttaatgggattaaaagtttatattaatatattttgtggctatgtttatatgcatatctatcttgcaaacaaggtaaaatggctagggactccagtattcactggggaaattaatggagacaggagcagtagcaggtatgtgggtccctatcgtccattgcattctagcagaaaatgtagtaggaccacatgttacagggagaagggatcaactctgatccataaattatagggtttttaggctccatgaccagggaagtttctccctgatgtgatcagaggctagagtactgtagtacatatagctatatgatatggtggaatcttgtcttcagctctgtcttgccagctcaggaatgactttaattcggggtgaatgaacatgacagtgttaagtaatttcacctaataatagtgtttctctctacttattcagatctttttttgtcctttaatattgtttaaaatttttctctataagtcctcatgcttttttcttcatttaacttttatttatttatgcttttgattgcttttatgaatattatcttgtcatttcctagttttgattgaatagaggaatactgttcatttttatgtactggtgtttctctgataactctgctgatctctcttttagttctcatttgtctgttgatactctgctttctgtgttttcaaatgttttcatttgaaatgttttcattttctaatgttttcatttgaaatgttttcattttcaaatgttttcatttcattttcaagtgttttcatttgaaaacaataactctttaatcttttctcttctagtccttttaccttttatgtatctttgaatttttactgctttggtcagttaccctagtactaagctgaccagtagctaatatcgatcttgttgtggactgcagggagtaagcttgctagaaatttggagaagaagatattcagggacatctgggcattgtttctttctgtcctgctggatgaagatgtagttttgatgatgcaccacatggcttaagaaccattggagccctggtttgaaacattttcttaattggaattgcataaatagtataagttcttccagaatgttgaagtaagccttgcatataaaagggcagtaatatagtaagaatttagctttccacaatgcagcttctactttgtcccttaaaggtttatttcttctcactgttagtaaatgtaggttaaggttctgtaattaagatcatctttaaacctcttttcttttaaaagttcaatgctagaagactttttgccttaactggcttgtctccacttctagtattccctcaggtcaccaaaatattctttaaacttctctttattttgctgagaaatagtttatatttttcaagtatccaagaaagatatttctataatgaaggtcaaataaatgaaagttcttgatttctgatttcctcagcattttatttagacttcttttgtggcatacaatacatgtttgattttttgtgactggtcttcttaagttcaaaaagaaattgtattctcggttttcttggtgtacagttttagatatatctaaaacttgcttaggttttggttggttcagtatatcagtctttgagatatttttgttacatatatctgaaatagataggtttgtccctatttgtccctattgttcttttggttcttgttcaaagtatttcagcgccacattgttgggtgttaaggtattcatgattgtaatgtatttaaaaatgtgtatcccccccatgacacatgtttacctatgtaacagaccttcacatgtacctccaaacctaaactaaaagtcaaaaataataataaaaatgttttctttttaactactatgtaatcttattttttcacttagattttaaaaaataaaaatttttttgtttgccttttaagttcgtatcccacctttctttttggttaacactgcaacatcttttctttttttctatttttattttatttatttttatttttcttgagatggagtctcgctctgtcgcctaggctggagtgcagtggccgatctccgctcactgcaacctctgcctcccgggttcaagcgattctcctgcctcagcctacctagtagctgggattacaggcacacaccaccatgcctgtctaattttttgtattttagtagagatgggtttcacgatgttgcccagggtgggctcgaactcctgagctcaggcagtctacccaccttggcctccaaagtgctagatttacaggtgtgagccaccgcacctggcttctccctttatttttaaccttttgtattcacgttttgaaataacctcttgataacacactaatggatttaatttttgaaagcacccaacgtatatcttttttgttggtaacttaatttacatatttataattactgttttattaaaacttatttctgtttatcatcgtttctttttctctctttttctaacttacacctcttatacttttttttttttttttgagatggagtctcactctgttacccaggttggagtgcagtggcacagtcttggctcactgcaacttctgcctcctgggttcaagtgattctccttcctcagcctcatgagtggctaggattacaggcaggcctggctaatttttgtgtttttaatagagatggggtttcatcatgttggccaggctagtcttgaactcctggcctcaagtcatccacccgcctcagcctcccaaagtgttgggattacaggcgtgagccactgtgcccggccactcttctaatactttagaacattcttatctgcctttggtgtctttcctctctttctctacctccttccccaaaccaaccagtgaacctaccacaattgtctaggattttagtcacgggttattatagatattgtgtgtgatagctcagttaaatagactttagagttatttttccattcttatttcataagtcgtttatctcttggctttctctgtatattggaatattttctctaagagtgctttcaaagaaatctttgtgtatttgattttgcgagttatttgatatttcaggatatctcatttcaatctcaaatacaaatagttgtttagctgactataaaatagcaagttcaaaggccatgtttcctttacacctttgacaataataatctattgtttcatttctatcattttatttctttatttatttgagacagagtcttgctctttcacccaggctggagtgcagtggtgccatctcagctcactgcaacctctggctcctgggttcaagcaattctcatgcctcaacctcccgagtagctgggactacaggcatgcaccactgtgcccggctaattttagtagagatggggtttcacgatgttggccgggctggtctcgaacttctgacctcgagtgatccgcctctcttggcctcctaaagtgctgggattacaggtgtgagccaaagtgcccagccttcttatttccataattgttatcagtctaatctttgttcttctgtgatcttttttccctctggaagttttaaaattttctcttgactttgttcttaagttgcatcagaacatgtttatgttttgactgaatctgagccagttcagtctgaggttttatatatttctttaattgtaggtaatacttgataattatttattgagatacttctctcccccattaattttttctcttattctgagacttctgatagatatttcagcttctatttctgttatctacatattttaatggctaatctattgtttaaaatctttttatcttatgtaggaggtgggttaaactaaataaataaatacaatctttttatcttgttggtgtctttttggagggatccttgacttaaccatgtagctaatgaattaatcctctagctgtgtcccttctgccatttagccaatccattgcattttgtatgtcaaagattatttcttttatatttaatatcttcagttggttattttttatttataagtacttggcttttgtgtttccaatattctttcttttgttgagaatatttattatgcttatttttgagttcttactgttatctgggccattgacactgattttgcttcctttttataaagtggcttagttttttatacttctttcagagtgcttgtgctgttcacaccattttatcctcttcttatctctcctcaagatctcatattcccttggaactataagctaccttagttctttgctgttgtgtagttatatgaagggcctagggaagagtgaaagtctggaccacaacttttaagactttggataggtttagggaatagaatggggttatttttatttttaagggtctagcttctgatgttgccatctgggattatctacttcctctttgcttctctcctgggtggtctgtcctactcttcagcaaacctctattccctctgcctcagctactgctcctttccaggcactaccacccttagatgtaaatgctgccagatattcaggggagaagtgaaggaaagagaatggtcaggggctggccagctcttctgtattggttatcagtttttgcctcatctgtgttcttgtgctgtacttgcataaacctgttgcctcttgatggtgctgctgtttttctttctgatgtgagggagagagaagagcctatgaaaaaagttttcttttcccacaggtaattctgtgctgtgacacagtccttctttcacttgtagggactttgttaattcaatgctaaacaccaaccatcctctgcctaagatttctcagagttttgtgattaaaaacttctgagatctcttaagctttttttcttatctctgtaaaatttctagggtttgatttctggagagagctagcaggctgtgcctatcttgtcttttccaattctttattacattaaaaaattttattgttactgttattttttttttgtgcacctgccccgacaaacccagccaggccaattcattaaaaaaatgcctttaagtacagtcaagggctgcatggtttggtcagtgatggactgcatatatggtggtggtgccataaaattatagtacttaactgtaccttttctgtgtttacataggcaatcattgttacaattgcttacattattcagcacagtaacatgctatatctaggagcagtaggctatagcatgtagtttggttgtgtagtaaatttataccatctaggtttgcatcagtacactccatgatgtttgcataatgatgaaattgcctcacgatgcatttcttagaagatatccgtgttgttaagtgatgcatgattgtccatatatatgtttaatgtctttacttaattagaattatttgtatattttagcgtgtagtttatttttatttggcaatcggtcttagaaactttcatgccaggacaaacagtagtgattcttatgatagacaaaggagactcagaagggtgattaggggtggagagtggtggatgttgagaaattacttaatgggttcaatgtacatttggatgatagatacactaaagcccagactttaccactacacaatatatccatgtagcaaaattactcttgtacttaataaatttatacaaaaagttagggaaaacagggtaatgtctacttaattaaaaaccataaggatataaagctttctatttgtaactaattcacttaataaactttactgttatggtccaaataaaccaccttctaggtagttttgtgttttcatctctatctgatgattctaagttgtatttatgaaattctcaagaatggggattcagcatactgcttttctaccccttagatcctaacacagtgctcgaatcctgaattagttaataaactttaataaacagaagtatatctctctgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtaataaaagctcctgcccggttgtgtttgtagcataaaccagggaatatatattttaaaaatcacgcgctttgttcaagagctgacatcatctacctactatgtatcagatttaaaattgccaccttaccagtcaaggttctttattagcttttagtcagattgctccttttattagtctcaaaaaaatcatatcggtcttgttcctcctttttctcagcttttcctaaggattgtcctctttcctcttttaaccatttatttattttcttacagtatgctatgtgtatgtaccttttcctttcagtgcataaattttatgagggtaggcacttttttttcctgcattcctagttcttttacattgcccagggtatagcttaatactctgcttcaggtattaaggcacgatgaatgctgattgaattaaatgagatatttcatgtgtttatttttgcaaatgaggtttttgacctatctgtggaaggatcactgatttcagaagacgcaatggataatattgatgaaatcctagagaagactgagtcaagtgtctgcaaagagctggagatagctctggttgtgagtatcgatattctttattattgcctcctttgaagcagtgtggtttcctttcatggttagaaagtattaaccaataatagagtttttcttgctagttagaaagtattaagactgatcttagctttcttctaataggcttgttgaaagagtaacaatgtctagttctaatccagacaccatgcaaagtcttattcttaggtgacatttttgttttaataggacatttcacataaaaaatctgtttaattctaagaaaactgctcttaatttgagtggacaatcttgtctatattttgattcttgaatgcgtcataccaaatgactataagaagagactccttagagtttgtgaaaacttaaaatctgagagagctctgaaagttgacacacaagatggagtggtcatcctctttctttctccattgtgtatattctttgttacagtgtcaaggtaaaaattagtgtagctactccaaagggtgttttgtaattttaattattgctcattgggactcttcccagttattcaggctgctttccaatgtttcagtggttaggcttctcattttacttgttttttcttttttttactttttataattttactcatattggcattaaaaatacattaagaagttttatattgttaaatagtcctgatgtagatagttttgtcagacttgattttagtagtagttgttaacaggtgatttctaaaagtaaagtgttgaaggtctatatattgtttatagttcttatatttagcatattagtatccctgatttccattaatgctcttattctacacagctttgggaataatggtgtaatacgggtaaagtttcccatatgaatggctttgctttttttagagagacagtgtcttgctctgtcgcccaggctggagtgcattgatgtgatcctagctcactgcagccttgaactccttaatctccctgcctcagcctcccttgtagctaggactacaggtgtataccactgtgctcagctaattaaaaatttttttttagggactggtctcactatgttgcctggctgccatatgaacatctttgatatctatctatcttctgactaggaaaacatttgtgtttaagaactgttttgaaatcactgcggaaatctgttaaaggcataattttgaagtttatctattgttattggaggccttagctgttttggatattcctttgtgtataattctatgtgtgtgatttcatttaggatcaaggtgatgcagacaaggagataatttcaaatacatatagtcaagtactgcaaaagattcattcagaggaaaggctcattgccacagtacaagctaagtacaaggacagtattgaggtttgattgtgctttctcttattgatcttataaattgatgatttgaatttttcagtacttaaatttttctattgttgtttaatactcagtgtcagtaaattgttattactagaattcactgtcaactggaaatggtgatttttgatgatataaatatatcaaattttttattgttttaaatattttattatgtccatgagaaccacaatttttaacatcattttctttttgcctgtatgagtctactgtagataatttgctatatacagaaagataagaaataaaacattgcttataattcccttagcctaagagatagttttagagtatttactcactggatgtgcatctgtatgtttgtgagcatatatatatgcattgcattgttttttaagttacttcaaacatactttcttcatttaatggtatattatgaacatttttctatatgatttttctatactgtcatcttgagtgactaaatcctcatccctatgtagatgtacaacaacattaacctttcatgtgtgttggacattaaggttacttccaatttttcctaccataaataacactgtacatatgtttgtgcataattttttgtttttatttctcagatttctaaattctataattactgagttaaaaggaatggacattattaattaaaacttgatacatattttcaaaccacttttgggaaagatgatttcagtttacatcctcactagaaattcctttttcatccatactaacaatgtgtgttttattgtatgtctcagtttgaaatattacttttgtctttgttactttgagtgctggaactgatattcttctaaatagaaacatggattaaaaaggaaatctattgaattgtcttgttgaaaattatagattttcttggtatttcagtctgaactcagtaaatactagttgaatcttaacagagaaataataaatgatcactgttcaataaatacttttcttatgtgtttgaaaatacgtaacttttgtttacttagtttaaaaagcagcttattgaatatttaaataagagtcccagtgtggatcacttgctatccattaagaagacattgaaaagcttaaaagctctactcagatggaaattggttgaaaagagtaatttggaagaggtaaggaaacagttgtttcttactgatctttatgtgcatctcattttacttggtctctgcttcataaaaataatgcataaatacactctttacaataagagagccattacattcacattttgttttatatactttatcttgttttctgtgtatataaataaaattgagattacagtaatagtgtaaaaattttcctatatcattaaatattctttaaaaacattttcctaggctgccttggttcttagtaacatgaacattttagaataattttaaaagctcttttagtttggactgttagaatgtttattgtaataccaacttgctacatgcaggtgacagggtaccccctcgaaggtagcgttttgtcataaagtatttttaagatcatggtatcttttgttaactccctttttatggatagatgtaatatttcttgcaagtattttaagttgcttttatatgataatagaactggagaggattaggatgccctaatctggactaacttcttcctttaggcttgaaactttgtgaataagatagtaaactttgtgttcctttgaggatttgatttatgtacaaggatctgtattatgccttaatccaatttgaattatctgtcttctacttctgagcactgaattgggggtggagcggaggactattctagaactaatatcatagttgaagaactttctagttttattctattctgggctttggggaagttgatttttttagtctgatttttcaacttttggagaaatctgacttttgttatactttaagttctgggatacatgtgcagaatgtgcaggtttgttacataggtatacacgtgccatggtggtttgctgcacccatcaacccgtcacctacattaggtatttctcctaatgctattcctcccctagacccccaccccctgacaggcccagtgtgtgatgttcccctccctgtgtccatattttctcattgttcacctcatcttatgagtgagaacatgcggtgtttggttttctgttcctgtgttagtttgctgagactgatggtttccagtttcatccttgtccctgcaaagaacacgaactcgtccttttttatagctgcataatattccatggtgtatatgtgccacattttctttatccactcaatcattggtgggcatttgggttggttcgaagtctttgctattgtgaacagtactgcagtaaacctacatgtgcatgtgtctttatagtagaatgatttataatcctttgggtatatacccagtaatggtattgctgggtcaaatggtatttctggttctagatccttcaggaattgccacactgtcttccacaatggttgaactaatttacactcccaccaacagtgtaaaagtattcctatttctccacatcctctccagcatctgtggtttcctgacttgtgtgtgtgtgtgtgagtgtgtgtgtgtgtgtgtgtgtatttgtatgttgcctatgttgttttttttttcattattatactttaagttctacagtacatgtgcacaacgtgcaggtttattacataggtatacatgtgccatgttggtttgctgcacccattaactagtcatttacattaggtatttctcctaatgctgtctctctccctgccaccccccaccccacaacagaccccggggtgtgatggtccccttcctgtgttcaagtgttcccattgttcagttcccacctatgagtgagaacatgtggtgtttggttttctgtccttgtgatagtttgctgagaatgatggcttccagttgcatccatgtccctgcaaaggacatgaaatcatccttttttatggctgcatagtattccatggtgtatatgtgccacatattcttaatccagtctattattgatgggcaactgggtttgttccaagtctttgctattgtgaatagtgccacactaaacatacgtgtgcatgtgtctttatagtagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacatcctccccactgtctgttgtttcctgactttttaatgatcaccattctaactggtatgagatcgtatctcactgtggttttgatttgcatttctctgatgaccagtgatgatgagcattttttcatgtgtctgttggctgcataaatgtcttcttttgagaagtgtctgttcatatcctttgcccactttttgatgggattgtttttttcttgtaaatttgtttaagtcgtggtagattctggatattaaacctttgtcagatgggtagattgcaaaaattttctccattttgtaggttgcctgttcactctgatagtagtttcttttgctgtgcagaagctctttagtttaattagatcccatttgtcaattttgtcttttgttgccattgcttttggtgttttggacatgaagtccttgcccatgcctatgtcctgaatggtattgcctaggttttcttctagagttgttatggttttaggtctaatatttaagtctttaatccaccttgaattaatttttgtataaggtgtaaggaaggtatccagtttcagctttctacatatggctagcccgttttcccaacaccatttattaagtagggaatcctttccccattgctttcccagttttcccaataacatttattaaatagggaatcctttccccattgcttgcttctgtcaggtttgtcaaagatcagatggttgtagatgtgtgacattatttctgaggcctctttgtgttccattggtctgtatatctgttttggcaccagtaccatgctgttttggttactgtagccttgtagtatagttaaagtcaggtagcatgatgcctccagctttgttctttttgcttaggattgtcttggctatctgggctcttttttagttccatatgaaatttaaagtagttttaaaaaaattctgtgcagaaattcagtggtggcttgatgggaatagcattgaatttataaattactttgggcagtatggccattttcatgatgttcattcttcctatccatgagcatgaaaattttttccatttgtttgtgtcctctcttatttcgttgagcagtggtttgtagttctccttgaagaggtccttcacataccttgttagctgtattcctagataccttattccctttgtagcaattgtgaatgggagttcactcatgatttggctctctgtttgcctattattggtgtataggaatgcttgtgatttttgcacattgattttgtatcctgagactttgctgaagttgcttatcagcttaaggagattttgggctgagacgatggggttttctaaatatacaatcatgtcatctgcaaacagagacaatttgacttcctgtcttcttatgtgaataccttttatttctttctcttgcttgattgccctgtccagaacttccaatactgtgttaaataggagtggtgagagtgggcatgcttgtcctggtgacagttgtcaaagggatgcttccagattttcccattcagtatgatattggctgtgggtttgtcataaatggctcttaatattttgagatgcattccatcagtacctagttagttgagaatttttagcaagaagtgtgtcaaattttatcaaaggctttttctgcatctgttgagatagtcgtgtggtttttgtcattggttctgtttatgtgatgcattctgtttacttatttgcatattttgaaccagcgttgcatcccagggatgaagctgacttgattttggtggataagctttttgatgtgctgctgaattcagtttgccagtattttattgaggatttttgcatcaatgttcgtcagggatattggcctgaaattttctttttttttgttgtgtctctgccaggtttttgtacgaggatgatgctggcctcataaaatgagttagggaggattccctctttttctgttgtttggaattgtttcagaaagaatggtactagctcttctttgtacctctggtggaattcacctgtgtatctgtctggtcctggactttttttggttggtaggctattaataactgcctcaatttcagaacttattgttggtctattcagggattcgacttcttcctgatttagtcttgggagggtgtatgtgtccaggaatttttccatttcttctagattttctagtcgatttgcatagaggtgtttattgtattctgtgatagtagcttggatttctgtgggatcagtggtgatatcccctttatcattttttattgtgtctatttgattcttctttattagtctggctagtggtctatctattttgttgatcttttcaaaaaaccaactcctggattcattgatttttttttgaagggtttttcatgtctctatctcctccagttctgccctgatcttagttatttcttgtcttctactagcttttgaattagtttgttcttgcttctgtagctcttctaattgtgatgttagggtgtcgattttagatcttttccgctttcacctgtgggcatttagtgctataaatttccctctaaacactgctttagctgtgtcccagagattctggtacattgtgtctttgttctcattggtttcaaagaacttatttatttctgccttaattttgttaattacccagtagtcattcaggagcaggttgttcaatttccatgtagttgtgtggttttcagagagtttctcaatcttaagttctactttgattgcactgtgatctgagagacttgtttgttatgatttctgttcttttccatttgccaggaagtgttttacttccaactgtgtggtcagttttagaataagtgtgatgtggtgctgaaaagaatgtatattctgttgatttggggtggagagttctgtaggtgtttattaggtccacttggtccagagttgagttcaagtcctgaatatccttgttaattttccatctcattgatctgtctagtctaatactgacagtagggtgttaaagtctcccactattattgtgtgggagtctaattctctttgtaggtctctaagatcttgctttatgaatctgggtgctcctgtattgggtgcatatatatttaagacagttaactcttcttgttgcactgatccctttaccattatgtaatgcccttctttatttttatttttttttatcttcgttggtttaaagtctgttttatcagataccaggattgcaatccctgcttttttttgctttccatctgcttggtaaatcttcctccatccctttattttgagcctatggtgtgtctttgcacgtcagatgggtctcctgaatatagcacaccaatgggtcttgactctttatccaatttgccagtccttgtcttttaattggggcatttcacctgtttacatttcaggtcaatattgttatttgtgaatttgatcctgtcattatgatactaactggttattttgcccattagttgatgtagtttcttcatagtgtcgacggtctttacaatttggtatgtttttgcattggctggaaccagttgttcctttccatatttagtgcttcctttaggagctcttataaggcaggtctgattgtgacaaagtctctcagcatttgcttgtctataaaggattttagttctcctttgcttgtgaagcttagtttggctggatatgaaattctggtctgaaaattcttttctttaagaatgttgaatattggcccccactctcttctggcattgtacagtttctgcagagaaattgctgttagtttgatgggcttccctttgtgagtaacccaacctttctctctggcttcccttaacattttttccttcatttcaaccttggtgaatctgacaattatgtgtcttggggttgctgtttttgaggagtaggtttttggtgttctctgtatttcctgaatttgaatgttgacctgtcctgctaggttggggaagttctcctggataatatgcttaagtgtgttttccaacttggttcccttttccctgtcactttcaggtacaccagtcaaacgtaggtttggtcttttcacatagtcgaatatttcttcaaggctttgttctttttcattttttttctttaatcttgtcttcatgctttatttcattaagttgatcttcaatgtctgatatcctttcttctgcttgattgatttggctattgatacttgtgtatgcttcatgaagttctcatactttgtttttcagctccatgaagtcatttatgttcttctctaaacaggttattctagttagcaattcgtctaaccttttttcaaggttcttagcttccttccattgggttagaacatgctcctttagctcggaggagtttgttattacccaccttctgaagcctacttctgtcaattcatcaaactcattctccatccagttttgttccgttgctggcgaggacttgtgatcctttggaggagaaaagatgttctggtttttgaaattttcaccctttttgtgctggttttttctcatcttcttggatttatctacctttggtctttgatgttggtgacctttggatgtgtttttttttgtgtggacgtcctttttgtttatgctgatgctattcctttctgtttgttagttttccttctaacagtcagtcccctctgctgcaggtttgctggagtttgctggaagtccattgcagaccctgtttgcctgggtatcaccagtggagactgcagaacagcaaagattgctacatgtcccttcctctggaagcttcatcccagaggggcacctgccagatgctagccagagctatcctgtatgaggtgtctgtcgtcccctgctgggaggtgtcttccagtcaggaggatgggggtcagggacccacttgaggaggcagtctgtcccttagcagagctcgagcactgtgctgggagatccgctgctctcttcagagctggcaggcagaaacattaaagtctgctgaagctatgcccacagccgccccttcccccaggtgctctgtcccaggaggatgggagttttatctataagcccctgactggggcttctatctttcattcagagatgccctgcccagaaaggaatctagagaggcggtctggctacagaggctttgctgggctgcggtgagctccgtggagtctgaacttcctggtggctttgtttacactgtgaggggaaaactgcctactcaagcctcagtaatgacagaggcccctcccccaaccaagctggagtgacccaggttgacttcagactgccatgctggcagtgagaatttcaagctagtggatcttagcttgctgggccccatgggggtgggatctgctgagcaggaccacttggctccctggcttcaaccctcttttcaggggagtcaacggttctgtcttgctggcattccaggtgcaaggggggtatgaataaatattccagcagctagctcggtgtctgcccaaacgtctgcccagttttgtgcttgaaacccagggcactggtgatgtatgcatctgagggaatctcctgctctgtgggttgtgaagactgttggaaaagcatagtatctgggccagaatgaaccgttcctgatggcacagtccctcatggcttcccttggctaggagagcgagttccccagccccttgcacttcctgggtgaggtgactccccaccctgcttttgcttgccctctgtaggctgcacccactgtctaactagtcccagtgagataagccgggtacctcagtttgaaatgcagaaatcactcaccttgtctgttgatctcgctgggagctgcagaccggagctgttactatttggccatcttagtatctggatccttgaaatctgacttttaaagtgtaaaccaaactatctgaggcaggtatcaatcaatttagaaagtttgttttgccaaggttaaggatgcatgcctgggaggcaggtctgtgcctttctcagagatgattttgagggcttaaatatttaaaagggaaaggatggatactggggaaagaggaagaaattttaaaaagatgtgagtagataagagacagatggtttgaattctttaatccttgatcacctttcagcaaatacactatttacatttgagagaggggtagaggaatagtcactagctcagtgaatctgcatttttacatcagaggaaggaatcagatatgcatttgtctcagttgagcaaagggatgatgacttagagttctgtcctttgtcctgcacctgagaaaataagccatcaatttaccttgtcagggtaaaattcaacagaactgttttagggtgaagatcctgagacccataaggaatttcctactgagcaaattgtgagagaggtgtgcagggtttttatggttgtagctatcttatttaggaataaaatgagaagctggtttgcctgacacagttcccagcttgactttttcctttggcttagtgatttaaagttcacaagatttattttcctttcacaaaagcatacatactttttaaggtggcttatgtattatcattggagacagttcacacatttactcatccttttgttttgtttttaactaaatatcatgtagaagacaattctagggaattcaggtgtattctggttgctattattaacatttcttttgttcgaatggcagttggccatctttatcttagagaaaatctacagcagatgaagagacaagaaaaatctgtataattgattttatgtctttactttttgtaattcctttttctaggtttcagaaaagtcattgttagaataaattgacctaagttaattcagcaagtattagaagggtcttttatgtgctaggtactgaaggatacatagaaaccacacagagtaatttactatagaacttgaattcttaaaagaagacttgttttctctatgttaataaaaaacactttttctttctgattcaagtcagatgatcctgatggctctcaaattgagaaaataaaagaagaaataactcagctgcgcaataatgtctttcaggaaatttatcatgagagagaggaatatgtaagtatttggttctttgaagttttacattaggttttactctagaaattgaatttaaatacccgttttatgaagtggactgtaatcacaaggctagaggtattatatagaaagtttatatatatattgacctggtaagatttttgtaaatttagaaataaatttcacatgacaaaatattctgaccattgtaccagtgtggaaataactgaaaattgtaaagaaggaaaaacatcacttgtaatatttccactcagtgataatagtagtaatcactgttaacttttgactttcttttagtatttttttgtttgtttttagaattgagattatagcacagacacacttttgcatattgccttttttctgtttaacataaaacctaaagaccttttccttacatcaacgtcattttcccataatgttgcagtgaaaacattaatggagcacataatttagttgaagaatgtaacaaaataagtctacctggttttgggggcaggagaagttacatcttttaagtctctatttttaccactgatttttgtgagcttgggaaaataagtcattgtattttttctttaaaatggaagaatattgtattttatatctgggagatgttaccaggaagaagttagttaagaaacagtgctttgaaagtaaaaatactgaccgggcatggcggctcacacctgtagtcccagcactttgggaggccgaggcgggcggatcacttgagcccgggagtttgagaccagcttgggcacatggtgagaccccatctctacaaaaaatacaacaattagctggtcatggtgtcatgtacctgtagtcccagctgctttggaggctgaggcaggaggattgcttgaacccaggaggttgaggctgcattgagctatgatcatgcctctgcattccagcctgggcaacagagcaagaccctgtctcaaaaaaaaaaaaaaaaaaaaagaaaagaaaagaaagtaataatattaatactgtgaaaacaataggtaagtgtcatgctttctttagcaaattcatctgcgtatatgtaaataccttatggaccttgggttaaaatagcgatcttgcaatgatttgacaagtgtttagaagttttgcttaataaatatgtgataagtggcttttctttcgtgagggtactcaattttcacatttatttcaaagttacttatgtagagctatgtgttttttctcttaggctttaaaaatttttcttaacgaaacagctgttattttaaaatgtcactgtgttcttaatattttgagaaataatgacagttttatgcctcaaattgaaatattatcagacattttcattttagtttggaagtgggtgaggactttgaccttgcaagatttgtgcttatgtatgtatccaaagcttaaaattggtaattaaatttttcttcaattagtaagatggtagtttagatgggttaaaaaaaaaaacttcagccaacttaaatttaaaggagcaatgaacaattcgcaaattgggcagctgaatcacagcatattcggagagactctggggatgctttgtggtcagaacaaattaatagacgaaaaaaggaaagtggctttcagaaattggcagcgaggtacagaaacagctatattggttacagattggtgtttgccttatttgaacacagtttgaacacttagcagtctgtaagtggttgaagtatggcggctgggattggccaagactcagctattgttataggtccacactgctaagttacattttcagtctcgtctgcctgttaagctaggttgcagttcatccacaaggactcaaatatagaagtacggagtccttctcaggccatgtttaatttgctttagcagatgcaaggtgagtcgtggttttcacttgttatttcttgaagtagaaggcaaaatcagtgattatgtatcttactggatatgttataaggtagatgctgatatattttcctgaagagcaacatgtcaaaattgaatatatattgatctacagttaaaaactttttttttttaactttaggagatgctaactagtttggcacagaaatggttccctgagctgcctctgcttcatcctgaaataggattactcaaatacatggtaaactttgtttcccttgcgaattactactcttcagagggtgttgaaaagtgataatattaaatttgtgtcagtgttaaacttatagtatcttttaaataaaaatactcctgatgaatattttatgggtattagaactttttcttatgaccctttaatagttgcatggtatatatttgtatttttatgtaaatttgcattatccgtttttctgctttcctcatcctcattcagtacattgcatgacacttatttgaattataggtgtttactttttgaaatgacaaaataaaattttaactgctatttcaagagttaggataaaaacaagatattgctagccctgagggatttgagcacaatgggttttttaagttaaagcagtctgggaaaaaattctagagaggttggttaaggtagagatgttgaggtgggtatggttttctaggtaggcaggattcaaaagctggagatcagcatattaaataggggccatagggagcaggattagtaaacactggtttactaatctgttagtcctgaatctgttagtcctgcgatttatattgccttctacagtgagggcctagatgaggtatttattcattaagattgtcacgaagtccattataatggcttaaatatggtacagagagggatatttgtgtagacatgtgagtttattctaaaaaatatttaagattaaagttccctaacttaaataattactctaaactctttctagactagactttaaaatgatgtgagttttttcttgcaactatttagcttagtgattaccttatgcagtgtgggcaaataagtatgtactgccacatgggacttgaaaattaatatttaaaaatatgctaatctactttattatggaagattataaaaggtttgactcatggtttattgaagtctttaatggctttctgatgtttaactgtaatgtatgcttaggaattttttgtaggttgattatgtattgtagaatacttaaatgtaccgacaagacttaaaaaaaaaacccagaaaacaattctacaatgcctcttactgaaactgcaccacagtaaaacttagctttgtttaaaatgttgatgatcatattttagtgtgaaaaattattccttttaaaaagtagcagaaatatctagtaaaattagttattgaaagccattttcacttttgaggactccaaacaggggcagaggtgttagaattacttcatggtagtcataatttttggactaatctttcccatttgatacctacatttttgtcattattttaccttatttattttttgtttttttacaaatgtttatttcagtagtttttggggtacaggtgttttgtggttacatggataagttctttagtggtgatttctgagattttagtgcacccatcacctgagtggtgtacactaacccaatatgtagtccctcattcctcacccccgtcccaatcagttgttactttagtattttttaggaaacataagtggtttttcaagtaaacattagggatcctaggatgcatgtctggttgattctagtcatttcctgaatctgttctaaaattatagcagtaattaaatgtatggtgattacactttgggtaggaggagtttaagagccaggaactggagaaagtacacagttttaaagattttaattttgttggtttttccagtacagttgatggtgtccaagtcatttaatatcgtgtaactaattattttgatgatttttaagtgctgggattgtttggattctttaactgtgataaaaacttgtgcctagaactctggtggtctccttacaatgagcttggaacgagatcttcttgatgctgagcccatgaaggaacttagcagcaagcgtcctttggtacgttctgaggttaatgggcagataattctgttaaaggtaagtctaacttcttcttacttgtgggagattcagcagcataaaggatagtggtgctgttacatttcaagaaagaaaaaacctcactgttagttttctaaagtgtataagttgactggcatgataattgtgcttgtagtttggttgccagaactaattttcacttttaaagtttccctcaattgaacaatgagaacacttggacacagggcggggaacatcacccgtgggggcctgtcatggggtggggggcagggggagggatagcattaggagaaatacctaatgtaaatgatgagttaatgggtgcagcaaaccaacatggcacatgtatacatatgtaacaaacctgcacgttgtgcacatgtaccctagaacttaaagtataataataaaaataagtatataaaagtcattaaataaagctttgtctcacaagaaaaaaaaataaagtttccctcatttccctaaatagaatatgtccttaataggatatactttcctttttttttgggtgaacttattatagtcatccaatatctttttaaaattcttgattttcttacatttctccttgaaatctcagctgtgttatcagtacaatcttctactctttaatttcttcttctcattgatctgggaaactgttaatcatgataataagataattaatttggccttagttgctacacattctagaatgtgtagcaggctacaggtagaattgcactttccttttccaaattatagcattcaaagaagatagaaaagtacttataaaattaaaaaataaaattagatttgatttaacttaaaataatgaattatgtttaaattggaatgatgtataattataatgagattttcatcttggaattacgagtgcctctttctttggtacaagggctattctgtggatgttgacacagaagccaaggtgattgagagagcagccacctaccatagagcttggagagaagctgaaggagactcagggttactgccattgatattcctgtttttatgtaaggtaaagttcttatgctaatctcttgcagaaaccattttatcttgcagaaactattttatttaaaataaattttagctccaggttttagagcagcagttcattccccttaacataaaagaaaaattatcccatagaatcaatgtatgctaaaaatatgttgaagaagtttttacttggagtcacattctctgttttgcttcttagtctgatcctatggcttatctgatggtcccatactaccctagggcaaacctgaatgctgttcaagccaacatgcctttaaattcagaagtaagtaaaaagcactatttatttccatggatgtattaaatgagaaaataacacctgatatttattcaggcatactacatgctatgtattttgtaaaattttgactcatggtattctatttgtcacctcaagcctgtgatagaagttatcgtgttatatagatgagaaaaagcgttaaagggattagattaagtgacttgcacagggtccgttagccagaggtagagctgggactcgaaattaagtctttctggttccaaagcccaaacttacaactgctaagctgtgctgtatgtgaactgcctaatatagcacttggtactgtaagtgcttaagtggcagctttaatttttgtcattgtaagtttaggattagtaataacagtaaaggaggccctgattcttcttatggagtaacactgtttcagtctcttatagctactttacatggttggtatttgtaatccaagtcttctttgagatgatagaacaggtgtcctcagaccccaggtcgcagactggtaccagtctgtggcctgttaagaacagggcggcacagcaggaggtgagtggcaggtgagcaagcattactgcctgagctccacttcctgtaagatcagtagaggcattagattctcataggagcataaactctattgtgaactgtgcatgtgagggatctaggttgcgcactccttgtaagaatctaatgcctgtgatctgaggtggaacagtttgatcctgaaaccaaccccctgcatccatggaaaaattgtctttcatgaaaccggtccctggtgcccaaaaggtatgattgtacacacacacacacacacacacacacacacacacacacacaaacacacacaggcacacatggtatcaccattacaaaatcaagccttcatctggtctttctctatgctgtattcttattaatggttcatttcgaggaaactttactcacttctagagcagtcttttaattagagaacagtttcaagattaaaatgatttgcctacttcctcacttcttttatgtgtacttatctataggaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtggtaagatatcatggttttacaaataggttctagactttatttaatattattaagcagtagttcagcacttatatataatataatactttattataggatctttgtcttcagttaaactgtgtcatgtagtataagcaactatttgccctcagctagatgctagaacagcaggagtattgtgtattttaaccataagtcttaggagctacctgacattatatactcaatggcattgacaacattaataattttgtcatcattaggaaacatttaattgctaggaaacatgtaaggaaactaggtggccatctcctaaacctctctccactggtgtccctccgtctatagatacaatttacatatacgtactttgctgttttttgattaataatgtgcatttttagaaaccggggaaccttggactttttagtttaaatcctgattcacctctaatggctgttaattcagtgtcatattacctcagaataggcagtttgtagagatagcaaaatcacacaatttaagagcatgttgtgatttttttgtcgttataatggaaacaattctctattttaattgagaaataaaaattgtatatatttatcatatacaacatgatgttttgaagtatgtatacaatgtggagtggccaaatcagtaattatttttctaaacattacagctttattgagatacaattcacataatgtatacaattcattaatagtttgtagtacattcacaaagtcgtgcagtgataaccagtattgaattccagaacattattaacattcccaaaaagaaaatccatactgattagcagtcactcaaatttcccacttcttctcaagcctggaaactacgaatacactttctgtctctatggatttgcctatttggacatctcatgtaaatggaatgatacaatatgtggccttttatgctaatttcacttagcatagtgttttcagagttcatccacgttattgactgtatcaaaatgtcattcctttttattgccaaattatatttcattgtatggatgcaccacattttgtttatatattcatcagttgctggacatttggttgtttatacttattggttatatgaataatgctgctatgagctttagcatacaatattttttgtgtggacatgttttcatttctcttgggagtggaattactgggttacattgttttactttttgaggagccaaactgttttccaaagtggctacatcattttatattcttcccagtaatgtatagggattttgttttctctacatccttgccaatattttttattatctgagcaattccctttgactagtatatgttataatgcttttatactttggtcatctgcaagtcatagtgtaatgctactggagtatatatagtcttaatggttttgatatggtagctcaaaaagatgagaaaatgaaactgcaactgtaatcaaaagctggattgtacaggatttatacagattgattttctgaaatatttactttattacattagtttaacaaaattaagatatcctaagaaatataactaaattatgaattttgaaagatctcaaccttcaggggttctggttagtttaccttttgagcatactatttgcataattatagatatgactacaataattactctttagtcattcgtcatctgttattattccccaaaacattgtttttaattttcagttaaaaatatttattctgaaatattgatcaaactcaccttttgctacattttccatgcaattttcagattgaagtggttatcaggaagataaatttgaaaagtagtctgaggtcaagatcattgcttttcaggccttatagtgcatacaactcacctggggttcatgttaaaatgcaaattaatattcagcatttctgcagtggatcatctgcatttctaacaagctaccagttaatgctgtagctcctggcccttggaccatactttgagaagcaaggatcaaaatcgtagctagaaaaaagatagcacttagtgacacatgctaggcattgtatctctgtaaggtagacattatttccattttacaaattaattcaggctcaaagaggtttacacctactatgtacccataaaaattaaaaataaattttaaaaatggacaaaaaagaggttaaagccctcggtcccacagcaaataaataggagagtggggaattgtaaccaagatctgcctgaatataggattcatgctattgtcactgatcatctttgacatgttagaaatggtatatttagagaatgatcagtaaggaaggaaagtgctttgtaggatttcagttcttaaatgaattatttagaattttcagaattagaacatggcactgctgctcactcttgtgaaatttattttttaaaaagagtatcaaatgtttaatcacagaataagtggttgttagtattaaatctgttcaagtctacaaagtgaatgtaaaaaaaagtcccatagttaatttattagactgattttaagagcaatttataatagcagaaattggtaaaaatatttgaaagcaagggaatgaaatatttaaaatgaatttgttttttgtattgattaaatgcagagtacttcacagaaagtcacctcaactgtgttgtatctgaaatatgtaaaatattgtttttgcagagtcagcgagcctcggtgaacatgatggttggtgacttgagtttgatgtcacctgagttgaaaatgggaaaacctgcttctccaggttcagacttatatgcttatggctgcctcttattatgggtatgttatttttttgttgaaatagatcatatatatatatatttcagtatataaagtgatgattttatagtgattctccttaaaaataaaaagcagcagacttttagtagaactttaagttttaacaaaaactattgatatgcttcctattacctattgtgtactttctacaaattggcttgatgtatattttaggtatcatgctattgtcttggttctgttgaagtcaagattaacagtgaagatgattttgtcctacattaatctgaaagcagttcatgcatatatggaaaataaatgttaaataagccttgggtatattcctgcttccagtgtagaccaaatagctgtttctcatccatagtttaagaattaagaagttggatggagctggagaccattatcctaagcgaatttactgtggatcagaaagccaaatactgcatgttctcacttataagtgggagctaaacactgagtacatatggacacaaagaagggacactggggtctacttgagggtggaggttgggagaaaggtaaggattgaaaaactacctgttaggtattaggctgattacctgggtgacaaaattatctgtacaccaaactcccatgacacactgtttacccatgtaacaaacctgcacatgtaccccttgaacctaaaataaaagttggaagacaaaaaaataaaaagcttgtttcatgttgtactgctattttacgtagagaatgcctctttttccaaagtcttgagtgtgacaaaaccttatctttgttgatcacataaataaaaataatctccttgttagaaaaacaagagttaagagggattaagtattaagagaaggaagactattcttatcagcccaggggccagcaagcattttctgtaaaggaccagatggtctctgttgcaagtactgagttctgctgctatagcatgaaagcagccatagacagtatgtaaacaaatcagtgtggctcttttccagtagtactttatttatggatattgaaatttgaatttcatgtagtatgcatgtgcatgaaatagtattccttcagtttgctattaaacatttaaaaatgtgaaaactacccttggcttgcagctgtacaaaaacaagtagtggaatcagtttggtgcagaggccatatagtttgctgatctctgttccaatcagtgtaataaggtcaaaaaaagaaataaaagtcatagagtttgaaaatgaagaaataaagctgtctttatttgcagatgacatgcttaattatgtagaaaatctttgagaatgtacataaaagctactagaacaaatgagtttagaaagatagcagttttaatttcaatataattgtgtttttatataagcaacaaataataggaaattaaaatttaaaaatcatttacaaaagtattaaaatatggaatttgtaggggtaaatttagtaaaagatgtgcaagagttgcacactattaaaactacaaagcattgttcagagaaactcaagaagacataaataaatggagcgatacaccatgctcatggactagaagacattgtatggatatcagttgttcttggcttatagattcgatgcaatttcaacaaaattgctggtagattttgcttattttttcagaaattgacaattagattttacaattaatataaaaatggagaggatctgagatagccaaaacaagtttgaaaaagaacaaaattgaaggacccaaactacctgattttatgacttaatagattctaggaaattaagacaatgtaggcctagagtggtggttcaaaactgtaatcccagcacttagggaggctgatgcaggaggattgcttaatgccaggagttgaagactagcctaggcaacacaagtgagcaccccctgtctctacaaaaaatagaaattagctgggtgtaatggcgtgtctgtggttctagctccttggtaggctgagacagaaagattgttggagtccaggagtttaaggctacagtaagctatgactgctccactgcactccagcctaggctacagagcaggaccctgtttctaaaaacacaagtgatactgctgtgaagttagatgtccagatgaatggagcagaatagagacaatataaatagactgcacatgtatgataactggcttttgacaaagatgccaaggcagttctctgggtaaaaggagaatcttcaacaaaaatgatacaggccaactcataccatatgtagagaataaattttgattcatttcttataccatgcacaaaaattagctcaaaatgtgtatcagacctaaatgtaaaacgtgagtctaaaacttatagaagaaaacataggatgaaatatttgactttcgatttggcaaagatttcttaagtaggacacagaaaacatcaactctaaaagaaaaaaatcatttggatttcatcaaaatggaaaaccttgctcttctaaagacattgtcacaaaaatgaaaggcaagctacagactaggagaaaatatttgcaaaacatatatctgacaaaaatattatatccagattatcaagagctcctacaatcaatactaagaagactgcccagttaagaaatgggcaaaatatttgaacaggtactttaccaaagaaggtgtccacatggcatgtaagcatgtgaaagatgctctgaacaccatttgtcattagggaactacagattaaaaccaaaatgagataccactatactactcactataatgtataaaattaaaaagatcgtaccaacggttgcttagatctgttgtacctagaactcatatatattgcccaggggaatgtaaagggaacaaccactttgaaaaacatttggcagtttgttaaaaggttgaacatattcctaccctatgacccagcaattccacttctagatatttagccaagagaaatgaaagcatatgtccacacaaagatttgtatgtaaatattgaaagaatttatgtgtaatagatgaaaactagaaacaactcaaagtccatcaacagatgaatggaaaaacagtctgctatgtatgtgtctatccattggaatactactcaggaataaaacgattgaactataaatataactcagtaagataggtgagtcttaaaataattctgccaagagaaagaagccagatgataaggtttggctgtgtctccacccaaatctcacattgaattgtaatccccatgtttcaagggtggggtcaggtggagataattgaatcatgggggtagtttcccccatgcagttcttgtggaagtaagtctcacaagatctgatgatttcataaggggcattttcccttttgcttggcacttcttgctgcccccatgtgaagaagaatgtgtttacttccccttctgccatgattgtaagtttcctgaggaatccccagtcatgctgaactgtgagtcaattaaacctctttcctttataaattacccagtcttggggatgtcttttattagtggtgtgagaagggaccagtacagtaaattggtacagagagtggaatgctgctgtaaagatacccgaaaatgtggaagcagctttggaactgcgtcatgggcagaggttggagggctcagaagaggacaggaagatgtgggaaagtttggaacttcctagagacttgttgaatggctttgagcaaaatgctgatagtgatatggccagtgaagtccaggttgaggtggtctcacctggagatgagggacttgttggaactagaataaacgcgactcttgatgttttagcaaagagattggtggcattttgcccctgtcctagagattggtgaaactttgagcttgagagagatgatttagagcatctggtggaagaaatttctaagcagcaaagtgttcaagaggtgacttgggtgcttttaaaagcattgttttgtgtaatcacaaagatatggtttggaattggaacttatgtttaaaagggaagcagagcataaaagttaggaaaatttggagcctgatgatgtggtagaaaagaaaacccgtttcctgggagaaactcaagccagctgcaggaatttgcataagtaacaagtagctgaatgttaatcgctaggacaatggggaaagtatctccagggcatgtcagaaagcttcgcagcagcccttcccatcacaggcacagaggcctaggaggaaaaaatggtttcatgggctgggcccacggtccccctgctgtgtgcagccttcagacatggtgccctgtgtcccacctgctccagtcatggctaaaaggggccaaggtacagctcaggccatggctttagagggtgcaagccccaagccttgttagcttccatgtggtttgagcctgaaggtgcacagaagtcaagaatggtggtttgggaacttccacctagatttcagaggatgtatggaaatgcctggatgtccaggcagaagttttctgcaggggtggagcccttatgaagatactctgctaagacagtgcaaaacggaaatgaggggttggggctcccacacagagccccaactggtgtactgcctagtagagctgtgagaagagggccacagtcctccagaccccagaatggtagatccactgacagatcacactgtgtgcctggagaggcaacagacactcaatgccagcccatgaaagcagccagaagcggggctgtagcctgcaaagccactggggcagagctgcccaaggctgtgggagcccactcttgcatcagtgtgacctggatgtgagacatggagtcaaaggagatcattttggagctttaagatttgactgccctgctggattttgaatttgcatgaggcctgtagcccctttgttttggccaatttctcccatttggaacaggtgtatttacccaatgcctgtaccccattgtatcaaggaagtaactaacttgctgttgattttacaggctcataggcagaaggaacttgccttatttcagatgagactttggactgtggacttttgacttaatgcttaaatgagttaaaactttgggggactgttgagaaggcatgattgtttttgaaatgtgaagacatgagatttggaaggggcctggggtggaatgataatggtttagctgtgtccccacccaaatctcaccttgaattttaataattcctgtgtgtcaagggcaggcccaggtggagatatttgaattacggggtggttcccccatactgttctcatgactttagccctatgcctgcatgtatatttaaagttgtctggtttcattgaaccagcaccctcatggaaataaactagcatgattttcatcaatgcttcagtaatctattctttatatcagaagggtgaaagtaaacatatcaagtttttttttttgtttctgggaggactcataagatatcccataagtgtggtaatagcagtttttattccacctatttcctttaaatgatagtaaaaagctccatgagtaaatatattgtctgattttctactcttatgtattgttgattaagtcctttaaaaactttatttttagattaacttgtacaatggacttttttttgtatacattctatgaattttaacacacctatagattagtgtaataaccactgccacagccaggatgcagaacagttccataaccctgaaaattcctgtgtgccatccctttgtagtcacagcctcctcccaacccttaaacgctggcaaccactgaccttttatcactgtgttttgtgcttttaagaatgtctcacacatagcaatatgaaccttaaatgtaaatgggctaaatgccccaattaaaagacacagactggcaaattggataaagaatcaagacccatcagtgtgctgtattcaggagactcatctcacatacaaagacacacataggctcaaaataaagggatggaggaatatttaccaagataatggaaagcaaaaaaaaaagcagggattgcaatcctagtctctgataaaacagaattttaaccaacaaagatcaagaaagtgtaagaagggcattacataatggaaaagggatcaacgcaacaagaagagctaactatcctaaatattatatgcacccaatacaagagcaccaagattcataaagcaagatcttagagacctacaaagagacttagactcccacacaataatagtgggagactttaacaccccaccgtcaatattagacagatcaacgagacagaaaattaacaaggatattcaggacttgaacttagctctggaccaagtggacctaatagacacctacagaactctccaccccaaatcaacagcgtatacattcttttcagcaccacataacacttattcagaaattgaccacattattggaagtaaaacactcctcagcaaatgcaaaagaatggaaatcttaatggtctctcagaccacagtgcaatcaaattagaactcaggattaagaaactaactcaaaactgcacaactacatggaaactgaacaacctgctcctgaatgactactgggtaattaacaaaattaaggcagaaataaataagttctttgaaaccaatgagaacaaagacacaatgtaccagaatctctgggacacagctaaagcagtgtttagagggaaatttatagcactaaatgcccacaggagaaagcgggaaagatctaaaatcgacaccctaacatcacaattaaaagatctacagaagcaagaacaaacaaattcaaaagctagtagaagacaagaaataattaagatcagggcagaactgcaggagctggagacatgaaaaacccttcaaaaaatcaatgaatccaggagctggtttcttgaaaagattaacaaaatagatagaccactagccagactaataaagaagaatcaaatagacacaataaaaaatgataaagcagaaatcaccactgatcccacagaaatccaagctaccgtcacagaatgcaataaacacctctatgcaaatcaactagaaaatctagaagaaatggaaaaattcctggacacatacaccctcccaagactaaatcagcaagaagtcgaatccctgaatagaccaacaataagttctgaaattgaggcagttattaatagcctaccaaccaaaaaaagtccaggaccagacagatacacagtcgaattccaccagaggtacaaagaggagctagtaccattctttctgaaactgttccaaacagtagaaaaagagggaatcctccctaactcattttatgaggccggcatcatcctggtaccaaaacgtgccagagacacaacaaaaaaagaaaatttcaggccaatatccctgatgaacattgatgcaaaaatcctcaataaaatactggcaaactgaattcagcagcacatcaaaaagcttatccacaacaatcaagtcagcttcatccctgggatgcaaggctggttcaacatatgcaaatcagtaaacataatgcatcacataaacagaaccaaaaacaaaaaccacatgattacctcaatagatgcaagaaaaagcctttgataaaattcaacacccttcatgctaaaaactctcaataaactaggtattgatggaatgtatttcaaaataataaaaggtattcatgacacacccacagctaatatcttactgaatgggcaaaaactggaagcattcccttgaaaactggcacaagacagggatgccctctctcaccactcctatttaacatactattgcaagttctgatcagggcaatcaggcaagagaaagaaagggtattcaaataggaagagagacagtcaaagtctgtctgtgtgcagatgacatgattgtatatttagaaaatcccatcatctcagcccaaaatctccttaagctgataagcaacttcagcaaagtctcaggatacaaaatcagtgtgcaaaactcacaaacattcttatacacccgtaacagacaaagagccaaatcatgagtgaactcccattcacaattgctacaaagagagtaagatacttaggaatacagctagcaagggatgtgaaggacctcttcaagaagaattacaaaccactgctcaaggaaataagagaggacacaaaaaaatggaaaacaaattccatgctcatggatagggagaatcagtatcatgaaaagggccatactactcaaagtaatatgtagattcagtgctatccccatcaagccaccattaactttcttcacagaattagaaaaaactactttaaatttcatgtggaaccaaaaagcccgtatagccaagacaatcctaagcagaaagaacaaagctggaggcatcatgctacctgacttcaaactatagtacaaggctacagtaaccaaaatagcatggtaccggtaccaaaatagatatatagaccaatggaacaaaacagaggccacagaagtaatgcctcagaagtatctacaaccatctgatctttgacaaacctgacagaagcaagcaatggggaaaggattccctatttaataaatggtgttgggaaaactggctagccatatgcagaaaactgaaactggaccccttccttacaccgtatacaaaagttaactcaagatgcattaaagacttaagacctaaaaccataaaagccctagaagaaaacctaggtaataccatttaggacataggcatgggcaaagacttcatgactaaaacaccaaaagcactggcaacaaatgccaaaattgacaaatgggatctaattaaactaaagagcttctgcacagcagaagtgaacacatcagagtgaacaggtaacctacagaatgggagaaaatttttgcaatctacccatctgacaaaggtctagtatccataatctacaaagaactgaaacacatttacaaaaagaaaacaaccccatcaaaaagtgggcaaaggatataaaccgacacttctcaaaagaagacatttatgtggccaacaagcatatgaaaaaagctcatcatcactggtcattagagaaatgtaaatcaaaaccacgatgagataccatctcatgccacttagaatggcactctttgaaaagtcaggaaacaacagatgctggagaggatgtggagaaataggaacgctttacattgttggtgggagtgtaaattagttcggccattatggaaaatagtgtagcgattcctcaggcatctagaaccagaaataccatttgacccagcaatcgcattactgggtatatacccaaaggattataaatcattgtactataaagacatgcacacttaagtttattgcagcattgttcacaatagcaaagacttggaaccaacccaaatacccatcagtgatagactggataaagaaaatgtggcacatatacaccatgcaatactgtgcacccttaaaaaaatgatgagttcatatcctttgcagggacatgggtgaaggtggaagccatcattctcagcaaactaacacaggaacagaaaaccaaatacctcatgttctcactcataagtgaacatgttctcactcataagttgaacaatgagaacatatggacacagggaggggaacatcacacagtggggcctgttggggagtgggggtctaggggagggatagcattaggagaaatacctaatgtagattatggtttgatgggtgcagcaaaccaccatggcacatgtatacctatgtagcaagcctgcacgttcttcacgtgtatcccagaacttaaagtatataaaaaaaagaaaaaatagaaaaaaatataaataaaaataatatcatattagtggtatcatacagtatataattttgtgagtctagcttctttcattcagcatgtgaatcatcttttgtgattcattcaagttgtctaatgtagtttttcccttttttgtttctgaatagtgctctgttgtatgtacataccaaatttgtttgttcacctgttgcagaacatttgcattgtttccagtgtctgactattgcagataaagctactgtgaacatgtgtgtataggtttttatgtgaacgtaagtttttgtttctctatggtaattacccaggagtgaaatttctgggtcagattgtaatcgtatgtattattctttaaggacctgccaaactgttttccagagtggctgtactgtttttgattttcacctgcaatttatgaaagtttcagttcagcatcattgtcggcacctcgtattgttattatcttctattttagccattctcataggtgtgtggtagtgtttcattgtggttttaatttctctaatagataatgatgttgagcatcttttagtttgtttattattggctttctgtattttctttggtgaagtgtctgtcttttgcctgttttttaattggatttttgttttattgctgtagagttttgggcattcataaatacattctagatagaagtcctttatcagatgtcatttgcaatgatttttttctggcctgtagcttttctttttattttcttttcagtgtcttttgcagagaaaagggttttaattttgaagtttaatttattattgttttctttttatgtatcatgcttttagtgttgtgtataagaactcttcgcataacccaaagacttgaatattttttcttatattttcttctaaaagctctatagttgtatggtttacatttagagctgagatctctttggatgtaatttttgtgtaaggtgggaggtttatgtcagggttcatgtttttgcatatggatgtccaattttacaacaccatttttttaagagagtgttattctctgttgaattgtctttgtatctttgtcagaaataaatcggccatttttgtgtgagtctgtttgtggactctttctgctgttgatctgtgtgtctatccgtttaccaacatcatactgtcttggttactgtatctttatagtatgtcttaaaattgggtagtatgattctttttcagattttagctattcagctatctttccttttttgtatatattttattttatattttacatcttaccttattttattttattgagacgtgtaaggtcagccgagagaaaggaaaaatagacctaaagtcaggcgcgtaagtttattgaacctgaggggctgcttcacctcactcagaggaggcagccctgagtttacaaaatgaggggtttatattggagaagggagtttgagggagttctttggtgtggccgcattccagggttgtttgctggttaattttgtcacatatcaccttgtgacatttgtggtagcagaactttcaggaaggtgtaggtaaagtttgtttattcttccaacgacctcccgctgtgcggtccagatggttcgtaattggggtttgtttatccagcaaggtctgataagtgaagtctgctggcttcactgtggtgcctagataagggcttagaaatgtaaagaggcttgggggaagggtggacagcacggagacgtttgaggggagcgccaagaagctttatggggcagtttgtctttaagacgcagtctcactctgtcacccaggctggagtgtactggcacaatcttggctcactgcaacctctgcctcccgggttcaaatgattcttgtgcctcagcctcccgaggagctgggattataggcacccgccaccacactcggctaatttttgtatttttagtagagatgaggtttcactatgttgaccaggctggtctcgaactcctgacctcaagtgatccacctgccttggcctctcaaagtgctgggattacaggagtgagccactgcgcctggctgcttttccatgtatattttacaaacagcttgtctgtgtgcacaaaagccctgctgtgattttgattggaattgcattaaatctgtagatcaatatggggagaattgacatctttactacattgagcctttaatttgtgaactccatttatttaaattttctctggtttcttttatcaacgttttgttattttgggcttacagattctatacatgtgttgttagatttatacctaagaatttcatgtttggaagctattgtgttttttaaaaatttttgttttctagttggtcaagttcttttttacaacagtatttttttgatagtaaagttagtttggtacgaaaggctgtgtatactttgaccttcctcctcaaagaattgggcaatttattatgaaagcacatagtgtaaaatatataaaagggcaaaaagtcaagatccaagggctgtgcttaaaaaggtaatattcagagttaaactggaagcattatcaaaagattttatttacaaggccatgaagggattactgtcactttgtctttaaaaaaattttagaaatagcaataataaaaaagtaatagtttgatagcaaagctctagaatactaactagatattttgggcatatcaaagatactgtggttttagatcatttttcttatgagatccagattaaatgaagtgttctgaagactgcctacagaaaattcaaaacaatggacaattcaagtgttgtgggttattaccttcagtaataaaccatatctttttttaaacgtttaaattaggtttgggggtacatatgcaggtttgttatatagataaactcgtgccacaggggcttgttgtacagattattttgtcacccagatactaagcctagtacccaatagttattttttctgcccctctccttcctcctaccctctgcccttaagtaggccccgtgtctgttgttcccttctttgtgttcatgagttctcaacatttagtgagaacacagagtatttggttttctatatcttttaactgaaatacatggactatagttttatcatgacaccatttgtattaaggttcttcactatatttttaggttattatggaaatcttaaaggtgttttctagaagccagtttttaaaaagtataacagttctgtctgatgttacattgaaaaagaattgtgtttctgtgtgtgttgaggagtactgctgtgaagaagttgaatataaagaagagaatggccccctttctttgtttatttttatttatttatttatttttaagagatggggtctcactatattgctcaggctggtctcaaactcctgagctcaagcgatcttcccacctcgatctcccaaagtgctgggattacaggcatgaactaccacgtctgtcccccttttatttattcagagacacattttcagtgttgctttccctaaaatgcattttttcctgctttatttttctgttaccatattatacacttatttatctttattattgtctgcttctaccactcgagtggaagctttttgggagtagcttatctatcttgtttgccactatatcctcaaatgcctagaactgtgcctggtgcaaagtgggcactcaaatattagttgaatgaatgtttaaattttagccacagttatatgctgaagtattaggctttaaaaaatagttccatgtttttttcctgagttcatttacttacctctcatttatggccccatgtacatcattttattctttaaaaccttgcatgaagattttattccgactcttaatatatttctaggagatgttagtggtcatactgatcacccagtgaacctaactttgcatttctggaccttcttaataacgtgagacccaaacctttatgtaatttcagtcacttccccaaaccaggattttgtgaatctctacaattgttatttttcaaaagtaatagagtccaatccattatatttttctcctaacaggatttcctgtcctctcatttactgtgtctgctaatcttaaatctccagtgggtttatttactgtctctcttttcttccagtttatcagcagccttctagcttttttctttatttactcattcttggaccctatcatacaattcccagactatgccttatattcccatttactcctgttcttctgtttagtctttttggaaaaaactcaattttagataagctatggcctgccatttgtgagtaaaacattctttctcatttctctctctctcttttttttttttgagacggagtcttgctctgtcgcccaggctagggtgcagtggtgtgatctcggctcactgcaacctctgcctcctaggttcaagcgattctcctgtctcagcctcctgagtagctgggattacaggcgcacgctgccatgcctggctaattttttgtgttttagtagagatggggtttcaccatcttgctcaggctggtctcgaactcctgagcacaggcagtccacctgcctcggcctcccaaagtgttaggattacaggcgtgagccaccacgcccagccccatttctcctttttaaaaagttttatttctatgcgtcaataacttttttaaaggcattacattttatttctttaacagagtgtgaccaaacatatttgtttttattttttatttttttattttttggagatggagttttgctctgtcacctgggctggagtgcagtggcactatacagctcattgcagcctcaatctgttgggctcaagtgatcctcctgccttagccccctgagtagctgggactacaggttgtatcaccactcttgactcatttttgaattttttttgtaaagatggggtttcaccatgttgcccagcttggtctcaaactcctgggctcaagcaatttgtccacctttgtctgccaacatggtgggactacaggcatgagccactgtgcccagcccatatttgttaatttaaggacattattatgtctctttataacatggtggtaacatcctcccttggtgagagcacatagaacatgtttggaactaactgctttagaaagttttatctcattacaccctcctaacaagcatgtgagggagtatgttattatccaaagtatagatatgagaattttgtgtgtcagagaggaagtacctgagtgatgccccatttcagaattttagtgtctcgaggctccatgcaagaccaccttctgccttcacatcacatattattaagcctggaaggcagtcttcactgaagccaatgatgaacaactgatgaagggaacccagggctgggaaataagttaccagtaaatgtcatggcattgaccactatgaagtcccttgtatcatattattccccttttaggcatctttaggcttgtctcctatgtgctgtttttttaagaagttctctgcttacaaagtcttgcgtggatgtatttaatacttttgtttggaatacaggtacacttttcacacgtgatacctggttttcatgtgtaatccaaaaataagagacaatgggaaagttatgttccatatgctgtcctttcttgaggaccagctcacgtgacttgtgataagctctcccaccttctctgaaccttagcagtgcctctcaggaatatgctaactaagataaatggagagaaaggaacatgggtagcagccccttaaaatctagaggttttatgattctaacatcataatgaagcagactggggaatagaactcattattgtagaattgaatgtaggaggattaagagatacaggttgggccgggcgcggtggctcacgccagtaatcccagcattttgggaggccgaggcgggtggatcacgaggtcaggagatagagaccatcctggttaacatggtgaaaccccgtctctactaaaagtacaaaaaatcagccgggcgtgttggctggcacctgtagtcccagctactggggaggctgaggcaggagaatggtgtgaacccgggaggcggagcttgcagtgagcagagatcacgccactgcactccagcctgggtgacagagcaagactccgtctcagaaaaaaaaaaaaaaaaaaaaagagagatacaggatggacggactcactaatctctttagtacccttccctgtacaggaatttcgtgtattaatatttctgaaactgctttgagagccaatcaagaaccttagactggtcattcctgtcttatcagatccaaatgcagagaacttggaggaggttcacctttcaaggtttttgtttttgttttttaagatagtctatttacccatatttttattcttattctttttaaaatttctaatgtttcagcatttctccttttatcatttttatcctaataacttcttttggccattctttcaaggtaagtctactggtgacaaatttttagtgtcctttatctgagagcatcttgatgtcacctttatttctgaagaatattttcactgggaatagaattctggattggtagttctttttcttttagcatttggaaaagattgtgctactttctttaggtgtccatggtttctgatgagaaattcactgtcatttgaatcatttcctttataggtaatattacatttctctctaaccagtttcaagatttttgttttctttagttttaagtttattatggtatgtagtggcatgtgtttctttaagtttattctgtttgaggttttctcagcttcttcagcctgtgggcttatgtttttcaacaaatgtgggaagttcagcaattatttactcaaatgcattttagccccccaccctttctcctctttttctaggactctgattatacaaattttctgtcttttattgtctcacaggttcttggggctctgtttatcagggtgtttttttttgtaatgatggttgttcaaatgggttattttctattttttcatcttcagattcattagtgctttcctgtcatatttattctatcattcagtccacctaatgagttttaacatttttgattactgtttttctgttataaaatttccaattgattcttttttatatcttctgtcttctgtttctttgctttctattttaaaaatttaagtgtgtttgtaattgctctatgcagcatttttatgatggccgttttaaaatccttctcagataatcacaacatctgttctatttggtgtccggtggttgtctttttctcagtcaagttgagattattctggttcttgatataaagtgattttttattgtaccctaaacatttgggttattatgttgtgagactatgaatcctttttaatatatatatatatatatattttttgtaggcagccaccctgtttaggtatagtatgcagttccagatggggttagatatgtagttccccactgggctctgctgacatcaccccagcaaaagtggaatgcccagttgtactgccttacttctccttgctgctgacagatgggagtgtaaattcagcactttattgagttcttttgacaccgggagaccaggaggagcaaagtgttagctataactgtttcaccaccaccttattccaccttcttgtgccttgttgctacctggtgagagtggaagttttactccccagtgggtcctgccaacaccgtggggagtgggcaatgaaaaactgaatgctgactcgtactacttcacactgctttgtttcactttttttggctgctgggtgggagtggaagtaagccctgttctgagtcccactgacagtatcccagactgtagagtgacagctagtgctgtttctcactgctgtcttctgcctctgttgatgggtggaagtagaagttcagttccctgtttggcttcatggataccatgctagtggaggaagcaaagggatgacttcccatgacttgttgctgctgggtagggctgaaagtccagctcctcactcagcactactaatactacggatgggatagggggcagtttttcgtttggtgtgtgactggaatagggtatattacctattacagttttctgttctgctaggccaccctcttcccagtcctgtggctacaggaagcaggcttttcttggagcttttgtgtgtgtgtgtgtgtgtgtgtgtgtgcctgtgtctgttggcatttctgggtggcagacttctcaaggaccccatcagagatataggggggcaaaaagaaagcccagggaactcaccattatattgttcctcaagtggcaaggtcctagctacttcaccttcttctttccatcttttagggttttcctgtgttgtattatagctagagttgtttgttttttttaagaggaaaggttgatgtgaaatgtgactactccttggctggaaccccttgcatgctcttgtaccttgggagctgaatgctgttgcactgcattactttaattgagcccttggtgctttcttttggttctttgacctcctcacagccacctcattctcacattcctctcaacaattattttaaaccttttcatcaattctccacttaaatcctatcctcattcttctcagatgatcttacttcttattttactgaaaaacttgagatcatgttatgtgcttttcatcaaatttgagcacttacaaattacagtcatccctcagtatacacagggaattggtttcgggacccccacatatgccaaaatctgcgcaaagtcccactgtgagtattgtggaacctgctaatacgaaaagtggaccttttatatatgcaggctttatgtcttattaatagtgtatttttccatccatgtttggttgaaaaaaatctgcatgttagtgggccaacacagttcaaatctacattgttcaagggactacattatctgtttacccagtcttctatctttgcctcctatttcagagaattaaagtgctccttccccagtgcaagtaattcagtaccgtaacatacaatatggggttgtaaccttggagcggtaggctacatgtatagcctaggtgtgtggtaggatatatcatctaggtttgtgtaagtacatttgttatgatgttcacacaaggatgaaattgcctcatgatgcatttctgagaatatattcctgttatgtattcctgctgttaaacagcacgactgttgttttgtcagttactgagagttgaagtccctggctataattgtagacttgcctatttctcctttcaactctatcttgtggtttaaggtcatcttgtataatatgtacatatttaggattgttatgtcctcttagtagattgatacttttatcattatgtaatatccttctttttctgtagtaattttctttgctctaatgtctactttgtctgatattacagccattcttgtgtttcaacattaatgtttgcatggtatatcttctgccatccgtttactccaaaggtacctacattgttgaatttggagtaagtttcttgtaaataacatatagttgcattgttttttatttactcttgctgatctctgtcttttaattggggtttttaggccatttacatttagggtaattattgatattttagggcttaaatctaccattgtattactggttttgtttgtttcttgtttctttttctttttttcccttcctgtgcattacttgaaaaaattttctaccattgtattactggttttgtttgtttcttgtttctttttctttttttcccttcctgtgcattacttgaaaaaattttaagagtccatctttttatatatatatatatataatatatataatagatataaaatatataaattatatatataaaaatatataatatatataaaatagatattatatataaaatagatatatataaaatagatatatataaaatagatatatataaaatagatatatataatatataatatataaatatatattatatataaatatataaatatgtatatatatttgtatataaatatgtataaatatatatttgtatataaatatgtataaatatatattatatataaatatgtataatatatatttatatataaatatacataaaatatatgtatatatgtgtgtgtgtatatacacacacacacacacacacacctacatgatgtcttattttttttaaacaacacctgtactccagataaatatggtcaaaataaatgaaaaactcaagatgacattattcccatttgtctaaaggccgggtgttgtgtagatgataagcacctgccatttatgatgacaggtgatagatccaaagtaattgccagatttgttaatttttttccatttctaaatcatccataaagaaaatcacatatagggtcacatcatccttacagtagtttagcagagcaactgtgccatctagattgatgttttcaccagtaaaggactggtagtttttgaaattagcaagtatgtgcttgatttgttctgcagcttctgccataaaaggttttactctttctggtcttcattcttcaagtttgcctttgattgatttaatgtaatctttcatatacatcttgtaggcttcttttatgaagccagcttgctgcaagtgatggttcatgacaatatcaataccagtgattactgtgctttcagtaccttcacccttgggtccttcagtagaggcatttccaccaatgagcaagtcatcaatattaccctatgtcttactgaccatcttcctctccccctccaggcacagcctgtttgcagtatctcagatcttgtaattgtcagagataatcatgatggtggctggaggtagatgatagcagtgctcgcttatagcagaagcctggagcttggagcaagtatggtgcagttggaaaggcactccagggaataggaagcatccagaaaagtatattgtgtttttgagtgtattgcctcttacagttttcctagtggttggtttgggtattacaatatacatatgtggcttattacattctagtgatgtcagcatttcaccattttgagtgaagtatagaaacctcacttcctttgaggttcctttattctccccacttttaaatatcattgtcttgagtatcagatggtggtgtaattttggtttggatcatcatatatgattagaaaactcatgatgagaaggatagtctgtggtattagtcatatttctgtttttttccattgttatttcttccttcctgatgctccaagactcctttaaaaaattattttctttttgtttgaagtacttcctttagccactctttaagattgtgtctagtgacaaattcctttcgttttcccttatttgagaacatcttgatttcactttcattactgatggatagttttactggacatagaatttgtggtggttgagagttattttcttttaaaagttgaaaaatgtgctacttccttcggtctccataatttcatatgataaacgtttatcatacaaggtagtatttcttataggtagtgttttatttctctgtggttgctttcaagattttttctttgtctttagttttcccaaacatcttttttcattcctttcctttttttttttttttttaagatttttttctatttggggtttgcacatcttctttaatcttcttcaaaatttgggaacttttcaaccattattttcttaaacttttttttattaaatttctctagatttagggagaacaagtgcagttttgttacacaggtatattgtttaatggtgaagtctgggcttttagtgtaattttgaacagtgtacattgtactcattaagtaatttctcataccccacccctttcccaccctcccaccttttcgaatcttcagtgacttttattcgacattctgtgtccatatgcacattttatttagctcctacttataagtgagaaaatgcagtattgggctttctgattttgagttgtttcacttaagataatggcttccgattccatccatgttgctgcaaaagatatgattttattcttttttattgctgaatattctgttgtatgcatgtgtgtgtacatatgtatgtatgtgtatatgtgtactcacacacatacatacacaccaccgtttctttactcactcatctgtagtcactattttaaaatactcctttagccccattatttttttccttttcttctgagactctgaaagttggatcttttgttattgtctcacaggtccttgaggctctctgttcttttttttttttttttttttgtctgttttctctctgatcaggctgagcagattgtattgatctgttctgaagttcactgattttgtcttctgtcatttctgtcatttcaatttatcccatccagttttaagatttcggttattgtactttgtagttctgtaactttcatgtgattctttttaataacttttttctttgctgaaatttctttttatttaccttagagaaattataattgtttgttgaagcattttatgaccattgcttgaaagttcttgtcagataattatgtgattcattgtggtgttgattgcagtttctcgttgaagttgtggttttcctggtactttgtatgacaagtgatttttaattttatcttggacattttggatactattttaatagattctgggtcctactgaaaattttattttagcaggcagtcaccttgtttaggtttaaacagaggtcctggactactttttgaactgtggttttaacgacaatctaattttcagaaacttttcagttatattttgatctgcttgagttgttgcgtgctgctgggcctccagtggtccctgctgatggtgtttgagggaatgaaaggaacttttcaaggctgaactgcctggtgcttctaagtatgggaatggagaccctggtctatgggatgaagcttcttgagctgggtgctagttgtggcaggatctctcctttcctatgaccgatgcagaatacctccagaaccatcccttgttatggtgggatccccctacttatgggtgtcagagtgtatttactggaccagctgcttgtggtgtggttttcctttgttggtgcctgtggcctcgttggtgtctcaggtggtgctgctgctgaggatggtgaatgcttcccctggctgcttattgacagggaggtttccagttgaaccttcttgctgtttcttctggcctcacatggtggtgttgatggcaatcctattaaattcaagagaagaatgaatctacctgggctgctttctgttgcaggcttaggagttgggaaacatcagatctggctcacttatttttttttttttttcagttgggagggttataagacaacctgttactatgttgttcctctagtcctggggtcttcaactagtttttcttccttttttaaacctttcagtgttttcctttggttatattttatggtattttcaggttttataattgtacttaatggagaggaacaggaagagaccaaaagcccttttgctcattttttaattgcaatgggtggaacttatttggatctggatttaaataaactaaaaaagtaaactaatttgatatgagattactcaaattttgaaagctaggtattttgtataaaagtatttttcctataatgatatgattgtgtaaaaataaaagactgtctcttagagatatgtactaagatatttataggtgaaattatgaaatacataggatttgcctcaaagataatatatatgcgtttgttcatagggtaagagtggtcattggctgatggttgttagggctaggggatgaatatgtgggactcagaatacctttgtgtatgtaaaaaattctccatgtttttaaattaaatttaattaatttattttttgcatccccctgatttctgaagtttttttttaagtttagcttatatttcttgaacaaagtttagatattatggtagaaagaaacttgcctgatttattttctttgtacctaatttttgagtattggtgaggctaacataatataggctaccaagttctaacacgttttcttataaggtgaggaaatattaaagtgtttatagtgtgtacatcccctctgatcggtactttaggagccccaggaaccatttggttgcttgtaattagaatgaaagtgcttttaccctgtaagagagttaatgtgctttctttaagtaagctcttttctagtcaccaggatctgaagttccagagttgactcttctatagattggcgtattaatacattggacatttattcattcttactttctttcacagctttctgttcaaaatcaggagtttgagataaataaagatggaatccccaaagtggatcagtttcatctggtatgtgacctttttgacatttactggtttgaaacacatgcagtaatataaacttagatatctgactgaaagttgtcctccagtttttctaagaatccaaattaacatttgcaataaatgaagtattgaaaaaaattcaggtgccctacttaacaccacttaattaatacaccagggttactctgctgggttgtttgtcacacagattatataaataatctaacaattagggaagaatattgtttactatgtgtttcaagatcatattatagtaaaataatgttttattataacttagttttttgtaagtacctaactatatctttgtcattcacatatgtattcagccaacatattttgagtagctatttctgtgataggaattgaaccaggtgctaggattacaaggattgtggcattgagaatgaaatgaataatttagaaatgtgaacaagtaagtgattaacatctataagttgagtaattagcaagtactttgggggtactccatttaccctgatttgattattacacatcatatgcttgtattaaaatatctcatgtacttcataagtatgcccataaagatttaaaaataatgaagcccctaaaaaaagtacttggggggaagctgatttttagttctgcaaagaaagggggaattcagtatgactagatataaagaggataaatatggcagtaaatgagtctataagagtataatgatcagactctggaagttcttagctattttgagttaagattacaatgaaagagtacatataattttgttaaactcagtagttccttatttgaccacacaaatattgtataataccttctaatgtcccacgaaatcattttaaaaaaacataccttagaaatgatattaaggagctttgccacacttcttgggtagcagtaaaaagcatttcagacaacttttgtgagattataaaactttgtgttacacttcctgattatctctgtggaaggggataacaaagaaggttgactatggtttacagttttgaaaaggctatgataaaaatttattgctattagatagaaaaataccagaaattctgtattagaggttacaacttcaccaaaagtgcacatccagaacccttgctttcaggtttgatagaaaaattaccttgtaccaagttatcctgaaatttagtttaaacttaaaacttatattacagtttcgtgagtcaggaatctggacacagcttatttgggatttctgcttcagttaatttaaggttgcagttaagatgttggctgggctacagtcatcttaaagctcgattggagatgaatatgcctctaacctcacatgtttgttcataggattctgtttctttcagtttattagaatgaggacctcagttgttctctagttgttggccagaggttgccctcaatcctttgccctgtttccatcatggcagcgtgtttcattgaaatgtatacgcagagaaggcagtagactctgttcactaagacagaagtcacagtttttcatagcaaaatcatataagtgatatcccatagtttttgatagtattctctctaaagcaattctctaggtccaagaggaaagaattatgtaaagttatgaataacagaaggttggggtcttggggcaatcttagaagtctgcttactctaaaatgtaatctggccaggcatggtggctcacgcctgtaatcccagcactttgggaggccgaggtgggcagatcaactgaggtcagaagttcaggaccagcctgcccaacatggtgaaaccctgtctgtactaaaaatacaaaaaaattagctggatgtgctggcgggtgcctgtagtcccagctacttgggaatctgaggcaggagaatcacttgaacctgggaggcagaggttgcagtgagccgagattgtgccattgcactccagcctgggcgacagaacaagactttgtctcaaaaaaaaaaaaataataataataatctgcctgtaatctgcaagtaatcatgccttgctaggcatgcagctaggtatatgtataatgaaagtaaatgtaaatacacagtccccgtttaatgtgggtagctactcatggattcaaggattgtggcattgaaaatgagattaataatttagaaatttgaacaagtaagcaagatttataaattgagtaataagcaagttcaaattataaaaatcttggcttgtatagtatttgcttctgtgatctgagtcagttattagtgctgggaatggaattacctttacctacattttgtgttcacacatagctgcaaaacaagtcaaggctctgtagtcagcaccttacagataccataccacaaatggagaagaatataaatgtatggaaccatgtagttgagagagttattagaggataattaatacacccttctcatccttcagaatccctccaataatatccccaagagatggccttcagcctctgcttaagtagagtaatgctgattttggtagtttgtgtctaaaagttggtccattccatttaagttatctagcttgttggcatacagttgtacatattttctttataattatttttatttctctaagttcagtagtgtcccctttttcatttcagattctggcagtttcagtcttctctcttttttttcttcgttagtccaaataagtttaaatacctagcttttggttttattaatttttctgtattgtttttctgttgtctattttcttactttctaatctttattatttctatccttctgcttgctttagatttagtttacaacatatattacacagttatcacaccttataaaattaacaaattgtaatattatatttaaatttccctaattgtcttaaatatatttttaaatggttgcttttttgaaattagcatatcaacaagatctacctgtattgggttaatatatctcttaatctctgttgagctataaagttcccccacaactctttttctccatgccatgtattatgtgaaaaaaatgatttcattttccatactttggagttggctgattgcatccttatggtattatttcatagttctcttttccccagttgaaaaaagtggtagatacagaggttaattaaatttacattcagtttttacaggcagtatattttatattattgtgtcatatgagggggatcatttggtgtttgattgtcacagtaagattgatcagtgtgttcaggcagaaaattttgtatgtacaggggtatatttttagtttttctatcccattggtttgtttattcatatcccagtgcctcactcatttaactaaaatagactttatagtagctttttaatacttatagggctagttccttcttcactgcttttttgttttgttaaaaaaaaaaacaacaaaaagcaacaaaaaaataaagtccgaagtcccaggttggagtgcagtggcacgatctcagctcactgcagcctctgcctcccaggttcaagtgattctcgtgcctcagcctcccgagtagctggtactacagtcacatgccaccacacctggctaatttttgtatttttagtagagatggggttttgccattttggccaggttggtcttgaactcttgacctcaagtgatccacctgcctcagcctcccaaagttctgggattacaggtgtgagccactgctggccctcattgctatttttaaaatcagctttcatggctattcttggttgtcattcttctaagacatctttataattaacttgtttggtctcaaggaaaaaaattatatttttattggattaatataaactttttaagtcaacttagggaaaattgtcccatttgttatgagagtcatttttgttgaagaccataataagacttttgttcctgatctacttttgtggttttcaggagcatgtgttattttttctcatttggattttgtaatatttaattgtttgcacctagggaaggtaactatctttaaatgttcttaaaaacatattctgtagagtacagacattggcattcattcatttatcaaatatttactgaatgtctgctatattcagatactgttttttgctactttctggagatgaagtgacaaactaaaatttcaaatcttaaggatcttagagtgtaatgcagacactagcagtaaacagatgatttctttcctttttttttttttttgagacagtcttgcttggttgccaaggctgaagtgcaggggcacgatctcagccactgcaacctctgcctcccaggttcaagcgattctcctgcctcagcagcttgagtagctgggattactggcatgcgccaccatgcccagctaatttttgtatttttggttgagacagagttttgccatgttggccaggctgatcttaaactcctggcctcaatgatccacttgccttggcctcccaaagtgcctgcctgaccagcagttaaacagattatttttattcagtctgatatgtgctttggttggagtaatcataagaggcaaataaaaggtatactaaggtgtcaaataatggaatagcaacattacaggatcatttacatgttctaatacaaataatgtcctttgaaatggagggatataataaattctagctcccataatgatggtgataatgatagcagcagtagaggtgatcctagagagtgatcacttaaaaaccaaaaccagaaatagttgactagatgaagaaatttacccttccagacagagaagcttcagtgtgacattttaatagtgtcaaattctgaccagtaccttgttaaaagagggagaaggaagtaataaaatttatttgttcgtatttcacttgtttttgagagatttcagctatgatttttttccttttacactttttccccataattcaattccattgtttcagtattggaggcattccatttcaccaaaaagtacagtcgtccctctgtatacacaggggattggtacagataaaatctacgcatacccaagtcctacagttggcccagtggaacctatgcatatgaaaaatcagccctttgtatctgtgggtgttgagtcctgagaatactgtgtttttgatctgtttggttgcagatgtggaaactgcagatagggagtgctgactgtacttacttatttcatattgatacataatatttgtacatatttatggggtatatgtgatattttgtaacttgtatggaatgtgttaatgacagtcggtatttagggtatccattatcttatttattatttctatgttttgggaacatatcaagtcctctcttctggctattttgaaatatttaatacattgttaactggagtcatcctactctgctatcaatcactagtacttatttcttctgtcaacctggttgtttgtacccattaaacaactctcttcacccccttccacctcacccacattctcttagtctctggtatctgtcattcaactctacctctatgagatcaactgttatagctccgacatatgagtgagaacatttgatatttgtctttctgtgcctggcttatttcactttacagaatgactgttccatccttgttgctgaaaatgacagaatttaattccttttttatggttgaacagtattccacattttctttatatttctttaatagtgttccacattgtctttttccatttgtccattgatggacgcttaggttggagtccttacctttgtaattgtgaatagtgctgcagtaaacatgggggtgcaggtttcatatactgatttcctttttattttgatgaatatcaaatattttgacacttaggttgagtccttacctttgtaattgtgaatagtgctgcaataaacatggggatgcaggtttcatatactgatttcctttttattttgataactatcaagtagtgggattactggattgtatgatagttccatttttagttttttggaaaatatttgtactattttccatagtggctatactaatttacatttccactaacaatgtataacagtttcctgttctccacatctttgtggagatttttcaaaatagtatttggctattttttgtcattttttaaaatagtggcattctagctgatgtaaaatgatacttcattgtggttttgatttgcatttctctgatgattagtgatgttgagcatttttcatatacttattggtcatttgtatgccttcttttgagaaatgtctatttatgtcctttgcccactttttaatggaattgttttccctgtcgagtttcttgtatattctggatattagtcctgtgttggatgaatagtttgcaaatttttccttcaattcaacaaattgtctcttacactctgttgattatttcctttgctgtgcagaagcattttagttaagtatagtcccatttgtctctttttgtttttgttgcctgtgcttttgaggtcttagccataaaaatctttgcctaggccaatgtcatgaagtgtttcccttatgttttcttctagtatttttatagtcttgggttttacatttaagtctttaatcaatcttgaattgatttttatatatggtgagaggtgagggtctactcttactcttttgcgtatggctatccagttttcccagcaccatttattgaagtgggtgtcttttccccagtatatgttcttggtgcctttgtgggaaattggttggctgtttatttctggggtttcaattctattctataggtgcatatatctatttctatactaataaaacgctgtgttggttactatagccttgtaagatattttgaagtcagtgtgatgcctccacctttgttctttttgctgataactgttttgactatttgtgctcttttttagttctacatgaaatttaggatttttttctatttatgtgaaaaattacattgctattttgatagggattgctttgaatctgtagatttctttgggtagtatgggcattttaacaatactaatcttctgatccaggagcatggagtgtctttccatttgttagtgtccttttcagtttctttcatcagtgttttgtagctttctttgtagatatcttccacctctctgtttaaatttcttcctaggtaatatatttattttgtagctgttgtaaatgggattactttcttgatgtctttcttagctagttcattattggtttatagaaatgctactgatttttacatgttgattctatatcctgcgatttactatattaatcagatctaaaagctttttggtggagtctttaggtttttctagatagaagattatgtcatctgcaaagagggacagtttgactttttctttttctttttttattattattatactttaagttttaggatacatgtgcacaacgtgcaggtttgttacatatgtacacatgtgccatgttggtgtgctgcacccattaactcgtcatttagcattaggtgtatctcctaatgctgtccctcccaccaccccacaacagtccccggtatgtgatgttccccttcctgtgtccatgtgttctcattgttcagttcccacctgtgagtgagaatatgtggtgttcggttttttgtccttgcgatagtttgctgagaatgatggtttccagcttcatccatgtccctacaaaggacatgaactcatccttttttatggctgcatagtattccatggtgtatatgtgccacattttcttaatccagcctatcattgttggacatttgggttggtttcaagtctttgctattgtgaatagtgccgcaataaacgtatgtgtgcatgtgtctttatagcagcatgatttataatcatttgggtatatacccagtaatgggatggctgggtcaaatggtatttctagttctagatccctgaggaattgccacaccgacttccacaatggttgaactagtttacagtcccaccaacagtgtaaaagtgttcctgtttctccacatcatctccagcacctgttgtttcctgactttttaatgatcaccattctaactggtgtgagatggtatctcattgtggttttgatttgcatttctctgatggccagtgatgatgagcattttttcatgtgttttttggctgcataaatgtcttcttttgagaagtgtctgttcatatccttcatccactttttgatggggttgtttgtttttttcttgtaaatttgtttgagttcattgtagattctggatattagccctttgtcagatgagtaggttgcaaaaattttctcccattttgtaggttgcttgttcactctgatggtggtttcttttgctgtgcagaagctctttagtttaattagatcccatttgtcaattttgacttttgttgccattgcttttggtgttttagacatgaagtccttgtccatgcctatgtcctgaatggtattgcctagttattcttctagggtttttatagttttaggtctaacatgtaagtctttaatccatcttgaattaatttttgtataaggtgtaaggaagggatccagtttcagctttctatatacggctagccagtggtcccagcaccatttattaaatagggaatcctttccccattgcttgtttttgtcaggtttgtcaaagatcaggtagttgtaggtgtgtggtattatttctgaggcctctgttctgttccattggtctatgtctctgttttggtaccagtatcatgctattttggttactgtagccttgtagtatagtttgaagtcaggtagcgtgatgcctccagctttgttcttttggcttaggattgacttggcaatgcgggctctttgttggttccatatgaactttaaagtagttttttccaattctgtgaagaaagtcattggtagctcgatggggatggcattgaatctataaattaccttgggcagtatggccattttctcgatattgattcttcctacccatgagcatggaatgttcttccatttctttgtatcctcttttacttcattgagcagtggtttgtagttctccttggagaggtccttcacatcccttgtaagttggattcttaggtattttattctctttgaagcaattgtgaatgggagttcactgatgatttgactctctgtttgtttgttattggtgtataagaatgcttgtgatttttgcacattgattttgtatcctgagactttgctgaagttgcttatcagcttaaggagattttgggctgagatgatggggttttctagatatacaatcatgtcatctgcaaacagggacaattggacttcctcttttcctaattgaatgccctttcttccttctcctgcctgattgccctggccagaacttccaacactatgttgaataggagtggtgagagagggcatccctgtcttgtgccagttttcaaagggaatgcttccagtttttgtacattcagtatgatattggctgtgggtttgtcatagatacctcttattattttaagatacatcccatcaatacctaatttattgagagtctttagcatgaagcgttgttgaattttgtcaaaggccttttctgcatctattgagataatcatgtggtttttgtctttggttctgtttatatgctggattacgtttattgattttcatatgttgaaccagccttgcatcccagggatgaagcccacttgatcatggtgggtaagctttttgatgtgttgctggattcggtttgccagtattttattgaggatttttgcatcaatgttcatcaagaatattggtctaaaattgtcttttttggttgtgtctctgcccggctttggtatcaggatgatgctggcctcataaaatgagttagggaggattccctctttttctattgattggaatagtttcagaaggaatggtaccagctcctccttttacctctggtagaatttagctgtgaatccatctggtcctggactttttttggttggtaagctgttaattattgcctcaatttcagagcctgttattggtctattcagagattcaacttcttcctggcttagtcttgggagtgtgtatgtgtcgaggaattcaaccatttcttctagattttctagtttatttgcgtagaggtgtttatagtattctctgatggtagtttgtatttctgtgggatcactggtgatatcccctttgtcattttttattgcatctatttgattcttctctcttttcttctttattagtcttgctagcagtttatcaattttgttgatcttttcaaaaaaccagctcctggattcattgattttttgaagggttttttgtgtctatatgtacttcagttctgctctaatcttagttatttcttgccttctgctagcttttgaaggtgtttgctcttgctcctctagttcttttaattgtgatgttagggtgtcaattttagatctttcctgctttctcttatgggcatttagtgctatacatttccctctacacactgctttgaatgtgtcccagagattctggtatgttgtgtctttgttctcgttggtttcaaagaacatctttatttctgccttcatttcgttatgtgctcagtagtcattcaggagcaggttgttcagtttccatgtagttgagtggttttgagtgagtttcttaatcctgagttctagttcattgcactgtggtctgagagacagtttgttataatttatgttcttttacatttgctgaggagagctttacttccaagtatgtggtcaattttggaataggtgtggtgtggtgctgaaaagaatgtatattctgttgatttggggtggagagttctgtagatgtctattaggtcctcttggtgcagagctgagttcaattcctggatatccttgttaactttctgtcttgttggtctgcctaatgttgacagtggggtgttaaagtctcccattattattgtgtgggagcctaagtctctttgtaggtcactcaggacttgctttatgaatctgggtcctcctgtattgggtgcatatatatttaggatagttagttcttcttgttgaattgatccctttaacattatgtaatggccttctttgtctcttttgatctttgttggtttaaagtctgttttatctgagactaggattgcaacccctgcctttttttgttttccatttgcttggcagatcttcctccatccctttattttgagcctatgtgtgtctctgcacgtgagatgggtttcctgaatacagcacactgatgggtcttgactctttatccagtttgccagtctgtgccttttaattgaagcatttagcccatttacatttaagattaatattgttatgtgtgaatttgatcctgtcattatgatgttagctggttattttgcttgttagttgatgcagtttcttcctagccttgatggtctttacaatttggcatgtttttgcagtggctggtacctgttgttccatgtttagtgcttccttcacgagctcttttagggcaggtctggtggtgacaaaatctctcagcatttgcttgtctgtaaagtattttatttctccttcatttatgaagcttagtttggctggatatgaaattctgggttgaaaattcttttctttaagaatgttgaatattggcccccactctcttctggcttgtagagtttctgctgagagattcactgttagtctgatgggcttccctttgtgggttacccgacctttctaaactctggctgccgttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatgctgaagagtgttttccaacttggttccattctcttcgtcactttgaggtacaccaattagacgtagatttggtcttttcacgtagtcccatatttcttggaggctttgttcatttctttttattcttttttctctaaacttctcttcacacttcatttcattcatttcatcttccgtcactgataccctttcttccagttgatcgcgtcggttactgagtcttgtgcattcgtcatgtatttctcgtgccatggttttcagctccatgaggtcctttaaggacttctctgcattggttattctagttatccatttgtcttatttttttcaaagtttttaacttctttgccattggttcgaacttcctcctttagcttggagtagtttgatcttctgaagccttcctctctcaactcgtcaaagtcattctctgtccagctttgttcagttgctggtgaggagctgcgttcctttgtcggaggagaggctctgatttttagagtttccggtttttctgctctgttttttccccatctttgtggttttatctacctttggtctttgatgatggtgacgtacagatgggtttttggtgtggatgtcctttctgtttgttagttttccttctaacagtcaggaccctctgctgcaggtctgttgtagtttactggaggtccactccagaccctgtttgtctaggtatcagcagtggtggctgcagaacagtggatactggtgaaccacaaatgctgctgcctgatcgttcctctgggagttttgtctcagaggagtacccggctgtgtgaggtgtcagtccacccgtactggggggtgcctcccagttaggctactcgggagtcagggacccacttgaggaggcagtctgcctgttctcagatctccagctgtgtgctgggagaaccactactctcttcaaagctgtcagacagggacacttaagtctgcagaggttattgctgtcttttgtttgtctgtgccctgcccccagaggtggagcctacagaggcagggaggcctctttgagctgtggtgggctccacccagtttgagcttcccagccactttgtttacctactcaagcctgagcaatggcaggcacccctcccccagcctcgctgccgccttgcagtttgatctgagattgctgtgctagcaatgagcgaggctccttgggcgtaggaccttccgagccatgtgccggatataatctcctggtgtgccgtttgttaagcccattggaaaagcgcagtattagggtgggagtgacccgattttccaggtgccatctgtcgcccctttctttgactaggaaagggaattccctgaccccttgcgcttcccgggtgaggcgatgcctcgccctgcttcagctcacgcatggtgcgctgcacccactgtcctgcacccactgtccggcactccccagtgagatgaacccgttacctcagttggaaatgcagaaatcacccgtcttctgcgtcgctcacgctgggagctgtagactggagctgttcctattcggccatcttggctccaccccctgacttgttctttttcaatttggattccttttatttttcttgcctgattgttctgactaggacttccaggactgtgttgaagagaagtggtgaaagtggagatccttgtcttgttccagttctttagaggaatgtttttctttttctttctttttttttgtttttctttttttttgagatggagtttcgttcgtgttgcccagctggagtgcagtggcgtgatctcagcgcgctgcaacctccacctcctgggttcaagcagttctcttgcctcagccttgccaagtagctgggattacaggcgcccgccatgatgcccagcaaattttttttttttttgtattttttagtagagacgaggtttcactgtgttggtcaggctgatcttgaactcctgacctcacgtgatgtgcccacctcggcctcccaaagtgatgggattacaggcgtgagccactgtgtctcactagaggattgcttttcttttccccatttagtaatgatgttagctgtggctttgttacagataggctttattttgttgaggtgtgttacttatatacctagtttgttgagagcttttatcataaagggatgttttaatctatgaaatactttttctgtgtctattgagatcgtttgccatatggtttttgctctttgttcagttgatgtgatggatcatgtcgctgatttgggtgtgttgaaccatcctagcatccctgggataaatgctaattaatcatggtgtattatgtttttgatgtgctgttggattcggattggtagtattttgttgaaaaattttgcatctgtgttcatcagggatactggtctatagttttttgttgttgttgtgtccttgtctggttttggtatcaaggtaatggtgggctgggccttgtagaacaagttagggagaattctcgcctcttgaacctttgcagtagtttgaggataattgatgttagttctttgaaagttcagtagaattcagcagtgaagctctgtggtcctggacttttctatgttgggagactttctcttactgaccaaatcccgttacttgttactggtctgttcatgttttctatttcttactgattcaaacctggtaggttgtatgtgtccaggaatttatatatttcctctaggttttccagttgttcatgtatagttattcataatagtctttatgttttgtatttttttgtttgtttgttttgagacagagtctccctctgttgcccaggctggagtacagtggtgcaatcttggctcactgcaagctccgcctcccgggttcatgccattctcctgcctcagccttccacgtagctgggactacaggcgcccgccacaacgcctagctaattttatgttttgtatttttgtgatatcaggcatagtgtcttctttttcatttctgattgtgtttattgcagcttttttaaagttttagtacagctagcagtttattgattttgtttatcttttaaaaaaattttttttgtggatcctttgtattttttttagtgtatttcacttagttctgctcccatcgttattcttcgttttctactaatatgtatcaggttgtttatttgtaatcttactccttttttgatagaagaatttattgctataaacttctcttttctcactgcttttgctatatctcatcagttttgttatgttgctttgattttcaattgttctaagacattttcttattccctctttaacttcttccttgaaccagtgattgctcgaagacattttctaattccctctttaatttcttccttgacccagtggtcattcagcagcacgttgtttaatttccatgttgtgtgtgtgtgtgtgtgtgtgtgtgtgtgtgtgtgttgtttttgagctgggggtctcactctgttgcccaggctggagtgcagtggtgtgatctcatctcactgcaacttctgcctcatgggtacaagcaattctcctgcctcagcctcttgagtagctgagattataggtgtctgccaccacactcatctaatgtttgtatttttagtagagacgaggtttcaccatgtcagccaggctggtctcaaactcctgaccttaagtgatccacctgcctccacctcccaaagagctgggattataggcatgagccaccgtgcctggccaatttccatgcgtttgtatagttttcagtttctcttgttgatttttagttttccattgtggtctgagatgatactggatatgattttaattttaaaacattttttgagctttgttttgtggcttaagatatggtcgtttcctatagaatgttccatatgcttatgagaagtatgtgtattctgttgctgttgggtaaagtgttctgtaaatatctgttaggttaatttggtttttaagtgcagtgtaaaatcagtttttttaaaattaattttctctctagattatctgtctagtggtgagagttgggtggagtctgtttctccctttagatctaataatatttgatttatatatctgggtgctctgttgttggatccatgtatatgtttagaattgttacattctcttgctgaattgatccctttattattatataatgaccttctttgtcactttttgctctttttgacttaaagtctgtcttacctgatacaagtatagttacacctgcttgcttttggtttccttttgtatggaacatcttttcccatctttttgcagcatacaattgggtcatttaaaaaaaagaaaaactcctttcaaccagtctatatcttttaggtggaaagtttaactggtttacattcaaggctgtcattgatacatgcatgagggttaatttctgtcattgtattaattgattctggttgttttgtgtatcttttgtttcttattttctctcttattcattgtggtttggtggttttctgtcgtggtaacacttgaattatttcttttatttgtgtgtttgttttaccagtggagtttatatgtgttttgtaatggtagatattgttctttcacttccaagtatacaactctcttagtagagacggggtttcactgtgttggccaggctagtcttgaactcctgaccgcaggtgacctcaggtgattccccccaccacggcctcccaaagtgctgggattacaggcataagccactgtgcccagccagatgatctatttgcagtgtgattatcggctcattattttggtgtttttttttgttgaggggagtaccagatacctcgtcagtcatcttgaaacccctccttcctgactgtatttattgaaaaaataagtccacttccttcttcattacagatttgtccttttgttcctttgttttgtaacacctgtttttccttgcaggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttggtttggttaatacacagaaatatctagaaatgttctgggactagttgagttgtatctttagtattcaggttgtgaaaaataaagatgtttggctatgcacaa

SEQ ID NO: 733 - DNA, 122187 bp, Homo sapiens; identical to SEQ ID NO: 732

SEQ ID NO: 734 - DNA, 122346 bp, Homo sapiens; identical to SEQ ID NO: 730

SEQ ID NO: 735 - DNA, 522925 bp, Homo sapiens
tgtgtgtgtgtgcgagggtgtgtgtgtgtgtttgtgtgtgtgtgcatatgtggggggtgtgagtgtgtgtgtgcgaggaagcgggggtgcgtgcgcgtgtgagtgcgtgtgtgagtgtctgtgtgtgtgtctgtgtgtgtgtgtgagtgagtgaattccagattttctgtctttccaaaacccgctcctgtcctctcgcatatcactcacagacggggatctgacagcagccacaaacctacagtgagtgatcgctctccccccggcacgaatccgccatagagatcggcgaggaggaggaggaggaggaggaagaaaagaaggaggaggtggaggaggaggtggaggaggaggaggaggagggaaagaggagaaggaagaagaagaaaaagaagaaacccactaccttcccaggattgccttttttttttccttatctttacgcgcgagtgtgcctgtggcgcgtgtgcgcccctcgtcccttccatccgaacccgggcttggatgtttaataaagaaatcaagtgtctcaacagtcaccaaaaaaaaaaaaaaccgcaaaaacaaaaccaaaaaaattccaaaagcaaaaacaaaaaagagagaggaaaaaaaattcaaaataaacaaacaaacaaacaaggcagaaccaacctctacttcaaagcagccggcacaagccacccgtgtctgccacccagagaggggggtctctggcccgtggtggaggagttgcaggggggatcgtcagggggacagaggccgagtgacgtcctaggagccaccgggcaagaggcggaggagacccagagaggccagagagacagcgggccccagcgcgcggctcggggctggggcgccagaagtgggactggagcgaagtagaggatgccgaggagaaaacagcaggcacccaagcgggcggcaggtaagagaaacggctccgcttcggggctgccctgtgcgccgagctcctcgcccgccctccttgcccctgggtgcccgggggcaccacccacttaagctttcgggggagtttgcgccgggtgcccttctaataaccccgtcctctctcgccttctctggtctcccaaatcctccccttccaagctccggttgggttggggtgagctatcccaccaagcctttcctccttaaactttctttcctccaccctctaccccacccctaactttcttccagtctgtttcttgcctctcgggccaaagtcggattgaggatttggggtgcggagtagggagacagcccctccacccctgcatccctctgcgtggtcagtgccagtggcttttggcctccagggatagcgtctcctctcactggggcttggggcgctgaagtgtgaggcatacctaacactcgggctgcaggcaggctttggggccagcaataggagtttagcgttgatcaccaaggtggacaaaatgcccccaggaaatggatgactctttgcatatattttctaaaaggatccatatttggaaatgtaattaacaatttccctattctttaaaaaaaccaaaaagggttgtaggggggaaattccccatagaaatttaaacagctctggattttctttgcctagagagttgcaaactttgtgaaatgattcgtactgtaaaaactatcccatctgaatccttactgccccctaaaaaagataagaacaggttaatggatcagtacaatagaccttctaaagtttttttttcttttgggttgcttaattgcttttttaatagtatgctggggttttgtttctcggaaatgtaatatgaaagttcatttttcttctgccagacccacccactgaaaaatcagctttccacttgattgctagttttgatttgacatttgattgatcacctgtcatctcgctgcctttgatctattcattcttgatatatatcaataaatcactcaccatggtaactcagagtgccagtgacgcaaaccttgccctctatattcagagccagacatgcacaattattatcttgtttggcttttaatgtgggcgtttttatttctttgtgtcctttagttgaatcagggctttcgcaaaaagcttaagtttagttgttttttcctctctctctgtctttaccctcttgatttaggcaacattaggtaagactggtcttctgcagacccacctccacatttcattctgttccaactctagcaaaacatagggagaagtttggtggaacactttcataaactttgcaaagtcacccttagaacaaatccaaagttagttaggaatctgaggagagtgggcatcccttgtctgaatgtgttgaaccaccaagctcatcctccttcctcgcctgagtgtttcaaaatatccacaattatcattccttctgagcacagaattgcttccctatttgtaagttggttcaagtggcatgcagaaatattgataaagcgtggattcatatattttctgatcgtttccctaaaagcaaaataattaaaatatttttagtgaggtacgtatttggaacttgcctcatcagtgaggttttcttttttcaactctagttacttctttggaaaacaatgtctctttcctaccgttgtctctttctgcatttaactcactgatttcctaaaacttaggctgctttgcaatctgacagcgtgtggatgtgttcaatggcctttgagacccaggaacagtgagcctgctgcatctagttctggcaacataagtttaagtgtagctacattattagagataacgtccttattgttgtcccgaaagagaaccctgggctacggtccagcaagaagtgatactgccctgaaaattactctttttttttttctggttgttccggtaaagactatcaacaactaggcagtaatttaaattaccagaatgactggacatgtctcctttagtaagctcattacaaaaagtgcattgctcagaattgctcgactttgattataattatcctacgatcgataaggatccaggtgtacgtaacataacactgtatcacattatttaaatcaggtccttttcattaagctgtgtctgttggtgctggctagtttattggtgtgtgtgggtgtgtgggggtgtgtgtgtgtgtgtgttagaaacttgtaactatagtttcagttttctggcctattatattcctactgtctttgtatgtttgttttgtatgattcttattattttcaccagaagcggaaaccctttttaagctgaaaaaggatgattcatttcgtacacagtgagggccctcttaccttatttatttgctcacatattaatagaggagacagtttttcatgcagtgtttcttctgttcatctaaggtcatcaatgccctactctatttcagctgaagtggttattcacaagtaaagttagccactttggggttctgtagtcagttaacatccagggaaggggagaaggtgggttctaagattatggccatactaacttttatcactgcttaaaattaaacacaatgcacaactgtaagtaattacacccaaggactgatgttgaaagcttgatttctagcttgattaatgaataatgggagatagaaaaagcctgtgagtggatccgagctgaggctctcccggagcgctctttttcccaagaactgttccaggcaatttgattcctttgtattattagttataagttccatgtttcaaggaatcaattacagaactttctactaaagcaggtatctaaacagaataaacaagatgatattgtaagtgatgaggaattttagtctttatttgttatgttcctcccccttcagggggaagggatgtgaggggacaattctctttaaggaaacagctaaatcagagtatttccctctgaaatgtcattcttcctggctttcttaagctatgctattccaccatactattacttagggcaagaaaaaaaaagttgagaaagcagcctacagtaccccaggggtttgtgttgtgtgtgcatgcttgcttccttggatgtatatttcactcaccattaaaatacatccactattacctgaaaatattgcaggattcagtaccagcattttccccttctatgcatttcaagggagatagagaaaatggcaggaaagtaaaacagaacggtgttttgatttgtttgcattttgcaggatgcagagtggttaaaaatttaaaattgtagacttagaatctaactcttgattttctacagcctatctcagcctctgtgcgcgcacataaataatacgtattttatttcaccatactgaactgcttttatattaatgacagccaattgcaatagaacacacaatcttttgtgagcacatcttgtgaatatatcttttatatatgtaagttataggattctgcccctgcccacccaaagcaattagatgtttccctcttgctgactcttaaaggctttctgatcacccagatctgaagagtcttgcaagaaagaacagctccctcaatttattttgtttatttaatatggagatgaataatgcagattttgttttcatgaatgtccttgtgtggcagtaaacattagactattagcaatcattacttaaaagttgcaatttgcaccttaataacacaggttatttacatgggaaacatagtcaacagggacaactctgaacactgcaacagagcagaaatgacctcagagatctcttttccacctcttgatagtgatgactctgaattaaccggtgaggtcccagaaatctcaaccaacaggatggagggagggggcaggcagctcagggcgaagtttacctttaatttactgtcaagtgggacagctttcaagagactaggaatcgggtagatttgggacccttcctccctcactttgtttaaacatccttcagaaagacaagttcacatcttgaatatttaaatatctcacgcgatggattccttcacttgcccaaaagtatgtttttaacaaatgaatggaaaaatacacacacacacacacacacacacacacacacacacacacacacacacgcatggacacaataaagtccaaagggtcttagcagcacaaactcttttggccattcttgttacttaaggcagatatctgaaaaaggaaggatagattccttgaaatcgcttggtccacacaacattttggacggaaattgattgcttaagtggtccttttcccacccccgtcttgatttccttcttccacctctcacctcacccttaaagactcagactgaataggacatctcaaaagcccatttgttttaggcatttattgatttcatttttaatctgccatatcaggacacaatacgttaaccctaatcagcagattacaagtgacagagagtttagtggaaactctgtaagggagcaggggctccgggaaacttcttgacaatgaaaatcttctctgaggcttaagagtttggatgctgaagattacttttggggaggggagaaacattcctcagaaacagtctacatttttttcttccactttacatttctttatctcccagttgcccattctactgctacactttgggaatgcttaacacccaagaaatacctcccaagtatttttaggaggtcggtccctgaagcagcttgacttttgtcatagtctccaacggacgtttatgctttcatttcatcccagctgatttctcattcatttgacggaatttctccaaaggataatacctgagttgatctgtttcttttcccagggccttgggaattgtgctgtccattgaatgggttttggtcatgggggtgggggcacagactgagcctggcattttttaaagccattgaaatgatgcctcactgttcatcactgcagctgagcttatcaagtcaaccaagaagaaaacctaggccctggtcacgtttgtgctatgcctgtaattagctgacacgaggtaaatgtccaaagtcgaccttcccttccatcactgtatttatactatcaattttatttgggaatgtcatggtctgggaagactcagccactatttcgaaggcaatgcctgcttctacctaggtcccctttaaaaaaacacagaaattgccgaacaaattctatattaagaccaggcatacacggagtatcattttcgtttgatgcaaagtcagttggaaatacatttaactaacagttaaatagtgtcttgcatcgcttccctgaagcagtggtttttcattacatatttaattacaatcaaactgaacgacttttattaaaaaaatcacagtggtattaaaagaagcctggcgcacaaataattttattgcttcacaagttgagaacgcttttatatttttatttctttgagagaaatttattttaattttctaatgttgtgataaatacagactatcttttactgtagtctgtaatcagggagagcttatccttctatctttatagagtctgcttaccccagaataggtttttacattcatttttcagtaatttgtaacaattggtatttttaattttttttttaagttttacaagttctatttaaagttagaaattctcacattccttagggtgatctttggcaagcagctcttcgattataggaggaagttagtcattctaaccacataagaaagtggagagtacttgcttgcttacctgaatattacagtaagaaaaaaacaccatctatttacatgcctctaacatgtaacactattttcactggatttataatttcttttttttttcctcctactgacctttcattcacttgttttgggaactttttctgagaagaacgtttagagatagcatttaaagtggatttcaagatacatcagattttaagacattgtaataaaaattagagacttcagagcccaacggttcactgctagtctaggtctgcaaactaatgagaaagcacctctgcaaacacatagtttcaactttaacttgcacatgaatggggagcgtctccagcagtgtggccgtatccatattgctcattttgtccgagaaattattttgtccaagggtatcagactgaggtccgttcaaagacattatatacatacacagagacacagaagagaaatctgagatgcgagtgggaattgctgatatatttgtttccaaagcaaactccatgaatgaaatgattcaataatttggaggcatttgaaagtcattaaaatggccatttggaattttcagttgttgcctccctcaattttttacgtttcccctgtagaaaaagacatcctctgggcaccctcaaatattctgggatgctaaagtcatgctaaaattatttacaattttagaaattaaaattcaggaggcacagcaagataatccgattattaatatatcagtattatttagctatgcataacaacaggaaaacgcacaatgcaaaagttttagagataatgagcttagagaaattacatggggggaagaaatacctggatcatatttgaaagcatttgtcttgaattctgctcatctaaatgagagctctctttctacctgtgtcatttaaaaaacaatttcaatatcctcctacctgctaccccagcctgaagcagggactaatgaaactctctctggacacacagatgtaagacactatattacacaacactttttaaaaaattgtttcagaaaaccaaatgtgggcatgcaaaccaaaagaaaaacctcaaggatcttcgtaagatagctagctcagggttcaagatcaagagaactttgttgcggcaggataagaagacaacagcattgcgttttagctaaacatctcttcttggcaaatgagaagcggtgaagcagggaagatttttttaaggagctttttagctcttttgcatctctctccaaagactaatttaattgaaaagctgtagtgtccatttatgattaaggaaaggcctcatgtttccacaacactgctagacactaaggtgggtttgaagaaaaaaaaaaaaaggccagcattctgcagtttctgttagtataaaaattaagatcactggtcttaattacttgagtgctttcagaactgaaggaatactctaaaatcacccctgagctttcttcttaaagccacatctaagccatttctatggaaattatatagtttagatattaaggtgggtagaatacagttattgcttttaatgaaaatagttacgaagggcagaatgagataaaaacagagttggcagcagccattctatttgtaatgaatttgaaagaaacttccgtaatgctttactggatcatgaaaaacccatgaaaccttgtgacatgggagatacaaaaatgagacagagggtcaaggtcttctataggggaaaaatggcttgtgtaagtgagagcagtggcatataaatatctctatataaactgcacagggcttactttaaatcacttcaatttatcagatccttggaattttttttatgtatttaggagcctctcttttataccccagagagatatgaatagcttctgggccaagatgatgctgtagagaagagtcaaatctattctatgtgcacggtgccatttggtacagaagaaatgccaaaatgaaaagccataaatgcgttttatatcagaattgcctttggctattttcctttattagaaagttgggtacactgctgagtgcttcttcttgttttcccccttgggattagatttgagactgtggatggaacagcggagtaagggcaagtgacttgggttctggttgcagccttgccccacgctagttatttagccccgggcaagctctagagataaaccttactctccgggtaagaatgtgagtttttggagtcagactgattgaagttcaagtctctaggtctaattcttattcggccgcgtaaacttgggcaggctgctcaaatctctgccctccactttctaatctataaaatgggggcaatcatatgttccaggtgtgtggaaaggattgtgtcagaggagggctgagaaagtgtgctgaaactgttaggcaccacagggatacgagggaatagtgtgtctttaccctgaataaccagactatggaaaatttatattaactgggaaacaagcaacttaccagttatcacagaacaaggggtccagggcttgaaagaaaccagatatggatggattttgatttgtaagcctggaaacacaatggctaagcagtgttttagcctcttctcctgaggcagactcattctgggctgtttggagtccagcacccgctcaaaaaagagtttctttcccaagaaatagaatttatagcaccaccaacaacggtaacaatggtaacaatgatatctgccactaaacaagtgctttttacataccacgtgctttatatgtttacatttattcgtttacacggcagttatttcttgagttcctactatgtgtcagatgctgttctactacctggacctggaggtgaataggatggggatgatccctggggatcttgccctccaattgggggaagctagagaatatacaaagaaatttataaaggaaaagataatttcagtatagaaaaaaagcttcatgatggcaatagctttataaaagcaaaattatgagagcaggagttgggacaacagagatgtagatggtcaggggagacctctcagaggaggggacatctgggctaagtcctgttccttataactttcaagtataatccctgttttactgatgagaatctgagtaagttgcaggataactcattcaagttcgtgcggtagccaagctgagttttaaactcagctcttcctgcttccaaagtccatgcatttaatttattatgatcgtttatctagaatagtcatagcgagttgccaggaaggacccaaggaagaaccctcagtcttattattctccccctgtgtctattgtgatgtctaaagctatggggttaattgagagcctagacggaggatgctgcctttagcggcatctccagatagaatcttcaggccaactcctgtcatctgaagttgtctctttatgggatgttctttcatatgtccgtacatgcattcatttgttcaacaaatattggctgtgcatctattatgtgccaggtattgttctaggtgctgtaaaaataacagtagacaagaatagagatgcccctgccctcacacagctaatattcttgtgggctagcctaaaaagctaacaaacaaataaatatataacacaatattgaatagtcctaattgcatttcataagaataaatctggcttcatgaggtagagtatgatggagggttgccatgttatatagagtggtcaggggagctatttctccagtggtgatttgatcagacctgaaaaaaaagtgagagactagccaagcacagggctgggagaagcagtccaggcagaggaaggaggaaatgccaaaggcctaaggaggtgatgtgatctgattggttattagttgaacataggtcctgtttgtatttcaaaagtgatgatggacttgggcatgtttgctctctccgtctacttacccagcccctagtgatggtgagtaggatgcttaggatgatagaggtggcagctggagataaaaacacattcccagccttcatagagagattggtgctgtgatggatgacatggcgaggctgtggaaaggcattgttaagagtcaagccgacctggggtccaactgcagccagctgtgcactcagaagcaagtttcctcacctcattgcacctcagcgttttcatctgtcagatggggataagaattttgctcacctcacattttacttgtgataattagattatgtgacacatataaaactcttggtgcgggcccagtatttacatgggttcttcctcacaaatgaatgttttttattcttgcacttaattgtgttttcttttctgcaggaattctgagagaaatctaggcacctgagttagtccttggcaccgtttaggcagtaaccaaatatttcctgatgaatgaataaatgaaactgtaaagaaatgaatgctttcattcatatattgctttgtatactaattaattactttcaagtataaggatctctttcataggtctaaaacttttagcagacctctggaccaattgcaaatcctagctgttcttagaatatgtttcaaatgagaaaatattaatgaccaaaagacgatgattttcgtctgaatcttgtattttgcgcatcgtgacatcacgtgccttcgactgaagagcagtgatatccctttgtgcggtaaatattgtgcattcatcttctagacagtgcttgctgagaacatggatggaggggaaggagtggagggtcctcatttctgaccctgaggttcagcctctccctgcgcgctctccaagtggtgctccgagccccccaggacctggcaactctgtccctcccccacggggaacccgcgctcatcccctcaggccccaggcggcgaagcttaggggttgttaagctaatgggaataggctacgggctgtttcctggtaacgccttcttcactttttaattgtcacctccagataagtgcctgagagcaggaagaagggaagctggctggctgcctgttaagatgtatcttaggacaaagagatttgggatcctggagagcacgggggagattctgctgcctgccttaggacctttatgaacaagcgtgatgttgggagggcggctgtggctgtgtaccaggtgctgtaggaggcgctggaactggagccttgcatccgaatgacaaagtgcctgccttcccggagcttacattgagtgcggaggacagaccagggactagccagcagacagtcccatgtgtcagggtctggtgtttgcagagggtgtttgcaggggtagagcatgacaggaagtggctgttttggataagacgatcaggaaaggtacccgtctgcggaagtgatactgggtctggagtgaagcggttggaagaaaactgcacctctctggaggaagacagtgccaggcacagctgaaaatccggggctagagctactgggaggaacaggaggagcagctgggaaactgggtggccggagcagacggggagggtgagcagggagggtaaagataagcaagcaaggggctggggctgtcaccgaggtggggtgcctcggagggtgcaggagcagagtcaggatctgacttaggtttgataggctcctctggctgtcctgcgatttatcagggacccaggttgcgagcaggccgaccactcaagaggcgtctacatcaatgcagtcaaaggctatgctgacttggaccagatggatggcggaagagccatgacagtggtccggggagagaccacaagtttgcaggcagggtgctagtgaaaaagaggcgtctactgaaagctgtccaggagaaatcagactaggttagccatgaatattttctctaattctgtcttctatttttctcctccagttatatgtaagggtcttactgcaaattgtcagtctatcgttctctgagccaaagtggaaaccaataaaagtgttgggagctgcctacattctagaactgaccgtacagggaaagaggccacacttttccacgcatatttcctggagtcctggaatggcttcttcacatatttctccacccccattagacaactcagtcactaggcaagaggatggatcttggagtctgacagacaggcatgggttcaatttctctccaacgattatttcatctcggtgcgacctcaggcatctttgctttcccagactttgttttctcattagcaaaacagacctaataaaaggactcatttcataggttttttatgaggattaattgagataaaccagataatacgcttaacaccgtggtacttgcaatgaagaaaatggtgaatggtacatacatggtaagtggtcaatacattttagtcattctattaacaagttaataatcctctccatgccttgatttccttattggtagaatggggataataaaacccccttctgggtagttgggagaagtcaagcattaataccagtgaagcacttcaaatggtgctttgcatacagcgagtgctcaataaatgttaaattcttaaaatcatcaccacgattctgaccttatggactttgaagggcagatgttgtgtctcattgctttcgtgtccacaagacctggcacatagacgatgctcaataaatattatttgaaggagtgaatgatggtgacatggttcttaggagttaaaatgagaaaacccaaggagccgaaagcatgtctctacggggaaaggttagagagcactgactcaaaccatcgtctccaattatgcagttttaatgaggaagcaagcccaaccttgaacattatttaagccagagttatcccaataagcattttcctaccatgagtggtagattaagtagcattgagtcatgtagtgaaagtaatgtcccttcttcataccatttcaatgcctctggtaagtcaagagaaagtctttgataatagcctatttttaacacctctcacccttgtttgtcagaaagagcagacctcagattcagagactttagcaagcaaagatatccagtaaagaaatgaaataatggccgggcacagtggctcacgcctgtaatcccagcactttgggagtcctaggcaggcggatcacgaggttgggagttcgagaccagcctgaccaacatggcgaaaccccgtctctactaaaaatacagaaaaaaaaaaaattagccgggcgtggtggtggcacatgcctgtaaacccagctactcaggaggctgaagcaggagaattgcttgaacccgggaggcggaggttgcagtgagagccgagattatgccactgcactccagcctgggcaatggagcaagaatccatcaaaaaaaaaaaaaaaaagaaagaaagaaatgaaataataatctcagggcagggcatggtggctcacgcctgtaatcctagcactatgggaagccgaggtggcagatcacctgaggtcaggggtttgagaccagcctggccaagatgatgaaaccccatctctactaaaaatacaaaaattagccaggcgtgatggggcatttctgtaatcccagctactccggaagctgagccaggagaatcgcttgaacccaggaggcggagattgaagtgagccgagatctcgccactgcactccagcctgggcaacagagtgaaactccgtctcaaaaaaaaagaaataataatcttagacttttgttgtctgattaccatcaatgtatggcaaatgatatgggtttttcattgactatgacataaatttttgttttaaaataaaattacggcaagaaaaaagaaggaatggttttaaagaaatattaaaaaatcaattgtgtgtgtgtgtggtgtgtttgtgtgttttgtgtgtgtgtgtgtatgtaggggaagatgttgcacaagctgtgaagagggggtagaatgatgtgaggacactgcaatgccagggcagggcaaggtgcagaagaagctgtgagtaagggctgtcaagaaacccccagaagatagaggctttcattaaaacttccaaaaactttggaaatctgaaggaatctcctctcccaggatatcagcgggaagctcaggaaagtctttactcacccccaaaattttgcaaatatggagggaatgggaatgatttcctggttttgcatctagaatagaggagtggttctcaacctttatttggtatactcatcacttggagaagttgctaaaatgcaaatttgcagattccagacctacagcctagagattctgattccataggaggggaatgaggcccatgaatctgggaatctgtacattagatatccattaatccatttgaattacaggataacaggaaaaagtacataaaatttatataagttccctttttttatactctttctctctcctctctctctctctttctctctcctctctctctctctttccctctctctttctccctctctctcttctctctctcctctctctctctctcccctacccccaaaatgccaaagcacttatattttaaaagttgtttcaaagttgtttgaggggtccattttcacttgtggcttttagtgaacagaaaaaaatataagaaggctctctattgtgttacagcgaggaaatgcatgcatttacacatttgtctacctggtctcagcatgaaacagagcccagaaaagtcttcaattaagaaggagaaagacaagcaatccagaaaataatttaagagggctttgtctgcttgggagccagctggcaacctgggttccagatcagtgagacaagaaagaagcaaaagggatctctcagacttgattctttatttcttacaccctacaattctcaagactctatagaatgagggcagaaaacctgggttgtattttttggaatctcctctactttcttgttatctgtttcatattttttcatactttttcaatgacttctcttcttttttattcttccttcatttcctttgttctttcctgatttcctttcctgaatcagacttccaagccctttctatgtagtaccggtgatccatgggtgaatgtgataaaaacgatgatggtgctaatgatgaacatgacactaactgtcatcgccttaatggttaccatttcttgacccatataacaacgaagccaaaaggactaagcttgtacctaacatttaccaagcactggctacattcaggttgtttatatacaatctctccccgagacatcctgtaagctggttatgattattggccaattgaatagatacggaaacctaagttttggaaatttcaaggagcttgactaagatgatgacaagcttttagataggatactgaagcccaggcccacctatcagagtccaagctctcagacactatgctttgttgcttctcatagtatttcatgcttaacagcacagactcacataaataaacttccacaatatagtatagatacatggaggctaaggccatgaactgaaatttagtgtttccccaggttgaagtaagtcaattgtgttgtagaaaaaaaaaaaaaagatcatccctacttatttaaatccccaaacaccatctttaaaacttgagcctatgaagaaaaagaataaagacttttgaaatctcttatgctatccatgatggcatttttgtaaatccattcctgtttcactaaacaaaagtagaaaaaaatcatgaaaacccccaacacagtccatctggggcgtctcagtaagaatcgtgctcacccactccacagcatctttgaggatgtggccttaagtcagacgctgctcatctgttcctgataaatctcttgtaggctccaggactcttcctggccatcaaaaaatatggaacgcatgcaacgacactgccctcttatttattttagcaaatgaaaatctgccctcacaggtttatggtcaagatgtctaaaagatgtcttgtatttgtatttaagagtcaccttaacagtaggtgactcttaaatgagtactccaaataataggataagaaaggtgatcatgaaactcaagggatcctatctgagagggagaatgttgtctacaccagaaatcatgatagactctgtctggcaaaaaaaaaaaaaaaaatcaattgtttttagttattattggtgatgtttttttttaacatttttgtttatttatttcctttttagtgggtcacattttaaaacaacccattgtgttaatacaaagtttggcaaactgccttgccatctgatttgaggttaatctaataagaaatggaatgaaatgatcatcctgttttattgtctttaacattaatgttttctttgttagtattggatgggaagtcagtcagatggaatagaagaaagaactgttaaaaaaataaaatgagcttatttcacttgatcaatcaatttcagatataaaataattaagctttacaaatagttaaggactctttgaacaaccagcttaaaatctctgtgcctcactcctgtaaaataggcataaggagagttcttacttccatgcactattatgagaagttaaaaaggtgatacttattacatactcagaacaacgcttggcgcataataagaattcaacaaattttagttattatttcctttctcagtctctccctagagacaggcactattaaaaatctagtgtgcgtatcttccattatttatagttttacatgcatgtatatgttgttagaagcattattattctttcgtatatgtttttaaaagattgtgtaaatagtttcacactatattttgtaattttttttcctttttttttaactttatgtttggactctaaccaagtaaatagataggtagaaaaaagaaaaagagagatgataggttttaatatatatacatactaattatatatatataactaatttctctttatgtgctttgtaatattccatcataagaatgttcatttgtattcatttatcggttcctctgttaatagacatttagcatgttttaaatttttcaccattgcacaaaatcctgtattgaatattggtggtaatttttacaatcttcacataagtaatttatgtggagaagaacagttatgaaaaatttactggatgtagtaagaaaatcatttgggaaaaaaataaacattattgaaacagctaatattttataatttgaatattttttgtaacttcactgagatgtctacccctctaatgaaaaatgtctacccctctaaccaaagatgtctacccctctaaccaaaacatttgcacatagtaggcacttgaaaaatgcctgcttggcttaagtacgctgaacgtaaataaaatatatcaataatcccaataataagtgtgttaagaaaactgagtagctgccttggggtggggtggggtggggaacagggagaagtaaaaagaaaagcatgaacaacagaaaagaaatcacacttgtcctcagtgtttgtaatagatcaagcttcagagctggccagctacggctttagagatgccgagctcctggagtgttacaggtgtgtggatggggtcgggtcagggaaggaagagccccccggattttgtgttacaagatgaattgttaacaacagtcaatcccgcaatttaacactttaagcagttaaacttaagttaatgcagtttagcaaacatatattgaagctcactggtaggtccagggggtagaaataaataagacagaactccaatgtttagaaggtccatgtggtacaatatgcttttcctaaccaagaccaacatcatccttataacagggatgtgtgtgtgtgtgtgttgggtctattacctctgcgtattgagaacactgtgtgtatattttacccagcatgacttggttacactgtatgtatattttgattgtgtatttctgctgtaggtctcttttattgtgtgcgtgagttgtgaatacatgtatattatgtgtgttgtgattgaacatgtgtgatgtatgttgtgggtattagtgtgtgtgttgtggcaggggaagagagcatgaaaagcttttctgatgcatgattttgtgtggattatgtatattgtgggtattattgtgtgtgttgtagggggagagagtgtgaaagcttttctgatgcatgattttgtgtggattatgtatgttgtgggtattagtgtgtgttgtggggggagagagtgtgaaagcttttctgatgcatgattttgtgtggattatgtatgttgtgggtattagtgtgtgttgtggggggagagagtgtgaaagcttttctgatgtatgattttgtgtggattatgtatgttgtgggtatcagtgtgtgttgtggggggagagagtgtgaaagcttttctgatgcatgattttgtgtggattatgtatgttgtgggtattagtgtgtgtgttgtaggagaagagagtgtgaaagcttttctgatgtatgattttgtgtggattatgtatgttgtgggtattagtgtgtgttgtggggagagagagtgtgaaagcttttctgatgcatgattttgtgtggattatgtatgttgtgggtattagtgtgtgttgtggggggagagaatgtgaaagcttttctgatgcatgattttgtgtggattatgtatgttgtaggtattagtgtgtgtgttgggggcagagagtgtgaaaagcttttctgatgcatgattttgtgtggattatgtatgttgtgggtattagtgtgtgttgtggggaaagagtgtgaaaagcttttctggtgcatgattttgcgtttgtggtggacctggcatgttcatgtgttcttgccaactatgctgctaatggaatcactgcaaagcccttcaggattttccctgtgaacatgaagccgacgtcacagtgtattttcctgggggttcccctgtggcactgtaccctgacctcctggtcatggcttggttagaggaaaacaaaaccactgttacacaggatgtcccctgctcaggaaaatttgctctcaatgggaaatgtataagagacagatagtactggaagctccacaccctattgtaatgtctatttcctggcctctcttcctctccatgccacatgttctatcgtgtcagggattcatcttaggaattgtgggaacaattcatttgcagtacctggaacacagtcagtgggttgaatgcatgaatgtatgaatgaatgaatgaacaaggggttctccaaggttccaggcctttggaatatttagataccccagttatttatactcacagagctgactgtagtaggatcttagtaaatgtcatatagataaaccgatgcatgcacatggcactcgtgaacatttgcttatctcagaagcaggctagcaatcgtaagaaaacagttcttcagtggggcttttattcttcctctgtggatcccataggagccccttgtctcctgtccctttggtttaattattgttccttaagatcagcagggcagcccttctgtttactgtcaaactgcagccacaaatggagagaaagaatgaaggggaaaaaaatcttcataatccaggtacaggaatttcctcaaagatttttttttctttaaaagaggtgaaaggaaggtggaaaagttggggaaatgagtttccaaacttgccaaacacataaaccaacagaattgtgttgctgcctccataaatgtttaataagttttatcatcttgtgactaaggttaaacaaatgtgagtcctttgaggaattatttactggaagcaaagttatagcatcaacatctgtgtttccaatcacttagatgaggaatagatcaaataaatcatgagtaagttccacaaaataacttctgtattatcatctcaggagaagaataatgtaagcagctcttttaggtgccctctcgattggaatttacaggtttttttcttaggcttctctttttttattcatttcattatctccaaataataagtcttcactgctttgtggaaagttaccataaaaacatccacaatagaaggactttgaaatttctctctgggaatctggctatttcagccaacattctcatttgggaatgggctaacatttccaatatataacatccatataatttaacctcataaatttattttttttcacagtgatgtaatggggagactgacctggagtttataaatgttccctgctcactgcattcccccgggcaacataacattctagacagtgttttatgtgccctgattaaaatataacgtattcttgcatttcctgtggactgacctgttagtactcttagcagaacatttaaggaatacagagatgttttcaaacgtgtaacaatgcactgtgtgaggtttgtttttgttgttgttattaaatcatgatctcattttcattttagatcacagtcccctgggcgcccctccacaagaaaagttctgtgctttggtttgacttttgaatctgccagtgcactctgacaaataaaaataagcaggaacgcttgtttgtaactgcaattggaattcttaggcacatactttaagctgctttcctgaagtggagggaaggatttggaaaagttaatggggagtcccccaagataaaacagtagcaatggaaacttataaccttccttattgaaagaaaaaaataataaatgaagacaaggggaagggcttcctatagtttttgcaatcatgaaaatgacacttgtgacacatagtacactgagcaaaccaatttgtggattgagatgttttaattttctatgcgagaaacacataacaaaagtaaaaggccacccttgccttccggaggagcaaagggaagtttgtggggtgaggatgtgagctggaaaccttgctgggctgaagctgatgctgccatgtagcttttccagggtacaaatctcattccaagaataacacaaaagaggcttggaaactgcttggaggaagaagggatggatagatcaaacaaattagtgaaagataagttcccagaaaggagtatgtgtatttgagagtctgccttttattcatttaacagatatttattaatttacattgttttccggcccctgtgctgtgtatcagggcttatcaggataaacaaggcacagcctctgctttcagaggttagcaatggagtgcccagaataacgtccggaagaaggcacccagtgaggtctcaggaaatgttagttgaaagaatgaatgggtgaattaatggaaaaatagacgggtgaatgaatggatgaatggatgaatggatagatggattgatggatggatggatgaatggatggataaacggatggatggatggatggatgagtagatggatggatggatggatgagtgaatgaatggacggatggatggatggatggatgaataaatgaatgcataaagatgatctgtggctccctaggaattcaagctcatgtctatatgtttgtttctggatctaattgttgatttctgcccggattttatcacaggtgggccctgacattttcattagcaatggttcccttgatttcccttcagacgaatccttcctgaacccaggtgccctttatcctgcacattagcccctagtcagctcttacaagccataatgtgccgtgaagttctccagatttttccctggttggccactctgagtgtttttcactgctcaccacgacctctaatcaaatcagcttggtttccctgtgtctccttccctctgttttgctcctggaaactgtgataaccagatgcattaacatttccgagagtccaccacatgccaggctctgtcccatgtacattacagtgcacttgaggctcatttagcctccctttcaattgagcaggtagactattattcctgttttccagatatgcaaactgaggcacagagctgtgaagtaattagttcagatggaagacacatagtggagccaggattgaagctcaggtgtgtttcactctaaagccacaacaagtacctaacctcagcacctctagaggtcaaacttttttatcttgatgaatcctgtttttgcctgtgatacattttccagcatctcagttcctcagcagagctccagcttcacagctacagatacagagacccaaggaatggagttggggtaagctccatctttgatgttttttaacctcgctcctcattcagaatctctacatggggtggctgtagtaaccacctaccatcatcgtccatctggcttagccactagcagaaaagaacatctctctcaggacctccagcaaatattctggggttgaccttaacctacataggtttccacgaccctccctgaaccaatcactttctctggctctgtgcatccagaatgatttgccaaagcaaaatcaaagtggcattaccaaaaaagggaggaatgcatgcagagccagcagagtccatagctgtccactacattctctatagggttgcaaccaagtgctttgaactcaggcaaactgaggttccaatctaggttatttattttttctttcctttttttttttttttttttgagacatagtctcgctctgtcgcccaggctggagtgcagtggtgcaatcttggctcactgcaacctctgcctttcaggttcaagcgattctcctgcctcagcctcctgagtagctgggactacaggcatacgcctccatacctggctaatttttgtattttttttttttttagtagagacagggttttgccatgttggccaggctggtcttgatctcctgacctcaggtaatccacccacctcggcctcccaaagtgctaggattaaaggtgtgagccattgtgcccggccaaggttatttactttctatctgatcgtagacaagttatttaaccttctaagccccactttcttaattaaaaatagtgtttttaatgcatgctaagtacatagtaagttcttaataaatgttaatgtggtgtttgtagacaacagtatgttgaagactactggaatagcacatagatgtctttggagaaagagatatattcttttgaggtctgcatttatgctttggggcacacagtttaataaaaaggtaatataaaatggaagtggggtaaaatatgtctcccagaatgagccaacaggattgaaagaaccactttccaagtctagatcactgtagcatctttttgcttaaggccgaaagttcttctcaactttcctttcaggtttttatttatttatttatttatttatttatttatttatttatttattaggcaaaatgggaattgagaagcctgaaatgatgaagatgctcatgattttaaaaagtttttgtatgtcaggaatgaaagatgtggtgaggttgaacaggaggaaaaaaatgactgtatcccagtcagcctgggtagtatcacttcctgctttcctggggtaaaaagcctggaggaatatgggcattcggttgttgagaaagagtttgtctgacttctcttgctgtatttgggattgttcagagactaactggttggattgcaatttgctttcttgtggaaaaactgatctagcaacatatattgtgcgtttgagctttagagaagccttttctcttgtagtttattctcttgcatagtggtgtttctaggctgctgacatatgcgaaggaaacattgtattgatgtgtgcatgtgacagtctacctgcaacatgcatgtgctcgtggctgaatcatttgtgcatccaaagctgaggtccctggctgctgttgatttagtccaatgcatatgtaatactctgtggaaaacattcctggttagtagctcctcactactgtgttatacaagctgctggcaaaggtaattatgcttaataggagccacctttgatttaaagctgcagaggtgagtaattaaattgagctcgctcaagcacgagggggtggcatgcaacctttgtttggggacattcattgggagcggctgggatctgttacaaaggcaatgtttcttgggctcatatttgtcacccagattgtcttagaaagacatcagtgcacctgggagagatgcagcaaaggcatagtgcaggcatctctttcttcgtcctgtcccctcaaatatcaccaaaggagaactcgcctcccagcttcatctgccctggttcctgtgctcatcttgccccgggggggggttcagcactgtcctgctctctggtttctcgatgctcatctctacagatgatcacaactgatcaccaatagtgatcagtcttgccacgtggactggcagtcctgagatttctaatctgggtctgctcggacatcaacagcaacaacaaaagcataccagtcccttaatcctttaatgattgaatatgagacgaattcgtgtttgtaagatttcatttcaatcccatgggtggctattattgcatctcaaagatgatctatttgtatacatttctatattttcttttcagcaaacctaacctgataaaagaaaaaaaaaatgcctgggctgtcctctccccagccctaccctctagagtttctgaatggtaacacccaagcaagccgggttctgttgggcaaagagcctgttccaggcgatgccacctagaactggggtgacatacttgctaggaaagaacagcaactccaactaaatctttgtggcttccaaaggattcccaagctccaggcagagggttttgctctgtgataactgcaaagtgggttcataaaatccagaggaatcctaggaaaatctctttgcctaaactcccctgcttttaggataaacagatggccttacatcttcctactcaaagtatggcctgcaggccaacagcctcagcatctcctaggagctcattagaaatgcagattctcatgccccaccccagacctgcttcatcagaatctgcattttcagaggatgctcagggggggattcgtgagcacgttgagatttttagaagagttagcctaccctgaatggttgactcctgcctcctttctgacttgaaatcctcatcatttccttgcctgaactgtggtttctttctgtccttattccatgcccagctgtgccttcttctttttttggggggacagagtcttgctctgtcacccaggctggcatgcaatggcgtgatcttggctcactgcagcctctgtctcccaggttcaagcgattctcctgcctcagcctcctgactagctgggattaaaggcacctgccaccacacctggctgatttttgtattttcagtagagaccgggtttcgccatgttggccaggctggtctcgaattcctgacctcaagtgatccacccgccttggttcccaaagtgctgggattacaggtatgagccactgcacctggccaaagctctgccctcttcttggtctagttaatgccttcacatggttcatatattagcccaagggttacttgctcagggaaaccttgcctcagcctttagattaggttaaatccaccctcgccagtacaggcctgaaagcaccatatacctcactgccttgctcttttcagggttacaattctatgattcttggtttagttaatttctgtctatcgcctctgcacacagttccatgagggcaggaaccatgtccagttttatgactcccacctgctgggaccccaccatagtgtccagtacatgtagaagctcaataaatatttgttcagtgaacagatgcgtgctctcaggacatataattaggaatattgtaggcgtattgctggctacttagtttatctcttcaggaatgttcaaaacatttctagaactgttttctgtttattcaattccaggtgatgagaaaatcaactcaaccgaactactatttttaagcactttccacacattcagcattataccacttaatcctcacaacattttataaattttataaatgaataaactgaaacttacagcagtgatttcagactagcaaaatgatggcagagctgaaaaccacgttctactcttcactgccacattccactcttcactgccacattccaagacccatgagtctgaggcctcatgctctcccttgggttggaatcagagtggttctccaagatgcacagagttcccgattcacctccttaacacagatctttattaagcacaccacctgggtgccaagcactgttctgtagcagcagtaatgagtaagatccatcaggaccctgctctcaggggacagaagcaacatatatacttaagatgccatgtggttaaaaaggggctaagaagaaaaacaaagggtggcaaagggagggaaggtgagggaagggggctataaaccatagagcctttgcctccttcatttttgtatctgagcacttggctcaagggccagtgtgcgataggtctcctcagttagcatcggttgatgactgactgacagatggaatccaacatttccaaagtgggctaagcaccagctggtgtcgtatgtgaccataaaactgagcagagcaaacggccagtctagagattgggatttcctaccctgttgcccagattttcctccctctatcagccactggtttgtgactggaatcatcagaatcgcctctagagctttcaaaaaaaagtcatgtgctcagcttttccttgggcaaactgggatttctgggggtggaaaaccagcatgtgtgtttttaaaaaatcctacagttaagtctgatgtgctcaaatggttgagatgctgtataccccaaccatgtgaaataataacaccatctagctttcactgagtgcctactgtgtgccaagccacatactcagtggttaaccaaccccactaagagagaagaagatggtgacgatgatgatggtaatgaaaacaacagctaatatttattgagtaatgttgtttgtgcctggtgttatgctaaacacttatgatgtccaaatagttcatcttcgcagacgtccaatgagtctttttctgtctcactcaccattatagacatttcagagaaggttcaagtaagtatcagatatatgtttcaagcaggggttgacaaactgtgacctgtgagctaaacgccacctgtttttgtatgacctatgggttagaatggtttttacattttttaatgattgggaggaaatgtgaaaattagttttcttaggttatataagtacctatataatatcttaaattttgtctcttggcctgcaaagctcaaatttactatttggtcctttattggaaaagtttgctggcttctgccctagtgtatttttttccaacttgttgtatgtgtaggacagtcatatgagtgattgttttaggtggtagaagcatgaatttttaaaataattatggtttcatttgctgtgtaatagaaggggaaagtaaaactaatatattaaaactgatttcatggatgttactgctcaatccaatgtaaagaaaaaaatgaatctttttgaaatcaatttttaaaaaataataatacaggcagtatggagataaaacagaaatcatgcaagttatagaaatgggataaacactgttataggatcagaaagtgggatgaatagggaaaagtcaaaataatggaaacaatttcacctggatgagaaagataggagatgagatgacggaagctttttgcatttttaatattctgtgattctcagtttcttagaacccttgtttttcaggactttttgatctcttgaggtctcttccagcgctctgattccatgaaaagtttcctcgggagatactgacacaagctgggggatgtccagggttcgttatagctcaaggcacagtcttcctgtgtttttccttctgctgacttagaaagacagatgagcaaacctcagatggattcagaggtttggtggggaaatctgagaggctctctagttcagccaggagtggaagagggggacagccatctgataatgactgttgctattttaagacacagatagcagagatgaggagtagcgtgatgaaaactcacattaaaacaaccaagagaggcacaacaggaactctatgaaccccagagagacccggtctgggtttacaatgacaatgttgtgtgtgcgttcatgtgcgtgtgtgtgtgtgtgtgtgtgtgtgtgtgtgtgtgtgtgtgtgtgtgtgtttgggagggggtgctgatatttttttaaatgcagatggttttgttctctgtagttgaagcttcagttcagcagctctgagacaaacaggaaagcctgtgttattctctacaggaacacatcaaaggtagtttctggcaacagtcaaaatgtatatcaaggaaggagaaaggattcatgacctgtttgaacaactagtgttaaaaacacattcgagaagaaataatgctaggtagaggatgaaaggaaaataggagaaaggaagaccccttgcttcactcagacctaaagatgattgtttctcaccattgctagctttttcaagaataaggaagcgaaaaaatcacctgtctcatttatcatctgacaggggagctaaactctgctggatgaaactttttcttttgccccagactaaataaagccccacctcgtcttctgtttcattttgaaagaaaagaggtaaaacatgcacaactaaaacacttgtttaaaagtgtgtgacatttcaggaaggtttaacgttacgtatgtcttccctattgagtttcataaacagagtatcattgtttgatagtggcatagctgtggttttgagaaggcttgtctagaacggagttcctgagctgcttggatgatatttcactgctttgatggagaacggactaaagaacatcattgtgacctttttatcaaggcttaaaggaagtataaaaagaaaacggaagttgtcaacactcaccaggctctattgtgaggcacacaaccaacccagggaggaaaatctaaggttgcttttgtcaccttaactcacatcacttcattgtagtacaagtgagagccggaacttattggacacttactctgtgccacacaggctttgggtgaatttttgcattttaattctcaccccagtaaagagacataatggtatccatgttagaaatgacaaagaggcacacagtgaagtcaggtgactcggccaagcttctgcagctgcttagaggccaggctgatctacctagccaggggtacctgacttccaagcccgtgctgtcgacccttctggtttaactctgagtaaatttcatactttgtggagcgtccatcagccaatcacaatctaaaaataatacaaaatgaaagaaactgtcatacattatctttttttcatcttcctaacaaataagctggcatgattattctttccattaccctgaaaaataaaccaaggctcaaggagaggtcatggtctgccccaaaccacagcctccattctctggcttgaaatcttatgcttttacccaccttttgatgttacctcttaagtgatgttgccagaattagcaataaaataaatttataaaaaagaaaataaatatttttatttataaaaaataaatttataaaaaagaacaggatgcacagttaaatttgaatttcagataatataaaagaatgtttagtataaggatgtccagtacagtatttgggacctacgggcaagctttaaagaacataagttttatcacattctccaggtacgacgtgtgtattaataaatcaatagaagtttatctgtgagcagttatctcagttttttaattcctaagtcttcatgttctgaagaaatggccatcaccttgcattcccagggcctattgattatgaggcttcataaaccttaggacttgagagaacagctgggattccttcccagttgctaaccaatgacttcataatgtaatggacagctctaaattgtgcttctacgttgtagacataataagagacacactaaaggacaaatacattatctaataaagctgcctcgagcttaagagataacaaaatgtcaaaactaaattctttttctaagcacttccagtatgaaatttagttcaccgtccaggtactgtccttcattgtggggagaaacatcctgcctgtctacctggggttctattttatttcatcagcctcctgtttttctccagggatggtgtgtgtgtgtgtgtgtgtgtgtgtgtgtgtgtgtgtgtgaaattttttcctaaatattaagtcagtgcaccttcctcgcaagcgctggacagctcaggatcttattttggaagctcgaggtatgagcaggcctgagaaaattgtggcccttctttttactccttccctctgtgaacttttgagaagattccttagtgatcggcttacacgctttcaaactggcacgcctgtaatctggtaaaatgtgtcagccctatggagaaataagccttccagaagagtttcttcattgttgaggtaattgtctcctctctgacaggcacattcatcagtggcttaatggtcaatcactagttggcaggcagagtgttttcattcttccctatccactacattaggcatacttaatcaaaatgtctccgggtaatggctgtgaagagttcatgactgactgatccgttgtctgtgctgatagaaaattaacagctcagtgctggaaagatgcgagcccacagataaacaaattgtacattaatatttcatcttggggacctgggatgtgctgtccatagcaaaatatttcctggctgcacaagcaattctttctttccttctctttccttcttttttttctttttctttttttttttaattatttctttccgtaagctgtgcacactcataccacatggacagtatgcatcctgttctagaagcttcagtgtctgtggaaagttcaggggagttcatattcgatgccctgttttcatcactgccaaatgaaagcaggcgaaaccctatagaggagttgttttgttctttctttttctagtataatatctgtgggctgactgttgcctgagcatggaacacgcacccactccccccctccaattaaatacctgccccaactttaaacatatttcatacagaatatttaagggtttctggatgaaatacaaatttcatccagaaatacaaatttcatccagaaatacaaataggaaaacacacattgctcagtcctacttattttagctgtaattcattgtgttggatgattttgcagagtattctgatagtgaagacaaactgattccctagtgaagctgaaatcggtcaagcttcctgatggccaagacgtaagatgatacagcagttgaccatgtgcgaaagaccagaagggtcagagtttgacttgccttgaccccatgcaggcgttgccccgccacctcttcctgtctttttaattttatacccagaagaacaaaaacagagaaaaggcatttacgcttagcagtccagacctgccgggaaaagcataaaacaaggtgtataaatgctggaagaggaagccacaccatcctgctgcttatgagctcagggaagttctttttaaatggtgtcctaggtgcacacaaaagaaatgtgtgggcgtccgtgtgacatcacatgccataaaagacatcaagatgctaccaaaagtcagaccctcaggtttaatctgagtggttcaatataataataaaaataataatagccaactttcagtgtttactataagataggcaatatgggctgtacatgaatcttctgatttagtggaggtagataccatcattattcccattttacagatgagcaaactaagagagacaggaggaaattcatctaagaccaaacagccagtaagtgatataatagaatcgtgggagtcatcctgaactttgaacctcttcccttaactgcactacatataagaagccaggtttaagccgggcctggtggctcacacttgtaatcccagcactttgggaggccgaggccagaggatcagtgaggtcaggagttcgagaccagcctgggcaacacggtgaaaccctgtctctactaaaaatacaaaaaaaattagccaggtgtggtggtgcacacctgtacctagctacttgggaggctgagccaggagaatcgcttgaacctgggaggcagagattgccgtgagccaagatcacaccgtgcactccagcctgggcaacagagagagactctgtctcaaaagtaaataaataaataaataaacaaataagccaggtttgagctgaactatttagaaatataaaatgttgaagctggagaaaacgtgtagatgtcctgccatctgaactcttcctgttccagaggagaaatggtggcctagaggaatgggaggtgaagggtctaaggtcttaccactgctgtccccaggcagtagacacattggttttattaacaggaaattctttggagattctctgtaaatcctgcatgcagcgtgtcctgtgtcatgtggtgatgagaagctgaataaattcacacttggatcattctcgatctgtcctaggcaaggccctggagaggtactcggtgttaaaatttctggagtgactgtgacatcttgaagtataaagtagaacaaacctttgtgtatatagcccctctctccaagtactggctctttctggttattctctggctagattttctttcctctagctgatgtgtttggtgacctcactttttcttctctgttttgagaaatctatgaaatttaagataagataagcccattgggttaatagcatttcacctgcctttcctgtatactcaagaaataatcccaagagaagaatcttagctttaaaggcatcaagtttaacacagagcagggtgagatggaatgtatttaatagttagatgatccttcattcttttcttttttgtgacacacacacgtacatgtgtgcactcaaaatgcttaacttataaccagttccattgccacttcattcacttacgagcctaaagtttggaagtttgctcctattgaaagaaaagttgtaagatgttcaacattataaaaagtgcatgagttgatctgttcccagacagactcacagaattttacttaacatatattgttgcaaaaatgtttgcatccctactgaaaaatcattagtgtcactattgcaagagtagttattaaacagttaagaaaaaaagtgatattttccctaacgttaagtattcatgcctgaaaagagactgagaaatagatacagatttttatagctattctggaagaagtctccatgtgcttttgaagaatttgcaataggagcacaggctcatgtatccttagatgccttgcatggaagcacatgaccaagataaactgaacactagccaatagggagtggtgaggaccatggagtgctgcaagccccagtcccttttaatgtgcaccacggctactcaactccagtctgtagtcaccatgcaggaatccatcatctatgttgccagatcttttggtttctcaatggattcacaaacctacatttcaatttcctaagcagcacaagttaagtaaatcacacgtggtacctgaattcaatgtaaactgccattttataaactcagatttagagatacatgtagtccttcattcttcattctttcacatcattttctttggtacagatctaaaatagcatcattctaatattaatctgtcatgttgggtggtggtggggtagggtgctatggtttattttgtttggggtcaaacatgaataaaaaataaaaataggacttttctgagttaattgagtaggagttgggagagttagaggggaaaactgaatatcagtataaatatttgagcacctacaatgtgcaagttctggaaatccatgagtgaacaaagctgatgatgccctcatgacacttgtaaatttctcaataattctttaattgccattgtgactggtgctgcaagagtaaaggctgctactgtgagggtgtctgacagccctagcctggggtggcaagaaaggcttccctgaggaggtggcattgaacttgatacttgaaggcttagcaggagttgaccaggctgaagtggcctggtggagtaaggagcttctggccaagaaggccttgggtgcagaagtcctgaggttggagacagcaggtgcatggacagaggaaggttggcacgatcggctccagtgagaaagagaaagatggtaaggaaggaggttcagaaatcagatggaccaaacacatgaaaatgtttggtcattttaaaaagatgacttgcaatatggcaactgggccataaagagttaacaagaggagtatggcatgagtataggcctttcaaagtgaaagacaggaagaagcacaaaatacgtgttggataaaataatttcttggtgatgacattagcatggaatagttaccatcctagagaaggtgctagaagatacaggggaatgataagagtcatccaagaaagaaatgtgtgtttgtgtgtgtgtgtgtgtgagtatgtgtgtatactcgtgtgtgtatgtatgtatactcatgcgtgtatgtatgtatatgcgtgtgtggtgtgtgtgtatgtatgtatactcgtgtgtgtgtatgtatattcgtgtgtgtgtgtgtgtgtgtttgtatttctgacatatccatatatccagttgagtatttgcagagtgatgtgagcatgacatggttaatgattaaaatccaaattaggtttcatcaggaaaattaaaataatttaaaaaataataatacaacacagcaaatggtctggctgtgtttcctacttttattcataatactaatttatatcattataaattatgtgtaagggtgtctaccttgtcaagcctatgtttgtaaagaagaaagcattttgtatctcacaccaagaaaccaattccactgaattgtatgtgagttaatattcaaggcaaaaaagaccaatttaaatcaatacataattaaccttgatattagaattgagaatgaaagcccagtttagagtgttgagcatgattttcttaatgatatgaacagtgtgtttagtctttatgaagaaaaaaataaagggaagaaacactggatggaaagaggagagaagtaggtaaaggcatttcagaaatatggttaattgggtaattggggattgggtgtcacttgaacttaagcctgtggttaattcatggcttattcttcaggaatgacattggcagagcagttattggaataatgaattgctcacttgtcctgggcaaatagaaaattcccctggttgaataaaacagtgggaggaggcatttgataggcttataatggcttaagagcctgggttagggttcttcccctgacagtcagaaaagagaactttgggggattggatattttcagcaaaggggcaaaattaagaaaggattataatcaccttttttttttttttacgggaattgacattgatacttaaagcattttcaaaatgaacgtcaaaaacagagttaagcagcagaatattaagtcaaggtagggggctgatataataaggagtttgaggaattttagaggaaaagtagtcgatataaaggccaacttagtcaagtgtcaattattcccgttttaaaaatagagtagtgtatacccttattcatggggaatacattccaagacctccagtagatgcctgaaacctcagatcataccaagtcttatacatattatgtttttcctatacaaatatacctgtgctaaagcttaacttataaattaagcacagtaagagattaacaacaataaaaaatagaacaattataataatatactctagtagaagttatttgaatgttgtctttctcctctctctctctctctctctctctctctctctctctctctctctctctctcaaaatatcttgtactggctgggcatggtggctcacacctataacaccaacaatttgggaggccaaagtaggaggattgcttgagcccaggagttcaagactagcctgaaaaaatagtgagaccaatcgctacaaaaaatatatatatatacaaaaaattagctgggcatggtggcatgtgcctgtgatcccagctactcaggaggctgaggctggagaatcggttgaatcagggaggttgaggctgcagtgagccgtgatcctgccactgtactccagcctgggtgataaaatgagaccctacctcaaaaaaattcacaacaaaacaaaaaatatacaagcaatatcctgtacagtgctcactcttctttttcttgtgatgatgaaaaatgataaaccgtgtgtgcaaagagatgacgtgatgaagcgggacagctcaggatttcatcacactactctgaaaggcacataatttaaaacttatgaattgtttatttctggaattttctatttaatatttttgaaccatagttgaccacaggtaactgaaaccacagaaagcaaaaccacagataagtagggactactgtaaaaagagaaatagttccataaactttcaatgttaacttttttagccccaaagtttagaagattcagaggagaaagattttcccagtcaaaaagcttctgcccaaactcagacttttcagatatcttgttgaaggcaaatttccatgttatttcaatggcaaatggcagacccttggaccaaccaccaaagatactcaattatttccattaatgcagtgaagggactagaaattcattacccaaaattccccccaaaaaaagacctacattgggaactctgaggattttgtttgtttgtttgatttgtttctaatatggcttcgtggcatcttgtgtttcggggatgatgtaaactatatcataatcactatcattgtcattgttgattctcttagtcttttagagtggacaaaaggctctcgtccatgggtctaccctccccttctcacctaccattttctcctcatcctcgtatgtaaatactgagaacctactctaaccacaaagccagtcattcaggacccattgcctcaggctggatgctgcagtcttttggatggaacccaggaatctggattcctaactggaaccctggaggatggttacacacgtcgaagtttgagaacatccctctattccacccaccacattgcatcacatggcagaatgagaaaagattgatctttgaacaattccccattttgattggatcatcaaaatcctatctgcacaatcctccatgtctaaacacacactcctaaaggaagcaaagcaaaacaacaacagcaataacaaaaaacatggcactagtaactcagagtggaaaacatgactctgctgttcagtggttagaaccagctggatgcaagatcctctggtcggattttatgtgtgcccagcctgtgagccttaggaaggaggtcagttggtttctttttcttggccaactagattggaaacaaaacaaaacaaaataaaatgctgatatgctgagttatgacaaactgagacacatgtcatgagaggaaaaatgacagctttactgctgcagtgattacaaaaaacacagcaaattaaccaccaatatggctttgtatgtagagtgaaacaactttattgcactgtaaattggagacctagaacatattttaggagtgtcacacctgaaaagctgacgattttccccaaattgctattaatatttttttatttttattagttttattttccacccaactgaaagctgaaactagaattatttttcctccctagaaaaattttattttgtagagttggacattttctttattacgttgtctctgtaagagttacttagctataataaaacagtcatatttataacttaattaaatctggccatttaaacagaaatacttgtaagtaataccaataaaataaaaaagtgaatatcatatttgataagttttgctcaaacagctttctttattagtgccttttatgtaactcagggaaaaaatatactgatccagcttggcctgaattttactgtgaaaagtcctcagatgagttaatatttgtttgctgtgttttaagttattgagctaagcaggggtgtcatgaatgaatgttcaggttgtgcactgtgcaagtctgccatatctcaagagccccaattcatatcctgggatcctcttttggttccaatttcaaatatcacactgtagccgagaatctcacttttaatgcccataacaaattattaatacctttatttccaatgtaacagtggccagataagtaaacccaaagttttaaatataacaggaccaacagtgttcattcatctaatccaacatgattacattactaataaaaagccaggaccttattttatgctatataatcctaatagttcagaactagcagacttattcagtttctatcagattgtgtattaaccaaacacatttctgagatgattttttttgaatatcaaagagcacacaggagtatgtggaaaattagggtaggagcatagtaggatctcaagaaatgtttgtttcatggttaattaaataaacagatggctgaatgaccatatattgcttttatataagaggaaaattaaaatctccccagagtcagttttaagggcagttttctttacactgggaaaatcgaacaaccccacagctgcctttggaagctgtaccttttggctgaagagtgaatggttcaacttctttgagtcagtccccatctgccttcccaatagggtcattcttttctgtgcctggcaatggtccctgcactttacaaaacaaagttatgaggtaggtacaattgccaccacattacagatgagaaaagggaagcacagagaattgagaaacggggtcttatgctagtcagtgatacagctgggatttgatccacgatatctggtttcaaagccagtgttcttgaccactacacgatggcccatgactgttcagagaggtactcatacagatttatacttcaatgtacaatatttcgagataaacagccctattgtgaatcagtgctacccagggctggccagaggtcttgcatcctaattaccagcgaggtcactttgatatccagtaggtacctctgggtccatttgtctgaccttatcaccttccgttcttgtttcccgtctctgtttctgctcagttagccaccaatcggccttctctggtcccttactcctgggtgtgttccatctcctcgctactcagaatgtggtcctcagagcaggagtatcagcatcgtctggatttgttaggaatgcacaatctcaggcctctgccaacccaaatgaatcaggattttcatttaacaagatccgcaggtggttcaaacacactttaaagcttgggaagtttaggtgtggtacctattttccagaaccccaagcagctgggccaatttagaacattcccttggtttgggaaggttcgcttctccatttccctctaggacttccttgttttcttcaacaggccccctttacagccctaaccaaccaaccacacacacacacacatgcacatgcacacatacatgcacacctacacatatgcacagatgcactgacacaggtgcacaagtacactttttgggaaggcagttttcttttctcgctcatgtctcagactgccttggcccttcccggcttctctctctgtccctcgcacctgccacttcagctaagatctctcctttccacaacagtggatcccactctaaaatttcaaaaaaacgaccaaatgctggggaaattagctccaggttgctctctcttttactttgccaaataaagacattaaactaaaacaagacaagctaccctagttgataactatccctttatgatctcagaaaaaaagaatagggtttaacacattttacttgataaaaaattcactatattttcttcttgttttcttgtttcatctcagtgtgattggagttttagtatagcttcacagagtaatatttatagatcacttcagattttgtgaccattgcagcaaaaatgttgggtgatcagccatgtctttctctcctttgagtcacctactcccaggaagattttattatcccaattaaaacaagagaagtaaaggcttcccaacaggctctacttgttaatggaaggtggctatttcctgtatgaaactctcacatccctatttgtcctcaatggtttctgagctcgagcattttttttttatcatacaaatacagccagctttataaagaggaaatacatagagacaaggtactaaagaattttaaatgacactactctggaacttcaactgttctccataagaacaggaaagggtcctcagcataggttaacttaacaaatatttatagtgtgtggtccttgtcctctagactgggcgagaatccttgtcatccattctttgctactgcaccagtagacactattttaagtagttgtttgtggaattattaatatcatccctttaattgtggtctaataggaccacatctgttttgttcaccataagctccccagaaaccaacacagtggtgatgactacatgtgataacttatagtaagtggcgctaagcaaagaggaagcataggctgattacatttatttaagcatcagtgatagctttctattgcctatgtggttttaaaaaatcttctttcctttgcattcaggctcatttatttattctttcaaatgatatttatgacactcttactgtgtgccaggcagcgttgaatccacttgggataagggaatgaaaacaaaaggcaatacttcctgcagccatggagtttactttcaatttcctgcctcgtggggatgatatgaaagtgaaatgagcagtgagtgtgtattagtcagctcaggctgctgtaacaaaataccatagactgggtgggtggcttaaatgacaaacacttattgcttacaattctggaggctagaaagttcatgatcaaggtgctagcattgtcaagtttctggtaaagggtttttttctggcctgtagaagaagccatctcttcatacggcagagagagagagagagagagagagagaagagagcgagtgcacatcctcatgtctcttcttacaagggcactaataccaacctgaggattccacccttgtgacctaattacttcttcagggcccctcatcctaataccatcacattgagggtctgggctttaacacaggactttggtggggacataattcagtcgatagcagcatgttgaagtgattagaaaaattccctacatgtgaagaatgcagaaaaatttcttcacctatttatggagcattagttatgaaccaggagctgtgctggaatttggggaccaggtggtgactggaggcacctggattcctgctgctcatgggttcctaggcagtgctctctgccctgcctcaagttctaccctcctcttcctcttgactaaagctccattttctcctccttcaagaacctctcccttcctctttccgtgctaggaaatgtacccccagcattttgtatctatctcttgttaacacttataacccactttttcttggcctacttgttaatatctttcagtagtctgggaacctctcaaggtcagggacagggacttagttgttttcatacatttccaaatcctgctcccctccacctccctgaagccccagtacaacgcttcgtacagaatgagtcgtctgttcgtttgtgtgcaatgaatggatacattttgtaatgtcaccctgtgtttaaaactcccaataacttcccaaactgcatttaaagcctaattctttgccctgtctctcctctgcctacctccccacctctccagtgtggaatagcgccattcccttgttgccccacactgcatggtggccactgtctttccttctgtttctgaaaacagctgaccccattctgtcctctcagttttacacttgctggtttcctggttcttcccatggcctggcttctcctcatcattgtcactgtcacctcctctgagaagccctctgtgatccctttgctgaactgatctcttcttttcctagacatcctctttcaaccttttcaaatctcattttcctcatagcagttaccattgtatgaaattaccttgtgtatatttcatttcttgtacgggaacagtggttctcaactgggaccatttgcatcccagaggacatttttttgttatcacagttggggagaagatgtcactggcttccagtgtgtagaaccagagatgctgccaaacgttctacaatacacagaacacccccaactacccctagcaaataattatctttggccacaatatcaatagtgccaggatgagaaccccaggatagaatttgcacaatgaggatggggcctcttctgtctggttcttgtcaatgttctcatggtctcaaatagcacctggcacagcacattcctttagccaatgtttgtgtcatggataaattaagttctatgttaaaatataggagggtaatgtgacttgggggcctctacctcattattttggaagaaatggaatcagaattcaatgccacaccattagacattctctagtgaaatgatgccgttaactcaccggtgatcatgctgctgggacaggatgggagggtgagaagtgggggaaaggggtgtttttctctattcttaaggatgctgtgaagtacaccttgcccagtgttcagggggctgaaagtaagggcagcacctatctgtgtcatgcatgacaagaggctgtgccagaaagggaagaatttttaaaaataataaaaatcccgatttaatgataaataatcatgccctgcctctgacgttaaagggcatcattgtctcggctcagcgatgtaaatcaccataatggacgaatcttttaaaagtaacatggaatttaaaaatggaaaatatgagggccatgcaggatgactgtgaaaatcatccgtttattatctaggtgtgcttaataatctgctgcctggggaagaatcatttgctaaccctgaggaatggctcattttccaattcaatcattcaggccagcactgcctaggacttctcttcctcctcccttcccctccccactcatgacttctttcgtcactgtctagaaagagtctatcactgccataacttccattaaagcctccactaaacagtttcaaaagaacaaggtaggttcaccatgagctggtgcagttagcaacaaatcagccttcaattggtgagaatgactcatttgaaagggattattagccaaatgttaattgattagtggaactaaagcaattaaagtgaacagagccttagcctgtctccacccatcctcaacgcaggcatctttctaccatgtgactcaccctctgcaaattatgagcattcctggtccacagagaaatggtttttcctttttacggtttccagaattttgtgagaggctttgaaatcaagaaatggaaatcaaataagtaagtgcaaaaagacaatctactacttggtatgcctgtatcagatagaattggctggattatgctgctgtaacaaatagcccctaagtcacagtgacttaacacatcaaacgttgactttctattcacgctactcatctgccattagttgagggtggtgggctccacaggttgcatccccataaagctgaccttgcataatacacaacccccaaatcacaatgacttaacacaacagaagtttaccttttactcgtgagttgcaggtggggggcttgcttgttttcatcactaactgctaaggagacaaggacgttattctctaccatggacttggaggagaaggagaatggaaataactgtaagaaaccctgttcattaccccagtgcctagtgccttatacaattgaagaacattagtcatcatcatattcctttccccaacaattgacaccattattgaagtttgcctatgttcagatctgtgctcattgctttatgtgcggtatctcattgaattttcacaacagctctgtggcatacagggcattgtaaacctccttttctgaaatgaggctcagggtaattagtaacttacccatcatctcacctagtaacttacagagctgttttgatccctagtttgcttgactccacagcccatgacatgctacaagtcgtactgaaataagtcctctctgtctttctccctgaggatctctcaaagtgcagtggatgtaattctggtgtttcacaacatgattttacatagcatacgggccaacattttttttctttaacagttgatatgtatcgtaatgtgtatgtgaaaaagatataactcgtggcaaaatcatgatctaatagatgttattgcttaagttgaggcttaactgaatttttaagtttaaaaatagtcaagtttttaaattaagtaaatataatagggaaaaacatgaaagcagtacacaattaatggaggtttgaaaatttgaatcttttcacataaacaatccatcaaacagcctaatatttactaagattgtctgtgggctagagaatactttgacatcacccgctttgggaagtatttatcatcccttccttttaatgcgtcttcaccccaatggttaagaactttcttttctgtgcttcagaagtatcttgtatagtttaggaccaatcacattgtatagtagttacctaacatgtctctctttcacaatagactatgtaactttcatgggattttattaatcttggtattttcggctactgatccaaatagatattttacaataaaatcatggaacttacctaggtggagtatgcaatgcagtgaaagagacgaacatcgcatcaataggattctgctacaagtaacaaggaaaacatcacattcaaactggtttataaggaattactggctcatgtaattgaaaaaccccaaaatcatgtatacatcagggaaggcttgctctagcagctggacaatatcaccaagaaggcaacgtccttctgtctcctaccatttcttgcagcctcaagacggcagctagaagactctagagttataaacttcctcattcatatccaacaggaaagagaaagtgtctttttcctgtctttcccagcagttttgtagacaatcactgggaatagaccaccttatgtcatataccaagttcccaaaccattacccgttttcaggggcatgaagtgagctcattggcttggtcaaggtcacctgctccactgctagtcctggaaagggggtctgggtttccagaattctgcagaggatctgaagcaaaccaggggctaacagaagggggagggcaggacagcagataacaagaaacatgaatctgactccagtgaactggaagcattttgtaactagcattgaatgcccctgtgtcaccttgaaagtgatgactttgcctttgtcctatcacaggtcaccactgcctttaaatcagattacctaaaagcaatgttgaactttaacacatctttccatatgctgtgcttcccgtaggcaagattttgcatttgtgctattttctccagccccttttcctggtttcattttgcataccataaagatcatgagaaagcttaattcaggacacaactcttaggttctcagctctacactgagatcctgttttgtttcaccttgctaaaaacgtcttgcccagtttatctttcaattcgttttctggatcttcgtccaatttaaaaatatgttaagattatttttagatcctagtcattagtgctatgagactgttttcaaacagatttattcttttctctcatttgctcaatatttgattccctatttaaagtgcttttctcctttcaagctttctacaaatctaaacattgggagaaaaaaaatgagggaaaggaccaattctctatatttgtgtaattgtaagcaaaatgtgctgtactcttttctggccacttggcacataggttacaggtcatgaactatatatgaaggcctgcagttcaaatgagatccacagatctggtatgttcctcccagactgtgtttcaaatagacaagtgttagttgcctgggtttttttttttttcttttaaaggagacttcatttaaatttcagggtattttatatccaaatatagaattagagccttctttaagacttgatttgaaagcactgaagtcactatcctatatggcaataattgggtggagctttcactgttggggcttaccactcccactgtgactgctgggacaaggctcaaacttctgaaactctgtggccaaggagaggagactagctacagtttcttactgaggaaagggagtggtatcagggggttgggggagacccctgttgttgaatgtccagaggtggtgcctgtgatattgacccccataggtgagctcgtgtgatgtaatggtcaggtcttggcctttacgtgaatctacgtgaattccaaagtggtgaatatatattccaccactttggaattacatcctcgtgggcaagttgcctacttcctccaagcctccgttcttgtttgtaaaatgaggacattgttacaatctactcgtagaattgttttaagaattaaatgaatccatgagttgagtccacaaagcattgagcacagggcttgtccagtggagaaagtctcatgaaggttggttatcactctcttcctgtattagtctgttttcacactgctataaagatactacctgagactgggtaatttataaacaaaagaggtttaattgactcacagttctgcatgactggagaggcctcaagaaacttacaatcatggtggaagatgcaggggaagcaaggcacgtcctacatggtggcaggagaagagagtatgcagggggaaactgccacttttaaaaccgtgagagctcgtgagaacccccgcactaccatgagaacagcatgggggaaaccacccccataatccagtcattccccaccaggtccctccctggacatgtggggattacaattcagaatgagattcgggtggggacacagagcccaaccatgtcacttcgtcaccatcggtcctcgtgttattactacttctattactgttggtccattttaattttttattctcattcttcctttctctaatctcctttttctcagtctcatttcattttacttagcatggcatccttgtagacaaggtggtggtcaatatttgtatttcccagatggccaacgaaaacagccatgtagagcctaacagctgtatcctaactcgcattacaagctaggatctggtgttcacaaaaaaccaccttcgtttctgctgtttgtaaaaaggtccgaaaccactagcttcttgtggctatttttggccccataaagaggtcttggctcttgaaatactggtcacattccaattaaacagattgtcatttgccttcctgggccaggggtgaatatcaccacttacttcctgcaggaattgccaagagcaagtgggtctaaatggggtgcacacccactgtgaaactgaatagccaaaatccaaagaccagggatagcctcaggtttacactgtgatactgtgtttctggataaagaatctgataaaaataaaagaagctgctgtatctctgtcttctacctggagagaaatctccacagtcttccaattaagaccataggctccggaaacagacctgaactccaacctcaggcacaccacttaccagctatgtgacctcaggctagtattaaccctcaatttcctcatctgtaaatggggaactatattaatgtctaccttttaggataagtgtgtgaatgaagtaaggcttgtaaagcacttagcataggtctggacagagggagctctacacaaacatttgttgctgttatgactgaaacaaatggtggaccaaaccatggcagtttaacacacatttatatctcccccatctcctttcccagcccttcccctaacgctgtggaatagcacttggattgaataaaggagggaaaatggttttaggacaataactgaataactgaaccactttggatttttttctggggggaaggtgtgcaggaatttaagcagcatcagcctcacctaggaacttgttagaaattcagactctcagaccccaccccagacctactgaatcagaaaccatgacaatggaaccacgtgcgctgtgtttagcaagcctcactggtgattccaaagcacactagtttaagaaccactggtttaaatggaagttggaactccgctgatgctgaatcaaattgggtttgccttctttcttcctttcttcccctctacttaacaatgcctgtgtcagcctatttggaaccaaatttctctgtctcataatggaaagaaaaagcatttcttccaataatttccccttacgataaatatgcatctctgttttttatttttcaaaagccccagaaaagcgtgatgtgggaccagcctttaccaactccagcaggaactgatcataagtccaatgaatatattcttaggaaggacttgtcctaattatccactgcaggttcatcttactgtgtctctacaaccaagccatgtgctagatggcaagggaggaagctgtatttctatgttaagtaacactgatgtatccagatacttggtttttaagtagtaatttttttttaactttcaggcaagtaaaagaaacaaagtatcactgaggctacttgaaggaatcttgggacctgagtatgtttattaagtatttttcttctttcttcttccaaaaagaatttgaggagatttttcaataaaagagataaaatcataaaagtaacatggtggagggacaaataggggctcataatgaaggagcagatcagttgtgccagaaaacctaagctaagaagtgctactctaagtgactgcaaaatgaaactcagaggttcctggctgcaaaggcaaaaagagaaacaggatgagtcacagagcctttgttctctaacaagaaagcagatacattcatcaggaaagaaaaactatttcctagcactagactctaagagaaatttatcgtggagtcccttacataaggtacatgagtatgtatatttaacacagatctccggtgttaaccgtgggatttatctgtcttttagggaagtaaatttcagagctcagcaggttgacagtgtctcttcaaatttacagtgtcaacgtgcagtaaactagctgcttcccatgccacgttttactggaccgtctatcaatatttgatcaaattgggccaaagtttcaaactgcccttaaatttacccagagaaagtgcttgtacatgcagaatgcctgagtgggcttcaaaattgagtccttgtgaacgggaagcatcttttaaaaatatatctgcaccgtttgctcaagtctgaatccttcctaagaatgcttataatgtaaatctatctgcaaatccatagttgcccataaaaatgccaagcacatggcttgtttctcccaggtatacagacaataatttacgtgtaatcgtgtctctaattgtatatacatctaattgtacatacatctaacatgaataatgttattcacagaacatatgtggttgactaaaataggagttcctttgtgtgaacctaaaggattgattgagatgataaaatatcatcgctgctctgactacgtctttgatatttgtatggaataattacatgaataggtccaatggttttattaccatggcgatgcattgtgtgttattgcttctcttcttgtctaaactggttttccaggactctgctggaaaatgcacctctataatcctcagactacccccccacccagatctgctcctgactccatataaaagtaaattcttatcacctgggaatgtttttccttcagcctaaaacagtctctgttccatattcttgaaatcccaggatggaagtcttgcttgaattatagaagtcttgctggttgaagcattgctacattttttgggtgtattgtttcaccttaatatataagatccttttactgtccaacatgagacacttggaggtggtgttcatggcctttcaaggctggttcctatcccatagtcagagatataatctatagagcctttaactcaatgggaaatgacagaaattgcagcgggaagcagaattttatccaaatgttcttcctctgaattgttaagcattaaacctcaacattaacctaaatgttcagagatagttctttcctaggtatgtggaatattaaccaaatggttttggcaatttacatttttagcctctacgcaggagtacattccatttagaaaactagatattctaagtggtggaagatgtgacagaggcgttaatacttgaagccatcatagttcaagttgtagtttcagtattgtgctttaactcgttttttgtttttttttttgctttttgttttttatgagttatcaagttatcatgtttcaaataccatttttcttccttatagttaaaaacaacagcagccaaagcccttgcagtgaatattttgtgatattcaaacctgtgggaaacaggaatatcaaggacatttttctttcctggattttctagtattttgaaaattttgtgctgtttataaacaagcaaattgtccactgaaacgcagcacaccagtgagcaatctttgagcagtgtagggaatctgacttgagcgttttcctgagtgccctctgtttgcaccattagtgttaaatgtctgtcagcctttccattgtagtcactgtttttctgggatttattactcaactctaaaaaccagctccaggctacaaattgccataaaggggaggtcatttttttcccctattgaagtagtgtgggtgggaaggagaaaaagtattcattccaccctcttattttttttttgagtcaaaaaacaaaaaagctgtactcataaccagagtgtatggcttgatattttattgaaataaatatgtacataaattattatcttatcttaaaactgttggatgatgttgagagattattgttagtaggtcaagccaaaacttgacgttttcaggggaaaccaaatcatatgttctgcttttaatctggcgtttcctggtttgtgttttaagggaaatgtccttcattggatgaacctttattttgtgccttggaaccaggcatacgtgataacaggatacataaaaggtggtaattgtccctgacctcaaataattaatggtctaggtaggagaagaacattaaaccatggtttcctaccatgtgcacttgctcttgcagattttttttattattatactttaagatctgcagtacatgagcagaatgtgcaggtttggttacataggtatacacgtgccatggtggtttgctgcacccatcaacccatcatttacattaggtatttctcctaatgttatccctctcctagccccccacccaccaacaggccccggtgtgtgatgttccccccactgtgtccatgtgttctcattgttcagctcccacttatgaggaacaacatgcagtgtttcgttttctgttcttgtgttagtttgctgagaatgatggtttccagcttcatccatgtccctgcaaaggacgtggactcatccttttgtatggttgcatagtattccatggtgtatatgtaccacattttctttatccagtctatcattgatgggcatttgggttggttccaagtctttgctattgtgaatactgccacaatagacatacgtgtgcatgtatctttatcttgcaggtaaattttaagcatgcaaccctaaaatatgtatatcgtgtgtaaattatatgcatatgctactgtactagcaaaaaatgtgcttcattaaaatgtgtacaaaatggaaatttgaaaagaattagatataaaaattaagtttatgtagatagtattaaagactatatattattatatattttatagatatgcataaatattatttatatgtaaaactccatcctatttgctcatagtatttaaaaaattctggcttttaatttttttaaacattttatagtaagagcaaacatttaatatggttcataatttttgaagatcttggtttattacttcatcatatattgattcaaagatctggttgtcaattattattattatgtttagtgacttcatttaaatggctgtactagctgagatataacacaaaaatgcatgagttcaagtggatccaactaagcccagatgatgaagtccatgtatccagttgcataggcacattgaagctgcccttcctggaaataggctgagatttaaggaaggagccaaggatcacatcagccctccaccttgatgaacttccccgccccacccctgggtgcctgcccccggcagatgacaccttcacatctagaacaagtcaggacaccagtgtcaacctgtattttcttactttcagataaaaattactatttcttacctaaaaagaaaacacaaatagatataaattcaatttcttatatgatcttcctgtcacaaaatgaatcctctcttgaactctctgcagtgcacacaggcccccaaagggagacttactaaaatgtaatatgagcttccaattctctcctatttataggatgaccctcacctttaggagctcttcgactgccagtgatactctttcagccacccccacccataaaaacatgtagttctctttcacccagacagtagtccctgagaaaagcgacagaagtagagcccgttaggattgcaggaggctgtggtatggcagtgtctggctggtaggtgtcccatgtacccaacaagtgctctttgtcatttgtttttcctctctaagcaggaaattattcccaaccctaagttagtgaaaccaaagcttcctcttcccaacacacacacatacacacgtgagtctgactgcttgaattcagaggcaggttccatgaatggaaccataactggagctggtttgagaccaagtttataagaaacaggatccttctcattgtgcctgccctcctgtgacctgtctgcaagctcttctctatgtcaggccacctctggccccaactgtagccccaagatacctgcaggaattgggataccaaggcatcctctcatattcttttttttttttttctctgagacaaggtctcattctgttgcccaggctggagtgcagtggctcgatctcggttcactgcagccttgcctcccaggttcaactgattctcctgcctcagcctctggagcagctgggaccacaagcgcacatcaccacgtccagctaatctctcatattctttaaaaaaatttttttctaagacaagccaacaaaacttctatagctatcatacatccacaaaaagatgtttattgtggcatgcttagtaaacccatgcaaataagagagaaaaatataactgtcacatccacacatggtatgctgttaacattttgctgctttgtctttctgtacatttaatgcctttttaacaaaatattattatacttaaagtatgtactattttgtaatatccttccttagttaatgatatatcttcaacatcttttcatatttttaaatagtgctgtagaagcttagttttaataataaaatcaatttcaggctgggcgtagtggctcatgcctgtaatcccagcacttttggagatcgaggtgggagaattgcttgaacccaggggttcataagttatttatgtatttatgtttataaagacagcgagaccctgtctttataaacataaatacataaataaacaacaaaaactacatttcattaaatagtactctaatgtactctaatgcattaagtcagttcaagttgtttgcaacttttttgctatcacagccatattctaatacaaaaaaaaaattgcagctgaatatttgaatacatctatgattattttcttgggataacttccaaaaagtggaattactgagccagagctgtgtttatgggttaggatgtacttttcatttttattttaaaatatatgcatatgtatttatacatgcatatgtacagttcacatatacacatacacacatatccatatatgctcatatatgtatttatgtatgaagcaaaatggtttcatccaataatacagttctactatatatgctgttagagcacatgcaccttatggtactttatctaatcttagttgttgagaaaaaaatcatttgtcaaggaaaatgatggctaaccctgaggctgaagtaccagatagtggagaggggaagggatggtagaagaggatggtatttaccacataggaggagtgacaagtagaaaagcctggaattggtaaaagacgctgcgttcaaggtaccaacaaatagttctgtttggctggaatgaggatagaagatagatgaaagataaaaggaaagacccctgctgggtgcaggggatcgcttgagcccaggagtttgaagctgcaataagttaagatcgtgccactacactccagcctgagtgacagagcaagacttcaactcaaaaaaagaaaaaaatgtagagaccctgaagggacttgaaacccatactattgagtttacaccttgcgaacagcacagtggggctatggaaaatgccatttaaggagaggagagggtggttagatattttttttaaaaaagaaaagaatcccagtggtcaccaggtagaaacttgattgcagcgacacaggactgcagtcaggggaaaagtggggcactgctgaagttatccaggagacggggcttgtggttgcattggaggaaatggcaggacatggaggcccaggagctgatttcagagccattaagaagcagcatctacagagtgcaggaaatccagtctcttctctctgccttgggctcaatttgttgggaaatggtggtggtggatagcagacatgtgggtaccaagtaccccatatgatagaataagtactggagagactgagctgatccacacatgaaagccacactcatggagtttccccactacatcccccttcacctggatggattttccaagcagtgctgagaataacaaaggttcatcctcagaatgaactccttcaagcatcacatccccgatgtggccatctttaaaccatctccttgtttcaattaagagcaacagcaatgtgggccacagaacccggtggcgggaaccctgggctttgtttattgcctaacaccttggcaatgtttgatgactcgctgctcctgttggttgggaatctatttctttgccctggaaattgtgacttctagactgaagatgaaagatggactttttctctttgctttgtttttccttgttggttagtcactttcattcaatgtcatgctttttggcggaggtggtgccttaagatcttggacctactgagtcagttggggcaggtttctcagcagtttcctcagtgcctgccggattgtgagatgtgctggagatgggaataactttttcacactttacatgttccaggaaggacttggtggtgagtgaaatggcttcctctggcctgcactctggagattacaccatcttctagagctgggttcattaactcagatgtctaaaggacccaggcaagttacacaaatgaatccactgacaggtgtaatataatggtgatgtggcaaggactgtgattaactgaacagttcttggcttttataacagacacagctatgacaatgtgttgctagatctctcaatttttttagttcattcaaaactatgcttttctaattggatacttacaaaggaatatgggtaaaacatacatgtgaattatcaagcatactaatactatgagcacctatcaacctatctatttgaactccattcaaatagaacattgtaagtattgttcaggtttcttgagtgagacccccaatattacacacctgccatctgcagtagctgctgactaaaattgaatgtttataattccctcgttttcctctatagctttaccacatgggtttatatcccaaaacaaggtattattgactcattgcacatatacaaagagacaagtacaaaaatattcagtgaaattatttgtattagcccagaaattttcattaaaggagaatataaaaatatattgtggttttaaaggcataaagatgggctaggcgcagtggctcacacctgtaatcctagcactttgggaggctgaggcgggcagattatctgaggtcaggagttcgagaccagcatggccaacatggtgaaaccccgtctcaactaaaaatacaacaattagctgggcgtggaggcacgtgcctgtaatcccagctacttgggaagctgaggcatgagaattgcttgaaccctggaggtggagattgcagtgagctgagattgcaccactgcactccagcctgagcaatagagtgagaatctgtctcaaaaaattaataaatacggataaaccacagttatgcaattcatatggatggatgttggaaagatgtgtggcgaggtgaacaagcaagttgcaaacgtacagtatgatcacattttgtgttttataaaactcaaagtgggaggagctttcctttttcttcaaaaattctagaaatttggagtttttttgatatctcccaatttttttcatattagaaagcaaattatcatattaaaaatgcctatgactgccaaataaaatctgtctttggatgatatcctgtgagctgcatgcttctgacttctgctctaggaacttagatcaactcttgttttaacatctgtgacgcacctactatatgccagttccttatatttcgtcatttaagcctcacaacccctcaatagggcagaaattattattagttttagtcccatcttatcactgaggcacagagagaggaagtggttttcccaaagctataccaccaggaagtaccagagctaagatttgaaccccgccactcagcctcaaaaatcctatttgtaattactgtgctaaactgcctcttccctcccacctggtggttgatttttgctgaagatgtgtatgtggtaaattcacagacgacactattctcaaggttttcagtttccctggaaatagagcactgacttaaaaaaaaaaaaaaaatagtcaacctgggttttgcctaacaggaaattcacagtttcatctttcaaaaagaaattccgaactcagccaagaagccaagatcaagcacatcatggtcagcaagcatcaacagaaggttttaggttgctgtatggagtctctctggtctctgggtcaattttttatatcatggttgccctttataatgagggcatcaattctgatgagatatagatggagatattcttaaataggttacagtatgtgaagtttctgaagtcaatggccattgtgtctctgaaataaaaatacctttgtttcttctggctataaaaggaatacacatacattgtaaagtgtggaaagaaatttaaaatcacccacagatatcaccactggtaatatttggactacagcctttcaaaagctttttcacatagagatgcgtaatgtaaacattataatcatatagaggatagcgtaatccagtagagttttacaatcttttttttcctgagtacttaaggagaatatctttttccatcaacagataaagaaacacgtaaaaattttaaatggtgataaatattccattgtatggataggacatatttatttaacctattaacttcgccttattgctgaatgtgggctttattttttttaaaatttctttctattctaaacaacactgagatgaacatccttctatttgcatctttgcacacttgtctatttttctttttgggatagcatcccagaagtagaattgccaaaattatgcctgtttaatgcttttgctacttattgccaaatcaccctagaaaggataatttattgacttgcacataaagggcttgcttaatgggatttgatattcacaagctttgaaggtgctatcgcagcctgtcatgtctggggcctggaggtcctctctgatgtaaatcaaaacatttgagttaacaacattcagccttgtcagtcacccacaaattataggaggcctcctctgtctttgtcaataacaaaaaagggaaaaattactccaaaatggcataaaaattaggaaccagacaagtagtcaccaaaagaagacaagtgagacaacagttgaagaatttcagatttgtagtggagtgcagcaagtgaacaggaattgtctgggtttatagagaaaggcctgtagcatctgactcctgcgtgcttggtgacagggtcagtagcacagagctgggcacagagaagtcactcacacagacggcaagggtggaaaagtgtatagagggttgaggagcttcactctgtagtgggagggtatgatcctcaacagcagcagaatgttaatttccttaagtcttaaatcttgccctgatatggtatagatttttctctgcaactctttcatattttcagctcttgcattctgtagcaccacatgggagaatatgttactcaagagaaaatttttagtgatgtgtgttttgtcttcatttctgaaaatagtctcagttgtggaaaggcaagtaatccatgtgcagcatgattagggaaggaaggaaagaaggaagggagggagggaggagagaggaaaggaagaaaggaaggaaggaagataggaagagagaaagaaagaaagaaattcaaagcttgagtctttaaaatctttgcgtctctaaaagaaaaggatttagttatgggtctgatgcatacagctggtatttctagcaactagtgtgggcttcttttttctgctgcaatctattcattctgtgcatcttaccacaaattgctccaagaggaaacacagcctccttaggaggctaaagtccaacgaacgtcagatccagaacaacattgctttgcgtctctatttaacgttagagcggatgactttttgacacgtttatagctgacgagttctatagccagtcatgcaggacgattacgtttgaactaatttgatgaatcaacttgatgttctcccatagcccccataaccttcaggagcatatgtacccaattttcaactggaagtcaaaaagaagctttgaaatttggctaatcccatcatatccgcaggacccgtctggtggaataatcttgggacataaactcttgattgatgccaaaaatgggaagaaccacttggtaatatcatcagggccatcagtcaggcccttggtaggtcttgagatagggtttcagaggccagcgattgttttgtgagttcttgaataattttgtggtgagggaagcagagttcattgtcaaagcatttgggggtcagaccccggggaaaaatcatttctcattgttggattcagtttgatggggatttgtgagaaccgatgaggaggcgtaaagatttcctgagttacttttccccatgtcctgatttttttttttttccgactcctttcttgccaggaggcctgctagcatagtcattcagagcatgagtgtgggagtaagaatgcctggacataaatcctgcccttaccacactcccatcattgcacaatactgggccagtcacttcacttctctgcaacttgccttgctctgtgaaatgtagataataatcgttcatacccatggggttatactggaattaaatataacagtatgtacaaagggacataaacagtgcctgatatataagctttcagatactagaagctattggctatagactagtgaattttggtgactttccatgcccagaaagttgatagaacttgattaatccaaacagattaagtaagtagatgctatgatttgaattcacagctggtattattttttccccaaaatcgttagcaaaaagactattgtgccatcacatagtaaaactgattcttgctatcgagaatagtccttttctacagctgagagttactagtatgtggaaccggctgaaagcaggtggcttgctacatcataaattgggttggctgggtacttcatgtgttcattccacccatatttatcgagtttttcctactgcatgccagtgtcaatgtgtgatgtgaaaagaggagaatattttggggaaaagcgaacataagctctaccagtgactacctatgtaagcaagtcacttaatcactctgggccacagtatcttcatcattaaattgagataagcatgatccgccttctaacgtctcctgcaaggagcagatgggattgtataatccaagggcctaggtcagtggctggcacatagaaggtgctcaataattgctgtttttatgccaggaatttgttttagtcgccctctgcattgattgataaaaagctttttttttttttttttttttttttggagacagggtcttgctgtgtcacccaggctggagtgcagtggtgtgatctcggctcactgcaacctccacctccctggttcgagcaatttgcttgcctcagcctcctgaggaactaggactgcaggcatgcacccctaggcctggataatttttgtatttttggtggagacaggatttcaccacgtcggccaggttagtctcgaactcctgaccgcaggtgatcctcccaccttggcctcctaaagtgctgggattgcaggcatgagccaccgtgccctgccaaaagccactttttaaatagtaagaggattttggcagccttatagactcagatatctggagagcgtagcacaggacataggacatattatattctcgataaatacttctcgaatgaatcaatgagtaaatgactagcttgagcttactatattaataatacactgtttactagtaaatcaacacgtgggaaacaatagacagagacttgtgggagcatggactttgaagtcagaactgggtacaaatcaggcttggaaacactagctagatgcccccttggacaggttacttaatttctctgaggctcagttttctcatttacaagttatttgtaataacagctgcattaaagggttgttggcttatatatattatcaatagcttttattatagtgctgcaaaataaggtgtctgccccatagaggtattgaaaatctactcactgggcatctactttgtgccaggcactgggtactggggataaagagtgagcaagacagacaagatccctggcttcagggagatgacgaactggtgggcaggctggacaataaataaccatgatgacttttggtgaaatagaatttccaagaagataaaatagaataatgtgtttgtgagtcggaagttattttacaggaggtaatcaagaaaagctcctttgaggaaggaacatgaaaacagttaccaatgagaagaaggacccaagcatgccaggatttgagggcgagggcttccaggttgagggaacagcaagggcaaaggccctaaggcagaaatgtttgctccagggttcttttcacaccacaaacaatgaagagaatggcccatggtaaagtccaagatcctcaagagcccactcctgcaggatcttataggtcaggataaaatatttggattttattctgagtgtgatggaaacgattggcagggttttcacagctgggtggcagagtctcacttccttttcaaggtggattactccagcagctgtgaagattatagagatcaggatagcaggaaggcaagtaaggagactcctgtctagaaagagataattatcactggaacaaagaggatggcagtggtgagggaggcatgaacgacttaggacgtggtttgcaggcagcaccacaggatgtagtagaggtgaagcagagagaaggcacctggcctctgtcagcccacacgactacaagcctggaagcctcaagttgcatttcttattctctggttgcttctccactctcctctgtgatttgctgctgggtgccttgatctccatagcaatgagtcctcttttctcctgtgagactgatctggggatcaggaacctcacctctgactcccagtagaggtgaaatcagcagtggttcaagggaaagaggcaatgcagcagagactgatttctgggatgaggttttttgtttttttgttttttagttttttaattcaatatttacatgggtccacttagtgtcataaaaggttttaaaggaacttgctataaaaactcaagaggaaattaaatgcaaaccagtacacaccagatgcaagataggaatcaagaaatatagtgaatatttcctgtggtatattaattaaaatattatttccccgtaggaatataataggatgccatgatctattgatttatttattcaactagaatttgccatatatgtcgctccaagctggatatgaggaaagggaggtagataacagtccctactctcagggagctttcagtttaatggggaagacaagtatcaaagaatctctataaaagaaagcagagttcattggtttcatagcagagagtagctatttgtgtagcagcggagtgtaggtgacagacacattaggatcacttttatactacaaagattagaagtgcacatcaaaccattagcatcagatagatattcctgactgaagacctattcataagtgtatattttttatacatatttgttagaatatcagtgattaagaaaatatacacatattattcacttaaatataaaatatgtttattgatctttaggaaagacatttcacaaataatccttcaatgccatattaccaagtaaaattttcctctaactcaatgactaattccgcttctcgaccacagaaaaaggttgaatatgctattgtgtgcagagcaacaaatgaagtaaaaatttatgatgtacccacttaatttgacccacatgtactcaggatttcacgtgaggcttgggagttatttattccttgctgaaatgattctattctcttaccttgctttttcttttctcaatatgataaacattaattaagtatctgctttgtgcaagacactgtgatccgaataagcaagtcatgttctgtgatgttaaatgttataaaaataacttttattattcatattataacaggaaatttacattttgaatgtacctttaataacgtgtatgtatatgcacgtatacatacacacatatatacacatatgtattagaaagaaatagaaacacatatacatacacacatatataaacacatatattagaaataaatacacatatatattagaaagaattagaaataaaagaagttttaaaaagtaaaaatgtattctacattttattatgtatatcatatataatatagagaggttgggtttattgcattacacattatatattatatatgatatttataatctgtacataatatgtgtatgtattactatgtatatgtatgtatattatatatgtatttataatatatattatataattatatatattacataaagtatatattatatattttaaaagcatgtaacaatacatattcatatataacaaacattatttcacataaactttatattatatatgtgtagatagacatctctttaatggaatcatattgcttatatttgctgtaattttgcttttttacttagtttcatgaatatcagtttagtcattaaatattcctttacattttaatagctgctgaatatttcactttttaagttgatagtattgtatttaattatggtattagtgcagtgtattagtattataatcctcctaatgttgcatttatttattttttccctgatcatttctgttatgaggaacatcctgtcagttaaataagattctttccctatgatgaattttcaggcgccgcctccgaggtcggggcttcctgataattgccagtgtcacccttgccaggtcactcaggcacgggtcagtgagcgctcaggaagcagaggcagaaagggctccacgtgtgctatcactagtcagattattctgcacacaataaaacattcttttgtacaaaagtgaaatccctaagtcaaactgtggcttataagcagaaatcctggttagtatttcaaagttctcttagcgttttctcctgcgacttaaaagacttaaaaacgtgaaaagacatggacctaagactccaaacaaaaatacatttctttgaaactaaatagctcttaagtaagaaaaaattctatagatcttcaaatcatcccctaagcaaaatattctctaattaagtatttctgtatttccatctatgttcttcccaggcttggggctgttgatcagacctatttttacgggtaagtttctaggggtcatagaagatacagattttgacctgcttaatgtcaagaggttgcacggttgatttgtccagttgtgaattctatgaatgaagctttttgcttaaataaaacgatattcccctctggctgctgtgagcaccgggagacttgtttcggcagtgcctgggtgctggggcagggccggtggccctggatcatccgctaccaacaggacttgcctgtgtgcatctggtccaccctctctccacacccaacttcatgagatgcacaggggcctgtgtgcagagcagggcgagtctgccaggacagaatgcctgggtctgcttggttgggtctccacatgcgctcaggtaaatctcagtctgtcgctcatgctcgtattcactgtgctgacaagctccaagcttggacagcgtgtttagtgtaccgcaggatcaccttcggggagggaacgacagcctgcccggggctaaaagaaactgcccaacaagagaatcgcttgaacccgggaggcggaggtcgcagtgagctgagatcgcaccactgcactccagcctgggcgacaagagcgggattccgtctcaaaaaaaaaaaaaaaaaaaaaaaaaaaaaaaaaaaaaaaaagaaactgcccagaatttgaatgttgtacttgaaacctgcttgatccttaaagttcatttctagtcatctccatcaataagcctttgggtttgagaagcagaagcttactatcccagctaacttgggccttacaggaagattgggtttctcccctggggaagagtggagggttgctgtttacggcctgtctactcctaccaagcactgtgctaggcatgatgaatgcctttcctgctgaatcctcttctcactaagagtattgatcatctccatttcacaggagaaatggatctgaaagtgatgacataatggctgccttttcttagaaaatcccaaaccctggcccctcctttaggtgcctccccaagctctcattctgtctacttctttaactttgtcccatgtccagcctttccttcctctggctacaccaaccgctttttaacacatgttgcttaacacatatttaatgagggtctacctgtaccaggtgtgaataaaagagcatccagagagataaaggtactgactgttgttattgagagatactcatgcagacatatgtatttgttagaataggtattctaacaaagttcttctgggtccaagggccttttcacttcttgttttttttttgtttgtttgttttgttttgtttgtttgtttgtttgtttgtttttgagatggagtttcactcttgttgcccaggctggagtgcaatggtgcgatctcggctcacagcaacctctgcctcccgggttcaagccattctcctgactcagcctcccaagtagctgggattacagtcatgcccggctaattttgtatttttagtagagacagggtttctccgtgttggtcaggctggtctcgaacttccaacctcaggtgatccacccacttccacctccctacacttttcattcctgccatctggaacccttctccttcttggtctacacatggggggatgtgctttctcaccatctcagtgacttcatccactttggaacctaccccgatcatctgattaaaaatactccctgttcccagccatccttgatcaccccagagaactttccacactcttgttgttctttaatttgtctacatgaatatttctcaacaacaagtgtcagtacctttttctctctcgatgctgttgtattcacacctggtacaggtagatctttattaaatatgtgttaaccaaataaattgaacaaatatttataggcctctttctgtgcacttgacactgctctaggcactggggatacagcagtgaacaaaacaaataaaaatctctactctaggagggaaagacagatactaagcaaaagagtgaatagttggtcaacatggtgaaactccgtctccactaaaaacacaaaaaattagctgggtgtggtggcaggcacctgtaattccagctactggggaggctaaggcatgagaattgcttgaacctgggaggaggaggttgcagtgagcagagattgtgccactgcactctagcctgggtgacagagctagactccatctcaaacacacacacacacacacacacacacacacacaccagtgaagagggccggctgtggtggctcacacctgtaatctcagcactttgggaggccaaagtgggcggatcacaaggccaggagattgagatcatcctggctaacacagtgaaaccctgtctctactaaaaatacaaaaattagccaggcgtggaggtgcaggcctgtagccccagccactcgggaggttgaggcaggagaatcgcttgaacccaggaggcggaggctgcagtgagccaagatcgagccactgcactccagcctggagacagagcaagactccgtctaaaaaaacaaaaacagtgaatagttagttaggacctcagggagagatgcacagtggtggtggggtaaagcaatcagcccagagacgaggcctgtctgacaaggtgagacctgaatgaagtaaaggagcaagtcatggtgatgtctaggagaaacatgttccaggaagaagcacaaaagtcctggggcagagtcatgttggtcaatttggagccgcatggcacctgtgtggctggtgtggagggaggagggctaaatcagagggcaggtgtggggtaagtggtgcaaaggcttgtgggctgtgctaaatatctcagcctttggtgtcaaatgcaatgggagccatggaagggttttgagccaaggggtggcatggataaatgaatgaggttacacaacttgagagcagagaagctgggatacaaactgggctctctgagtgcagtttgctcccaccccgtccccccacccatcattgctgcatctgtccctggccacgtgttcttccctgtgcattttatcatcaaagtgaggccttagcctttcacggaagcctggttgtgggggcttagccctgacctggtggcagggtccattttgttttgtttttcctgtttgtttggggacttagtgtccacccttggacccaacgacccttacccaggtgcggtgtcttccagctgatcccacagtggggcccaggttgcatcagctcagccttccttaggcgcagcatttgctccctccccgagtttgacaccccacagcctggcacggtgccaagtatgagtaaattgggctcagggttcctgttgttcctattcacacagcagctgctttctttaccgtgccatgaacctgatctcctggcattgtcagtcagccctctcttctcaggtgccaaggggaaacgaaactggttagtctctgcaggaagctgagccgtctcctaagtgcccacccggctccttgtgcactaattaccagacagtggactgaaccttttgcatattttattagtgaggactctaagtttcgagtgattggaaacccagtgggtttaaatcaagaagattaatttatggcccatgtctccaaaaggccggggaggccttggcgttgccaagttggacataagggctcaaatgactcatcagaattaggtcttattctttccatctctgctttcttctggaaacttctattctcaggacctagcaagatgccaaaatcagattacatcctaatatctcaataagcccagatttactttttaacatttctagtagacatctgggaattgagtctccatgcccagtcctaagcctgttgctttgcccagggaatgcagttctctgatccgccagttctgggtcacccattcagccctggagccagcctaggagtcagcccatgtgaccctccaggaccaacgacataaaggggacagtttctcaaggaagactagggtcaaattaccagatactggataggctaatataacagatgccaagtcacgctcactcttttagttaatcctcggagaaccctgtggcatagtaattatcccacactgcagatgaagaaggtgaggcccagagaagttaagctggccaaaagtatgcagctggtaagtggcagagccagcatttgaatacagattcgcctttctgcaaaatccatgccacgagtctcctgaaacttgaaagaaaagtgttaaaacaggatcgagatgatccttgatacccactgcctaaagcagccctactggcatgagctcattccttcttctaacttctttgaagcatttcaggtgaattggaagtctgttttccaggaaatctgattatggtggcaagttcctcccagcaagaacagagaggagcattctgagattttcctggaaggaaataagcctctcctacattgcagcatattacccaaatgtgggaaaaaaaaaacatatgcccatgacattctcttatataaatgtgtgggggcatgtttcaaaagcatatatattaatatcttctgtgtgtatgtatataaatataggtatttatccctctgctggattcataagcatcgagtgattcaaacattaattacaatctccttggtgagggaaaatatttttccttctatcatgttcattttaggatcatctgaagttcatctttttagagggtactgaatcatctggcaacacaatgttctttaattgttagattgtatacacattttggcgttactttttctgaacctcctactcccttgatttttattattaactgtgagaaatcacttcagtgtgctaggcatatacattcgtatatatacacacactgctattattatatataatctcaataaattctgacaatgctttgaaagaggcagtactattattgttattatggatgaggaaagtgagtttaaacaatttgcctaatgaaacatgaagatcatagggaatgatggaattgggactcaaatttcgagttctttcacttcagaaagtgaaagtcagttactcagcctcagaacaactgacatttatccatgctattaactactacactattatggaagtagagaagaaaaaaaaaaaaaaaacactggaattccaagcttccaaggctaccaaggaggctaaaacatctattggggatttagtggaaaatttgcggaaatctatcattgttataagtgcatatgtttcgatccagcaattccactagaaatgctggcacaaatgtgcaaggatgtaaatataaaaaatattcaatgcagtattgtttatagtagggaaagctggaaatacttaaatgtccatcactaaaaagtcagttaaataaattagagtgcatgattccagtggagtgcagtgtcactgtttcttaaagtaggcagaacctctaaatacaggcatgtggacaggtaaataagaaatattttaatttttttaggttggcaaagaaagcataattccagttttaggggaaaaaagttagcatctatgtctgcatggagacgggataaaggtgaatgtaaatttgattgtgcataaaaaaattgctggaaaaatataaatgaaactggtaacagtggttacatcagggaagtttttattctggggaagggatgttcagttatactttatatgccttatttatactgttctcaacaggaggtggttttgcctctcaggggacattaccaaatgtccccgtttttgttgtcacaactcagggagtggggtttgctactggcatctattaggtagagaccaggaatactgataaatattatcaattacacagaacagccctcacaatgtaggatcatcctgcccaaaatgccaatagcaccaagattgagaaactctgcttgtaaccctaagtgtctgagtttattataataagcattcattaatcttgcacttaaaaaaaaaatctctgaaacatagtctccattctgatacttgagtggaattattgctgctgctgccttcatagatcaaatcaaagtcacaactttaatactttggccatgtggacataatatactttttcttccattaccagaacaatttcttcattcgaatataggatttgtatatatttatctttcagtctcaaagataggcaatcttataatataggtcccatctcacagattaaaaaaaaaaactgatacctggggaagctcattgttttcatggacagccaatgccagctagaaccttggtaaacaaatttaatagtttctggaaatattaaattgcttaatctcaaacatctgtacttcgctggagactcaaagaaaaagcactgagctatattttcagttctttaattgggataagaggtaagtttcctaagtaatccttcattctctatgagagggtatgtactccatcattttgtcctccgaacagaaatacttcctgctcaccgggcattcacatttcagtttggagatacagggtgagtatcccttgtttgaaatgcttaggaacagaagtatttctgattttggattgtttcagattttggaatacgtgcaaagagcatccctaattcacatatttgacatttgtgatgctccaacgagcctttcctctgaacgtcatatcagctctcaacgtttcagattttggagtcttggatttcaggttttcagattagagatgcacaacctgtgacacatatcttctgtcatattccgctctgtagcgtagccatggtgtgttgggttttgacacatcaacattctgagtgcaagatgatactgagtgtgactggtgtggagtgagctgcgagtgaagtttctaatgaggaggaaaagtgtgctgtaaaatctgtcatggtccttgtgacaccagtagctctcacttagcaagacactagctacggccatcagcgtgtcagtggctccaggacagaaggaagttgctgagccaaggaccaagacttgaagtggcctgtgttaagcacccccttcaccaactctgaagtgtaagtcacagagttcttggaccccagccccagttccccaacctttaaggatgcagacagtgctgcttgtatgttttggggtgctttctttctttgtttgtttttagacatggggtctcactgtgttggccaggctggagtacagtgatgcaatcacagctcgctgcagccctgaactcctgggttcacgggatcctcctacctcagcctcctgagtagctgggactacaggtgcacaccaccatgcccggctaattttttgaaaatttttgtagaaacggggtctcacttttttgcccaggctgatcttgaactcctggcctcgagtgatcctcccagagtgctgggattacaggtgcaagccactgcacccagccctttatttttaaaaaattaattctcatatttgtcaggatgagataagttatgtggtgacaaagaaaaatccccaaatctcaatagcttaaaacaacaaagatgcatttaccactcacactccatgcccacagtgggtcaactgagggcttcttctgggactccagatgactagagcagccaccatctgacaccagcatggcctgcccctgtgagaagggaagagtacagcgggtcatacgctgactctcacagtgacgtcctcacttctggtcacatttctctcaaccttccgtgatttcaaaagggtggggaagtgcagccagaaaatacacatgagaatccaaaaggagaagagacccaggatatttgcaaatggttctagtgatttccacagtccactggtagttggtgtaaacatcatgtgcacatctgaattcctggatccttttgagaaatcacaggaccttgggacaatatgcatggtgtaggaaagggggcactcacgaatagtgactccgtttagacgagacatttccccctcagttcccaggctctacctatcctgattcattcacctaaggaatcagctttgtccctgtaggaatttggattggcaacttttgaattaaagtctaatccagtggtaacagttcacccatggagtcagataacctggcttcgaatctgggaaccacccttatggctgagtggatttcactctctgcacctcagcttctctacctatgggtagtaatcccggagggatgtggtgaggcataagagaaaatccatataaagcacttaaatgagtgcctaggacagagacaacacaactgttccatcatcgtcatctttccaaagtgccactctgcatgtacctttaacttacacacacaaaaatggggtcatacagtaagtgctgttgatggacagatattgaccagctctgctcctttctctgtatctgtttcctgtcttataaatcaaaagggtcggctcagaagctttctgaggtcctttccaattctgacattctgtgactccaagatccaaggagggcccccagattccttcttgagctttcaaagcattcccgatgtgtgctttagagtgggtctggacagtgtatctgtcaagggggctgcaggcaagaggggagacacgaagccaaactatgagacaagcatgggaacagccttaaccgcaagctctagccttgaacccatccaaagaacactgatgtgagccaactgtgcatatctgttgattaatcttcccaggaaatgatgttctagaaccctccacagccacgtgacctccgccgccaacatcagccatcatctggactggtcttttcatccagggcactcgatggtggctagcaaaaggacccccagcccatgctgaatgccaggatttgtatttttatcttgccctgcaggctgcctcgccttgagcaatgctgtgtgatgacagagatattatcaccctaagctaaaatattcaccaataacgagacaatgaaaacagttgctagaagtctgcggtgaatgcagagggagcaaactctgttaattattcaggaaatcctcttcataaattcatttagatttctgcaaatgagttagtatttgattaaaaaaaacaaaacaaaacaaaaccctgggaactcagcccaagcagtagagtaggtataggcttgaacaagttcaggaatcagacagccttggacgttcagccccatgaccttaaacaagtctgtgccccctcaaaacttctgttacctgtctacaaagtggggatgctaatactaacctgtggtgttgggaaggtggaactaacaggatgcattctgtgtacttcacaaaaggtctggctcatgagcccttaatgcatgttatgaacagggtaacttcactgtggctttcttattaaccatccctgtgtatcgctctaaggagagggcagagtctcaaggctattcatgtttgaatgaaggtgctggaaagagacagaggcgtaagggatcctgcatgcctcatatgaagacacatgtgaacacaaggaaacatggctccagtgttgcagctgcttctgatttttcaagataaattttaaaagcataatatttatttgaaacctcctgatttttaaatgttaacattaaacaatgccggtttggcttctgtaaaacagactctaactcttcatatcctgaaagataacatgactttattaaggtataatagaagcttgtttctgtcttatataaaggtctgatataaaagtctcggtaagtggttgagagctagcaggacacttcttggtgttgggatcccaagtaccttctctttggttgctctgccaccgtaacacaaggcttccttctgatggtccaagatggctgccctggattctaccattatatgcacattccagccagcaagaaaggaaaagcagtggaaggcaggcccctctttttaaagatataacctggaaatcacaaatattacctccactgacagctcagtgtctagtgcattgccacaaagctgtatctatctgacagaggctgggaaatgtagtctctattctgagtggtcaaataccaagaaacaggagatctatgagtgaaagaaaaaagaaacaaagctacaacaagtaattcagacttaagaaaaacactatgacaaccaagcaaaatacagtcacgggccattttggagcaaaaaaaaaccattctttactgaggatgtgataagagagtgtccttataataaaattcctgtgtgttaaaactactgctgccttcaacatcaaaataggttccatgcatggagtgcataccccatgcatggatgtggtgttaggtgctaaacatacatagattttcgctgactctgaaaacagccctgcaaggtagacaccgtcgcacttttaattggcagtggaaacggaggtcagaaggggagacgggatgtggccaagttagtaaacaggttcgtaagtggctgagtggcgatcccatctcaggcctgtctgcccccagcgccttttgtggtactctgtgcttgaatacagctggcgctgaccttcctctccgctcaacattctgcatcattctccatcttgtgcaaaggaggaactgagagccacagtgtcacaacatggactccagagccccagggtagagccgatcaaagacagcccaggacccattctgacttctggcctttcccgttgttctttgatctttgttttcataagttacaaattcctccacctacttacatttttaaaagaaggggaggagagagagagagagagagcaaaataataacttcttagccggaactgcttttcttcaaaatcacgaataattgttttcctgctctgtctgggaaggcattcccctctcatcttttgcccaggacttggcaatccactttccatctccccttcgcttgtctttctttagcatccacgttccgtgcaatccatcatcagagccattaccctcctcctgatcaagggtggaatggaaaagctccctctcccttcaacacctaccaccagctctttgatttgccgggcgtgggcagcaggaaagtttccggcggatgacctcagaccctctccatagagagccccaccagcagctcatcaccatcagtctgcaaagtgagaactcaagtcaggctctttggaaacagtcagcaaatggcttctagttcactcagtgcagaaaagcttttcttttttccccttttgtatgggattttgtgagtggggggttctaatagctgctcactacacacctccagccacccactgggcttgccagtgttctgtgcaacacgccctgcgtcacaggtttcaataacaacaaactctgcacatttttaaaataaaaataaaataggtcagagattcacccagctggccagtaaaccagggcaggatttctctcattcattctttattctaccgaaactgtctgaaactcagtcttcatgcctatgaaatggacagaataatcatatctatttcatgaggttgttgggagtattcattgacatcgtgtttgtaaaatgcccagaagcccttacaaagggcgtcaggccctttgtaagcaggaaaggaaagctggcttggatgaacatcggctattggtactgagctaacaaagcagctatgaggaccaaagaggggcccctaatcccttctctagcctcttttctcaccattccatgactccaattttgtgttctgacaatgtcagattccttctagtttccctcatgcaacatgttctgactgggcccccagctcctattcacggtgctcttccagtacgaattcctgcccccacccctcccgtcttcatggttaacatatattcaacctaaaactcaactgagaggtcacctcctccaggaaccattcatgattgcctctttacttttcccaagctgaggcacatcccatccccagtgacgtagggagtcttagtttatctttaatttgatttttcagacattttatgttttactgtcttcaccattaggtagtgccctccataaaggaagcgcttgtgtcatatatgtctttgaattcttaggattcagcttgggattgtacactgaaactgctgaaacacctctcagagtagacaaggaaggaaaggagagacgaagggaggtggggtggggaaggagggagaaagaaatggtgaatgaagcacacagcacagtgccctaaggggaaaaaaagcagcatttgaatcaatagtaggtactttaggctgggcagtggctcacgcctgtaatctcagcactttgggaagccaaggcaggtggatctcttgaggtcaggagctcgagactagcctggccaacacggtgaaaccctgtctctactaaaaatacaaaaattggcctggcttggtggtgcatgcctgtaatcccagctactccggaggctgaggcaagagaattgcttgaacctggaggcggacgttgcagtgagctgagattgtgccactgcactctagcctgggcaacaaagtgagactcaatctcaaaaaaaaaaatgtatatgtgtgtatatatatatatatatatatacacatatatatatgtgtatatatatatacacatatatatgtacatatatacacatatatatgtatatatatatatgtatgtatatatatgaatgtttatatatagtggctacttaaaaagtgttttgtgattggtatatttagttgttcttactactgctgccgatttactctcactgttgctaaccaaagagcagagttaagtctgcaaagaaagataccttcccttttcaatgatgaggttagtgtcttcacaaataaagcatctgataccttagtctgatacattagatacaaattatgactaataatttgccccattttccaagttttctcttgattgtgttgattgactcaataacgactcagctcctgattcagagatgaatcaaagaatgtcttgcccgcacggggctgtgagtctagatggagagacattcgtagggagctgtgtaatgtcagcagagacgtgtcataggaagactgatgaagcagacgatggagaaagttgagttgagttggttgctatttaaaaggggttgtctaggaagggtctttgataaagcaactgaataaagagctgaaggtagtaagtgttaagatcaaaggatctttataggagatccaaccacctccctctaaatggtagttcttggtgtgctgtgtgtaaacctcagagtatttgcagaaaggagataactatttgggagctgcgtgtatcaacatgttccagaatacataggatgttggtagaagccacctgaagataaaacagtctgttgattctggcaaaatagataaacaatatttactatctttactctagaactctttagagctttcaatagattaatacacattgcagatctccaagtgggaactagagcatttagtatttcctaacagaactccttattcaagaagcatattgtagctgggcatggtggctgactcctgtaatcccaacactttgggaggctgaggtgagcagattacctgaggtcaggagtttgaaactagcctggccaacatggtgaaactccgtctccactaaaaatacaaaaattagcagggtgtggtggctggcgcctgtaatcccagctacttgggaggctgaggcagaagacctgcttgaacccaggaagtggaggttgcagtgagctgagattttgccactgcactccagcctgggtgacgggagcaagactgtgtctcaaaaaaaagatattgtaccacttgtattcagaggaatgaatgtattttggtaaaaatgacttttgagtgggtaccaaatctaaagaaatattcttatcatattactctgtggcgcacgcacacacacacacacacacacacacacacacacacacaattcaggtggatttgcactggagccctgtaagtattcaagctcttttgctgtagagaactaaagaaaacatcaagatatcaagtagttttattgatttattccataatattttctggaacatattggcttgtctgagttacttacaggccttgccacctggcaaaaatcatttcaaattattgggaaaagagccacagaagtggaaaatatcaagaatatgggctccgactgcacaaggctggactcacacacaagccctgccaagttctcacacgagtctccgtttatgttgcttctaaaatggggtccagttgcaggacaaatttttgattttaatcaaaagaaaggtgcgaacccatagaacggacctttgcaggagaaagaaacaattgtggatggatgtgaaaaccgaggcagctgttgcttcacatagataatatgcccattaccttttggaacaaaattaaacatttttaagtgtattaagatacacataacattgcaatttatcatctggaacattgttaagtatacagtttagaagtgtcatgtatatttgcatggttgtaccaccagtctccagaactttttcatcttgcaaaactaaagctctatacccatcaaatgacaactccccattctctcctactccccagatcctggcaaccactattttatttcctgtttctaagaacttgactattttaggtacctcatgtacgtagaatcacgccacagttgtctttttgtgactggcttatttcacttagcacaggggtcctcaacccctgagctgcgggtcgctactagtcctttgcccattaggagccaggctccacagcaggaagtgagtggaggaccagcaagtgcggcattagattctcatagaagtacgaaccctattgtgaactgtgcgtgtgagggatctaggttatgtgctccttatgaggatggaatgcctgatgatctaaggtggaacagtttcatcccaaacctccttcctcccctgagccaccagtccttggaaaaattgtcttccacgaaaccagtccctggggcctaaaagggttagggtactgctgacttagcataacatcttcaaggttctgtgataacatgtatcagaatttttttcttctttaaggctgagtattattcctgtgtatgcatatactacatttcgtttagtcattcatctgttgatggacacatgggttacttccacctcttggctattacgaataatgctactacaaatacagtatacaagcatatatggctgtacaaatatctcttagagaccttgctttgattgattttggatacatacccaaaagtgggattatgcctgttagattgcatttcttaagacagctctattgtgatacaattcatataccataaaattcacttcttaaagtataaaattcaacagtgtttcgcatgttcacgtagctgtgcaaccgtcgtcgcggtatctaatttagaacatcttcatcaccccaaaaagaaacttcatatcctttagcattcacacctccttcctcccttccctgagccctaggcagcctccggtactggtagagagactttctgtctctatagattgacctgtttggggcctttcatatacacggagttctacgctatgtgatcatttgtgtctggcttcttccacttagcataatactttcaagattcgttcatgttgtatcagcacttcattcaattttattaccaaataatatttcatgaaatggatatgccacactttatttattcattcatttgttcatttgttgatggacatttgggttgtttctgctatacccattacttttgttccttgccaatgactgcatatctgtagcctcataacattcagaatttcccttttctctaccaaatgtgcttaggtttcagggacaaacaaggtcctctgtgaaaaggtagccaagagaacggtctaggtagcagacaatggattcattcccccaccatcttattccctccaaataaaaaaggaagaaaaagaaaactgcttccatttgtcttaaaagctatatatgtatgtatatgtgtgtgtatatatatatatatatatttttctcgatatctaatggaagagacttgtgctctttagggaaatcaataggagggataacaaccgattatactatgagaaagaaaattttaaaagactctttggaaatagcgcatacataaaacatttttgaactatctgcaaatgtagaaattatgcctcaatgcaagggatccatgccaaagtaaaagtctgctcaggcttttatgaatttcagtgttagtggcaagtttatcactccagtatctgtgaaagccactgcatttgtcccatgttgtccattgccatgagaggaaggggctaccctgtctaattagtgactgcgccctaactgaactcatagtgttttctgtatcacagttcttgaccacgtatccaataatagcattttgattttattgagtgccagattaaaagatccttaggggtttggacaacatatttccttgctctggaattgaaaagacatcgaagtcagatccggagcgaatcgaggaacgatgtaccacaaggtggcccacacaaaagctatgtgggcaattatctcatgatttgagcagcctgacaaacttctcccttctcactcatatttcacacagatgcagccacggtccaactttgttacaaagaaagagaaacttgtcatttgtttgatcatcagcatggtgtaagaatttgcctgtcacttgtttaggataatggctgaatttttcagttttcaattgatgcttggcagcttcgatgtgttagattgctctcaaacaactgaaagaaatccacacatcctatccattgtcaagctcatttagcagattattctaagactaaagtaagggaaggtagcttgtgctatgaatcttttaagaaaatattacacagtgtgaacaaaagcaaatccgcagaactttaaaatgtcagagcccaaagagaacttagaaatccttccattgaaacatctgaaacctcacatgcccacagagtccaggcaagtagcaagccaacagcaagagatgtagattgagtctttgccgccctaggaggggttctagtgtgccagactgtatgttttcataaaatttgcaaaagtaagatgtttaactttaattcattaatagggctgtcactttttgacatcctcctttttttctcccttatgttagggtgttagatggcattggagtcaccccaggaattttgtattcatgggctatgggcactatacagcttttaaaacttcaggatccacaaaaccagcaggtcagatagacactatggcaaagtggaatgctcatgctcatttaaaggaggtgtttttgcttagttcctgacaattactgtcaggtgagaattgaagggctcagtgtggtcagttctctcaagggaagccagaaatccagatttatatgtcaaatcttctgatttcaaaatgttgataactaaccgaacaacactaatctgaaggctgaacttgatctgtgggctgtcagtttttatcctcaggctaaattcaacccttgctattgatgacaaaaaaagcaaatgaacaggtctaaaaataattaaccctctatccacaccattgtcttccacaggttttatattgaaatcatcaacctggttttcttataatcattcgttgagcatttcttgagtgttaagtgtgcattttaagtacatttgggtttccctcaagcttagctcttgattaaatgagtccaaagtagtccacatccaggttcagagttaggagacaggactggatgtgaaattatctcactgtgccaggattttgaaaacaattcactaaaatttgcaataattcagacaaggcttcagatacttattaagagaaaagtttcaaaaagtggtgtgggattttatatttatggacatgttattgtaatcctgctgttagttataatttttttgcatgaactttgagtgatttatagtacccagaggtaatgaatccattcccatttttactcctcctctcgttggaacatttgcatcagttttctccacttctcaaacatttttttcagttgatatttccatggctggacccttcttatcactgaggtctcaactgacatgttacctctttaaaaaaatctttccagaagatcttagctaaattcaccaactcccagctctctatcccaggggcagataaactatggctcacagtttgaatccagcctgcagtctggctttgtaaataaagttttattggcactcagctacatttatttgtttacctcctgtccatggctgcttttgtgctaccccaggagacttgagcagttgcaacagagacagtgtgacctgtgagtcccaaactatttactatctggcccttgatggaaaatgtttgccaacctaagacttttccattgctattttattttcttcacagtaatgcttatctgagattacttattttttacttgtttgcttgtttgtttctgaattctactcttagaatctgagctcctcaagagttattttatctatacctagaacacagtaagtacacaatatattttggttgcgtgaacttaataaattccatgcttcagccttttttcttatagcagagagggctcctaaagtccttctgtgcaggtgggtcctaaggatcctgctgcttttcagtactacagggaatatcaggccaagttttttattgtttctggttgtgcaaactggaccaactatatacactgaaacaggtgatgcctaagtaccagacccttgaactggatgaggaaaagccaagatgggaaaccactggaaaacatcgcagtctattgattctgtgtatcatttcgcccaataccgttgtcgttatcaagggctaactcttatttgtcaagtaaagaaagactacaggttcaactgacttctaagttagcaaacattttggttcctccctatctagttaaataaatgagtttctttttctaaagcctcaactcacctaaggacagggttctttgtttttctctgcttaattgcgtcatattcctccataccaactacacaaaccccagcacacactcagctgcagattaccatcctgtgttcttgtcacctcatgcattttacctgctggaaataaatgctcacactctgcccaatcccatctttccctgcacctggacatgcttcagaactccttttgtctgttcctctctctcatgtgcctgaactcttctgtgacttagaatctctagcacatgattcagaaccttaggatctgtccagtggcttcttgtctgttagtaatttttgttctctcaatgatatggtgtggctgtgtccccacccaaatctcatcctgaattgtagctcccataattcccgcgtgtcgtgggagggacctggtgggaggtcattgaatcattggggcaggtttttcctgtactgttctcatgatagtgaataaatctcatgagatctgatggtttcataaagggcagttcccctgcaccgctctcctgtaagatgtgcctttgctcctccttcaccttccaccatgattgtggggcctccccagccatgtggaactgtgagtctgttaaacctctttttctttgtaaattacccagtcttggatatttcttcatagcagtatgaaaatggactaatacacctagtaccttgtaagcatgcaccatttttactcatatttatatcttcctcttttactcaatttgtgtttgaccgaacttgaatctgcagtaccaggcccctggcattgtgctgggagttatgccaggcactaacaagaccactgaaatttcccagacgccctacaaccttcctttgggagttcccataccatatagtaataagcctgttaaaatgcacccacttgccaggttatgtatgtttttttttcttttaagaaatcataataattcatttgctttttatgttgttattatttattataatcataacttctttttatgtctcaaccaatgcatatttggtcatatccccaaggatttgaagtcccttgaattttttagaggcccaggagaagctggtatacctaatataccatgccccaaatacctactgtattcatactgctttagcagccctggacactcacagaaacagtgatgaacacgcatggttcttgtcctcagggagtccagagtccagggagtgaggtgcaggtaagcacgtggtaatagaaaactgtgagaaagtccattgtgaaggatgggcagaagctaaataagatttgaggacatggacagaaatggggtcaggaaagggcatggaggtcccctccctggaggaagtaatgtcttagatcggtggtccccaaccttttgggctccgggaaccagtttcatggaggacgatttttctaggactggaggtagggggatgatttcaggatgaaactgttccacctcagatcaagcataagttagagtctcatgaggatcgcacaacgtagatccctcacacgtgcagttcacaatagggtttaggcccttgagagaatccaatgtcactgcagatctgacaggaggctcagctcgggccataagactctctggcccaccgctcaccacctgctgtgtggcctggttcctaacaggccacagtctcgtactggtatgggtctgtagccccagagttggggacctctgtctttgatggcctcaaacaatgcaaagtggaaggatccaacttgaattctgcctgtcaaaacacagccaatttcccccaagttagccttgataaatctacctagtcaacaaactaattcacctgaagtcacaatcataacaggctacagtttgtgaggcctgatgcaaaatgaaaaggcagggccccttgcagaatttcaagacagcaacagcagggcattaaaccatgtatgggcccttctgagcatggggccctgtctgacagcacgggccacacacccatgaagctgaccccgttagttgttctaaaagtggggccagtgtcattcaaaagacagtaggagaaaaaaagcaccatggactaaagccccaagtacatagcagatgctcaaccaaggtttgtggaacaaggctgagtttctttagtttattttgcttttcttggaaataggcctgaccaggtggcaaatgtctgtaagaaagcagttactttgtcattttccctttctagaagctcaggacagatgcagagatccaggtctggcctggggaaacatgaccagtctggctgccttttgtcttggagatgacttgggtattaatacatatatttcgtttgtttgaaatatatacatgcatttaaatctgtatacaaaaccttttggtggacattttctccacatcctatcctgacagaagatgacgataaactcatgctagtgatttttattaagtctcattgagtgtattttcagaagctgccacacaaggaaatgtactaaacattttttccctgtctgtaaatgtgagtagtcttgaattgccaagccaggtaaaatgagtccatggataactcttaaatgtattaaactcctaaaatattagatccttctgcaacagatgaggtttggtagtgcagctcattagcatttgaacaaattagtgagacttttaaggcatgttgttggattgagctaagtagatgaacacagtgaattccagaccctaatgactccatttatcaagggagcaggttttaacataatgcataaacctttctcacatggccattttactatgcatttagttctattgcaacatggtgctttgggcagaggaaatgaaaaacttaaacaaggttaacattccgagaaaagactaggaaaaaataaatacccccgtccctccccaaatgaaagatgatttacaaaaatgaaaatctgtatcgataacagagtcttacagatgacaaaatataccagtgatggtttgtgactaggacatgagctgccatttctcctgaattcatatccagttttagggataatgtaatgaaaatgttttagtgtgattagtaagaggttattaattggttaaagaccctcctacagctttgagatttattttgaggacaatgaagaattctatctcacttattttgtttcacgttcctattgactttgaaatgttgtccttttttctgtttatgtatgcttaagaagaagaactaaagcgactgtctttcttcttactcaggaagatttgccagaatttaacactaacacttcatccctttggaatacccagtcgttcaaaattttttgttttgcctattagtgatttaaaaataccctagcttcatgacatttgcagatgtagcattatggttttgtctatcaaggaggcagccaaaggccgagggtttgtattgtgcagggtggcatttatatgtaaaagtgtgtaattttactagtgagctgcccagagctatgtcgaaatgtagatttgcggcttctctcttgggctacattgtctctgcctgccagtgtagttgtaaagcagtacacacaaaacaggtcactttttacaaatgacttttgattctacatttatacggccattaagaaactaaagaagtcaaaatttttcagatctacctcactgaattttatgaaggaaaagatatgctttggtagattcataaatttaggggattttgagggctgtagaatgtatctccaacaaatggcaaaggtctatggcaaataactctgatttctcaggagctgtttccctgctactcacataaaaaacacttcactactaatacctaaaacaaccccatagttgcttattctatccaaactattatccaaagttatttccttaaaaagttgagtcttcccaatttccctgcctccctaatgaaactggttttctacacggtgctaggcaggacacaagtattgacagaataagttatgctaagttagatagctgaaactggatagaatttccatcactcagaaacagaaatgtaaagttggagcttaagcatggagcttagcaatttgtcttccatcttcagaaaactcaaaattatacttacgtagtaaaaatgggttaactaaataatatcctgaatagaaggaagagtgtttaaaagtgttttttcataaaagtgagtaaaaatattaaaatatccttctacacaacagtatcctttaaaagtaataaaaccccatcaaaaccgtggatatcaacagccagatttttcaccatatcctggcagcactcagaagtcagggcaggcctctcttcctcaatgaatccttttcctggttttcacagtctaggttgggtggtggtgtttcatttccttagtcattctatattcctatccattatcatacttattacatattgcttcattgttttcttatctgtctgtcaattcaatgataagtaccttaccggtaggtacaagatcttactaaaggttcctttcttggttctaagtacaaaattgacactgttgaaccccaaagaacatttgtgaatgaattaatcaatgaatgactgaatgcaaccctgaacgttttttgaagcttcagatattttgaacgccagaaatgacaagaaaatagaggtaaggttggagaatttcaatctttactctccttttaagcacatagaggaattctaccacctctttcaataagaatcagcaatgcacagatcaccagcacatgcgtcagagagagtccattgtaggggctcaacatatattcactgagctaaacccaaatgcatttgaacttctgcccagtagcttgtcaaaagacaccctgagtcattctaacagaggatcataagagatgaaaaggaaaagatataagattatgaaaacaacattgcacatctagtctggacttctctaatctgcccagtggtgaatccaggcagcaggttatgaagatgctgggagatttcctgtgtagagttgttgagctgaactagctttctcaactattcatgttaatgtgtcaccagtcttggaactttcttttactgacaggttgtatctatttttcctattctgtttttgtgaactcaacttaaaacatcatccagcaaggttccagaaagactccaggcttcttagtgagatgttatccaaatggcttgattctttggatttggcactagaaagagacatgttttttatgtatgatttaaactcaaattccattttaaaatcaacgaatgtgcttcacccaaccacctcaaatctcagagacatggcccacttgaaataaaggttaacaatcttcaagtttaattcccaagcttttctgatatcattttcccaattatagattgcatcattttttcttccctatgtaaataagtaagtctgggctgaagttaaaacacttaagcaagaattagcaaggctttctttaaaaaaagtaggccatatatcttccaagaaatctctatgaagagatgtgtttttataccttaccaggaagcagctgtggtacaagagtgggaacttcaactcttaaaagctgtttttaatctcaactaagccacatcaccagttaacctctctgattttgtcatctcatctgtaaaatggaaattaattgtgccttccctacagggctattatgaggataaaataagacaatcaccaggaaactgcttggcaaattgtaaagtgcagtataaatataagagatattaactataaacggtcatatgggaggttttcgagcacaaaacagtaagctagagaaaattctgaggcagtgcaaattcagaaaggaaattataaaagtaggtataaccatcctaatagttgtgacaatgtaatttcagaatattggtgagttacaacatataccacatttaagtgtttacaagtgttagtgtttacaagtgttagtgtttcttgaacttcataaaccaacctctgttacctttcaacttttcctctgcagcttcctcatctccctcagccttcacagaattgaagagagttagggccttgctctggattaggctttggcttaagggaatgttgtggctggtttgatcttctatccagaccactaaaacgtactccatatcagcaataaggctggttcactttcctatcatttgtgtgttcagtagagtagaactttttattttattcaaaaactctttgttggcattcacaacttggctacctggttggcacaagaggcctagctttcagcctgtctcagctttcaacatggccttcccaactcagcttagtcatttctagcctttaatttaaagtgagagatgtgtgcctctgcttttcacttgaatacttagaagccatggcagggttattaattggcccaatttccctaatttcaggaaataaggagggctgaggaaagagcttccctatttccagtttgtttggcacccccgaaacaattacaacagtaacatcaaagagcactgatcacagatcatcataatagatataacaataatgaaaaagtttgaaatattgcgagaattaccaaagtctggcacagagacttgaagtgagcatgtgctattggaaaaaatggtactaataaacttactggatgcaggcttgccacaaaccttcaatttgtaaaaagttcaagctttttacaaattgaaatacctctgaagcacaataaaatgaagcacattaaaccaagcatgcctgtatatgcacttaaccaaacatttccagtactgtaaaatactctaaaattctactttgcctatatattacatatgcacatttatatagatattatgcatttaaataaacattaatgcaaaggaacatatgcataaaatgattcataatataaattatggacaatttaaagatttttaagggtagatttcagactgtaaataaacttactactttcacactcatcccctgcagaagatgagaactggcagtatagtctaattacttaagtaggagtggtggacatcattgtgttattttggagcatatttttcatcttttcttaagtgaattgtaagtgaatagaaaatgtgtgtttgcttgcatgcatatgcatatgcaaaaatcaaaactgatttgcccaggtactcaacttgagcacaaaatcacaggcatgaatatgcaaggaaatttgaatgtgtgtttgtcagcaaccgaatatttggcaaaggggaaaaattaaaatagattgcacttagagctcaaggaaggaagaataaacacaaatttacaggtgagtgttagcaaacagcacatatattgaatagtagtctgaaatagacccatctgaactcggtgggaaattgacattctgtttgtgctactgtgtattagaactggaagcctcaagttatatttcttaatagcgatgcagcaaattactatatctacatggcaggcacttggcttttaacagctggcaagattgagggttatttgaggcatttaaaataaaaatttcagataagatcaaatcagtgtggtcaatcagcaagatagtcaacaggtatttatgacaccaccacttatctatatacatatttttaaatgttgtgcttgatgggatccgaatggggaaaagacccaaaacattaggagatctctggctctggtttagaagaccaaatggtaataaacaagggccttggagtcacacacacctgccgccagaacccggacacctcttactttctaagtaagctccacattttatgtgagggctaggttctgaagccaggccattaagcaaaagtcatgtacagtcagaattatctttgaaattttatgtcttctatgcttaagccttctttattttttttatgttactgaattaagaacgtttgagcccctatgccattagaagacagaaatttaatatcagccaagacacacacacactacttgggaggctgaggcaagaggatttcaggagtttaagagcaggagttcaagcctgcagtgagctatggagtgcaccatgcactccagcctgggcaacagagcaagacagcatctctaaaaaataaataactttttaaataaataaataaaagacgtagacagagaaacacacacacacacacacaattgtgtgaagccttttctcgtcagttttatgcccacaaaagtttgataattgctgtgctaatgaaagggccaaaaagaaagtctatgtgtggatatctggacttttgactcatcctgcctttaagatatgatactatcaaatccccagtgtgaggagcagatggtaagacttctaaagtgttcctgcttgccttcagggtttactctactcacttataataataagcctctctgactttaatacatgttaatagacctatttgatgtttagaggattaaatgaaacagtggatggcaacttctttaagggttaaattcgaaaatcggtacataagttacctgtgctttgtgacacttcttcatttatgtgatctttgtcaatgcacttaacctcactgcgcctcattcgcctcgtctgcaggatgatgcaacacacaatacctacttaaaggagttggtgacactctaagtatgataatgcgtgaagagctgttggcagactagtagcaagaaattaaaacatagtaactattttattattattacaaattattgttgtcgtggttgagatgattattattacttgtatgctctgagactttggacatgttaccagatctttctgtgctttagtcattcatctgtcaaaagggagcatgatatcttttcctcctacctcaaagagctgcagaaggaacaaaaaaaagacaaggggttggaaaagcatgaaaggttgtacaagtagaaggtgaaaacggaataatgaaacataatattcaaatcccaaggcaccccagtttcagggatgttgcaaaccaatgtaatctgcagaacaaggcatgtggctgaatagcaacacagtcgggacccaggcagatcgtaaatggttggatttgtcctgtccccacccctggggataccacttaaagtgcattccctctggaagggggcgtggaaatcttgctgtggaatacacaggaccctaccttcctcccagaaaatactaccatgaagagtggctttgtgctgcagacgtgaatatataggtctctagcccaaatggcaagaaacctattgttatttttttcacaactgaattaaattcttattataatcacctttgccattggttgacagaaacgtaatctctgtcaagttagggcatgtaggttaattcagcttcctgagattgtgcctaagttccagggtgtttacagacatccaagaatctgggggtcatacgtggttctcagttatcacctgtatccacgctgacttccgcagggatctgcagctccctttctgctcaccgactgaaggctattccggaactgctggggctttcctagaaacgtctcaggccccttgctcagttgcagcacgcaagcatctccagtcttctgctcctgcgtcatggtgcgtgtggaagaaggaatggcggcctaggggaggtggagtttctttacaaggcattggaacagagacctcttctgctcttgaatcgccaaactcaaggggaagggttggtttatgctccctccgacccccgactccactcgaggccaaggaggccctgcaagtagcaagtggaagtcaggacacagagctgcttctccgctccgagtctgaatggcaaagactgcttctccttcactgccccccaccccccacaattttcacattcctctcaatacccaggaagccttatcttctacgtaaagggaggtgagaaaatggaggtgaagtggacctccggctatcgcgttttgctctcctgaagctgtttcttgtttgtttttgtttgttgctttgtttgtttgtttgttctgagacagagcctagctctgtcaccaggctggagtgcagtggctcactgcaacctccgcctcctgggttcaagtgattctcccgcctcagcctcctgagtagctgggataacaggtacgcgccacaacaccctgctaatttttgtatttttagtagagacggggtttcaccatgttggccaggatggtctcaatctgctgagctcgtgatctgcccgcctcggcctcccaaagtgttgggattacaggcgtgagccaccacgaagctatttttttaaatgctaggatgtctccttatgaagtccccaaaccaagactaaggctccttgttcagctttctcccctatgatgcctcttctgaggcaagggctgcgtcttttacagagtggggtgcaggagacagcttcagaaagtcccgctgcaggagtgggaccagctcctcacatttcaaaaatattatccaccaacaatgtttagaacattacccagaaaggtagatttctgaaggagttgagcgtgcatagtagagcgtgattctgccataatctatgtggttggatgagaaccagtgaattgctttggtccgtttatgacaacgtgaatagtttgtcttatggtgataggggaccagtgattctagctttgactgtctcttcgatggttgatggtatgtaattgaaacaagtgatcctcccccttgccccccatcacatcctattctgccacattcttaagggaggtgagaagtaactctttatgctttgtcattcttgagcaggttttttgttatgtaaaaagcaattataattcagagaaaaacaactcaatgtgtgaaatggtaaaataattctaatgtcacttgcaggctccagttggggtctgcagaatacatctttgtatggaatagaaatacatgtgcccaaatttgagaattgtcactgaaaagtaacctttctctttctagccctcctgggcagtgcagccaagtcctcatcagtgccaaaaatatacatttagcaaatgtccatgccagcgcctcactcccagaatgcacagttctcccaagctgcttccagagccttctaaagtactttcccactccatctctgaccctctctaacttggtggtgttcattctgcagacaaatagatcttttgaaaatgtaaacgtgatagatacggtcactttcttgcctttaaaactcctgccttccctggcagttctgctgtggttctctgggtgtgttagtggctgctgggacaaagtgccacaaactgggtggcttaaaatcacagaaatgtactgtctcagagcttcagaggctagaagtgcaaaaacaaaggtgttggcatggcattgctcccactgaaggctctggggaggacccttccttgcctcttccagtttctggttgtggccagcaatccttggcttgtagacacatcactctaatctctgtgtctgttgttacatggctcccttcccctgtgcgtccgtgttgtcaggtggcatcccctcttttggtgtctgtgtccaaatttcctttgatttttaagaacaccagtcactggacaaggaccaatcctaaagacgtcatcttaagctgattacacctgcaaagacccttcttctgaataacgtcatattcacgggtaccaggggttagaacttcaacttttcttttcaggggacacagtttaacccataaccctgggtttattcaggtaaattccaacactttaccatcacccacaccagtctatggatcccgagtcctgcttgtctctttggcttcaagttttgttgttgtccttctcataatactttcatactccaaactccactggacttctctgttttttgaattgctgtgccacttcccactttaggaaatttttttgcaagctatgcattcttcctgaattgtcttcctctccttattccctactgcgttacttttctggcagaatctgccttaagcccccacaccgagtctagttgctttgccatctcctatagctcttccatggcactgaccacacttggcaatcaagaatgtatttgtgtgactatttaagtcataacaatcacaccagtgtaaggtcccagcaaggggtctctggccagagtaggtgcttaataagtaattattaaatgaataagtataagatttcataaatgctaaattagattacagtatggttggttaagtcccataggacacccatatgacttttaatcttaagaaaaatggtccttttcatgcactctttggattttagcacgctgcaacttaattttggctttgcagaggaatctattagagattttctgttgttttttttttccataaagaactgaggcaatgactgtgagaactggatttagaagttgaacacctaagaaccccgtttttcttaaaataaaaaaaaaggtagaatagaagagaaaggaaaggaaaagaaaaacaactgtgtcgagtgttaggtttacagttcagggaagcaccaggagccattttatctgattttgttattatttaaccactgcacaaacgagaagagcccataatcctctgtggaataatgcattaatcctcattagttgtcattcagttgggtctgctttctctgcgccatgtgaaatatgaagagataccttcccaagaaggataaatgtgttatctcatagttcacctactttagaatacccagtgggctgcactggaagtatatgttgtttatcattacttgtagggggcaagatgggccctactgaagactgctggaccgtgagtgatttatggtgctttttacccctccaccgttgggggaggtgtccacatggttagaattccatctgtcccgtatgcagcccctttaattaatgatttatcctattatcttccttcctgaaagaaaaaaatatcgaggttttactttatcggtaaaactaccatctaccaaaacagaatcattatctaaatccgagtgacaaacaagttgatgggagtattctggggaagagaaacctaaggggaaacgggttaacaaaatcccttgtttcctgagggaaacattaggaggtgttccctaatcctgcctagcaaaaggtcaatgctttgatacacacacacacacacacacacacacacacacacacacacacacacacgctcaagtttccatataacgagaggaaaagcaaagagacgccactggatgaggggagccattaatacagtgggtttgacagttggatgcttgaaaaaaagatgacttcttattaacatgcaattgtcaccatgttaataatgaaatattgatctgttcttgcttaatgaaaatcagcttattctaatttacccctggaaagaggaccacttagggtcccgttccaacatctttacactatccatctatgtattgtttatagctagatttattttttagtatgcacctctgagccagggaggggagaagggaataatgaatgtcaggtaaaccaaaattatttgtcttttcttcttttgttgaaattcagtcatcttatttagcaagaaaaacttcatgaaagaccttagaacaacattacagggtattcatgattttatgattaaatgattacaatcttttccaataaaaatactgttatataagaaatgtgaaccttagaaaatcactagcactcctcatctaaagcttgatttacagctatttataaccatatatgcattacagtaaggactgagagaatccacaagatttatcagtcttactcatggagaacaattttacacagagaaaccctgtctaatagcctatcttaattagctgccaattttgtgaactatttctgttttatagtcacagtttttctactcatttatttacctgcgctttcgaaattatctgtgaagcaatctctttcggataatagggaaaggagccagtgactgtgaccctctaaaaatgtagatcatttttatttacaatttaaaatgtaaatgctttggggtcaggcctctgcgaaaagagtaattcacaagtcaatacattactccttcacacttaaacattgattaccaagaggcacatacagtgatgtgtgtgtgtatgaatgtgtgtgtatgtgtgtgtgtatttaccaatgtagtggcttttattgtttctgttaggtgttgttgcagagaggttcacataaacatttatataggtttcagaaaacggttgttactgaggaagagcctttttctgtttacacaaattcagaacaaagaaacattgctacagcttccggtaattgacatgtgggcgtgttcttcaagtcactgactggaagaagtgagtgtctgagatttatttttgacaggacttaaattactggtagtctgacacatttttgaacaattactagacactgaggtgtttaaagtaatgggtactatttgtttgagggatggggaagtttcaaaaccgttagaacgaaacaattttccatttgattagtaagatgctaacactcacatttatattactaaatagcacatacataaatgactcctcgagtgagaattttttctcagaataaaagttgtactttaaaaaatatcccccccatttggtgaactggtgaatcatggagttcaagagaggaatgagcctctgtgctcactgtcagctttctcccctctagttctttagatcagtccctgaagtatacagagacgggagcattgtcctgctttgtttcaaatgtcttagaaactagggcttaatgttcattaattagtgactatctttcaggagcttctaaacattgttgaaccagccatctgaactccgactgctaaattaaaattcacatttcatgagctgctagtgtccccaaaagataaagcaactacagctgccataattggcaacacactgacgttttaagttacccaaagagtcaaagcagtcatttttcttcctccttctttcctgttcatgggtctgatgaagataaaggattgcaaagtctctgtcctcttcttttctatttactatggcttaaaaagccaggccaattttgggggaagggtctatctcacggacctacgtgttcttgcttgtagttcttaaagctgtgggtcgggagaacccagagctgacttctgtgacccatcacaggtgacatgggttttattgcttatccaagatctttttcctctcccctgcatccagggacgtccgtgaagtcatgtcccctgaatacccctggagagtagtactgtgtgtatctgtctataaaaatctcttttgcttgttttattggagacactgagggctttggattgtcgttgtctcaaccaggaatgatcctgtactgccccagctccccaacccaggccggcattttgcaatttgcagagtcatttttggttgtcaaaacagatgggagcttttactgtcagcttgtggggtagagaccagagatgctgctaaacatcccgtaatgcacagggcagccccacagcagagaatcacctggccccaaatgtcagtcgcgcggaggctggggaaccccggtggaatattctgtgctatgctgtagtagctggggtttgttttcctaaccaacaaatccaaacagaaaagcatcggggatgctaagctgggttggagcagaagtagtttgggaaattcttttgtttctatgacattaaggactttttttaaagggatgcatcccatgtttttggcttctttaaggcaacatggtatacaaatacaagtgcaaagagtatcttcagggtataccacaaaatcataataatccagcaatatcaattaccacttgggggaaaggggtcctactatgtttctctcttagaaataataaaaatattcattgactgaatgctcacagctgctctgcagccctgcttctgtcccttttcatttgtaagcttggaaaataaaattgtccttcctagtctcctcattcctcattgcaacatgaaaggggtgaatctaaataatgtcttgtttccattctatttgtaagagcccataaaattgataaactacttatagattttaattaatatgattaaaaataactgatttggcttcattttctccttctcatttgggtgttttgacaccatccctagaaggttttccaagactcctctgagaagtccatttttggaacctagaaagtatgggaatagagtctgtgagactggacatttccttactgtttactggggggtcgaggcaggtaaattcactagaatgggatcaaccattagccttgaaaacaataaaggcatatacttctgcccatccatccatcaatccattcattcaatcctccattccttcatccatccattcatcccttaatccattcatccatccctccgttccttcatccatctatccctccatccatccctcccttcatccatccctccctccatccatccctccctccatccatcccttcctccatccattcctccttaatccattcatccatccctccattcctttattcatctatccctccttccatccatccctccattcatccattcctccatccatcccttaatccattcatccatccctccattccttcatccatctatccctccatccatccctccctccatccatttatcccttaatccattcatctgtccctccattccttccttcatctatccttccatccatccatccctccattcatccatccatcccttcatccatccatccatccatccatcccttaatccattcatccatccctccattccttcatctgtccctccctccctccctccatccattcatcatttaatccattcatccatccctccattccttcattcatctatccctccatccatccatccattcatccatttctctattcttccatttacacatatggatagagacacatctgaaatataattaactgaaggttagagtaatttctagatgctgggctactgaatgattttaaaactttcttctttataattttctctattacttaaatacagtaagtatgagtcattttaacaatgaaattattattttttaaaaggaaggggatgatacgggatgagctaatggatgcttttcaacagtccaggaacactgttttgatagttgaaaagagtggttctcatcttttattaactccattccgtcaagttaaaaaaaaaaactggtctattttcagttttaggcctgggttgattgatgtacatttttaactttgagacatgcatgtttaattatagttttccactgacctcagtgtttgttacttatactatacattagctaaaagtagacactattaattatacagatttgtttcaggatttcttgggggcaggattttgctacatactttgggatgcctggtgatgtgtgaggtgcttccacactttctaatttcaaatttcaaggatcttcagtctggctgcagtgaaaagaaactaaaaaactgacttcgcaattctagcattgtaaaagacatgtacatacaactgtctctcaccttcatgacatccttggtgaactcttatgtatcttttaaactgctgttcaaatgtcgccttctcaatggagccctccttgaccactcccttgtgaagttagaggattcttcctttgagtaagaagttaaatgtttcactttcttctcacaataccctgtattgtacttggaaatagaagttaccacattgctgaaattatgtcctaagtatcagtcctttctactggattttgagtttccagagggctaggaccaggattcatgggtctttgtgttcttacagtgcctcaattgctcaccaggaagtgggctggccagaatacaagtcagaatgagatggatgcagtacgaagtgtagaaatccaacaaatgtgtaaaaggtaaaggcaaaccagatttttttaaagcttatgattgttggaaagttcaagtatacacagactaaacagctggacaaaacttgcaaaacaatgaagaaaggaaagaaaatagtgattgctatgtctgagtttcagggactcataataaaggactattcagattaagaaaaggctacttggaaactatagatactaattatttttaactatagatactaattatagtctgaattttaaagaaaaattcaggcacatctactctgtgccagggaaggtgctgaaggaactagcatgtgtattactcgtttttcaacagagatatgtattgttagtcccatttaacagatgaagcaattgaggcttagagaagcaaatgacttacttgaagtcatccagctcatcagaaagaaccccaaccctcccaaggtatttgaccttgcaggtcagtgtttttcccactcaaccacagatgttttatgtcctcttttgtcgctgacgtttcctccatgtggaaagctttgaaagtgctccagtcacattttgaaatttcatgacaaaaaattgaatgtcatccaaagcatagttgaggatttaaacatccctgtcaatcctggctgtcatcaccaaaagatttctatcccaacgatagatcattgtgacgtgcttggcctaaagggccctgggctgttataatgagtaagattggaatctactgagtaatgcaaataaataaaaaagagacaggtagtctcagactttttcattattgccttctttgctgtgaagctcatggactgctctgtgcaaaggatctttctttttaccattttaatagcctgtgcaatgggattaagaaagatcttgggtttttcattcaacagatattttcatcattaaaatgcttactgtttttgagcacataagtgactctactggaatggtagtaggaaaatagggacacgaaggggatttgaagtcagattatgaaagcactgcatgccaagctataaaaggagcgacaaatcagggaggttagtttctgatactaaccttggcaaacacagagaggggagaagcaagtgcaaaagccctagatgaaaatgagtttggatagtatgttctagaaacagaaggcagcaggacaggtgagaactaaacaaggcagagcgtgataagatatgagaatgaaggtggaggaaggagtagggtgatcaccagcccaggctgctaggagactgagggagttcttggggtgatggattttcagtttttaaactgggagagtccacggcacactgggacaagtcagccaccatcggtgggagccaggttctgctgggactggggaccatgggaaggagtttgggctgtactttacatgcaatgggagagactgaatgtgttttaagtggcacattctcaactgcattcagtctggagactgaaacactgattccttgttctttggcaagtcacccaacccctcttgacctcgctttcctcacttctagcgagaggtggttacaccagatgatcttcaaggttcctttcgactctgagaccctaggacacttttcactttgttctgtagacagaaaagagtggtcaaggattactgagcaaaggaataacacaaagaattttttgaaggattaatctggcagtagtttacaaaactaatcacagcaaagagagatctgaagaaaacagttgagctcttacagtgatccaagcaagagatgatgagagcctggactggatgacagcagaaaggatgatggagacaggaaggaagggtggagtgatattaaccagaaaaattgctgaatttgctggcaaactgcacatggctgataatggagtcaccaaagtgtgatttaattcattcattcatttgttcaacttactgaggccctattgtgtgccaggcactggatgaaagtagatgagcaagtccttgccttcacagagctcacaatctagtggggaaaccagtatcagactgcacgtttcagttgtgcttaatactatgaaaggactgggccagattccatacaagcgatgcggaggtcctgacccagtctgaagatcactgagggcttactgagatgagtgatgtcaaagctcacagctaaaaaagaaaaaaacagcactaaattaggttgatggtgggaggtgagggtggagcaggccatggagtggagaacattttaggcacaggtaccttatttgctgacaacatgaggcaggaagatgttgcacattcaatgaacttaggaaaacacaacctgatgaaggactagatggaggatcctggaaggctggaaagagttaaattataaaagggacttgcagatgcataattcattttggacgcaattcagagagtgatgggaagtcattaaagaaagagttataaacaagaccctgatgtgcagtttcagagttttgcatttttgtatccggaagaatcatggtattcctaagagaactcgggcttagagagagtggagaggtaaattctgatggaaaagcaaaagaggggaaaggaaaagtgtgaccaagtggaagtagtctctcaggtgctgaagacacaagtctatgagcttagcagagatgagaggtaaagataatgctctggaggccaggcacgatggcccatgcctgtaatcccagcactttgggaggctaaggcgggtgggtcacttgaggtcaggagttcgataccagcctgggcaacatggtgaaaccctgtatctactaaaatacaaaaaaaaaatagcatggtggcgtgtgcgtgtaatcccagctacttgggaggctgaggcaggagaaccatttgaaccctggaggcaaaggttgcagtgagccaagattgtgccactgcactgcagccaggatgacagagtaagactctacctcaaaaaaaaaaaaaaaaagataatactctggggatcatctgtacagttggagctgtgagagtgaattagttttgtttgagaagggagagttagcaaggggagaaaagattgacaagaccagagtcttgggacctgtccacatattaggagcaattctggatgatccagagatagaaaggcaaacagaagggaggacgacccaggaggtttaggcacatcatacacagcagccaagcctgagtcacacagacagggtagtggaggtatcaaatactgcacaaaggtcaaagaaaaacaaagcctgacaaaaggccagtcagtgtggcaattaatagatcattcgttatcgctgaaaaggaggttggtgactaatgtttggattacatcaccttggacaaaattaataacaaatttcctgatagtcacttgcaaagatgcaatggaaattggctgctcactctccctgtctgttctgaaatttcttaactttgtgaacactctaatctcctctgagtactgcagcagaaaattgaaatgtgccctgtgtacaatgtgggtgagtttctgttacccaaatccttaccttttagatgtttagaatgtcaacttctccaatttactgaatgcgtaggcagagtttgcatgactgtttctgagagtgaatctatcggaaaggagggagaatgacatgcgaagagcttctatcaatcacgaatccagctttagactgcaaaatctgtgtgttcacgctaagaaagggagatttcctgaagtcaaagatctaaacccaaaatctaaaaacatatgagtaaagagttttgcacttagggggattactcagaatagagaaaataatgtgggtttaaccatttcatgacagctttttttctattcctttgaatgaacacctagacattttttaaattaaaattttgagtaatacttgttcattgtagaagatttgccaagtccaagaactacagtatgcctgacacctaataaatactcgttaaatatttcttgaaaaaagacatgaaatggtacaagataaaactggattagagggactctggcatatttgggatcatgttaacacttttcgatgtggtctttgagcatggaggaattattataggtttttagtcacaggattacatcataaattatctttgaaaaataccctggctgcattttgctggatgtattggagtagaatgaggatggattcaaggacagcagtgaggtagttactgtgataatcaggtgacaaaaagatggtggcttagactaggctggcagcaatagagatgtagagaagtgggtggattgagatagatttggtggtaaaaatcaatagagcttggctatatggtaaatttagaggtacgctgggaataatggagtgggggaaaattttggtaaaggtaaaaatcgtaattccatttgggaactgttaagtttgatgttcaagagttagggagaagaccattgggtacttatctggatttcaacataatacccaattacatcaatgtcaaagtcctagcaaatagaacataatgaacccctggcagtggacgagcatgtttagggtgagattattgaggaagaaagactaagccctgagaaaggccaatatccaacattgaaaaggaaaaaagtctgcaaaacatgagcttttggagagcgtggaagactatcaacatagggtgattgtcaaaataggaagtaatagagaagagagtgtctcaagagggaaaaagtggttagctctactaactacttttagtagaagtcagtaaggtgcaagttgaaaaaatgcacactggacttaacttggctgagctcctgggtgaacttagtaaaagcattcacagtagaccaatgggaggagaagccagactgggtgggttgaaaaataaatgagagatgagaaatagagacaacagtgtgcatatctcatgcgggttgccagacagtggttaacgtagacagtgacatgttcacactggaagaggttaatctgcagagcaagtgcaaaaccctctcaaatcgctgctatgtttaaggcatcttagcgctacagagacagaataatcctgtgtattgggaatacagaaaggaaaaaatcaggaatgcagagacttcaagtctttagaggccaaattccaaggctttggtctgagccaggcactatttcaaacagctggattatgtgccaatatgcctaacgaagtgaatatcagctggccccacactggtaataaaacgataataactctataaataaatgtattgagtgctgactgtgccctctatcacactagccactctataccctttatctcatttaattttcacaaaagcaccagcagatagctactatagctactagtaacctttttctttttctgttttttttttctttttttttgcagaagagatcctgaggtccacaaaagttgaattatatgtcctaatacacatagcttatgagtgaagccgtgattctgattggtctgactccaaagttcaacttaggttattcagtctcttcaagttgttgttgcccaatgaaaacttgttgcctagctaactggaaatctgactgaatttccagactagctcagcttacctaatttaataaaaaacatcaagacccgaaaagcaattatgtagaatgattcgaatcttaaacgagttaatatatccagagctcttatggtaccagacgcatagagagccttatgtatgtgtttcccattaattcttactaaaaggctctagagagaaattggtctgcccttccctggtgctaatcaaacattgtgaatagtaacaccattttttcctcccaagggccactaaatttctgcttcttacagagtagttttcaacttggtcttaaggaagaggatggtatttcctggctttgtgcttaatctctttacaggaaatgatattgttgtaggcaaggacaaaggtacaagtgtacacatttaacaaatgcattgaatcctctattaacattgcaagtcagttctttagagcaacagtccccaacctttttggcaccagggatcagcttcatggaagacaattttccacggacaaaggtaggggagatggatggtttcaggatgaaagtctttcacctcggatgatcaggcattagttagagtctcctaaggaatgtgcaacctagatccctcgcatacacagttcacaacagggttcgtactcctatgaaaatcgaatgcccctgctgacagaaggcagagtttaggtggtaatgttcgctcgcccaccgctcacctcctgctattcagcctggttcctaacaggccacggacctgtaccggcccgcggcccaggggctggggacacctgctttagagtcgtatcatttttgttgatccagaataacaaagagatgaacagcctaagtccaccagctatgagtttgggattgaatttgacaccagtttaattgaggcagccacggagatcaaggcaaaaataacacttcttaaggtcccactgtgtagtgacaaacattagcttctttaatcttcataatgctgtcggttctgctataatactgcttttaaaacatgttttttagagacaggatctttctctgtcacccaagttagagtgcagtggcatgatcatagctcactgtagcctcaaactgctgggctcaagcagtcctcctgcctcagcctcccaagtatctgggactacaggcatgtgccaccacacccacctgttttttttattatcttattattttttattttgtaaagatgaggtctcgctatgttacccaggctggtcttaaactcctggcatcaagtgatcctgcctcaaactcccaaagtcctgaaattacaagcctgaaccactgtgcccagccaatgcttccttaaaacataattttgctccaaaatggtggatacactttcagcttgacactgagtttgcatttgtgtacgtgtgacttcgtccttgagaaacactgaacacagaaaactgcacccagctgaaccaggccatgtagaaatacacaaaagcaaacacacacatacctcaaacatctactcacttccttcagctggtgtgccacaagccccacccacccatgcacaattgctgttacaacgctgtaggattccaggtaacactcctcccaccacttccaacacccacttccacggctctttattaaggtaaaatacttatttatcacggtgtttataaattttttcaccatttaacctgcataaaacggtgctactgtttgtattaggttcctgcttttttattatatgttactgacaggagctttgttctcccaaacccattttccccgtaagctctgtgggttttattgtgaaatttagaagactgtggtcctttttagaaacacacaaacaccttatattagactgactgtacgtaagtatgaaacaaatatgtttattcttttttttttttttctgagacagagtcttactctgtcgcccaggctggagtgcagtcagatatttttgttcttattcccattccacaaatatgaaaatagcccagaggagatgaataacttacccaaggtcacccgtcactgactttgtatttgtgtaatttcgtcactcccttctcttaacagacacttctaaatagcttcaaagcacattgaactggacagttgttgcaaaccagcttcaacattacaaaaataaacattttccagaaaggccttcactcaagatgacccacacaactctttgaatggtctatgtatttttaaatcatgtggtaatcccctttgtacatactaaataagtcccattctgctcacatgttaataaatttttctcatttgtgagagttgctgaatagagcaagcgaattgttttactcagtaggtggtcgagccataataaagaagcctcgtgattaagtagagttggagcctcttatctttctcactgagtgggaggcaccattagtagtaaaagtaattacctgtgtagaacacgctgattgcatcaagtacctactacacgctactaagatagtcatctccattttagagcttcttaagagatcttcatttgatgttaattttacattttaagccaaagtacattatttttggaaaacattgtcttagctggatgaactcatttttaaagcctttcaaaggacttctgtgccctggtgattccctcaccgatgccctttctccaaaatggcagctgcaaagctgtctaaacaaagttggaaatgataagccacctaaatgtgaaagaatctatctggcaagagttggttttatgtgggggtgaaaaacctgtgctttcatctatgaaatcacaaagtccgttatgggaaggtgttggctatttaaagcagtaattcctgagaaactgtccatgccaaatcttgttaaatgttgtactggatagtttcagcaaatttcaaattcttctctgatgggaatattagaaacagggtgctcctggttagatggaggcaaggccagagccttgacacttagtggtggtaactcagaaagagtcctcagcagaggggttttggaggccagaggactcccccagctctgtctttggctgacaaaatgaccactacttgcaacctaaccttctgtgtataaaatgaacagattgaataggtgtcccatctaagtccaaattttgatgtaggtatacagctaatcatttattagatttattagaattctttatgtgtgtgcatttacagttaggcatctgtgcaatcgtccaaccaatgaatcacaccatgcctttgagttttccaattctcccttaaatgtagctatcaatgttatttttacttataggaccccaaaatgtgaccttccttagggaggtaaataagacattgcttgtaggcctgacttgaggcttgtaaatagctttccaaattaataggtctgcaaaaatatattctgaagcctcacatttctatcggttttaaccgtatagccagggtcggtgatccttttttcgccatatctacttctttcatattgctgatcacatcggaaagccaaaaaaggactatcagatatgatcaggttacctgataaaaagaacaaacagttttcgaagtcagacagactggttcaaatcctgtttctgtttattcaggctcaaaccttagtctgtcattgttaccagctgtgagacattctgcaaattatttaactaattgaagtatcagtttcctcatctataaattgggcatgacagtaatatttgcttcaccgttataaagactaaaagcaaatgagatagtatggaattctgtttctgtttttactggaaggaattataaaaatttccagtttgcattgataacttgaagagggaatgtctattttttttataagttttcttccctttctatgtgaatttttttaactgtaagcatttattgcattttttttacttctgtcttttaacatcatttgatttatcttgggtaaaatcataagccttctttattattgtttaagtttctctgatttaaaaaaactaaaatattattaaaaattaaataagataacatagctaaggtatttttcataatgtttgccacagaatagccactaatcaaatttgtcataagtaataagatcacttccataactacaaaaattttataacccaggaaaagtaaagaacgacaaaatacacagcaattactcaaaagatttttcattccacttattctggttaatttcaggtcctggaatcaagaacaagtgtttatatatcggttaaattgttttataatgaattttgaagaacccttggaattatttttgtgttggaattatattgtattaaagagtgtttgaagcaatttggatattcaagtggacttagttttgtcggggttttttccactaagatttttcactgtttgggcattatttaagattcagcccaacaatatgtcactagctaaaactgaatgatgctgtaatccatacagaggacaaatgacaaatttgttgactaaacttctatcagtttggttagtgaggagcattctgattataggtgggaatttttgagcaagattgactcttaatttcatgttcaatttttaaaaatttattcatcctttcctctgtttttcttcctttccaaccaaacttcctccctccctccctccctctctccctctctccttctctccttctctccctccctccctccctccctctctccctctctccctctctccttccctccctcccttccttccttccttctttggttaagcacctattctgtattttaaaaccagtagtcaagctcagttcatacttttttatgcaagtgcctttcaccaagacaaaaaccaaggcttgaactaacatttagcttttctgaaagcaatttactgagaaagtaagatgcttgggttttttctgtgtagacattaataatcatttattagattgttaggcctatttcaagccatgtaacctcactgggtctcagtttgctttcctccaaaatgggataataatacctgctttatcatatacatgaagaatttagtcctgtgctagctcatggtgcatttgttaaataagaaaaatagatgctgggtgtggtggctcacgactgtaatcccaatactttgggaggctgagatgggtggatcacctgaagtctcctgacttcgagaccagccaggcgaatatggtgaaacctcatctctactaaaaatacaaaaaaatcagccgggcgtggtggcgggcacctataatcccagctactcgggaggctgaggctggagaatcgcttgaatccagggggcggaggtcgcagtgagccaagatcgcgccactgaactccagcctgggcaacacaatgaaactccatctcaaaaagaaagagagagagagagagagaaagaaagaaagaccgatatttcactttaggtagaacttttgcatgtcttggagaatctgaaatatgaccaggctgtcagtggggaaacacaccgaggagaaactgcatagtggtagtggcttggttcctaaagtaagacaaactcaggtgttcaatgctgttatttattgaacacttatttacatgccaggccccttgtcaattactttgtatgcattgtacactaggtgttattttattattcccattttacacataaggaaatgaaggcccctgaaagagggcaaggactttccccaggataaattacaaagttcagatttaaacccaggtggtctagacctcatgatcttaaacactatgcccccaggattcagggccagaaaggtgcctagctgcaaagtcatgcccattactgagttcaacttcctcaaattccccctgaagtaatcccacgcagggctcagtggtggcgttcaggcgtaagcattaaaccacaagccaggcagaccttcatgagggcttctcaaagttctcctctccagctgcgctcaacctcacctgtgcctctcaaggcctagggttattgtgcatgtggcatggtctccagctgttcctcatcctgacttctccatctgcaccaatctctttgcatggaggccgtgtcttctggtctcttggtagctcagtagtggtggggtgggtgccagctgcccactgtgcatctcaatcaaggtttctttagttgtaaggaagaataactctcttcaaaggaaactaagcaataacaactaaacagtaacaacaaaaatgtctaaggagggcgctggcatagaccagggaattgatgcaaaggtggggttgagtgggatgtcggagagggtagagccaggtatctttatgaaccaaaaggtatatgtgttttgcaccttccttcagactttccttctctcaagatcgccatatctccattcagatttttgggctaatctctaccaaaagcttggctctctgtgggtagcctactttcagtccatttgtctctgattgaggtggagtctgttagggcttgaggagcaagtagttcttgtggaagggaaggtatggcttgaatagatcatccccaagtgtgtctaccacattggttctttggaaggtgattgttggagaaacctcctgtcaggaatgatgtatatagggcaaataacaacctctccctggtggccttaaccataaaatagaagtatggacagctctgttcatcctaacaattatttataggccacctcaatttgcctctgttaactggaactcgtgtcctgaaaccgtgtcttccctttgcacagttctgtggttgctgagatggcatgcaccataaggagtgtctgcatttaagacttatcttttaatgccagttctccttccaggagctggggatatagcaatgaaccaatcaaatgttcttgcctaagaattcaggtaagggagaaggaaaataaaaaatgaatatattagctagctggcatgttagacgtgaaatgctaaggagaaaacaaagccaagaagatggtagaggaagagtcaggggatggggtggagggtttcatgctagataggatggccaagcatggctctgcggagaaaggaacctatgagtagactcataggaagtgagaaaacaagccatgtgatgatctgaaggaggagaattcataataccagattctcacatggctagaccttttgccctttcttgagcaacagcctgtcatgaatggagagaagaattgaggtcaaccaaaaaagggaaatttttttgcccaggatcagatgcttttccaagtaaacaagtagttactccaagggatatttccaggagattcttcaactccaaaggccaaatcttcacgtttccgttactgtagagctttctaaacacagataattgtttgcacagttggtcagctcacacaaatcccttggcagtttctacagacatttatgcattacacattttcgatccttggcccaaagttctgatgttttagctctgacagtcggctcatgagaactcagacttcttgatgcaagcccccagtcttcacttttgaaagaccatggaccaaagttttaattgcctcgtgggtgtctcttcctcttcactgggtgcacagcgttactcataatcatgcttctgatttgtgtctgttaaaagaaggatcagaaacagactggcaaggtcttacagttcttggtaaaactcttggaaaagactttcttttttgatttgcttgtgtattttagtggtgtcttcaggctatttagagaaaagtagtatgtctattgattcggccattggcagggacttaaatgatggtacgtgttggctgtgtagtacctctgcttcttctagttggattaaatccaaggacaggtaaattcttttggcatttggcttgaccagagactttgtatctgccatattggtaattggccaccttggtgatttttggactaatgctccagggagagaaactaaataactctctcctccaaccttttcccaagcagttctctctacctggcattattttttaaaattgacttaagctttgccccctcttggaagcattctattaccccatgtctgtcttcaagatgaattcagcttcctgctctgttgtcccataagtatcctgggcatagttctgctctgggactcatcacctattgctgaaatccttttgttttcttacctgtttcctactgaacagagagcttcttgaggtccagcactggggcttaatttgattcatttagtaagtttttgttgggaacttactatatatgaagcactggattcaactctgggaactcaaaagtgaacagaatgtacacaattctgctctcatggaatttatagtctactggagttagacagacattttaaaaaattatcatacaggaaattgcaatgagtaattttgttgggtactatggagggaaatcctttaagggccctgtttgtttctgactttaaagcactagcaacaaattggcattaactgattatgtgatttgaatggaattgaggatctcagcgttggccctccgtcctgctgttgtcaactctcccaagtttttaaatgccaagttgtagttgcctttgttccgctaaattgaaaaatttaccccgtgcaaatgaataactaaattcatatttttttgaagaattctatctaaatggagatttgatggctttcagaaacctttaaaacttccctttcccccatatgaattccactatggattgacatatggcatattttcaatgtctagtttttgtaattaattgaaggctcactctgtctgagaaagagagtgctttggcatttccgagacctgtggattccatccagagtaccacacagcaatgcagagactccactgccgctcacctagctaggaggctgcagctctgtttgtgaaatgttgctattcagctttcaagtttattgggagcactgagttccaaggatagcaattaggttgttctgcattcttcggctggctcaggatgcacgtgctgagactgcacatcatagcaacggctccttgactgccagggagaacagtgtgaaagctttccgtggctcatctcaaccacctcctcctcgcccctggcgctccgcaatcctctctactccttggtgatacctttttaaatctccccattatgttcaacagcatgtcagctgagagttcaggcttacgagatcatgtccaataggccaaagtgtcgaaaataaatgttagctcataaaacatacgtggcacatctatagggcctgaggaaagcccacacagagaaaaaaatcttaagtgaacttgtttaacccagcagtgacaggtacaggaatgggattttctttttttttttttttttttttattaaacagagtttttccaacttccaggctggcaaagaagttgtaaagggaatgtacattttgcaccgtaatagaaagagataagtagggatttttccaagatttggaaagctggtcttcgtaagtccatttatttattcaacaaaaactttatgaagtatctattacatgccaggcactgtacttggcatttgggataacatagtgactgagaaaagatttgcccttgagaaaaatcacagcccctttggagggactgacattaaccatttaatcacataaatatgatttttcacacagtaataatagctatgaagattaaaaagctagatcataagatacgtggctataagagaactccctgatagggtgacattttagataagtctcaaagggtgagaataaactgtctacatgaagaacaagaaaagaacctttcagtcaaaggaaatagcaagtgcccagaccctactgaggaaggcctggggagcgcccaagaatcctgtgttaatcagggttctccagagggacagaactaataggatagatgtatatatcaagaggagtttattaggagaattgactcacaattgcaaggtgaagtcccacaataggccatctgcaagctgaggagcaaagaaatcagtccaaatccctaaacctcaaaagtagggaagctgacagtgcagtcttcagtttgtggccgaaggcccaagagcccctggcaaacaagtgttgtaagtctaagagtccaaaagctgaagaacttggagtctgatgtttgagagcaggaagcatccagcacaggagaaagatgaaggccagaggactcagcaaatctgctctttccatcttctcctgcctgctttattgtagctgtgctggcagctgactagatggtgcccacccagactgagggtgggtctgcctctcccacaccactgactccaatgttaatctcctttgtcaacaccctcacagacacccccagaaacaatacttggcgtccttcaattcaatcaaatcgacactcaatattaactgtcacaaatacgaaggagaccattctgactggggttgagaatagggtggagagagtcagggcatgaagccatgggggaataggtttgctggaatttgaaagccatgagacagagtgaggagttccttccaattgaaagattttaagcagcagaattcagacatgaactttggctgggtttggaatggagtgcacctctgtaagactgaggtgcaccatttccccgtctgccaaaatggagcagctgacagcagcttgcttgcaagggtctccgagcccacaagcccaggtgtgctttgaggtggcttcctcagcatcttaagataactcacagcaattattttgctgtggatttgcagaataaacaaaggcttcatcgagcctctggtttgaggtaataagtcactaatgctgtgtgtgcacactcctaagcttcaagcctgtgtggattctttcttcaattttactccccttttcgtttgctgttttgtttccaatatgtcatgtttccatataacaaaacacgcatacagacttgataccatttaatatttaattcaaataataaaatacttaccatatcagataaaatgtttacatgtatgaatgtttatattccctcaggagtgtgttttggaggatgggtgaaactctgatagcacacagtggcattttaagtggtacacagataaacttcctaacaatttaattgtaatgtatttattttaaggtgtaatacttgtgtaaaatgaggaccacatcaatttggtaattttgtagctattatcgctagattgccaatgtcagttgtgatagaaaatacactgttcaaattcatttacttaagaagtgagtttatgtaaagcctggatagtagtgcaggagatagttctataacggcaacattggtgaaagaagtacatctatgctgagcattataaaacacagtcccttgaaagggattgtgtagtcatcagccacttctctaggtttgtatgccgctcccggttttcactggatgtgggttgcctgctgagcttccagcaaagctacagattcaagttgctttgctgaaaatatagcttaaataatttgtaagatttacctactacttaaatccttcatttatattctgattttgctcattaaaatttgcaatatgattgtattttatatgcaaagccatactatttcttggtagatccatttattcccttaccttagatttttgaagatgcaaaagtatcacgacttcctgtccaaaaggaaatgaggcactgttgatgccaatgcagcatttatacttaatgtagagaaagcactccattatagtgtacttcagaaattcagagagtgtgctaaaaacccgtgcttctggtcagcctcagtggctcacgcctgtaatcccagtactttgggaggcagagagattggaggatcactagaacccagaagttcaagactagcctgggcaacataacaagagcctgtctctactaaaaataaaaataaattagctagacatggtggtacccgcctgttgtaccagctactagagaggctgacaagggtggattgctggagcccaggagttcaaggttgcagtgagccatgattgcaccactgtattacaacctgggtgacaaagcaaggccctgtctcaaaaatataacaacaaaaccgatgcttttgtttgtttcccagaggagggttttggaagaaactactgacacagcatgtgacagcaagcatcacactcacaatatcgtttccttgtgtgaccgctcccatcaattagaattgacatcagttccaatcctatactttatagccctatacgagagaccttagtagaattggaaaccaacctagttaccattctgtgttgtcacatcccttttttaatgtgtaaactgagtcaagtgtcgactgaagcttcagccagaattcaatgccaggattcattctccgtcttaacactagccaccagatgatgttttatcagtcaacttgagtcttctcatattacccgttgactgtgttctgtttgacaaagaagctgtgtgggttgctagtatatttttccctcaagaccacctaacaaacacggcattacttgtgggataaatgttagccatgggaaaaggaaacaatattccctggtatgctgctcattgtcacatgctatgtctttagtttcttctgaaacccttcttggaaacatttctctcccagttgtaatttgtatattgctgcatcttttgaaaaattattttgaagtcttaagataaaatactacatgagaacggagtgggaaaggatctaagaagcagttgtaaaaataacattctgggacagtggcactcatggtaaagtatctttgttgcatcacgtttgttttggacattctgctggctagaaagagtagcatagaccacggattggcaaactttttctgtaaaagggcagtggatatatatgttcagctttgcaggtcatatagtctctgcagtacctactcagctggaaagcagctatagactaggtaaacaaatggccaggattgtttcccaataaatcttatttacaaaacaagcggtgagccggatatggccctgggactgtagtttgccctgtgctagggagcacagaagagatgcatttgactcttagaaatatacagacctgagccacatcctggctctgatacttaccagctgtgggtgcctggccatctgaaagcatttctcagctcatcagtttctacttaagtaaaatgggaccaattatacaacccctctgatgggttattgggagaatctaacgaggaatgctcagtgatgaacacagacctgacccagtaagcacacatccaatgttagatgctactgtggctgctgtgttgccgtggctgctgggttggaagccctgctccactcttccccctccagtctgttgcccatagggaaggaagagtaaccttaacatggaaattgacccaagtgtcttttctgcttaaagcctttccgtggtttcccacgcctttcactatggcctgatctagctcatgcttccttttccaacatggtggtgctgctctccttcactctcgctgggtgggctccagccatactgaagcagtgcatggagctcttttgtgccttgggacatttacatgccactttcttttccagaatgttctttctttggcttttctaatggctggtgtcttctcattcattatgtgtttgcttagatgttacttcctcagagaagtctttatcattctcttaccataactattttctcataactctcagcaaaattcatcaagaaccgtgcctgtcttattcacagttgaaatcacagtgctttgtacagtgttctggcacataatagacactcaataaacacatgctaaaaataagtgatttaatgatttatgatgataatcattatcatcatgaataaatctgaaagcataggacctcagccgggtttcatcagacttcaaccgtcttcaaactacttcatgatttttaccttatctaggtaccacttttgttacaaatatttacaattttttactcccttttttgacttagtttttttttttttttttaaataaaccagggattgacaaactacagcctcagggccaaatttggccctccgcctttttttgtaagtaaagttttattggaatacagccatgcccatttattactgtatcgtctgcagatgctttcaccctatagtggcaaagttagatagttgagtagagactgtctggcctgcaaatcaggaaatatttactgcctgattctttacagaaaacatttgccaactactgtactaagtcataaaaaccaccaaatcccatgtttgatacgctagttatgtttttgttttcattttcattaaaaacaatcttgtaactattatgattttaaaaaatgatttacttaagggcccactaaaaacatcttgtctgccatctctggtatatgagccacactttgggaaccagagccacagtagtctttaaacttcatcagtgacattctacacctgggtgaaagtccaatatgtgggtccctgactcggtgcaagttagaacattttcccctccagagatcctttagtgactacttcattttgggaagtgcgattttcaaatttacccaatggtaaactcatgggcctttctccccacggtgcagtacatctgcctggcgtactcttgctaaccttccacacagcgtgctgagagtctgatgtgaacatctgcatcatggatgtcattataacaggtgtcaaaaatgctactatgcccccagaacacctagactcttcacaagatagatgaaacctatggctctctgtacctgtgcttccagaaatcaggactgatggatttttctcatattatgaatagccagtggctgttctgttagatggccctttgtaaagaaaattctgcctcccagaagtttccccagatttacctgttgcattatgaaatctcctgtaaataatgcagagaaatttgcagatgccttcttatttttgtttttcaatgaaaatcatttcaggtaatgaaagttatgacctcaaagtgaaaggtgtataaggtaagcctcttccaattacagcaggcagaaaacccaacgcaaaatggctcagacaatcaggcaatttgctggctcacgcaactcaaaagtctaggacaagctggcttcaggtactgctggttcaagccattaaattacatcacaaaggtttggtttctctctatatatttctctgggtcacttttgctatgttggctctatcctgaggcagtctctctcctcgtggtaaccaggtggctctagcagcctcagctttatatctctcaagagtaagtccaccgtcacagagctggcctctgtctcagaagttctaggcaatatctcatgatatcaaattgggtgtgcttgtgccaggctcaaccaagagaaatgggatgtgctgataagtcacatttaggacatgcgacagctggagctggggatggagctagccagccccctgagaatcacatggactctaaatggggatctcaaagcaagatgataagatattattagaagcagcatgaataggtggcagggaacaacaacagcagcaacaataataaatttctgttacataaaaagccagcttgctccccaaggcttgattttccatttcaccttctactgcaggattttcaacctaagcactcttgacatttagggccagataattcttcgttatggggctgtctcgtgaactgtaaaatctttagcaacatccctggcctctacccctgtgatgccagtggcatctccttcttaccccccaccccagttctgactaccaaaaatgtcctctgggagccaaaacggcccccagttgagaaccactgcctactgttacaagtggaaagtggggagcagaggattatcacctcacaattcaccagggaaataatactaaagggggaaagagccactcctagggctgggcttgacaacatttcagcattgggtttgaagccttcattttactctctttctccaatgaacctggggaaggttgtcagaaccccaaagggcccagccaatcctatcagcagaagcaattgtagtctagggtttaaggatcctagggtcaggaagttctaggtctccctcctgttaacactaacacctctgtgttttttgtttgtctgtttgtttgtttgtttttagagacagagtctcactctgttgcacaggctggagtgcagtgctgcaatctcggctcactgcaacctctgcctcttggattcaagtgattctcttgtttcagcctcccaaatagctgagactacaggcgtgcaccaccacgcctggctaattttttgtattattagtagagacggggtttcaccatgtcggccaagctggtctcgaactcctgagctcaagtgatccactcgcctaagcctcccaaagtgctgggattacaggcgcgagccaccatgcccggcctgtattgttttttagtacaggtgtgagatttcagtgattataaatgacaactatttagcaaaggggcaggcgtgagatgatcactcaataaatatgagctctaattttgtatgtcattatcataagcatcatcatcatcatttaaaccaggttttctcggccaggcgcggtggctcactcctgtaatcctagcactttgggaggccgaggggggtggatcacctgaggtaaggagtccaacactagcctggccaacatggtgaaactcgtctctactaaaaatacaaaacttagctgggcgtggttgtgggcacctgtaatcccagctgctcaggaggctgaggcaggagaatcgcttgaaatcgggaggcagaggtagcagtgaggtgagatcctgccactgcactccagcctgggagataagagtgaaactccattaaaacaaacaaaaaaacccaaaaaccaaaaaaaacaaaaaacaaaacaaaaacaaaaaacaaaaaacaaaaaaaaacaacaaaaaacaagttttgtcaagctcaatggtattgacatcatttgggggcagacaattctctattgcagaggactgtcctgtgtgtggtaggatgtgtagcatccccaacatccgcactgtagatgtcagtagaactctcagttgtgtcaatcaaaaatgtctccagatattgccaaacatcccctgggacaaggagggggatgggatgagggacagggtgggaacaaaactgcctctgattgagaaccattgagttaaacccactcaggggacagaatgaccatctggcacagtaataattctcttgctatgttttattccccagagctggtcccatgattttcccaataaaaataagaaggtacttcccaacctgcttaagaaaatgtttgaggtatcaaggccagatataatacccagatgactgttattagcaactctgatttcctgatgcagagatggggaaagcattcccatctcctttggcctttatgtctcagaaatgctgtctcaagactcctagatcacacttgttctatttccagtttcaatctggcccaggggatccatgcagcaaatccagttagttacttaaaatgtgtcttaatatttggcaaccagatggaaaatcattgctccaaaccttggcctgcatgttctaatgaaaatgcttgttagatttaatgaaaaccagatgtgaggacgatctggctgtgacatctgtcaccccattgattgccagggttgatttggctgatctggctggctaggcgggtgtccccttcctccttcaccactccatgtgtgtccctcccgaagctgcaagctcagctgaagaggatgaccatcccctatagagcaggacaggtctttggtcaagggtattcgagtagctatgctcccctgctagaacctccaacatgctctcaaggtccattagatttaatgaaagccataggccagaccatgaatagtgtggcgttttagatacacaagaatggatatgcagaaatatggtattgctgatgatgtggatgtgtacaatgaggacctttagttttcctatgtttgcctgacactgaggtttcttgtgatcagtgagaagctaagtctgatttggagtctggtaaactcggctcccaccattctccattcaaaatcagcagaatattgtggttacgagcatagcatttggagccagacaaacttcaatggctacttagcagctatgtgtggctggcacatcactggtactcaataaatactggttgactgttgaatattgcccagcctcagcgataataatgcataatgcttagtttattcatcttgagataaaaacaatgtctatgtctggggtagtaaattagataatctttgtaaaacatttagcacaaaggaaacagtcaaaaaattatagttaccatatgtaacagatgtacgagattcacagccattttgttcattctttattcattattcaactcatttttatttagtgcttactttgtgtactgtcctagcaattagtaagtcaacaactaaagagacctaaatgagcaattgcatactgttttctagttaataatactgcaaatgtttaatgtgtagaatttttttggtcccatttgaatccactgtgtgatgaattatcacaaaaaaatgaactgtctccaattatttaactttctcaaaaattagctagaaattcaggggggaatttccctctcagttcctgccacatctccacagcattcaataatactttttaattttcaaaaagaagtgaagtttccaggcaaggcactgacaagtaagtttaatggaatttattgcagacttattcctgatctatcccaagagtcccttgatttatttagtttatcctataacataagaacatgggctacatggatgaggaatgcagtcttaaggccagggttgtggttttctgtatccttctgtatctttggatggttacaattccctctcttagcatattttcatatggttaagtcttagcgtgattccattgccaatgagtctttgcctaggtgcttggaccacctttgatgccatcttgtggtcctacatataattctagtctccatagtgaatgaatggtgacctcccccaccacctcccagctcagcctaagaggtaatggaatgatcttctattgactaggcaccagcaaggaagaaagaagacccaaacaggtgcaggtcctttgagcgagggtcaggtgtgaaggatgcagctgcattcctcaaaggcaagttcttcacagaagcttatctggaatgtcccaattctcaatttaatagtaaaagtcataaaccctattattattatcatctagtgcttgtagagggccttccctgttgccattctcttgtcttagagtagtctacaaggtccagcttagactcgacttcttgcagaaagcctccacaatctctcacatctgaaataaaaatggtccctctctgatcatttgctacaacctgtttcttcacaatacttcttactgcctgaacatatcatgcacatttttgtttacttattgtattagtctgttttcacgctgctgataaagacaaacccaagactgggtaatttataaagaaaaagaggtttaatggactcatagttccacttggccagggaggcctcacaatcatggcggaaggcgaaaggcatgtcttacatggcagccggcaagaaagaatgagagccaagtgaaagaggaaaccccttataaaaacatctgatcttgtgagacctattcactactacgacaagagtatgggggaaactgcccccatgattcaattgtctctgacaaagtccctcccacaacacatgggaattatgggagctacaattcaagaggagatttgggtggggacacagccaaaccatatcacttatttattgttattacttctcctctacacactaacctggtcctatcatgataatggggatctgtctgcagcagcagtgaagggggaatggaaggaatccactttttgccaagtgaataagcaagtactcagtgccaggggctgggctgaggccactgctgaatactggctgttggtggtgattcagtggctaagatttgaccccaaaccaccactggatgcatgttatcattaatcctggagactcactgagattagttaacttgcttgagatcccacagagagtaaaagatggagccttgatttgcactcgtggactctgattctgtgcctgctttcttaacctatttgcaaacggcctcaacctcactttgccccttcatttctaacaagggaagttcctttgccttcccgttttccaggtcattgcccaggtcctaacccacctgtctggttttgcaaaagtctaaacccctcgttggctgtggctttctttcccccattaatattcagagctcaagttgcatcaaatggttaaaaaataaagtgcatattattaaacttttcaataatggagtcactttaatgttgggaaattctaccacaggataatgctttttggcaagctcctgttttagcaggaagcctgcagtgaaggtatgcagagagagagagtgagggggcatctgtttgctgtcagtttctctgacagctctgtttgtgtcaacgttcccaaggatggtaactatgatttcacaaaagggtcaaagcccatcaaacctttttgcctgctgtggtcccacccccaacccttctctcctgcctctttgtcccttctaaattaaatcacattccactgccttttattgaacaacctctggacaaaatactcttccacacactcctcgcttaaggcaaagtaattggaacagaaagtgctactggccaagagccaccaactaattgctttatgcccaactcccctcgccagaggcacacccagcattgacaaatccatggctgtttcccagttttttgaggtttctgaaacaattggtccaatcttaatagtggggcaggtgggggagagatgcaaagcaggggtaggggtgggagaaaatgaattctctgtagtcattagtaccttttacctggtctgtttaatctcctattattttgatcatggatatctggttttttaatttcctgtaatccagcaaggaatgccgttctaaggacatctgtggtctctgctttttcatgttccaaaaatcctaaaagagatgttttgtcaatgactggatatttcattagaaatccaaagattcccattaacttgaattattttcatagctctgatcaacttttaggttaataatacatgatatttaataacctgttcagatcgtcaccaaaattattgatttaataatatttggtcattaataatgaaaaaggaggggggagtgatagttcctatcacttacgtcaatttattccttattgcgttgcaaatctcagggaaaaccaatcattgtagcaacttttaatatcccaccgtcgttcttggtagaagccaggaaaatgttctgcattttaaaatgtctgtattcttaagtttaaagaataaatacaatgaaggcatctgtttaatccaaccattcttgatttcagaactttccgacagtttgtagaaaccacagcccccactcctcctgggttctctagcacatctcaattggctttcttcctcttttttattatattctattgagtcacattgtaatcaccttttgtggttctttgctaatatactttgaaatttgaaacaagaattgagctgaaaagttcatcatcaatttattttggcaacatgaaggttcaaatagttttcctgtagaggtcgtattggtgatggggttaaagtgagcatttcatcttatatgaaaaaaagtagaagtcacatgtatgaaccagatgtgtaaatattgattactattttgaagttatcacattttatttccaactttaaaatcacttttttggggagcgtcttttgaaatttgtcctcattgttggaatatccctatgaggacttttttttaatttggtaacaataaataagtctcttggctgacttccaagaagaacctacattatttcaaattctattcaatacttaatggtgttatggcaaatttccagcacctaactttccaggcaatgagaaatttccctctagaattgtattttgatggaaactgatttcctgtattggataaataatggacaatatgtacgcaactttagctcaagaaacatcatcagatttcccccaacctgaggccttctctgcacatgccagaacatctgcaggaaaaaagtgcctggggcaggtacagggtcactgtgtctacacagtgctagagcatctgtatatttgaaaacattcagacaattaactctatttttcactttttgtcacatagacccagtttgagtttaacgaaaaaaaaagaaaagaaagaaaggaaagggaaagaaaaggagaggaggtgggggaagagaggagaggggagggaagaagaggggagaggaggggagaggaaggaagaagaggggaggggaggaaaaaggaatactcttaataagaccgtaaagagtgaagggtgcaatttacggagagtagaaacaacctttgcaaaactcaaacggtgtccataacatctcagctgaaaatatgttttgggttctacaatagtgattctaaatcctgctataacacaaatacttcataatcaacctccccccatcttgtttaatatttaatatgtaaaaaagttattatggtagaacggaagaatatgacttggattttgagttgagcagctcatgtagtttaggagagggcattgtttttcaaattgtggatcaaggcccattagtacaatgaattttgtggattatgaccagcatctttcttttttttttttattatactttaagttttagggtacatgtgcccattgtgcaggttagttacatatgtatacatgtgccatgctggtgcgctgcacccactaggatagattagaatacatttgagtaccttgcatgtagcaagggaagtaaaattgtttaattgactgtttctttataacatatgagcgcacgtgtactgggtcacaatatcaaatgtgttttttactataggtcaattacaaagaaaaaaagttctaaagccctggtgtagaaggaacagtttctcatattcaggggtagaaagaagtaacataaaagctaatatgcaagaattatacctcccaagtatattgaaaaaacataatcttttgttggtttcattttcctgtatccgagcaaaaatgggtatcttttggttctacttctctctttatttctcaaatgctcagcagacagcaaagtccccaggggtttcttagacaaacaacctctgatggtatgtttaaaggagagtctaatttcacaaaattaaaataagccaactacctaatacatatgtgtgcattgattgcttttatttaggaaagacaaaatgtcattccaaaactagaagaaattgtttggggggaaatattttgtctaatttgtagggaaagcagagagagtgcttcagcttggttttgaaacaggaatggaagtatagaataacttcagttaccaacatttttaataacagagaaaaatcatctcacttctccattctgccactataatttcaggcccacaggtaggttgacctgacatctgggaagtgtgacttgcccctcaccatttcagttacagggcatatttgctgtttatacgaagctggtggctctcagtatcatggcctttcaggtgcagattttgatgctccatgatgaatctggctcttgccacacctggattttaatattcattgttaacttgaggagctgccgcaggtgggacaagatttcattatgagctctttgaacttataccagttatagaagtggagaaatagatttcacccaagaacatttttaatgttatgtcagagcccaattgatctgatggacttttaatgacttcagtgataataagagagatcatgacttagacccgcttcagccagtgtggaaaggttgctggcaatttgcatggtctgatgagatctgaagtgggaggaaatggacatctgagttctaagacatcgcgctctgcagaggtgccatgatctgctggctgctggggacattgaccactgggcacgcgtgctgtgaattctgcatgcctcaagtcacctgaatacatcagcaaaagtcataacctatcaagaaagcaggcagactggggggtggggggaaggtgggagggttggactcacccacagacaccggaagacctgaaagaatgctgaataaaggaggagtggcgaaagagaggaagaaagtttccccactgttagaggccatttaggctgcttaagagcactaggagcaatccagagaaagtacttttcacttgcattttaagcaaataggaggtttagcaggatattatcacctggagagcacagtaatgggtaattgagtagggaaagggactgtgcatttctgattaatatttaccaaagtctttgtgtgttttttccttaaatgttaatgatgtgacagatccgactgaagaaaaaggacactgtggttgggaatatggtactgtgcccatcaaattctgcctcctctatgcttggcttatgatgaataccattctttaatagcaaactggtgttcgtgaagaacttattacggaggctaagagaaaaccaagaatgaaggaatgcccgcctggcagtgatcaatcaccccctcttaaagatgaaccgatccttctgttttaaagtaacagttcttacgaaggtctcaaacataaatatgcaaggcatcgaagcaattaccgttgccccatcctattcatgtttctgtgcatgtttgaggagaaggtgaagatggcgcccacctttcccgggagagttttcttctaggagaaaggagctgaggctcttctccagataaggcttcctattaaatggaggttaattattagtaccagcagcataataatatcctaatgccaaaggacgaagtcacatttggttagagatttctgcattcctagatgcagtagtcaaaagagagtcactcccaagagagctagctaaggaagccatgcttgagaactaaggaacacgagagtctgtcttcagagccaagatgccccagacccggaactcatttcgtggccacgtgaaatttgcaatgcctttttcagtttacccctgactttatcatttcttgctcaaaaatctttaaagcaagatttctccacttcctttaccttggcactgctgacattaggagctagatgattcttctgagaggggctgtcctgtgattgtagaatgtttagcggcatcccaggcctctccccagtggatgctggtagcagcccctttaatagtggtgataattaaactgctttcagatattgccaaatgtctcttgagcggtaaaatctccccctgttgacaacaatgactttaaagataacttggcgccttcagaaaagtttaatcttttctgaatgcccaaaggccttgatctcatctcctttaacctccacttatcattcactgataccaatcccatagagttctctctctttttttaagttatattttattttatttttatttttatttattaattttttgaaacagggacttacagggtggcccaggctggagtgcagtggtgcaatcacaccccactatagcttcaacctcctgggctcaagccattctcccacctcagcctcctgagtagctgggactgcaggcacaccccaccatgctcagctaatttttatattttttgtagagctagggttttgccatgttgcacgggctggtctcgaacgatcctgggctcaaacaatctgcccacctcagcatcccaaagtgctggcattccaggcatgagccaccgcacccagccttattttatttttaattggcaaataataattgtacatatttatggggtacgatgtgacgctttgatacatgtatacattgtggaattatcaaatacaagtgtttagcatatccatcatctcaaatctttaatattgtgggaggagaacctttcaaatcttctattggctattctgaaatataaaacatattattattaattgcagtcatcttcctgtgcaatagaacaccagaacttttttctcctatctaactgtaattttgtacccattgactgaggtctccctgatcctcccacgctccagcctcttataaccacctttttactcgcttttactttttttagatttcacatataagtgaggtcatactgtatttgtctctctgagcctggcttatgtcacttaccataaattatttcctctagggccttctcacactttctttttttttttttttttttttttttttttttgagacggagtcttgctctgtctcccaagctggagtgcagtggcacgatcttggctcacttcaagctccacctcccaggttcacgccattctcctgcctcagcctcctgagtagctgggactacaggcgcccgccaccatgcccagctaattttttgtatttttagtagagatggggtttcaccatgttagccaggagggtctccatctcctgacctcatgatccgccggcctcccaaagtgctgggattacaggcgtgagccaccacgcagggcatttttttttgttttttttttgacacagagtccctctgtggcccaggctagggtgcagtggcactatcttggctcaatgcaacctccacctcccaggttcaagcgattctccagcctcagcctcccaagtagctgggactacaggcatgcaccaccacgcccagctaatttttgtatttttagtagagacggagtttcaccttattggccggggtgatcttgaactcctgacctcaagtgatccgcccacctcggcctcccaaagtcctgggattacaggcgtgagccaccgcgcctggcccttctcacactttctaaaatgctccaggagcaagccctctgcctgtatctttcccgttgctgtttccttttaggcccagttcactgtagggtcctggtgcccagaacaggccctagaatatggacatgcagatgacttgaccttctcccacagccctgcatctgccaaaattccctctcccttcaagccatagcccagtgggttctttggcagaaggcttcaagtctatcatcatggttgagaacataaactctggagctatcctgagcttaatttctcctcctcaacctgccagccatgtgattggcaagttactgcaacttctctgtgcctcagtttcctcatctataaaacagatatcatagtggagtccatgagggcctcagagggctagtgtgagaatttgtgaaaaaagcatctgtcacgtaacaaaagcagcaccacctcgcctctgtttgccataagcagcacctcctaacctgaagccttctctatgggagaggtttgaacatccatctcagttttcttgtagcatattttcattgactacattttctgagccaaaatcaggacatggtgtgtaatagcatctaggacaagggtccagaggtctgaaatatgagcagcctgaaaacctgtggagagtagttgtcataattatagttcattcccatgtgtgtgcatacacgtgggtgccgcacgtatcttcccaacaggtcatgggtgggagaccgtatcttcatgtctgttccatgtgcagaagtattaatagagtagggagagtgtagggggcccctgtggaatatttgttgatttgaattcttctaatttaatgaaaggagagcctctttcagaaactcctctttctttctggctccccaagtccttcagttaagaaagagatgatcttttgcaccctctaatttcttaaaggcaggtcctgcacttcttaccagaacaattcagggtaagatttgttatttgtcagaacttgtggaacaatgttttgttttgtttttaatttttctaaacataatctctcttccccatggggagcttgattaaaatgtagatttctaggcttcagtttagacttaccaaattagaaattctggtgatgagacctgagaatctgaatttttaaatgcatcccaaccactcatgtttactcttactcctgttgagaaccacaactttaggataaagcagcaaaaagtagagaggctctttggcattacacatacacagagccagagagagtctgagcttgaaaatgctgccatttttatgaggggagtaagacagaattattttcctctgtgctttctgtcatgttctggataatgtaagttatgcacatggaggcattttcttttttaaatgaaaggcttgtattccacattccacaactcttaaaaacaagccgccctgaggaggaggactaggtttttacaattatagctggaagacggtacgtgttaccctcaacacaaagggcagcacaggtagtcgacaagttctgagaattctttctgaatatcatgagtgcagactgtgacttcagagcatcccttttgggaagtctccattagcaggtgtaccaaaaagggttccatatggctccaatatccagtaggattggatgcatatttgagcacaacccaaagagatgaaataatccatccttggtttatttctagatgattaatctctcctcaatatccaagacctgttttatgattaatttgagttttcccacaaccaagaatctgtatcacatcctcaagagtaacagagccccacatccaatgtgatttatttaagaaacaaaagcaaacaggctgctgagtctctaccttcagtgtccctggttcgccaacaatttcataccattaatttctttttcttccttccctgcagtttctgaagaatacacaactctcccttctgcccctccaccctctaccctccaagaactcaggacagttcttgggattttttcattatctcttttcagctggaggtattccaaatggacctcttgaattcccaccctctcatctcctgacttctcctctcctgacttctcctctctccatacaaacattctcaaatctctcttttcaacaaatagacaaataactgaaatacaaaaatacacttccgtacttcagttttctcattttaaaatgagcttaaatatagtatctactttatagggttttgcaaggattaaatgagttagagctaaagctcttagaagattattggcccacaggaagtgctcatctactctcaggtaataatttcatgggagggtgtgtctgtctcaatcacctatcatctgtctgtcggtctctccgcctgtctctagacctatgcttctttctcaatccaccctatctctctcttatctttcattaccaacctctttggaagagtccttctcattttctccctggagctcctcctctcccactcactcccatctctttcaatttgctttggccaaccctagctggacctgaagacgtagttgcatggcccatcctgtgatttctcttttgagctcatccctccagaaagtactgcaatattgtgcacagaattttaattctccctttgttttatttgcagtgttgcaatggagtttcatcgatatttccctttctaaaagaatcattctttggttgtggatgtagttgcggctgctgttgttttcctggttatgatagaaacagaagcttgtagtcctagataatctctcctgacctactttgtaagaattggagtgctgctccttcccaagctctgtgatgatgcttttgctctgttcttcctccaatgacccagtaaatgtcatggctccctaggactctgtcctgggttctcagctcagctcagctcagctcatctcctctttacactcagagatctcaaaatagcaaccttcaagaaggcctggtccacagaaatgttctgttggagcttcacaatactttaaaaaaattagtttctacatttccattttttcacctaacaattcctatttctggcttcttttgaaaaatcagggcgtttcagcatgccaggcttgtgtttctgtgtgatcatggccagctggagctatgagtagagcagtcttaatcagggcatttccaaattcttacaaccatcttcacttaattctgttcactgccccgcccctctaggcagcttaagttgtcattcctattgtgctagccctaggtaagttatggctccgcaaaacaaggacagccaaatttttatttttcagcccaccgtgaccctcatgcccacagccaaattcccatacatgttccaataaatcccagactttctccggccctctcttgctgctcacacttgctgcagcccttcttctctatccctttagcataaccttcagaactcaacattccatctgagagagtgttcagatctggaattctaaaaggaaaaaaataaattatgttatgcattactacttggaggcatgctagttgggcaccactactctataagaagactctagttacataataaaaaaaaatgttaagaagatacgtgatcaacaaggaaggcaggccaacgtctgttggagcagttgggatatgagataaagagtactggaaatatggtggtaaggggtggaaattcagaccatagtgaatccaacagccatggcagagaaaagttgggaggcagataacattaaaataaaataaaataaaataaagcagatgcaaaacctaaaataaagctacagaaagagcttgtgggttggcggtgccaccgagatatagatggaggcagagacttggggaactgttgatggttctggaagatgcagctgagtcccattttgggcatactgagtcagatgccagcagacatctaaagagaaaggttctgtacagttgaaggcaagagatgacatgtagaatagaagggtggatctaaatggcagtttcagaagtcacctatctatctgtggttttcaaaaagttctctgtgaaaaggagaacacagggaaagaggaagaaaaatgaggagcccaggcaggagataaagattcaagaagtgcaaggtcaatcagagaagttcagaaatcaaaatgataatttgatataaaaggaaattgtccaagagggtcaactgagcaaggaagaatatctgcataatatatctacatgaggctctcagacgtggccaggagaagattatttattcagtcaatgaatatacactaaacatctattatttgccagaaagcatgccaagaagaacaattcatcactgagattatatccatcagtgtagactaggttttgctacactaaactcccaaatctttacggcataaaataacaaaagtttatttcttggtcatgaaaggggctctgatccctgtcattctcattctgggcccagactgataaagcagccaccctttgaaacatggtgcttaccatgacagagagaaagaagatatgaatcagctcttaaatctcctcccagaatggaaaagcaagtcaggtggcccacgtaacttcgagaggacatcaaagtgtaattccagcacatctgcagagaagagacctggaacattggtgcaaagcctcagtgactccaccagggttgattccaagagggagtggaagacattcacagccctaaatattttcatgttatttctctaacccaaggccaactagaggggcccagtgcaaaatggaaatgcagaccccagatcgagccaggaaagtcagtgtttccttccctcaggcccccaccttaactcagggttgtgggatgacccccagagattgcacgctctggtacctgatgcagagcttacaatccttgggggtcatcccaccacctgggtcagggatgggcaagaggccccacctaccatgccttggtgctgccaccgccttgccccatcctgagatgctgagggcacgtgtctaaccctgactgtctccacacccatgtcccggcctcatcaagaactgagaaccatggcagaatatgggccttccctcacctatatgacccagttgccacccaggcaaaaccaggtaataggagcaagacagggacaagggaggaagacaggtagggcccaggtcaccagagggcagggaggggccagctgagagccctgcttagggagcagggagagcagaaccacacaggagcccatgctccaagcccctagctcatgtcctatgtcccactggacttcagttaacaaaacacaaattcacagataaaattattaagaagttcttcaagccagcaaccacagagccccttctgagagtgaaatcctgtgcaactgaactgccttaagtccattttaatgcctcagttttgactggaaggacatatatctcttctgccccttcacttgtcttctactttttctatccttccttccaattactctcagaatcatattcagattagggataatcctaataagaaattcattttttgttggttttttgtttgtttttgagacagagtctcactctgttgcccaggctggagtgcagtggtatgatcatggctcactgcagcctcaacctcctgggctcaagcaatcctgagtagcaggggctacaggtgtgcaccaccacaccttgctaatttttgtatgttttgtagagatggggtttcaccacattgctcaggtcaggaattccagaccaggaattcttgagcacaagtcatctgcccatttcagcctcccaaagtgctgagattaaaggcgtgtgcccctacacccagctggaaatacgtttttgatgtaacataaatcccatctactgagattacatgaacaagcttgaaaataacctattattttttaatagtcttcatcaaagatattggattctttgtaacccttggtttggggcctgagaaaaggacagggcaagggtggaaggcacaagttaacttggcaggacccataattttcaaattccagatttatgcaaagtttaagaatatcagccacggcttgcagtgagattgcatatttgataagccctcagattccctctttgccatggaggcggactgcagaagaagtcaggtgtcagggaaatagaaataggtggtcttaatgtgctctctggtgttatatctgtctgtagagaatatagcttacaacagattagcagacctgacatatactgagaacgcagtaagaatgatgctgttgatgttttcagaaatccctggagggaaattttctccttttttcttctctttctttctagaatttgtttgtttgttccccctctgtacttcgttgttcgttagcccactgccgtttatctccctgaaatagttttgtgtatctaaccatattaaacccatttatttattgtagtttatcgctgtttagcgtataaaatgtttatttatcaaccactcacgtatctaacatttacctgattgctacttgccgatgctgtgtgttggcatgtatctggctgggctgcacatatatttgatattcttagataataggagtaaatagaactgtttagaagttctaaagagaggtttcagaatatctaagaggcaaaatattctgcacccagaatgtgccctaatacccagaaaaatgtgtcctagaattgactctgagtgtgtctgaacaataacaaaacttggcagtccttaagcgtaggttaatcccttttagtatttgtgcttttaataccttaggcatctcctcttatcacaaattaataagtattagtgttttatataaggctgctttccccagtcatgtctgaactccataatgggatccagaagtgtatggattatctggttttcactcagcagtggctctttgacacctctcaatgcatggtaccaaaaaaaaaggtccatatagtcagggcacggtggcacataccttataatctcagctactcagggggcttaggcaagagaatcacttgagtctaggagttcgtggctgcagtgagctgtgatcatgctaccacatttcagcctgggtaatggagcaagaccctgtctcttatgaaaaaaaaaaaaagaaagaaaaaaaaaatggtccatacacatttctggagtggatgttgattgcttggttccattttgaccaagactcttacttttctaatctcttataaatttgcgtctgggattattctaatttacttatatgtgtttcatggacgagtatacacaaagcatccatgaagagacaatctcagatgagtgctcagaatctgggctttggaactgtgtttatacctagtcttgagcctaactagctgctgaatcttggacacatcacaaaatctctctaaacttcagaccctcatctataaaggaaaaatagtactagtacccacctcacgatatgtcatgaagaagaaacgagatgatcaatgcaaactattccgtatacagtaagcactccataaatactagctaccactgctctttccagtgcagtctggtcaaattacatgtgttgggcacctctgtcagcaagttagaaatttgaggtgtaaaatgggcttctcagtgcaaacttgttggtgtgttggtgctgtgacctctttccgccactctggatcttccccaaatggctgctcttgctcagacagaggcagtctctagagtttacacacaaccctaatttccactgaaattctttagagaggaggtggtaaaagagaggggtgattatttgggccttctgcttaaattattttatgcctggggtgtgtgtgtgtgtgtgtttgcctccagcaaactctgaagcaggaacaatgcatatgtgcactaaataagagttaccgatgttttaaattgtgcccaccaattctgagggtggacctgagaggcaggaaaaaacttgggttgggtatcacgcattcttccttgcatgtgggagtgttaattctcagtggctggtgtccactgagatggatgaagtgtccttgcaggggccaagtcttacgcatttgggtggcccccttaccttgtcaggcttcctcatttgttcattccacaaatgctcatcaaggccctactccatgtcaggcactgtgctgtgtgtgggggtacaaagtttttccccttgtggatcatacctctagaatagagggaagccataaatatgtgattgaattttaagtactatttggtagcaatatggtttggctgtgtccccatccaaatctcatcttgaattgtagctccaataattcccacaagtcatgggagggacttggtggcaggtaattaaatcatgggaacaggtctttcctatgctgttctcatggtagtgaataagtctcatgggatctgatggttctataaagggcagttcccctgcacacattctctcttgcctgctgccatgtaagacatgcctttgcttctcctttgccttccaccatgattgtgaggccttcccagccatgtggaactgtgagtccgttaaccctctttcctttataaattacccagtctcaagtatgtctttattagcagcatgagaacagactaatacaggtggcatgacaaaaataagtaaataaatgacacagagcaaaggaattgagaatggtagtgaggtgcagaggtggggagggaacaggtgttttaattaggccaacagggaggtggtatttgggcaaaacaaggtgagagaatgagtctggtgagaggagaggaagcacattccaggcaggtgagcagttgcaaaggccactggtggggagatgaacttcaagtggaagaaggggaggcacataagcaggatttgggggattaaaattagaaattatggtttcatattgaatgaaagaacaacaaaggaatgagtggattgatggatgtgggtgtggataagtgattcaatccagcagtggggaaaccaatgggctgctgtggttacagtcaaggaaaccaagctatcgtgagacaggtgatgcagtgagaaaagtcttgtgttgcattacttctcttccttatatcagttagctctgtaatctttctgagcttcagttttctcatctgcaaaatggagataatctttaatggttcttatcagaattagagattctgtatgcatcaataagctactgctattaattgattgcattacattatatcatactattttaaatatttttcaaaatgatgaaaaaggaatgcacatttaaggagggaggggagatgccctagtgtttgactgtgtagctcattttgtctttattgcataggcaaatcattattcggtaacctggaggttccttttgcaatgcaaatctctgtaagagaagaatgtgatggcttcccacaggccacctctctgggtgccccaatgtcttccttactctcctgactacaacctcgctcattctctctcagctccttaagtgctacaggcttctgctcctgccctccaccccacggctggtacacaagccatttgtccaactggtctcaagacattttgcacaattttagggcaaactgaccacctagaaatgcagtgtgaatagtgtcccctgcagctgcagaactctgagatcctgcaagcctttttgcatggcatgaacgtcacctacctcctgatttctccagtggtcttctactcatacttgagaccctatgtcctcagggaacctcctctggcctcccaaatgtttgtttagtatattgttttgaatggcattttttaattctgccaacgagaaggtcaatgatacagctgtatgtatttgctagtgtcttagtcagtctgggctactatagcaagaaccacgggctatgtggcttgctcaaccaacacttgagcaagtttaaatattccagaggctggaagtctgaaatcagagtgtcagcattattgggttctggtgagggccctcctcctgatttcttcatgggggagagtgagagtagggtggaggatggtgtagagaaaaaggaaaagggagagaaagagagagagagaatgcttcagtgcacgttctctcatgcctcttcttataaggacatgaatctcctcatgagggctccaccttcatgacctaagtacttcccaaagcccctatctcttaataccaacccattgggagttagaactacagcatatgaattttaaggggaacaagcatgcagttcttaacacctagtaagctccatatagaggttcctggccaatatcatcactgtctgcaagagataacatatggcatatcttccttaccaagaacaatttggagttagctaaactaatttaagtcattcatccacttaatgtatagttataaagcacacacaaggtatcaggctctgttctaggcactaagaatttggaaatgaacaagagacaaaagtacctgcccttcaggagcctccttcctggtgaagggagacagacaatagttgtgtatgtaagacaatcagctagtgctaagtgccattgtgcacataagacagggttatgcattcaggaataacactgggagaaggaagcagttctagattgagctgagaaccaggtgaaaaataggagccagttgtgcaaatatttagaacaagagtgtatcaaggagagccagcttcaagttcagaagtcctgaggcttagttaatggcattgatcagtcatttggcagtataaactgatacaccgtattttaaagccgtaatcatggcaaaaagcaagtgcattcaaggcaccacttgggttctaagtagctctctgttcccatcttttggccaagcagtggacaaattcagtatgtttctcactgcttaatccaatgtcttccctcaatctacctgtctctccattactaaatgactgaaatggcacctggatgtaaaggatgagaagtgtgtattttcataaagacttgtcacagttgcattacagttgggccacatggagaagtgacagaattattatccttcttatcactcaggagaattgtggaattgtacagtgatggaatttgctcttgatcaccactgtttgatcggcatgcttagagaatttaccagtgcattcatgggttaaaagggatatccagataaaggagccagatgcctctgctggcttacgctatatgggtaaatggttcttacgaagcagtgtatgatagttttgagggttagtgagggaagatttaggataaattttgtaagaaacaaatagattttaattttaggggagcggggtgggaagaagagttaaaatatgacccaaaaaagaagaagaaaatcctagtgtcttatgtgaggtccactgaaagcagagcctgaggcagggatttaggtgctggtgatttatagagggagaggtctcagaaaaaaaaataaaacaaaaacttacgagagagtgaggaaagcaggacagggcaggagaaagatgagtggagggagggtgtgatctcagggaaaatctgatcttggtctgaagcacaggcagagggctctggaacataaactccagtggagctgtcctcatttgaggtaagggggttggatttgtgtatcccaatgtcagccagtcatcagttatgggtgtcagggaggttccttaacctcccaggtgggtgactgctagcagcctctggggacaattttctggaggggggaagctgtaagcagccagcagccaccactcacaatagccatagaatggccacaccagaaaggcatcttggtgggtgtactagtccattctcacattgctttaaagcgatacctgagactgggtgatttataaagaaaagagcctgttccacaggctgtacaggaagcatgatgctggcatcggctcaagaagctcacaatcatggcagaagatgaagggggagaacacatcccatggctgaagtgggagcgagagggagagagagagaggtcaggtgctgcacacttttaaataaccagatgttgcaagaactcactatcattagaacagctccaaggggatggagctaaacgattcatgagacactcacccccatgatccaaccacctcccaccaggcctcacctccaacactggggattacaattagacctgcaatttcctagggacacagatccaaaccctttcagtgaggtattcatcgagtctcctgcacatagattctccctctgccaaaaaagatctatttttccacaaaagaaagtgcatacattcatttaattgttaacttatttattcagtaagatcttactgagcatttgctatgttctagatatcggtgtcacatcaatgagtaaactggatttgttgccagttgtcatcaaacttaagcaaatagggacgagacacaactaaatgagacattgtaagacacgatgataagtgctacagcaagagaggtcaagttcatggaagctcagagccctcagtgcagtcaaggggagagagtccagcgctatgctgcccagcatggtaacgatgaacacatatgactgttgaatgctggaaatgtcactaatcccaatggagctatgttttatgaaatacacatagactatcaagatgtaatatgcaaaaaaagaatgtgaaagcttccactgacaatgtttatatcaattatatgttaaaatggcaacattttgaatatattgagttaaataaactgcatttttaaaattaattttgcttgtttaatgtggctgctagaaaatgttaaatcacatatggggttcactttatatttccattgaatggcatagctcttggggcttcgtaaagctttatttcttcccttctgcatcacagaaaacctcacagaacagtcttctagctaacgtgtatttccactgaataacttctcataataaggaagatgtagccaagagtctctaaatctaatattcagcatttctaactgtttgaggtgcctatgttttgttttgtttttaataaggccctctaattatggattcctctttatattttcctctggtattcaaaggatcacaaacatacaatttccctcccacatcccatctagataattggagtttgattcaacactgtttccatccaccacggatacaattctcatttcatgattcctttctttcccttctccacatggaatgagcatgaatatgaatccgtggattccaaagtgaaaaggcaaagaaatataaatggtttgaagtgcgtctcttttcaagcaattttttcacctaacctagtaagatgtcactccgcagagatctcacagcacagccacactacaaagtatgataatcgttcaaaacataattgaaagatttcaaaagttgaactggaagcatttttgtcagagtttattgcaactattttgtatctttaaaaaaaaagtttatgaaagttctgtgacaagaagataaattatggaaccgtaagaatggggaaataaatgcattctggagactgacaaacagggcaaatgacgagaacatataattttagaacacaaaaaaaggtaactaaatttgaaaaattgcattagtgtatcattttctgtgtatgagccattagagggaaaaagtggaaattacaccctgtaacaaagtaaaaatgttttcagtgtttaaaggtaattttgtaatactgctactattacttaaactcttacctcttataaaaaaatccaaagacaggacccctggtgatattacctgtgtcttaggcaaagagcaacaatttgaattccattcaaacacatttgtattttgccaagtgctatcaagccctgagttgcataatttgccgtataagtgaaatagatacttttcctctgcacatttatcactctcctgtgggcttcattactgacaatcaaatcatagaagatgtacaaaattgtcatgatgcacttattttctcatgatattcgatacaaatagttcttctttacaaatggcctcttttttttttctctttgccacaacatttttgctgtctttcagactcttaggaaagttccagtgatagactttttttcccagcaaagatgtaggcctccttggaaaacaaatatttctatttggggaaaaattaaaaatgcttcagacagacaaaatcagtattgtttacaggtagttcttttactgttgctccatatgtgtgtctgtgtgtgtatgtataacatgtgaaagtatttatgaaaacaatagcttctgcctcaaattgtcttcctttagaactcatacatgtctcattactaaatcatcttaaggattaaatttagggttacaatatctaataccccaaatctagtattaaaaaaaagtaaatgaggcagtgggcaagatatatatagccttcattgtctagctattatttttctacttttcagaggattatgtttcagtccactctgaacaatgatggcaggcagttgacactgcacctgtaattggaaagactgcagggagcagtggggactgtgataaactgaagactcatagcctctggagggaggaactgctctcaactcctgttttgagttactatgtgggatgctacattcccccctttatttgtcttcaagagaagccaaaaatctggatgtctttcattgagagacagttattttctgatttttaaaagttgataatgtttttaaaagtgtataaacaccaaacaagccaaagaaaacacattttccagcgagatacagcctgaagactgccagggtgtggcttttgtggaagagactcttctctaagtttctcggggaagtcgaggtcattaaacaagagtagtggagtaagtcctgagttttattgtccctcctctctccctcccagcaagtgatctattggaaatgagatcgtctattgatagatgttgcttaaaatgtcatctacattagctgcaaatattccacttttcttaccaatattgatagtatttgaatgttaaaaatagtgatttctggctgggcgtggtggcttatgcctgtaattccagcactttgggaggccgaagtgggtagatgggttgagctcagtagtttgagaccaggctgggcaacatggagaaactctgtctctaccaaaaacacaaaaaattagccaggtgtgatggcatgcacctgtggtcccagccacttaggaggctaaggtgggagggtcgattgagcccagcaggtgcaggatgtggtgagccaagatcacgccacttcactccagcctgggtgacagagtgagaccccatctacaaaaaaaaaaaaaaagaaagaaaacaacagcaacaatgatttcctctatcatcaacaaccatcatgacattattgtcatcaacatcatcagcagtagcatctagttgagtatgttttaggacaaaaaaacgaaagatctacaaataagaccacttttattttctagacttcaagttaatttctatttctatcagggcaaacagaaggcttcaattttaatcttttacggggtcctctttccctaaggttgagccagggatctagaaagtactccagcccaaggtgtttggagggaagagggggcagctctctggaaggatgtacagcctgttgggttacggggagacgttcatcacaccagtcaggatgctctctctggcatctgggccatgcttggaggatggatatttttcggcaaggctgcctctggtatcacggctacctagacacaccaaagatattgaatccctgggatgttggcttccattcactgtgcagtttctcctcctcccagccaaagtggactctctttttcatctagaattggtgggggacagggcatgaggaaggcccactctcaacccccacttctgattaaatacattttcttttatttctgttccaaattctctaagcttccctagagatttaaacttttggaaataaaaactgggggaggtactgggtatttccgctttctactcttccacttcccttccctgacataagaagcaccacccataactacatgaatgggttggagacaaaacacggattaaatcacagaagtatctcctcactgtcaccaatccggcttctccagccacctctccatcagctctgtgctggatctcagtaggtattgtctcatctatttttcaaagcaacttctatgaagtaaatattctcatccgtgtcagttatctattgacaggacagtgctccataaccaaaacctccaaatctcagtgccataaactttaacatttttttagctcaccagtctgtggagtacagatgacctgggctagagctgggctgatctcagttggtcctcttcaataaacgtatgatcagcttccatgagggattacagcctctgcttgtctggactggactcactgacatgtttaggggattgactatcggttggctgatctaggacagcctcaactatgatggctaggacaacttggtcccatatcacacctgtgtaattgtggagcaggctaacctaggcattttcttcttacatcaatggctgagggtaaaagcctgaacaagtccattcaggtaagcatttttcaagtttttgtttgcatcacacttgctaacatcccagtagacaacatggcacagtcaagcctacagtcagagtaggaagatacaagtaagttagccggcaaagggcatagctagagaactgaagtactggggcccataaaacaagcactaccccatttcccgaattatggaactgaagctggaagaatgaaacaatttgtgtagggccagagcctgaaagtaaggtggctgggctttgaacccatacatgcctggttccaaaactggactcctaagtgcatgactctactgccttaatttttaaaaggtgcttataaaaacaattctccgtgttaatgcagcatcttccaggccaaatggagcgttgggtaattgcctgcttaatatggttgatagagaaagcaaacttcaagccaaaacacccgaatttcccctaaacatatgtaatcatcttaattttctcttttcctctgttgacatagcttagggaagacaactcccttttagcgtcagccagtgtttccctgggaagcagcatgcagggaaatagggttggcattctttcctcctaaaaaatgcattttatgtaatcctgctatctttcctgggccggcccttcactacccactggggatctctcttgcttaactgtactcttttccaatgggtttgaacccccctgcatgtctgcaatcaggcttctgttgggcaatttgggacccagatttagtcccaatcacttgaatccatttggaggctgaatttcattcctaatgaacaaactgctcaagcagtgctgatgcatctggaaggactaggtcactgatcagtgactggtttgttccagagggcagtgttgtcctaatctgagagacagatcacatttttgaagagctaaatgcaaacctagcatcaggaggagctctctccatgcatcatcgacatgaccaggaattgccaacttggctttacggatgattagactttttagaatatggcatgaagccctagttatagactcaagttataacaatagtcatcatatagcaataaagattttctgaacctttgtcaggtagcagaacctatactaaactctttctttgcattttatcttcacaaccatcctaagatgttgatgatgctacatgcccattttccacctgaagacatggagatttaggtgacttctttcccagggccacactgtcagccagaaagtgacagacacagccagggagtgggcataacacgtgattgttaggaggttagcaaactttttctgtaaagggccaaatagtaaatattttaggctttgcagaccatgcaacaaccactcaactctgctgctgttgagaggaagtagccatagataatttgtaagcaaatgggtgtggctctgtgccaataaaactttatttacaaaagcaggcagtgacctggatttggcatcactttcaagctatattgctttggccaatttactcaacctcttttggaatgcgattttgtcatctcgaaaatgaggatgataataatcataatgcttaatttatagggtgattttgaggattaaatgaatgttgcatagaaagttcttgtttatattattactaatggtttatattattgctaattattaataattacaaagagatattgtgaaaggccgtagaggagagaagtcaacagcaagtcctccctgggcataagtctcatctctcctggttacccgctgagtggccttgggcatgttacttactctctctgagcctcagtttccttttcttgtaaagaatagtaaaaggatgagtctcacagaatgattacaaaggtgaagtacatttaatgcctgtgaagcttttagaacattgcctggcacatggcaagcactttctggttgctcgctgtattactattattgaataatcatgaattgagcccaaatggcctggcttcctacctcaggctctttcccaccctacgttcctgcaggggttcttaagtattttatactatcaggcaaccccccggtgatctgctgacacctgtggaccccttttcagaatactgtttttgaatgaataaaatatataaaagattacccaaacacctaattatacaggaatgcagttaccaaaatatttaaaaaaaaaaaattgtgatgcagttgtagatgagcttctttattaacacattagataaccaaatctatcagtgggcttaataattacaacaattttgaaatagaaataagcctcagtgatatttcaatatctctgcaacaactgtaatgtgatatgcagatatttatgatttgtattggtgctaaagtcacaagtcccatgacttagtggctacattgataatagcagaaatgctaaatttcacttaaaagttggtaaaaataaaactctgggtttttgtttgttgtgttttaaatgcacatttatgaaattcccagattcatgggactcttgatgtccataggcccccaggccaggaacctctgtgcctactaccctgaagaagccattttaaacagtaataaacctgaacaacactagtgctcatccacataaatactccttgcatctagatcttttggcacataaacatcgattagatttggcagagcgatgtccacaaagagagccagcgcttcctatgcctgtgcgatcacacagcattcattcctgggtatgtgagccagaaattagggactgccttgtcccgtaatttgatgccctacatggggaaagattgtcgttgggactaagccaacgagaggtaatagaaacatgataccactgacctcatccaggaaaaatagctattgtcacaggacagtgatgctgagtatttgtaggtttggggagaaatatatttgttagtgaaatggagcttactctggagtgagtaaaggtgaattatttttcagatgactagaggaggtttatgcaatatagtattattgagtggggctattaacagagtgaattgctattgtgacatgccattaaattgtttttagtgtccacaaaggtatcattcaggagctggcagggttagtaacagagttgtatttttggtggacagcagtagatcttgaaacaaaatagcatattttacaaaaaagtaaaatatgaccaaagctgaaagtctatagcgcgaggtagtcatttgcaactacttgacaagcaccccgaggatctgaacaaggctttccggatccacactgttgtagatagtggaggctgaaatctgagcaatccatcaggaaggggaagtgaaggaagtgagaggtagagataaatctgaatcctgggctctttcgaggatgttctgtccgttccatgaatgtacctccaacatgtagcagagagactggcttaataattattggctgaaggaaggaaaaaggtaaaaaaaaagaagaagaggaagagaaaaagaaagagggaggcaggaaagagagaagagagagcgaatgaattagccaaccaaactattggtggtatattgatggtatctatagatgcacatgtggatctgtgtgtgcatgaagatgtattcattcatttgttatttttcaataaatatgtattgagtgcccactaagtgttgggcactgtgccagaaactaaaaatatattcaatgagacagaaaaggacgaagctctcagatgacttacatttgagtgagggattcagagataaacaaggattgaaataagcttacttcaagatagggctaagtattataaagaaaacaaacaaaaaataaaaacattgtaacaagggagaggataactagaaagaagctatggctgggcatagtggcgcacgcctgtaatcccccaatgctttcggaagcccaggtgtgagtattgcttgaggccaggagcttgagatgagcctaggcaacgtattgagaccctgtctccaaaaaaactttttttaatagaaagaatgggctactttgggtaggatggtggccctgaagctgaaaccttgatgacaatgaaccaaccatggaaagatcagtggaaactgatgtttgattgacagcgacccacatgtcaggcatgcactcagttctttgcatccattatttgatttaatctttattgaaaactgtgaggcagagtatttataacaacttcatcgatgacaatgaagaaagtgagactcagagagacaagatgacttgctcacggtcagagggccaggaagaggcagaggcatgatttgaaccctgacttgctggatccaaagcctcacagatgagccagggtgccctgctgcctcaagaccaagggaaggtctttattcctgttcatgctaatgaggggagaaaaatttgctctaaagtctctgtcttttgatttgcaaatgagtgttctttttttaataccatgttgtggctgtttttggctggtcacttggctttaatcgtaaaacttgttgtaatccagatagtagatttcatcttgagggtgattcctaaatgatactaaagaaaatgtacatctttcctatgtggtcaaagaactgagtcatcttcctaagttagatggtggtggggaaagggacagggacttaaagaaaacaaattcttccactgaagaggctcaaccccatatgggacacattttctcataactaaactcatatgggctgagccatgtggactgttagaaaaatagagtaattttagtatcaaccagctacatcctgctctgtttctgccttggtgccttggttttattgtttgtttgttttcttgttccgtacctgcttcactggggccagtgaatttggtgtttgttgttgttgtttcttggtttttgtttatattttaagacagtagattgctataaaacattggtagtatgatgatagataattgcttaccaaagacatgcaacttaaaccaccaagtaccataattgttactgttactatgattatttggggtatcaattcgctatattatttctttatgtcaatacccagagaaatgagcaggagcacttttttttttagatggagtctcgcactgacgcccaggctggagtacagtggtgcaatctcagctcactgcaacctccacctcccaagttcaagtgattctcctgcctcagcctcccgagtagctgggactacaggtgcacgccaccacaccaggctaatttttgtatttttagtagagattgggtttcaccacattggccaggctggtcttgaactcctgacctcgggatccaatcccctcggcctcccaaagtgctgggattacaggcataagccaccatgcctggctgggcaggagcacttccatatgcgccaggagaaagtccaaattcataaccccctctgttgagcactttggtaagagatcaaaggcccatgaagtgaacaaaggctgtgaccccgtacttacatatctagcaatctagtaggagaatctctgcactaagatatatgtaaaattatatccagtgaaacattggtaaaatagtgaaaaattagaaacaacaacaatatccaataataaggaaatatttatttttgtcagtaatataaaaacttttattattttagggcaatacttcccaaatttcagttatttgcgcaccattttcacaatgtgccaaagctctactctttattatttaatttttaaattttgtgggtacatggtagatatatatatgtatggggtacgtgtgatgttttgatctaggcatacagggattggttacttttttaaaaatcgggcaatggatcatcacctagcattaaaaattcatgtttataaaatgaaaggtttcccacatattaagtaggaggaacaaaaggcaacttacaaaatagtgtgtacattataatctgtaccatactatatccatttatagctataatatatcaataagtggatgtaactatagatagatactgttggataatattgttattacattgttatgatacaatttatcatagacagtgctcttctttacatttttctattacttccagattttccttatgaaacatgacattatcaccaggaaaatatgcacacacacaatgaatgaaggtcggcgctgacggtgcaagtttggctgtcagtctacgcagagtggctctgcgtgtcttctcccctcccgtgccttgcttaaccttcggttggatgatccacccttttctgtggccagcgctggctcctggcatccttctgcttgccttttggttttcagcacaaattcctgatctgattcaccaggtcctgcttaatatgtattaccaaccctgtgttgacaatttcagaaaaactcagtcctgcttttatactcgttttcctctcggaatggtagccggcaaaaggtgttcttagagatggggggtcctgtgtcttactaattcccataaagggaaggggagtggcagaagaagaaaaaaagtaggaaaagaaaatgttagttatgtgtggttgatagtggctcagtgggtttacatattatgatagttatcaatttcttagcgctagatgctgcaaatctaaatctatgtaagactcaagaagtggttgtgtgtcttgcatgtgaactgtatctcacagctaaaatttaaaaaaaaaaaatagaaagaaaagaaaagaaaagaaacagtcatgggagcaagggagagcaaaagccaaaggtgaattttatttgttgttgttatttaaagtaactgggtcagccaggtacagtggctcacacctgtaatcctagcactttagggggaccaaggtgtgcaaatcacttcaggccaggagttcaagacaagcctggccaatgcagcgaaaccccatctctactaaaaatacaaaaagttcgccaggtgtggtggcgtgagcctgcagttccagctactcaggaggctgaggcatgagaattgctagagcccggagggtggaggttgcagtgagctgagattgctccactgcactccagcctgggtgacagagcaagactctatctcaaaaaatatatatataaataaaagtaaataaagtaacagggtcgactgatttcagaggaatgtgtatgttgaagggcagtgtggttaggagagaagatctcagtcgctggattcagagttgcctgggttcagacccaggccctgaattcatcggcgttgttaccttgaacagagacagtactatttggcaattaatacgagcatcaagcaaccagacacccaagttccaatcccagctcagcaatttctaagtgtgccattttaggcaagtcacttaagtgtctgagctacacttctttgcatgcaaaatgagtgaaatgctatttcttttacagaatcagaaatatattattaagcctctgacacgtggatgatacataaaatggtgactaatatcactttcagtgatgatgatttcattttatgtatgtgtcttccaaagaggaagaaaaataagaacatgaggaagagggaaagataaaccagattaggttgtttatgatttcatcaaatggagaactcctgaacgttttgttatgtgttttgtttttttgtgaaacacaagaaagtcaccaggacatctgtgtgggcatgtgtgctcccctccatattagattacatgttttaggacaataaatcagtgaaagaaaagtaataaataatgcatgctgacaatgtgatcatgtttattaagaagcaacagccttgtcatcttcattttcttcttcagtgattctcttctctaagggttttctctgcagggactccctgcaatctagctggaggccattctctaattcctgtttgcagaaatacctgctttgcaaaaaaataagttaaaagctgaacacctgggtcctctgatgagtctcccatcaaatgcagcccatcattagagatggcttctcagttttgaacatcagggagaaacgagtggccccactccacgcctcctgcgtgttggtgctttcccaccctctgttcttgctcctgtctttctgctgtgagttttctaagaagtatctttaggcatctagattttgaaaaagaaaagaaaaagctaacttttcttttcctagaaatttgcagctgctaaaaccagatgtagacattagtaccttgtgacatctgaagattttaattgggtttgcattttaatctgttactcttcactcatttgcacttgaatgacaacccccccccccccccaaaaaaaaaaagccacactagcaatcctagtctctcagatgcctggagcagaattttgctctgtaaaattgaagagtgttgcatattgagaaaaagagagggagcgagccaggttgagaaagtgggagtggtgaaggagagtagagggaaagagacaggaagagagaagaaggaagaacttgcaggcggtagccaggagcaccctggctggagtagaaggaacctcacatgcgcctcaccctcagccttgtatcacctctttgaaaatgtaatgatcaatctgacccaggcagtaactgttctgacatgccctttcctcaaatgtcttgctgtctgtgtcctaggttctgagagagggttctatcttttgagaacagagctagcttaggatttcagtcaagggtcagcttatatgtctctaaatacccttgaatcccctgctcccactgcaggtttctcattattctttctgcccctaattttttttttttttttgagatagagtctcactctgtcgcccaggctggagtgcagtggcaccatcttggctcactgcaacctcagcctccaggttcaagcaattctcctgcctcaccctcctgacctggcttatttttgtatttttagtagagacggggtttccctatgttggccaggctggtctcaaactcctgacctcagttgatctgcctgcctcagcctcccagagtgctgtgattacaggcataagccatgacacccaaccctgcccataattttttttgtcctcaaataaaacgctaatcttagaaaaccacaaaggtccccctctctttctctccattctccttcctagtattataccacctcttcatcccaagacctgcatcatcttgctgaaggtgtgtgtactgtgacactttatcattgagtgccaagcctattgtgcttaaattattcactagtcaattacctgtgtacagaatccatgtttaattagcttgtcctgacataaaatatcaggattttatgttccctctggcttacctctgacattcatttttaagttaatgttttgtcttcttgcttccttcattccctctcttccagccttcctctcttattctctttctaccgttttctatctttcatgatgcatatctcttttctctttctcattcttttctctccctgctagcatttgattaagttacaaaagcagtaatatctatgtttttaatattattcattgcattgctttcctgaccttctttttccctccagggtgggaatgcagcccctgaattccttgacaggtggccactctttgacacgttagactccaacttgctcaccttcttccaactggcttcagttcattccattttgaccactgccatggttggcttctacatgatccccatttgtgtctcaacttggtctcctcagccaggagctctgagctgcctgttccttgcctttgatgtacctccatttcctgtaattaatctcagctttcccacagctcagcagtacatgacagacacaaggataaagcacccagttcgagccagctccagtgtctctccacttgtatccattcctcgtggtctgccactttggtaggcatcatcttaccccagaggtagcacatatgcatgccatgcagaaaacacaacactgacttctgttcaaagaaaatcaaaccgccagaaagtgaggtcatgcaagcaggcagctcgtcatattctcaacagggagctttgctggataattctgcttaaaaatacatatatttacatttttatttatatttagttctatgtatattcagtgttccaagaaaaactaataaaaatcaactaaacatctagccattccagtgaattctatcgcattgccaaatatagtattgggagcattgtcctaactctgttgtctccgtggtatcaaaagccagtatcactctgtgttcttgattttttcttatcgacattcctgacactggctatggggtgtgttcagcaccaaaaggtctgttttgcctaaccctttgaccaatagaacaagtagattggaacaatctgtccttgtaagggttctttataaaaatgttgtccttgcattctttgatagattttttaccattttttctgaaaaaaaaaaaaaaataggccacgtttcatgggcaagaccttgatactatctggagaaacagatagccacaaaaagtactttgaaaaattaaaggcattctactcattctattctctaaacagttaaaggcactctacttgccccatgagtctcaatttcctcacctataaagtgggcacaactcagcacgccagaccaatagcaacctctctgagataacccataaagaagtgctctgaaaaccccagaatgttctaacaatgaaaacactgtgctccatcttcatttttatctggaaaatacagcaaattatattttctttgaagctgtctacaagaagtgtttggctggattagccagttaatgttagcaaactgtgttgagatattgaaaggttttgtaaaaaagaaaacaatatatgtttttttctgacactgtagaatgtttagtgttcatttaacctggagcatagcacacctcaatataaattttctcatcatttgacactttttattgtctctgcttaccatctgaaagaaggaagctgggcatttggaaaggggggagtttgtgtatctcaggattttgacttgtctgtgtcttccgaaggagatgcatcctctatgtattacgcagcaacttgctttgctcacttaaagatatagcatggacactcttaacaattcggcagctacatagctacacggacaactcggtgtttttacgcactcacatgttacataattttacataattacgatcacattatatgatatttgctgcttttatatttttgttggtcatcttctccctctttatgtactgaccctttcactgttggtcccacccctttcccactacactctgctatcccaccccatccgaaaacccaaatcaacaacttgaagaggacgttcacactttatgccatgggaatatgacctgtttgtgacatttatactctttttctctccaggccatctctcccctgacaaagaaacacacacacacacacacacacatacatgcacatgcagacacacacacacacacacacacacacacaagggttgtggcactgcctttttattttttaatctatgtttgtgaaaatggcaagcatcctccaagaaagaagacctcaaatttgtgtctggttgctttttgtcttatttttaaaattatcatatggtaaaattgactttctcctgtggtatacagttttatgaactttcattcatgtatagatctgtgttatgacaacaacagtgaggacccagaagagctccagccctccagaaaactccctcctgcttccctctccagtcacaccctcctcctaccctactcccggtcaacctttgatttgttctccatctctatcattttgtctttgaataatgtatatagatagaagcccgcagtaattaacctttggggactggcttctttcatgtagcataaggcctttgtgatctgtacgagttgctgcctgcacctgccaattactcctttgcattgcagaggaatgttctggtacatggatgcactgccgtttgttgatgggttctcccaagagtggagatttcctatggtgctggttaagtatgtttgtttatttttattttattttattttattttgagacaggttcttgctctatcacccaggctggagtacagtacagtggtgcaaccatagctcactgcatccttgacctcctgggctcaaggatcctcccacttcagcctccagaagtgaggctggaactacaggtgtgcaccaccatgcccagctaatgttttatttttttttttagaaatagggtctccctatgttgtctaggctggtctcaaactcctgggctcaaatgatcctctgacctcagcctcccaaagcattgggattataggcgtgagccaccacacccagacaatgtttgtcccatttctagtacttcagttttaggtagtgtattcgtgtgctttctgttgcttataacagaatatctaaaagtggtcaatttacagaggaaataaatgtatttattatagttacagaagctgagaagtccaaggttgaggggctgcatctggtgagggccttcttgctggtggggacactccacagagtcccaaggtagcatagggcatcacactgcgagaatgctgagtgtgttaaggtgccatgcacaagtctctcttcctcttataaagccactagttgcactcccatgttaacccattcattcattaaccctttaatgcatgaatggattcatcacctcttcaacgccctacctctcaatactgccaggcaggggacaacattcaaaccatagcaagtagagagcgtatattggtgcatgcatttaccaaattaaaacatggagaaaaccaagggatcgaagagctagtttttaagggaacttaaaattaatttgagcttacatggcagatggactactgggaataataactccttccaccatgtattggctacttgctgtatgtcaggcactgtgctgaacactgtatttcaatattttattacctctcttaaagcccacttcagtagacactcttaattctgttttatagaagaggaacctgtaacatcaaagtagttagaggaaagtatccaatctccctcccaaacactggaacttcccagcagtttgtgcttctcttggcttgagttaagagtttcaagtctcctttcactcagtagtttagataaacttgatattatagtttcctttcattcctctaagtgatgcaaattgctttacccaaagaaaggcatcacattacaccattacaggaaaaaaaaaaatctactgaggaagaaggggaaaagagatgtttggattttttttccccttcatttttttttctacctgattaaaatgactgttaggatccattttccccttctttcttgttaagtgaagatattccgatcttacatacagaagcaaaatgaagaaaagagatgatcggttatgtggtttaatggactgatatcgtctagatgattcacaaagcagggagggtggtgtgtctgccctcctctgcctgtccctgtgtggggatggcgcttgggttccgaaaaattaaaatacatgcaatcaaccagttacctacttcaatttcccactgtagttatcctggtttgcctttatcattgatagtaacacttctgcagctaaaaatctaagaattagatttacaaaataccaagaaaactgctaacagaaatttttcttctattagctatgtagcatccacagctgggcagacagatggataatatattcgtgtttcttttttttttttttttcattctaaacactgtgtatcaagtaaattgttttccccaggaaggatcttgctggctccgtcaccaagaattcagctcctgcaggttacataactgttcgttaggcattgaagagctcaagattccagcgtctgtgaataactgatataaatggaatcactttgtaaatggctgtcaggaactgcccctccattaaggagccacgtctagcccatcacagttgccaccatccctctctcacccatcaaatctgccgctaaatcctatttggtctacctctgaagtggccctcaaatgagtccctaactctcttcacccccacggctgctgcttcatccaggactttgtcacctttcagacacattcatatcatcgccctctagctgatctctgtgcacgtagcccctttaatccattcttcttattggcaacaggagcatctttgtaaagcacagctctgacctgatcatgtagttccaaaaatactacagatcccagggctccaaacaatatttccacaagtgtagcggataagatgctttggaggaacatacaaatgaatacatttcatttgaatagttgtggtatttttagagctatctttaaaaaataaatctaataaagtgtatttttaagtgagctacttaaaaaagaaatccccaagtcagtagccagccaggacaaaaattgtgaaagtggtccacaaatgactaatgtttggaaaacactggcagaggcagaaaatccaaactccttagcccagcattaacaatacttcatatatcagtggccgggcgcagtggctcatgcctgtaatcccagcactttgggaggccaaggcgggcagatcatgaggtcaggagatcgcgaccatcctggctaacacggtgaaaccccgtctctactaaaaaatacaaaaaaattagctgggcgtggtggtgggcgcctgtagtcccagctacttgggaggctgaggcaggagaatggcatgaacccaggaggctgagcttgcagtgagcagagatcaagccgctgcactccagcctggacgacagagcaagactcttgtctcaaaaaagaaaaaaaaaaaaaaacaatacttcacatataggttcctccaaaatagcaaatagtcaccttaaggtctgcctattctccctccacacaagcttttcaaccagggcttttctctcacccttagtcacatcaaacactcggcagttttttcagcacactaagtcctttcatatttgtgctcttcctccaccccccaacccctgccaacatattgttccttttatctattctagattgtatttttctacctgatggacttctatatatacttcaaaacccagtttacatgtgccaaactttgagaacccttctctaagtccctcaggtggaattcaccaggcctctgagctgctacactctgctggtaacattcaacacctgatgttctggctgtttcagtaggtgtttccttcaatccccagcactaaggaatcccacagggctgtgcccaagtctctgtctctattgaccagcggtgggcatggtgcacagagaagggctcaaacattttctgaacaaatgaggaaatgaatagctgagtgaatcaaggcagattcaagggtgtctacaggacagggaggtctcacacacaactaatctgacaaaaggaattaatcacaatacaccatcctccctgctaagtgggtctgagaaagttgttctgacagtgtttctcaagctacttaaccacaactatcttttcttctttaaattactctgaaacatttacccttagcaaatggtgacacagctgcacagatgccttcacataacactcacaagacttactataactgcttgctctctgcctctcctccccaccagattctcggtttcaccagagcagagactaaggctattttgttcattgcagtatcacctgctagtacagggtctggtttatagtaagtacttgttatttcctgaataaatggcatctaaatacatattccatgaatttatgtggccaccagactatctcgatttttccttgaagaaagagactgggcaaggtgaggtgggaaacctcccacagaaggccccttcaaagcaagccctttctttaaaaagtatttgccctgcgtttactctgccctgctgtggtaccagctgccagcctggagtactttccttcattccctgaattcccactgtcctcccaatacaaatcaatctaattctgtgttactggccagcattttgcttttaagtggcagtgatcaaaagtggaatctttcgtgtcagatagagggctagcagagtggctggcacatggcaaggcctcaaaagtgctattatcatttacaataatttatcatgatgtttacactcctaatgataataaatgctatgtgcaaaaaacttggttctctttttctggtcccttttatcattttatgtccagtcctgaatccattcgactgtttattaggattcacactaaaccatacctatcagtgatagctgccctaagaagcttttttgcatgtttctcagcatttaatcattttaggacttcgctacagaacttctctaatcccatcctctttatgttcactcatgcatgtactttttatctggccgtttttttgcctcactggatcttaattttctcagtccttcattaattcgttcgacaaatatttactgagcacctacgctatgcaaaggtactgttctaggctctcagtgcacagtgttgaacaagacagaacagcttttaccctcataaaaagtttactgtagtggggagaaagacaaaaagaagaaaaaagggaataatatgtacataaataaatatgcaatatatataatatgatatactaaaatatgttaatagaatatagcattatatttaaaagatagaggggccaggcacggtggctcgcgcctgtaatcccagcactttgggaggctgaggcgggcagatcacgaggtcaggagatcgggaccatcctggctaacacggtgaaaccctgtctctactaaaaatacaaaaaattagccaggcgaggtggcaggcgcctgtagtcccagctactcaggaggctgaggcaggagaatggcatgaacccgggaggcggagtttgcagtgagctgagatcacgccactgcactccagcctgggtgacagagcaagactccgtctcaaaaaaaaaaaaaaaaaaaaaaaaagagggacagtcacgaagacctgaacctcagtcacagagtcagtggtttcttggtttaatttctgattctgacccccatggctatattccctggccttgccaggtacccaaccagatctgtattatctcatgacccaaacaagcttcccgctgacctttgcacgtttccagtcttaccactcctcaggcttcccagaccttctgccgttggtggttctgatctgtgcatcactctgggaagagggagagctttgggggcaaagcatgccaggtagaatctgtccagggaaggggtgagttgagggacggtgtggacagcaggtactccagggtctttcccaaacccgtatcttgcctatcaatcaaaaatgaagctttgtgtgtcttgcatttcaaaggcatgctttagccacagagaactttctggaggttcctccttgcactgtggaaacattatttagcacagcatcttaaatgaggtaggcggtatgggaatatttgttaagtgtttgagaccatcagaagctgaccaccaaggaggttctgggaatttaactccattgatagggatggtgcagtgagccacgtgggtaccactgctgtccctcggtggatggaggacacctatagctcctgagcagacagcaaaatgagctccaaggagccaccccaggccagcagccagcctccagagttgtctgattcttcatggccctttttcagactggcgaaggctgggagcccagggcatcattagtatccttccatcacttcctcattagttcttagatagtgttttaatgacagcttgagaggctccgcatcctggcctccttctatttatgatccccaccgtgttaatgtgcacttaatgagaaattcttgtcttgcttgtaaatcctgtagccggcattcaatttattgacagatgtttgcttggatctctttaaaattacttcataaatcttcccagataaaaggcctcaagtttggttattaagacaaggccttgttgacagtttcatatttaactgtttagaactcagctgtcagggctgtaatggggtgtatggccaaggggcacagggcctgggtgctgtttgtcacctttcctgcacctatccgggccctccctggtggagtgtgtctactgtttcctgcaatcccctcagttaacttctgggtgacctcgctgtgccttgcacttattcatttagcatatcagcttgtcagtgtgatgaagtgttcctgctgataggcgctaagggctgagtaagccacagtgcctccatcaccggggagaagtgttgatgggagcccaacgctgaggtcgcccttcccacaacagccaccaggcaccagctggaaacctgtgggcttcacctccatctgtgggcaggaagcaagtggatgtcagggacggtggtggggggctctgcttggaagttttaagaccacactcatcttttgtggccatggacttttcaataccatcctaagtcaagattttttgttgtttgttgttgtttttgttgttgcccatgacagaaaactcacctcaaaatgacttaaggaaagagataaaggagaagaaagatagttaactggctcatgtgattgaagagtacaggggaaacgaccttcaggccaggtgcaagggttaaggtaattttgtttcactctcttcctagggtcctccttcctctgtattagctacactctcagatcctgtcctgcccccagcagctccacagggcttccggttcagaccggaagaacaggagaacagaaggccacgtgcttctcttccaaatgcccaggaggaaaaaggctaattaagtctcattggtcccaccaggtcacatgtacaggctttagccaatcactgtggtcagaggtaggctatgttttgattggttaggtctgagtcacgtgatgagttccaatacaagcacaggaaggaagataaggccagaggatgttctctagagaaaaagtggggctatgttacctgaaccagtcagcacacatgttcagatattctgatcaagttcagaacaacagcctgctttgtctaatgcttgcatttcattttgaaaagttgttatacattggcagcctctgagctgaactactgagggtgtggcctactcatttgcagagtgcattcaaaagattaaaattccagaaaaccctggagaggccaggccattgagaggtcctctaaacccacccacaagccggtaacagtattaagatgaaaaaaaaaaaaaatgctctgcttaatactatcacaaatcagcccattgcatgtaagacgataatgagcacttgggccaaaaatagcgtgttttttgcttacttgctggtgtcctgtcacattgcattgcttgaactgtgtcagatcgcattgagtaactttgcttaatccggcgctgacgtgacccgctgctttgcaacacttaagacaagtgtgtaggagcttttctcctcagtccattttgtgtgtgtgtgagtgcagtttaccagatgaggcatatgtaaatactattcgaattgaaaacacatctatttaagctagaatttattaaggggcctgtaggagtgaaggcacaagaaacatttactcacagaccccgacaggcttctacagaagactcactcctttgccccagaaaataccacgtttactaaattctgatattcacagtttcctatgtggaaacttctgaaaagtttagggcacactatggctgacagccggaaggtaaacttggctatgattttctgttgggccaactccccatgcccctgagaaacacattcttcacaaaaaataattgtaataggccgggcgcggtggctcacgcctttaatcccagcactttgggaggccgaggtgggcggatcacaaggtcagaagatcgagaccatcctggctaacacagtgaaaccccgtctctactaaaaatacaaaaattagccgggcatggtggcgggcacctgtagtcccagctactcgggaggctgaggcaggagaatggcgtgaacacgggaggaagagcttgcagtgagccaagatcgtgccactgcactccagcctgggcaacagagcaagactccgtctcaaaaaaataaataaataaataaataataataataataattgtaataatcttgacttagagttgccttgtaatgtagcctcccagtgggttctccttgcccactgcctagacacagccgatttatcaagacaggagagtggcaatagagaaatagtttaattcacgcagagctggctgtatgggagcccggagttttattgttattcaaaccagtctccctgaaaactcagggattggagtttttaaggataatttggtgggtaggaggttgaaaaatggggagtgctgattgataagtttggaaatgaaatcatatggagttgaaactgtactcttgcactaagtcagtttctgggtggaggccacaagaccagatgagccagtttatccatctgggtggtaccagctgatccactgagtgcagggtctgcataatacctcaagcactgatcttaggttttacaatagtgatgttatcctgaggagcaaattgggaagtttagaatcttgcagcctccagccgcatgactcctaaaccatagtttctaaccttgtggctaatttgttagtcctgcaaaggcagtctagtgcccagacaggaaggggatttgttttgggaaagggctgttatcgtctttatttcaaaggtaagctataaactaagttcctcccaaagttggttcagcctatgcccaggaatgaacaatgacagcttggaggttacaagcaagatggagtcagttaggtcagatctgtttcactgtaataattttctcagttacaatttttgcaaggagggtttcagtagtaataacagcaaacgcttatacaatgtttgctatctgccagttatggtttaatcactgtatatgttttaactccatgaatccctacaacagccctatattattaggtattattattattccactgagaaaactggggcacagagatggtaaataacttgtctaacaacccataatattcatggagttgagatttgaacccacacagtctgactccggagctgtgctccaaatactatatatactatgttcctcgtactatgaggttatatgggtaaacacactgactcaagattcatgccactaaatagtattacatgtattaaaatgtatgaaagatgaattaaatatatatataataatatataaaatacaatgcagatatatatgtagcctaagtattttttaaaactttctcttcaaagaattgagtccagatataataattcacaccaacaatgtttattaaaagaagatgagagaggaaacaacggcaaaattaaattttgttaaaacaataaaatgaagcagggagaaatgtaattccacaagaatgtattcaactaaaattggagtgaaaatttgggcctgaggatcctgaaagatacagcacaagaaaaacaggtgaagagttataatgttcgcctcatcccaaggttcaaagcccatgcctgtctctcaagacaagtccaagagaaatttctcccatggttcctctgatcaggacatggtgggtggtgaggaacatcactttcttttgaagaaagagagttggaggaggaccagggcctgatagaaatcccatgcattggtgtcaaaatggcagacccactctcttttcctgcacaagataatagggcctctgtttttctttccttatctgtacaaatgtgctgtcttcatttgtgttccccgagaatgacaccttgtatcaagaatttgagtacacattctttctttggttgttgatcctgggaaaccctaatagcagagtggggccataagacaggaagggaaggatgttaatgaagggtgagttatccagcctgacagcccagtgggcagcaggagcttccttgtgctggggaattctagaagagagtgtagaacacacacctcagagttatcccaatgagggctaaggatgctggggtagtttttaaccaaatcttcatctgtcattgcttggaagcttctaggggcattattctccagcatttccagcttgccctgtatgggaacagccagacaattgcccttaaccagagaagcacaggtaatcccagaagaatgcttgggagggagaggtacatgcctaggaaatacgcacaaggcacagaagaactctagcatggataattgtggcccttgcctcctagcacagttgtaatgactgaatggtaataaatagaaagcacttggactgctgtctgatttgagaaaaaacttaagagttggggaaaatcatgttggctcacaatactaaaacgtctaggagaaaaccttgaagcttcaggaaagggtggatccaggcactcaaatatattggtctaggcaagagcatggtgggagggaaatagcctgtgctgaggggtgcagagcttgtggaatacagatgaattttagagtttgatttagtaaagaccatgttgtctttgtggtccatttcatatctagtatattaagcagattcattgtcagatactcaaagtgaactcaaatcatcagtgaatgcagttgtggggcagggggcggatgagtcaacacaatttggcatcatgtagctaaaaccaccagtggtgtgatggatggtttcatttcttcttggactgttttggcattgtgtagacggagcctaaattggtgcccgcacctcacactaatcatgcccagagagagataacatggagctattgagatccccaagcagcactttggcacacacactatctgacaatatcaagagatgaaggaggcctttgaaatgagctttcgcgcgtgagtaatgaccttcaggatgtggctcaggattgtcttttgaaactggtatatcttgatggatgattgaaaagctgctgtctttggtatagttttcgtggttttatatttgaggatgtgtaataaataaatgtgtaattgccctcaacatgatgcaagaccaggaggtgaagatgacacagaaaagtcctataacagcataaaattttattaggctccccattggtaggcaagtcagtgttgtgtgaacaaagaatagtctgtcttaaggtgaccaagatagaaaccaatacagtgaggaacaaattccaccagctgatttgcagggaggtagaggagcgaggcgggcgtgaaggataggtactctcatttttaagatctttatgaaagtagtttcaggacccgtattaataactgcaacaaccacctgaaccattgaccttataattctgaagattaaccagttagtatttataaagcatttgatgttattttttcagttgatgggaatagctacatttcagtggcctgtaattcttaattcattgatgtcttcttcttccattttgatgctaaggttgattttgtgcccaatgtattaattacatgctttttgttttttattctttgtgatctcaactcagcttattacatattttttgtttcctcatgtgactctcattattggctttatacatggataaatctatctgtctcttctaaattaactttgatctcttttagtgacaattgatgggtgacaaccttagatattatacatggtgcctggaaactgggctcagctttcttttcatccccttttctttcagtaggtcaaagaatgtctttaatatctctgtataaactccattttgaagatttgtatgttaacagttttgtgctatcatctacaaaaaaggcatagacacaaaagtttaattgtagtcctaccttcttcaatccagtctagaaacttaaatgttcacaaagatttaataatattgtttaatgaatactaattcaatatttttcaaagctttaataatgtcatgtcataatatcattagaaaagaaatttttgattgttggttgccatatcactgtggtattaatgtgatttgtgtgagactaagatttctttttgtttgttttaaaccaatattcagttccatcatatctatgcataagacatgcataaaataagtggtgggtctattttgttttgttttgttttgttttgagacagagtctcattctgttgcccagtctggtgtgcagtggtgccatctctgctcactgcaacctccacctcctgggttcaagtgactctcctgcctcagcctcctgagtagttgggattataggcatgcaccaccacgcctggctaacttttgtatttttagtagagctggggtttcaccatgttggtcaggctggtttgaattcctgaccttgcgatctgcccgcctcagccacctaaagtgctgggattacaggcgtgagccaccatgcccggccagtgggtctatgtcttataacaagatttgtgttgttgttacacagcttaaaatagaggcatttgcacaaacctgataaatacaaatgtgtcttttggaaagtctctaaattcctacagctaatattttctatatcgtactatttagtgtttaattatctacgaacttcaattgatcacatgaatgttatttctctttggggatttgatctcaaatgtctagaacagtggttctcaactggggcaacttcatttctcagggcacattctgcattgtctgggacactttttattgaaacaactagggtggggaagctgttagcatctagcgtgtagaggcgagagttgctgctaagcttcccacagtgcacaggacaccgcccaccacacagagtgatccagcttcgaacctcaatagtgttgaagatgagaaatcctgcataggaagaattttgctttctatttcttaatttcttgttctggatatagtacaggcctgacaccctgtagatgctcatattcaatttgagaatgtggctgagtttgcctattaaatcaggaccccaagtggatctaagtgcagtggttttgattgaaagaaaaaaaaagtttttgcattcaatatgtatggatcatggggtgggggttgatacaaaatagaaaaaatatatagataaagaaaatgaagacatctcccaatcttttctgagattgccatcaacataaaaggcaggttattaatcttcagggtacagtctttgtatggagggaatcccttgggggttattggaaattttattgcttttcattggactcagtgtaaaatggggtaatttaggcttaacaaacaaagctcgggttgactcactttttttcagaggctccagaaagagaattctcacagagcaggaatcaaccttttcctccataaatcacaggaggaggtgagaatttggctaatatccagagcactgcaaagaaataaacaatgcaaagcaatctgtggcttacttgatgccagtttctccgtagataaatatttctgtgttttgatcttatacattcttccccctcaagctgaaactttttctgtctctcttccagtctgtctgttaggcgaggccttgggagcaggatcctgacaatgtactggtcagctcttttagggttttttttttttttttaaagttgatttcctctgctggtgagccatacatcactgacatccctgtctgtgctgcttgtctgtgacagaatgacaggtgtcatttgtcactggggcttgcggaagctgtgggaagagggattgaaattttttttctggaagggctcagtgtctgccagatcattaaaaagggggctttccaaagaaagctgtgtgtaatgtgattgcacttactgtcaacgataggctaaaagaaagagagaacatcaaaagggagtgagagaaagagggggaggaaagagaggaggagtttctgccaggggcatttaaagttcttgagctgccaatgcaaggatctgctttagttcagttctagtgtgtgcatgctaaataagtccttcagagatttccgctcagctcatggtgccaatgaggagaccgtaacaggaaacctctttaatagcacttcttctcatcacatattatgtagggcatggagacagacttggtactatacagggcatgacttgcagtccaatcattgaagagctgaggcaggaaaacctatttgaacaaaagcagagggtcccaataaatcacgaggcaaaactgagacctgctggcaggctccttctccaaagagacatttacagcatcctgtttgcataagcacgctcggaaaatgcccaagaatatctccttgcagcttctctcctcttggcatgaagtccgtcaccaaatggatctccagggatcagggaatagagtctgcttatcatttcattgcaaaggggaagtgttccttattctactccctgtgccattaaagtaataaaaagaagttaacactttcatagttctgcctatgtgccggacactgcggtaaatgttttacttatacacctcactgtaatcttcatagcaatcctatgagatcgctatttctgttttggggatggtgtcattgaagcacagagaggttaagtaacttatccaaggttgcacacttcttggcaaagctgggattcaaatctggatagttggggtctggagtctatgcttttagcctcttattgggagggtgaatgatgaacacagtggggaggccagatgattttgataacttccagattgcaaatctaaccatgctgatttaggaaattaacaatttagtgatgatgcaaaccagggatctgcaaactacagccagtgagtcaaatcccacctgaaacctgtttttatatagctggcaaactagaaagaattttcacataaatggttgaaaaattttgtaaaaatctgttttctcttttgttacataagtacctgcacatatcctcaatttagtctcttgtcttgcaaagcctaaaatatttactagctggtccttcacagggagtgttggtggcttctaatctaaggtaaaatcaactacaggaaaataaaataaaataaaataaaagttttttaaaaaaaagaaggaaagaaagagaaagaagaaaggaaaaaggaaggaaggaggagaggaaggaaggaaaggaggaaaagaaaaagaaggagggaagaaaggaaggaaggagaagatcttaaaaagagaagaaaaggaagggacttcatttaaaagcaaataagaaaactaagatcctcaccagtggagctctgaggccaacagaaacactgaaattgggctggcttaggtatacttacgtgggaaggccatcctttcaaaataagttttccttgactgcctttccacaaagcctgctgcttggagagacaaattagctattaggtaatctagttaattgacaagtgacttaactaattaccctaacatgcttattaaatgttacctttcccattctcaacacattgttagagcatcaatgtatttaaggccttatcatatcacgctctcttgacagcacattcctgttaaaacagaaggtgcatgcagtatgttttttctatcactatttttctccctctgtggttagagtcataagagatagaattgggagctgggtacataacaagcccatccctattaaggaacaatgtcctattatactggtgcctattcgctgagatggatcaagaatggactaagtaaagaaataatgcataatatcaagcctcggctaatgggtgtagctaaagcttagagaaaacttactttgactctggactagtctttcctagctgggagggctagtgtctatatttatacaaatctacaaattcctcaaccaaaattctttgaggcagatgtgttttacagttcagagttttccagatcttagaaagagaatatggtacatataccatgtagtagataatatcttcaggaaggaaggtgaggaatagcatcttgtatgtaaaaatataaatatttctgcaatgaagcattaggattactaaatgagatttttttaagctttaaaaagttcaatagatttttctgctacatgaatcacagaaaataagtttaaaaaaacttttggtattcagagcttttaggattttgggaatcaaagataagggattgtgaactagggtaaatgttactatcacctcatggcctttctaataactacagccttcaagttatttttaaattttatattggtcataattgatacatatggataccattggtgattattctttagcataatgtgagatgaagcatgatatatatcaagatacatacaaaataatatgtatgaatatatttcattataattaatgcctttataaaatactaagcaatacaagacggttggaagtaaatacaaagattctcttctgtttagaactgaactcgagggcaaggttgctgtaaaatgggaagcatcatctggtccaaggttgacaaactctgatttctgccagagccacgcaggtaccatgtactaaaatcctaagatatacatttttcacattacaacatccctgaagttaggatgcatcctccattcttcattgtacaatagtttgattggcaacatttttttttcactttcttgactgtgaaagtaaaaaagcattaaggagcttagatccaatccactgcagtctcagaggtgagccagggaactcaggtgacttaggagcttacacagtttctacacagggctcactggggctaacccaaattctgaccctgaccctcaccctaactttaaccctgaccttcaccctaatcttgaccctaaccctgactctcagcctaaccctgacctttatcctgaccctgagcttgacccttattctaaccctgaccctaatcctgaccctgattctgaatggctgaatggctgttgctctactggttgttgccacacagaaacacagaccaggggtggccaatcagatcttttgagagaagctagaaattcagccatgcagtctcacaagatttaactgttgtcatttattaaccctatgtaggacaaccaagacaggtcaggtatctagattggatctggccctccaacacctagaaagatttaatgagttgattgaccaatatcactctgctgaaatatgaaattatgtctgacacctatggttttattttttgtctgattggaatgacaggtgaaatgataaaagcataagcccagaaactcagggaactacagcagagagggagagatattcaagtaaacataattacatttataacatggtgtgatgctaccaggggctttgaggacccagagaagaattgcctaccccagtcctgtgcaggcaggaaagaacactcagagaaagtgttcaaagctgacagaggaatgagtagagggtggtgtgggagagaggttgatagggatattccagggaaagggagcagcatgtgcccaggtccagaatccatcatgcctcagaatgccttttcaaaaatgaaatcacccataacacaatcaggacatcctatgcagccgcatggaaccaaaatcagctgacctattaggaagttgataagagagaaaagaatatctgctgtgaccatagcccctgacacatcctatagctctgtagcgaggcaagcataaatgtccccagcctgggattctatcagagctcaaagagcaggactgttcctgcagtgtggccaaagcaggcagtggcctagagagtgctaggcaagaggtccctgtcaccaggtattacttcaaaagttgcatgtgccaccctgtccctctcctgcttggtcaaggctgtagatgaccacatcaaattgtatattgggatgttacagttcttggactgcaagcaggatcaactgacttggtaacttaaacaaaaaggaaattccttgcagggttaccagtaactcacagaatggatgtgaaaggtggaggactaatcttagaaatggttcaatgtcagaacagaccctgagtctagaaagtagaaactgcagaccagtttgttgaggtcccaccactggactaaatgaattgctcttcaaatttcctcattttcttgtcttctatggtcaagatgcaaatttcatgaaaagagtgtccagtttgcccaactggagccattagcttttgctgcattaaaaaaccattccaaaactcagcagcttaaaacagggaccacttatttagtccgtggtcctgcaggtcaataattttggctagactcagctgatgactggctggtcttgcgtggccttagataagatggttcagctcctctcataaggtctctcatcctccagcaggctaacctaggcttgttcccatggtggtagcagagttgtaagagcaaaagcctgtaagtccttgtgatctagtctcagaactgtactgtgcttacttctattgcattccattggacaaagtaagtcaaaaggccagcccaacttaagcaatggaaaaataaatgctatcttttaacagacagagcttcgcagtcacatggcaaaatgtgtgcatacaaacaaggccaatttaccagcaatcagtcatactggctaggggactagaacaggggacttgaaaaagagctttatcaggctacatctaatggggagtaagtagcaactcccccaaaactttagttttgttaggaaaggggaatgacctaagtgaccaaaaaaaatttttttaagaagtaaatgtttttttaacattgctcctatgtatgattcattagaaataagtgtcttttcccatgaacaaaatttgtttcagcagtaaaataaaaataacaaataataaaattaggtctcccagcttctcgtcaacttcctggcatagcaagaactgtgaccttccatgcacaaccactgcgggtgccctctcttgcccagttgaaggatccaaacagtgtggcccagagatttttgattcaaaaatcaatttctgaaatatatgatgaagttcatcaatacttttctttctggactactccagccctcattgaccactcctgtctttgaaatctgaatgcactgaaatctagaggtaactatgagagctgggcttgagtcacacacttcccgtatgattctgagtcagtgaacatctctaaaacctcaaggttcttatctataaagtgagtatagaagtgtagctccctccaaattttgtgagctgtcactgagacaatctatataaagcacatagcatagtatctcccgaataatcagcaaccaaaaactatcctttgcttatgccatcatcattatcattattgacatgcatttaattagttcttctgccccactagaaattatgacatctaaatattaccttctgtataaaagatgcctgtcacctcgatgtaagttgaaaaaaaaatagttaatatgtgtgagacttttgtttcttctaagacaggtgtttgaatatgcatttttttttttttttttttttttagttttgtcaggaactacataaaggttaatctctttttctggcaaatatttcctgagtgcttccatgaggactgcgtgggtagctcacctgtgattctgatccggaactggaccctccctatgaagtattattgtatcaattgtttgaccaggcagggaacacctgacctaccccagtaggtaataggggaagagtttaataaaaagacaatgaaaaggtaggagtggtgtttaagaaaccaagaagggatagttcagtgacctgagactggtgtcagaaaggaacctttggtagacgaacataggactcatggtaacctggtcaaaaggaacccgtgggatatatattcccgcctttcctcctcccacctgcccatcccctttgggcaaactccaggggtagccagaggacagaggatctcattgaggggatatatcagggacagtctcccagggcacaggtctgggaaggagggtgcagaattaatgtacagggcaagcagaagatacccgggacagatcactgaagattgagggaaaactcaatgcacaatatcttcccactttgggaagacccactctgaaaatgacttcactttttaggacctgggcccaggaaaaattacaaaaggttttaaaaccccgcttactagggaattttgcacatttcatttcaggagatgggttacctggtagatctcaatgttgtgatagactctacattggcctcaaaagacaattaagacatgatcctgttttaagttaatgagaaaacattccatcactggctgtctgggtcacaaacttgtagcctacaagacaataccacccctggatgtttctctaatattttttaaaactttaattaggtattggctaattaaatataaggaggttttacatatgtctctaaatgcctgtttcttttcagaagttagaaacctgaccccaagagtctcattttctcctgggaacaaggggctgcagctgagagtgtgcaagctctccagcttgccacagtcctcaccattctctgttgtctctaattagccagacccacgtatcctttaccatttttattgttcttgcactctaaatttcatcatggtaatgtttctttttacccatatctctatcagcaatgggccaaaaaagctagttgaagagggtcagtgaattttaagcaaaatttaagaaaacatatgtctctgtggaagaaaagaatcttcctacacttatatacacaaaatgatggtgtctgcctggaaggatggcaactcagtgggccttctttggttatcttattggcttgggtcacatgggcacttgggtttgcagtcctgagaaccctatccttttacattcaagtcacacattccagaaggagagcacttttgtatgcaccatctcacttaaacctcataatgaccttgtgaaacaagcagagcaaagcttatcactctttaacctaagaagaagctcaaaccagttcagtgattttcccaaggttacccatccagcaaatgtcaggactaaaacccagatctcatcatgaagggcaaactcccatgattcagagacgactgaggcttgtgtagcccagaaagaaaagaattgctcaagtttgtcctacatttcaggatgaaagaccaaatgtcgtgatttctacactgtgctgaattaatactttttcttaattttttttctggcctacttcatttccccaataggttatattctaaaggcagtcaaagattataagataacgtttctgtaggtagggggaaataagagctgttgaaatgacctgagtgtcatctctatctctggggacagataccatctcacgacttctatctgcctaagagaagttaagcaagaaggtgcagagctttattaagcagagaaacattagacctttcagctgcttgtgccatctaattacctgtgactcctggcatcacatgcaagctttattactgcatgtgtgaaaactgcaagtcctgctttcgtatctgccctttgaaactcctccaaacatctacctctactcaattttcagtacagctagaatcttaccctctatgagcaaagaagctaatttctcaattatgcttgaaatttagtaattctaggaacaattttttttagagcttagatccttatgggcgtaaaacactctgattgtgtttaaggattctaccttttatcagtgtctccagtgggtttgaacagaattacttcctttggcagttttctggaactctctataaattcattttactaatgttctgttgaacaaacctgttctatcctccaacattgagttggtttttttttttttttttagagacaggatcttgctctgttgtccaggctggagtgcagtggcatgattgtagctcactgcagtctgaaactcctgggctcaagcaatcctcatgctttagccttctgagtaactaagactacaggtgcgcactaccatgccacgccccgaattggtatttttaaagaaagtattctcatcatgaaaatttctgctttgctataggaagcactagataaagttgtttggttaacaccaagtgaaactagtgttatgtatagtaatgcatctcaacatatttactctatttgataatgaaactgatttacttctgcttttagagagagggagagatgaatggatggttccttgagtgttcttcatgtatttatttatttattcaactcacatacattaaatacctactttatgtttcctaggcatttgggggtcgcaataaagagtagtaaaggttcctgacctcaagaaggttatactctaaagggaaagagtggtgggcagtcacagccacaaaccaatgaatttcaggtagtgaacactgtcatacagagagaaactgagaaatttgagtgggggattgtgaattgctgctgccttgggtggattagtcaaggaagatctcatttgaggaggcgatatttgaacaagatctgaatgaagtgaggaaggaagctgtggggccgtggagggaacagtgtcccaggtggaagaaaacagccaagacccggaagtcaccatgggctttagagacagcaaggagacccggatgtctggagccgaatgaggaaggcaaaagtggaagaggccaccagggggcagactgtgcagaacctatgggacttcataaggactttggatttcactggaagagtaatggatgaggctagaaggtttggggcaggagaaaagcatcatctgacttacctgtgagcaggttgactgcacaccggtggatggaccgtggtgggggtgagctgggagcaggcaggcaggacagggctgtggcagtcggtagtggctgtggctgggctgatagtggtgggctgatagtggtggaggttgtgagaaatggttggattgtgggttaatttttgaagtttgagcctatcagtgggagaacaggacactaagaaggacagagtaagtggcgtgtcctttaaatgagatgatctcaatatccccagaaagtggctcctgtttttactctatcaacatccatttccaagaccctgcctcattgcctgtcagagtgtcgggccctggaacgctccagctgtgataatgtcgtggccctcaaggaccaccccctccccaaccatggagggacaagctaaatccctccttcatcaccaccgcctgttccaggccaccatgggtgcacacccagacttcctgtagtagtttctcccatggcctccctggctggtctttgcctcacctgcccactttgcacacaaaagccacaacaatctttctttaaaccttaaaacattctttacattgactctccctcttttccttcattacatttatttttaaaagaaattttatttcataactatacagggaaaattagcagaactgacgacagatagaaagtaaacatgaaaacaaatacgataggtacaaaacaaggttgtcgaattccagctcatttatttgacagcctcttaccctcacaaccatgctttgttatgaccattatctcattttaatcctaagtaaactgagtcccagagagatcaattgatgtgccaaagttcataaagcaaggcagggaatgtaccaccctagtttccagagttaaatgccaggctgagcctgtgtttttgtcttttcctcatcctctatagtggagtcagcaaagtacagctcatgggccaagtccagcccaacatctgtttttggaaataaagttttattggcacacagccactcttatttgttgacgtattgtctgtggcagcttctgtactataatggcagaattgagtaggtgctacagagaccatgtgaccctcaaagcctgaaatatttattatcaggccctttatagaaaaagtttgccaacccatgttctagatagaaaaaaaaatgaagtacatcaaagagaataagttatagttcatggaacacacataatgtctattcttcccatgactgcaacaaaatgtcagttaaagagaaataaatgttttttcaatgaatgatttaaaaaacaggagttaaaaaaaaaaaacaggaaaacacttaagtgaccaaagtcaataagttttctattgttcaaaataggaattgctcttatgactttattctttcagttgattctgacagtaaatttattcattcatttttttcattcatttgacaaatatttatttaatgtctataccatactaagccagtacctgtaatagcaacagcatgttccatgctgagcaaatctgacatttttcttgcctgaacattgctcacctctggtgatagacacagttgttagtcaaataattataaaatttgactagtcagggaagttggaggaggctttcctgaggacgttgtgtttgaggtaggagctgaatgatgagcaggtgaagaggagagggaagtccatcatcccagaagggagggtccacatatgaaaaggcccagtggtaggagggcacatagtaggccctaggaaattcaaagcaagatgcctgtatgtctgaagaacagaatgcaggaggggcacatgggagagaggagattggggaggcaggtatctctgaccatactgggctaagaatttcatgttaaagagttattctccatcctaagaaaatggaaaacattgaaagggctaaagggggtggtagttttttatgggatgatctttcaccttcatgggttcaggagtccacatcaaatcccttatggctatgccgagtctaatccctagtcgtgcaaagtatctcttctctgtgttccataatcatctgttgttcagttcaggcatttacagtattgctggagccaagtaaagcatgcacaagtgcagtaataagacagacattttcagggccgggggcagtggctcatgcctgtaattccagcactttgggaggctgaggtagacagatcacttgagaccaggagttcaagaccagcctgaccaacatgacaaaaccctgtccctactaaaaatacaaaaattaacttggcatggtggtgcacacctaaggcatgagaatctcttaaacccgggaggtggaggttgcagtgagctgagattgtgccactgcactgcagcctgggtgacagggcaagactctgtctccaaaaaaaaaaaaaaaaaagacatttcagtttgccctttctagatgaaccatgtggcaaactacacctctggaaacatttttcttttgctcaccataggcccatcttctttgaatgtacatcttcatctatatattccctactcttaatctatttctttataaggtgctaataggccaggtgaaaatttccactaatctattaataaaagcagaccagtgataggctttaagaataaagtcatgataaagttagcaaatacagaggggaaagaaacagcaaaatgtttggggttttttgtttgtttgttttcgagaacattgctacttggttccattagactcctttgattgtacatgacagaaaccaactctggttattttcagcaaaaaaaaaaaaaaaaaaaaaaataggaggtaatgcaaggctatctgatggagtggtatttgacttgagagctcattattgaggaaaaacccagccaaatgaatgtctgcggaatgagtgttctaggcagtgcaaagatcctgaggtgagagcaaaagaggtgtgccacagggttggaggaaagacccatgggtgggaggagggtgaacatgacggggagcactcagactgatgagacagggctttgtagctcatggtaaggagttttaatttcattctctgtgatagaaagccttacatgtgtagtagtccgttttcacagttctataaaaatactacctgagactgggtaatttataaaggaaagagatgtaattgactcacagttctgcatggctgggtaggcctcaggaaacttacagtcatggcagaaggcaaaggagaatcaagtaacttcttcataaggcagcaggaaaagagagtacaagcgaaagaggaactgccaaacacttataaacccatcagatgttgtgagaactcaactcactatcatgagaacagcatgaaggaatccgcccgcatgataccatcacctcccaccaggtacctgcctcaacacgtggagattataattccaggtgatatttgggtggggccacagaaccaaaccatatcatagggttttaagtaaatgagtgatattatttgagttagagtagagaaatatcacacttctataaacaattactatatctcaggcactgtatatccaccttaggtccttttcctttaatcttcaccaatgaatgggtacaattattatcacttctcagattagtaaagtgaggcttagggaggaaaagcaacttgtttggagtcacatagtgactatatggcaaatctgaacctcaacccttgtcatctgcctccagttcctggctcaaaatactcattaaaggctcatttttattgccattgtttatgatgtttatttttctaacccttccaagagtgttttgtggattgcattattcttttcttctcaattttataaataaaagagactcgcctcaaaatcacaactgaaggaaaaaaataacaaacttgtagtttcctctaaagaacttcacggacacccagctcagaagaatttggcccggccagggatggggcggggagggaaggactggctgccgcaatgttttgggttcggccatcccatttgtgagaattaggaatgttctttggacaaaagatcaaacacaagcttactcctttctatgctgagacgttgcccactcgcttcctcttttgtatctttcctggtaactcgacttcagtttctctgatggtaaagagatgagatcagccactaggggatcggtcgatgggatcaggtttcagtcatcaaaaaattacgtcaagtgctaagcatgagttaccttccactgccagtgtcagcccaggacgtgactgcagggccatcaatcctgccttccttgtccttgtagatgttaaaatacagggtactctgggaattcattagtgggggtgttgcatgggaaaggaggggctatgctccaggaaaagtgggtatagaggcagagatgtagctttctaatgctgttaccttgcacattctaactattaactgcagagacatctgctgattgttttctttacaaagcgggggagggggagaaaataagaaagttaatttcagagttggaagcaggtttaaaatgaccttcgtcagttataaatataacatctacttacttttaaccagtttatttccaattcaataacttttattgagtgtttccatcataataattgtttttaaaaagtttactattagaaagtactgaaaagaatgtaggaaaacaatttcctccatagtcctactatacagaggaagatccattctgtttcctgtctatcggcctctctgctcctcttttaaatactgaacccaacttttttattgtttcaaatgatgtgactatattgtacctatgatttgtgtgataggcgtcacacccaggaggtgtgatggtccccacctgctgagatccctgtccttgtgtgattttatcctcttgaaagtggatggacttaccctcctctagtaaacagaatatggcaaacatattgggatgtcacttccaagattaggttataaaaagatggtggcttccatcttaagtgcacgcacgctctctgtctcttttttttttttttttttttttttttgaggtttcagggcatctttggtgccacagtagctcaagaagagccttttattttattttattttattttatttttttttattatactctaagttttagggtacatgtgcacattgtgcaggttagttacatatgtatacatgtgccatgctggtgcgctgcacccactaatgtgtcatctagcattaggtatatctcccaatgctgtctcttgaatcactcacgctgggggacagccagtagctgtggtgtgggctatcctgtggtttggtgagatactgaaggcgtcactaggcagtccacaagcctgccagaaatcacttgccaaaaactacatgagttaacttaggagtggactcttcattcccagtggcttgactgcaacctggtgagagattctgaatcagattcactgagctaagccccttctagtttcctaaaccacagaaactgtgagataataaatgtttgttgttgttagttgctggatttttgaataatatgttacacagcaattgataactaatataattttttattctggttttctccattaattatgtcataagcatcttatcaagtggttatattatattgtaataaccatgtttatgtaacatcatcaagtaggagtatttatacttatttattgcttatttaatctctcctttattacaggacatttactttgttctgttttttgtactataaacaccactgtggtgaacatctttttatgtagagcttctattttttttttagctattatcctaaaatagattggaattagttttaggattaggaatcagcttggattactggatcaaagggtaagaatatttgtatttctctggatttttattacacaacttctccccagtaggagagattaatcaatacactactaccagaaatgcaggtcaatgtctacttcatctcacctttgccttttattttgattattgacaatttgataggcaaaatatttcatagtttacaactattaaaagaaagagatcattttcctggtcacctttcttaaaaaaaaaaaaggaatatacataggggttgaaatactgagataaggaactaaatattaattaactagaagaagtgctgtccaatagaactttctgtgatgatggaaataccctctatctgtatgtctacactagtagcactaggcatctgtggctgctgggccctgttagctagtgcaactaagaaactagttattttttgaattttattttattttaaatgcccacatggagttagtgactactatattgaactgcactgttctgaaggattaaatgaaatactagccttctatagaagaaagcagttgaagtttgagacactgaagctttcgccttcctaacaatatccccttttccctacgcattggctttaaataggatgtcccatgggtctgacatttaaatcatagtaacattatttccataaggaattctataaaataaacatatgttgcctaccataaaaggacacgcttagagggacctaatatcattgatgtttgtttgagatgcaaggatccttgattgatggttatatgatcaccactttcatttaatctctgcttctactttccaatatccctgcctagtggtcttgcaaaccattacacttgtcacagaggctggcatgaatgagtcgatggatagatgagtggatggaagggtggatggatggatggatggatggatggatgggtggatggatggatgaggatggataaaagtaataataacagctaacactcatagtgtgcctattaagtgtcaaaatttggacgcaaggttttacctgcaacatttcattcccattcaatctttgtaacagcccaaagaggcaagtgtcactaatttttcctgtctgacagatgaggaaactgaggaaataactagtaagttacacaggccatgtttgaaccagatttgtctgccttcaagccttttcctaatcaattatccaacatcacaccatgaagctgtgaaatacagcaccatgcattatttacaccttgtcacattgtcgtggtggcgattgaaaattttctcctgcaggtagctacagatgctagggagaaaatgctcaaaactgacaggtacctcacttgtctctaaaagtggctctttcactttttattgctgaccaacttctaatgtgtcagtgctatactaatgtggttaactgtttgcctggggcagaaaaataaagcttctgacatgcaattaaaacctgtcttgcccaattgggcgactaatgagatcagcaagagtggaagctgcctagttaaggcgtagtttgtgtctcagatccatttcatggggcaagtgaaagagtggccaagtggagtcgcctgatggtgaatttgaaacataattaggtagtcctcccagccacccttgactgcccatttgggtccacatgcagactcactcacaacggtgactgcaaacccttgcacagccacttaacactgagctcctttctgatgggctcacacagcattcccatcattctgtcctctggcctggacactgaagttcatcacaaactttctagtttcagatggtggcatatgtttagttgtcccgttcccaaatctgtgaactctttgttcctgcaatgacttatcagaaactaatacaagttgaagatttgtctagaatgggctgtgacgacaactggacatctccaccctttgaggatattgctgggagcttagagtccttgttagatttccccatccttggttttgttattaaaagatttctcaggaggtattggggcagtttcaacatattctattaatcaagttagttttgatttactttattcaacaaatgttcattgaaaaccaactgggtaagaaaaattctaagtgtggtgcacacagacattgaataaggcgaatttgggctgggcatgatggcttacacctgtaatcccaacactctggaaggctgaggtgggaggatttcttgaggccaggagtttgagaccaacctgggtaacacagcaagagcctgtctctacaaaaaaaactaaacatttgaaaaattaaaaattaggccaggagtggtggctcatgcatgtaatcccagcactttgggaggctgaggtgggtggatcacttgaggccagaagttcaagaccagcctggccaacatggtgaaaccccatctctaataaaaatacaaaaattagtcaggcatggtggcacatgcctgtagtcctagctacttgggaggctgaggtaggaggatcacttgagcctgggaagtagaggtttcagtgagccaagatcacaccactgcactccagcctgggcaacaaagtgagactctgtctaaaaaataataataataaaataaaaaatcaaaacaaaaataaggcaaactctctgcctgcatgcagcttacaatcaatggtttgaaaaagacaataaacaggtacataaatatctgaataggataatctcagatgctgctaagtattatattaaaaaaacctgataatgtaatagtgaatgactaaaaataaaggtgggaacaactatggagacaacggtcagaggaaggtgacatataggctgtgaccagaaggctgagtagtcccagtcatgacaaaaatctggaggaagacctttctacacagaggaagcagcaggtacaaaggtcctggggtgagaatgagttgggtttgttctttctggaaaagaaagatggtggctggagctcaatgaatccagaataaagtgggaagatgaatgtagaggccagcagaggccaagtcacatatgactatgctgtctgtggaggtgagcttttattctacatcaagaaggatatagtttacatctactgtaaccagacactaaattgagcactttatatacattttctcttctgatcttcacaccaaccatataaggtagacattattttcactatataggtgagaaaactggtgcttaggcatgtttaataactttcctaaaatcacaggtaggaagcagggaagtcaggcttcaaacctatgtttgaccccatcactcattctcacagtcaccaagctgtgctgagatcagactttgtgtcagggtggagaatggtagggagtaatgttttgtttgtttgcttgcttgtttgtgtgtgtgtgtgtgtttgtgtgtgtgtatgtgtgtgtttaataagggactctaggtattcctcatatcatatcaattggatggcagtttaattcataatgtcttaaacattgcaatctcaaattgttcttcctggaggcctgtgtgtttgaatgagaggtgcaagtggtgaaggtggcagagaggtgaactttgcagcacctgtcaatgcacgctcccactgggtggggtattacgtcccccgtagagtcatgtgaagttatgacaaatgtgacattagcaccaaattggaataaagaagacaaagttgaacatgtgaataactgtctttcaaggtgtttctttatgcccaggtgacaaaaagtccctggtacatttctgtctgattttctgacaaactgactgccacaatctggcagggagtggcaatagtcgccttgccagtcatgggcaacctgatttgttggactgcagggtctgtctggcatcagttggtcattgttctttttggcatcatgggtgtgtgattatgtccagaaggcaagcaaacctcagtccccgagatcaagtgcactctcaatttgatttgttcagggtttgtccaatggcactgttgacatttttgtctggatagttgtttgctgatggaggctgtcctgtatatcgtcggacgtgtagcccctaccctcagataccactagcacctcaccccaggctgtgacagacaaaaatgactccagacattgttctatgtcccctaggagccaacctccccacctgagaaatgaaaaccactggcttattcacatagtctagtttatgagaatggaatgtgttcttagttaaactccaaaagagttaaaatccactcaaatataccaatcctgaagctagaaataacatctatggctggctattcagagactttgccttagaaaacttatgatgaatactggaaaaattgattgaatatatatggattccatgacatactctgaaagatgtttttgcttgtctgtctccttgtattaggataattaaggctagctggtgaaacaaacagctaaacatctcagtggcccaacacagtaaacatttatgtttcacatgtacaaagttgatctccacgtggtgactcagatgcaaccttctttccagggtagctctgccatctggagcatgtggcttccaaaaccattgaaggtgtgaatgagttctgtaactgatgcccatcacttcttccctcatcccattggccagaaactgggaagagtggtcttcctgtagcaagagaaagaagaaataggatttggcaaacaggtggcatcacttctgctatcatcctagatatcggcttttcagtttattgaataatgttcaaaatcttcttgatttgtaacctgaattacaaataaacaatagttatgacagtacagtcttccctaaacatgccaagcatcagaattacagactcctcacgtcctgcccatccattccaatttgagaggtctgaatgaggttcaggaatctgtaatttttacttgctccaggtaagtgggatggataggtatctaggactcactggtctcagatccaagtagtcttacatcttcatttttactgcccttcattaggttaagaaattgagagttggttctcacctttctgggctttatttgaaacaaaaactgtattgtcagctgggttcagctcttcctccaatctggtaaactctccaagccataattgtaccagcttctggcctctcaacgtcattgctccagccgtgttgagctctagtctcccatgcttccttgaccaatgctccacactgctcagtaatctcttaggaaatgcaaatctgttggttttaattctttgcccaaagtcatcaatgatttcccattgtcctaggatcaagtccagatgttttattatctacctaaaacccttttcttccagctctcttttttaactacatcgccaaggctagcatggttcctggcatatagtaagcccctcaaaaaaatctgttgcatgaatgagtttgtagaatgcactgaactgtgcatatatgtaaatttaaacttgtcagaagaattagatgtcattccccctcccctttttaaacagaatccagtttatatcagttcttcacagtgtcaagaactcaagtcttgagaatagttgtctatttttatagaaatttgcatatcaattaataaattttgcacatgtgcatgcccaggtatgtgcctatatatacattgtatattatacttatgtaaaggtatttatacacagttatgtaaccaatgtatggtatgtatacttatacattcataagtaaatatattcaataaatgtatgtgtgtataagtgtgtatatttacatatatatgcccattttttctgatctgcataccaccattgaagacaagaatgctacttgtcttcaagaatgctacaagaataactactgtttggaaaacagatgtgaaaactgaggcttgcagaggaaaatcaactctagcagagccacatagctagtaattacagagccaggttttgaatggagatctattcagccccaaagtctagactttgtctttcgattacactgcttttctagggctatgctgcttctaattccatgttaacatttatactgtaaacagaatcgctgttcctcataaataagcaaatgaaattgacatctaggctaagaagccgtagactgcagcctgtatctactgtaatgtgattctgaaagagttttgttcattttctcttaggatagatacagttttgtatttcctagcaagcgtatgccaaaatctgagtctgcttccttagaagtttggcatctcttctctctcctaagatgaaccagggtttctgaatcttgacaaccttgacgctattgaaccagatactttcctgctatgatggtggtggcgggggccggggaggctgtcctgggcactgtacactgttgagcagcatccccggcctccacccactggatgattgtagcacctctcccccaggttgtgacaatcagagaatgtctccagacgctggcaaatgtaaccccagttgtgaacgctgaaatgtgtggtatgaaaaaaggtttctaatcataatgctgagcttagcggtactaaaatagacctttatataatgaaagggcattggtttgtcttccttaaggtgagggatattggatgttaggacgtcagagtggtgtttgggcccagctctagccttgcccaagacacacgtctctggctctccctcctccagtcccaaatccccacacctttgatggtgctcctctcaaaaggaaggaaagacaataaaaaatgaaaagaaaaaaagtaattaaaaaaaaaaaacacaaaaagatatagtttcaaaattacatgtccttacagtctgtccagctaatagaattatgcaccgcagctttaatttagacatcgagtttcatctcttacttaaatgtatctgtgtgttttaataggaacattcagctttgcttttattaatgcaaaaacattaaggcaccagccctcgatccgaaagccttaaagggctgtttccaacagaacctgtcataaaatgtgctctcaagcgtgtcccctttaagagactccagaattaaatgttcccgtatgtgaattttattttgtacagcacatttgctttatggctacaattaagttagatgtgccgataacaatgtctgttttccattttaaatcgcacatttcagacagtgtgcattgttttattatctaatccacatgcttttaattgcaattatggtcccttatgagtcccctgggagggcatgattgcaattaaaaatgtaatttaaatgttaattaattacattcattttctaaactgggaaaatttcatttattattttcatgtgttgtgcacttatcctaaatgcattaccttctaaatgttttttttttcctaaattaagtgttatgtttataaaacagggtgtttaataccctttaaaatttttgtgagggtgtttgtacaaattattactttaaattaattgattctgagctatatgcaggagctatatgtttaatatataataaaaataattttgttgacttttctgaggctaaaacatggtatcaaaatatatgtttttctcatttattttctggttgactttgatatggaaagtctacttcttatgactatcattattattgttttttcttaaacaaaggaagaaaggtattgttactacaaatgatacagatcattaataagaaaagggctttccccctagatgaaaattgcaacctctaaagaagaaatttataggtagagtaataagtcatcctgcctcatatgaataaaggggaacaaaaaaagaaccacaaggacatgaagctttaaaaatcattgtaacttacgaggaaaaaaaatgattgttgtatgcatatctcagtttatccagtcagccctgtcatttttctgtctatctcactttgcctagaacaagagggtcattttagatatgaattataaagcaatgtctatctactttaaactctgaaccatatcaattttggttggttttagtgaattaaagtgtaagtcccaagaggacaagggcagaatttgtgtttttcccaattcaattccaagtatatgctacatgtgatcaattaataaaaaggcttttgaggattttcttttttccatttgtttcctcttcaattggccaaatcttcttctagctcttttattttaaaaatgcctgctatgtctgaactctagctattgtttgggttttatttttatttttattttttagatttaaaatatttaaaagatgtcttaggaaaattctagtcagttaacagtttaagctgctctgtgggtagaggaggaagaaataagagagaaaagaaaaagttcccagacttacaacgttcaacaaatacttatggcatctttactctggagtctaagcttgaatcgtttgtaaaatcgactctgtgcctcctctgggccagattatgttgctaaatcctcacaaccatcctgtgaggtgagtactatcattatttctgtttaacagagaggaaactgaggcacagagcattctggtaacttgctaaagcttcacggctagaaagagggaaagccaggatctgtgccttggaagactgactctggacttgatattccattcggtcctcttcaccagagcatggctaagaaacactagcaaacttgagggaatcacgagagtggactccacacagcaggtagagaggaatgataggaggtaggctctgaagacaagctctgtgggtttgaatctactttgcatttgtataaccttggacaaattaccctccctgctgtaagcctcaatttcctgttctgtacagtggaggaatggcagtacctgtctcataatggtcttgagctggtgcatgacacataatgaacacagtgctcccagcacaaggaaatatcaactgtagctgctactattaaatagagctctgccttcaagaagcttacagtctagctgagaacaggagtaaatgatagaaggccagggggaataactttaacaaaataaaataaagtagattaaaataaaaatcaccaaattgtccatccataaaggattggccaaataaactatatcctatccacctgctaaaatgctaggtaagtatttaaataataataaagcggaggctgggcgctgtggcttacacctgtaatcccaacactttgggaggcagaggcaggcggatcactaggtcaggagttcaagaccagcctggtcaacatggtgaaaccccgtctctactaaagatacaaaaaattagccaggcatggtggtgtgcacctgtaatcccagctactcaggaggctgaggcaggagaatcgcttgagcccggggggcagaggttgcagtgagccgacgtagcgccactgcactccagcctgggcaacagggtgagactccatctcaaaagaaaattaataataataacaataaagcagatccatatggatcaagcttttaggtatattgttaaatgaaacagtcaacagtctgaacagttgtgtaactgaaaaggggatggatgggtgggtgggtaggcaggtaggtaggtagaaagtatttttgtaaatgcacgatcatgttctggaaagatatgagaccatacacagtgatgatttgggggttggggctgccaggaaggtgtgtggaaggcacccaggatcttgttttgttttgtttgtttagattttatacctctgtgtgtagtgtgtgtgttttacaaagtccatgtgatacttttaattttagatagaacttcaaagtatacacaaacacatacagacagacatacacacacatacacatacccatgaaggcatggccctgaccacagggaaattcaggagggagaggaaggggaaatggagaggaagagacatctcaggatgctggagtgaccagcatggctttatctgtgtgttgtcctagctctaacggttttagcatgggagagatgtcaaatgggctagagtaagaacaaagcgttagagctaggatagggttgtgcgcccagccagaagctgatagagaattaaggggaaagttggccccttgggtaatatttaaatctatgaagaataaaatcaagtagaaaaagaaaaaggaaaacaagagattccttgccttgagcttcagatctaaggagaaactttcacaaaccccactagcagttgagacctggggactcaaccataagtcttgctgtttgtcaaaagcaacccttcataggccatgtcgaataagttccagcatttttaattaaattggggccagtggaatgggtcacagatggactgggctcattttcaaatctgcttctgctaactgtgtgccttgtaggactcagcacccaccttctttatctgcagagcaagaatgataatactggtgggtggatgcctatcaagctctgagttgtcaagcctggcactcaaggcttagctatcatgacgcctgtgtctctgggacatgctcagggttattctcctttaggctctgccttggtcacgtgggttccaacaaaggaaaatgtaaaatggaatttggggtgattcaagtccacggaggggcagtcccagtgtaatatttagacaaatccagagaaatgcagcactttttaaattgggtcccaaacaaaaatggcatagtggtaggaaggaggcagcgtgaaggaggaaatggatcaagagcaggagaaaaataaaagaaaaaatgaataggaaattgcaggaccccatttctgagggtctgaataaataatctttcttggctcttcgttttttcattattttacaaatgtctttctctcgatgagtttctgtttgctggcttttagaatgagacgtaacgggggcagcaagaggatgattcctgactatgttatagctccctgggctttttcttctccttctcctccttcttcttctttcttttttttttttttttttttttttttttcaacggagttttgctcttgttgcccaggctgaagtgcaatagcacgatctcggcttgctgcaacctcctcttcccaggttaaagcaattgcctgcctcagcctcccgagtagctggaattacagtcgcccaccaccacgcctggctaattttttgtatttttagtagagactgggtttcaccatgttggccaggctggtctctaactcctgacctcaggtgatccacctgcctcggcctcccaaagtgctggattacaggtgtgagccattgcacctggccccctgggcgtttttttcttctgccttggcccttggtggttttgtctgatgctcaatggccagaaggaaacacacccttgtgcttatatcaacggctttcttccaggaagcatggcactgctttcagagcatgcacacattgttatcttgtctgttcgagggaagtcaggtcagtcttctcatctgtctcccacagataagcagctgaggcagagggtggattggggtagggcagatagtggctgctccaggccatacagtgaatcaggaattagtgccagaatgagaagttccatcggctcctctagattgcttggattcagattggtggtaccccgacctacagacttggttagcatgtcacaaagactgacttcccccaacctttgttgcattcattcagctaaactttactgggcacatgccagctgcctgtccaggtgtggggaatccttcagtgaacagaacagagccttattctcatggagattatttgctagcaaaggagacccagagtaaaaacgtaaataaataaacaacgtaatttcagatcattacaagtgctgtgaagaagatgagtgtgcacacacccctttaatccagatatttgacactgactggacagagttaaattccctccttgctctttcattcacaaggtgtttgacaacaggtgctgaactgctggagttactgctccttagttctaaggtcatcttcaggcttttccctctcaaatgccttttccacattttcctcctattttctctccctctttcttttacccgttttcccctcctgtctgtatcttctccctgataagcctcaaagaatgcctcatagactgaaatagttctttgccctcatccttaaaagttgctgaacacctgtagccagcaggtgtcagagggacagtgctagaatccttttgggaggaggtgtctgctaggcttagctcacctcattccccagtgcagggagccagcgggtaggtttctcaaagccctcttaattgagggttgctagggagcattgttagaatgaaaaaccaaggggacgtgactgaggactcccaacctgtgcatgtttcctacagcattgattactggagttggtgaccggtactggtgcaaaactccctaattatttcacagggcttaagtcaagagtaacaggatattagtgatttaatcaacattgttatctctaaattatatttttatttagaagttgtatttctttgtttctttcttttttttttttttttagacgaagtctcgctctgtcaccaggctggagtgcagtggtgcaatctcggctcactgcaacctccgccccctgagttcaagcgatcctcctacctcagcctcccgagtagctgggactacaagcatgcgtcaccacgcccagctaatttttatatttttagtagagatggggtttcactatgttggccaggaaggtctcgaactcttgaccttgtgatccacccgcttcggcctcccaaagtgctgggattacaggcacgagccatcgcacccagccagaagttgtatttctttatgtatttatttttgttattattgtagaaattatattgtagaaattttttgttattatcattgtagaaatgggagtcttagtatgttgtccaggctggcctcgaactcctggcctcaagtgatcctcctgcctcagcctcccaaagtgctgagattacaggtgtgaaccactgcatccaaccactgtatgcatctttgtaacctacctgccttaccaggggtaaaaggacacctaaaccagctcccaggaaaacctctgtccttacccagcatggttttagattccaatacaggttaaaattgccgtggctcatgtgaagatgaagagttagtataaattgttagttcaggatttagtggagtgcatctcaaattttaatgtgcgtatgaatctactggggatctcattaaaatgtagattctgattcagcagatctgtgccgagattctacatttccaaggagccttcactggtgcacatacggctggtcctcaaaccacacttgaagaagcaaggctttagacttgccctttaattccagttctttcttcagggctgcattaggtcttccatgaatccttggcacctttaccttcggggcccctcgcatttaaaaagatattaaaaattatatcctatgattacattagtatacagacaaatatgttaatctacatttaagcagtttcttctatctaaaagttcattatttttcttctgattttaaaataaataaaaatctggtcatggacccacacataatgtttctagggacagttcctaggtgctctccctacagtgcccaaggtaggacttgatcccaatgttgagaggagttgccccttactgacttcatgctgaaactctcagagcctctatttcctcatctgtaaaatggggatcacagtatctctcgcactgctttggctctttgcacagtgcctggtgcattgtaagcactctggaaatgttagcttttgtctccaaaagttacctggctccccgttagctgtcactgtctcatgacctattaaaagtcagatcctacacacatcactgctgctctcttaaagctgtttgatatgtcctactggttgcatgacctggataatttccataaattaacctcttttaccttccatttctgcgctaccctgctgttcctcttctggaaggaccctatcatctcttggacgcagcagacagcgatgccacacgaacttctgccatgacactcggcacctcccgcgagtgctcagacactcatctgcagcttgctctctaaactcatcatttctgtagaaaggcagcacagcccctgatggatctggaattaactgtcgatttttctgcctgtcactctgagaagaggaagggaccatagagctaatcacatgaggcatcaccatcactgttttcatgttcttttgtttatcttagcccctgactcctcttgattgtacttgcctcaatcctaagactctgtccattgtaaaacatgctgtagatttggccaaagcttttttggggaggagtgagtgagaggtggagaaggaaccctcgcatattaaatgtacacacaaattgcatcccaatttcatgtggaaattaaaataaggtgatttcagagtgaaggaaatgcaatcatgttttatggagtttgataaaatcccatagtctcattaaggaaatagtcatcaccaggatgtgggcctcactttataagaagatagagtaaaatgaagcttaattttcctttgtaatatttttgatacttccaaatagtgatagcatccagtcatagcatcgccaaatgatagatgcagaatttgctataaatttggattttcaagctatatcctttttcattttcttctataggaattcctatcacatgtactctttgaagtagtaatgtaagatcttaagttttcataagcactttgcattgcaattcagagcatccactcatgcgaaacataagctgtagttttagtgtgatttttttaaaggggaaaggggtcaaacccttgccagttggtcaaactcttttctttttagtttatcttcatcacagtccaaatctttctcattgaacgggaaacattttctgatctcaacctttattgatacaaatgttgatttttttttttttaaggaaaagagtatctccttcctcaaaagggatttcatttgagtgtttctttctcattttcttcgaagtaattcttccaaattgacccacaccacatcgagtcttggtctccactgccaacctcaattataaaatggaaactaggtgaacaaattatcaaacctctgtatgggaaatgtggaaaacatttagaaatattcaccaagatttacttccagccatcatgacttaatcacaggtgctgcatccgtaattttcaccttacagaaagtacataagcagctttgcagatttcagtgctaggatgccaaaggatccagagaagtcataggtgagacttcaggtggacaaactacctggacagttgacaaggtttccggctgttccagaagctcacgtgccacctgagtaggcttactgagtgatagcccataattgacaggtattacctcttgactctgaacatctggtctcccatttactccctcccctggttcttctgtgacccatcgtcattgtccaggcggccttgcctgttgaacatatcgcttgaccagcactgcttcctggatatctgtagagcctttggcatacccacacgtgtattttataaaatttaagttcaaactaaagcgtgctgggggccagagaagataaatgccagcttttttatcgtcaaggtaacgataagagattcactagaatttacatagcaccaaagtcgatttacgtgcttatttactctgttgttctcctttaaaaaagatggagttaccctagcaactgtaagatcacgtgatgttcagaataaccgtaatggaaacaccttctgaaaggaaaatacgcatttcaccagatgcatattataggcacataaactgtcatttatagaatgtcgaaccattttggaaatgattggaggaggttcatgtggcattgagtactttccccattaattacttcagtagcttcagagattctgtgacaaaagaaagagattgggagaaagggagggctttggatcttctcctgggcatgttgatagaattgtacactgtatctcgataagcacagcagcagaaagagcacattaccaaaatccatctttcattacatttttgcatttgggtagaatctattactctattcaaactttgttccaattcccaggatgatggcattttccctagagggatggtttgctttgtctaaagcagaatactcaaagggaacaatccgaagtagaagaaacccccaagaaatggcttggtcactcagccaattgggtttcatttcagttttacaaattaatttgctgaagtccagggtgagatacaggtttatgcagagatcacaccagggcagcccttcctgattttggttcagtcttgcatgctcaggataaataaagcaaccctggagaactctgtagttctaaaactcatgtaggaggggccacaactgccaacatccttctcctaacactgctgaaatgtatttgattaggagcacaccattcgggtgataggtacactaaaagcccagatgtcaccaaagcagaatgtatgtatgtaagaaatctgcacttttacccctaaatatattttttaaattaaaaaaattataaaataaaatgaaaagatcacttgttaacacaaagcaaaaagggacaaggagctgccttactgagtcagacatgtggctcctaggaattggagcttttgttttgcagaataatataaattagatcccatgatctcctatccacgatctcatatccagaccgtctggataggagggtctgccctttagacttagctaaaaccccagccaattgccttatttcctggtccctccccttcattgagtgtaccccaccatttctcacctttctttttcacatgttcctcctttccccagctcttcgctgtctcagtgtttttgcagttaagtttctcctaacttcactgtcatctcctggaagaacttaccctggccccgctagataaagaatctcttctctacatccctttttctcttttccatagctccagtcactctctgaaatgatattgttcatgggtgtgtttgttccttatctgtttccccaacaagacaatagactccgcagggaaaggaccatgttgttcttttttcacaaaggtaccccagctccaagaagagtgtctggggtgtaattgctgctgtgtacatatttactccacaaacaacagactggaagacagtctaaatagattctgtttctgacagatcaaaggaaacaaacagaagttcagcatctctcttgaaaacaaatacactggacagaaaaaagaggtctggaaagatggactgagcccacagacacagaaaagcatctaacaaatcaggggctctgaggagtgaggagtagggggtcgttgcttttatttagaaattaacaactgtgggccggacacggtggctcacacctctgatcccagcactttgggaggccgaggcgggcagatcacgaggtcaggagattgagaccatcctggctaacacagtgaaaccctgtctctaccaaaaatacaaaaaattagccgggcgtggtggtgggcgcctgtagtcccagctgctggggaggctgaggcaggagaatggcgtgaacccgggaagcggagcttgcagtgagccaagatcaaacaggagaaagagaaattaacagctgtgcccagacagccagtgtggctgaccagaaagactgaatttagcaaaacatggttttaaaaaaattaaatgaatgaaataggtgaagaagtgatggtagcaacatgtgggcctcaattctctgactttttatttgatgatcttaggatattatgcatcagtccatgttgccccatcaaacacctactacgtgccacatatagtgcctaggccggcctgccttcctttccttccttccttccttcctcccttctttctctccctcccttctctccctccctccctctcttccttttctttctttcttccttccttttctttctttcttcttctcttcctcactccctccttccctcttgactccctccttccttccttctatcattttttctctccttcttccctccctcctccgtccctgcctccctccctctctcccttcaatatttagtaaatcttcattatggctccagcatggttttagagcttcagtcattcattcatttgttcattcatttaacaaatatgggcaaagtactctgatccatgcaaaagtggattatccagtcatgagccacctctgcatagaggtaacgaggtgggcggggtttgccctcatggcatttccagtctaaacagacattaaacagttacaaatgattgactaaatgattatttaatggtattaagtcaagtaaagggatcaaattatttaacacctgctaatgattaattaaaatggtatacattttgccaaagaatctctctaacttttggtaatctgaacttctctctttccctttgataaacgtgctcagagtaaaaaacaaccaactaccaggagggttttctgccaaatttgttcccagaatgtttaaagatgagtgtctctcatcttttcctctgtaattcattctctctctgtgtgtctctcctctctttgaacagggatacagcctatgtgtgttcaatgttctaataaccccaaatttagacacaaaccattatttactgatatttaatgaagtcacctcatggcgttttaatgattgctagatggaacaaatctaatgattgttaagatggaactttacaaaccctttcagtcaggacaagtggcctgttctccccacttctccttgaacttggtgtactgagcaaaagacatgcaagcaatgaggttgagactcatttttcaacattacccaaagaacagtgtgtactggatccctggcagctgagaaaggacccttcccctggctgggagacaaaacttcaatgaaattagggcattctcccaacccaaccattcccaccctgtgctgatgtgaaaaagttcaaaggatattacgggcaaagctctcaagatgtgtttccctcgagaatatttcaggtcacccaatgtgtaagggcccctttgaagtcaagattgattgaaaaagcacaagggtgtggagtctaagaatttggatgtggccatcctctgcgtccctgagtgaagatgctgctcgggtcagtattcatattagcctggcccattccctttgcctgcggtatttacagtaacccacatgcagagcaggtggaagccaaagcggggcatagccagggattgtggcaggggcttgaaaaagtgttttcttttaattgtagggggatgattctgtttggcaggattcaaggctcagctgtgtgtgagcagatccttcatacacaaccacacacacacatatactcagcttcctctcacatttctcatggaaaactgatcacacacagctctcaggagtttcctggaatgcaggataagacattcagctgatcagtgactgacatactagggacctgatttcctgaaattaaagccactgccactgccttgtatcttgaggcaacacaaagtattgtctttttaagtttttattttcacaaggcagcatcgttagagtagccaggatgggtcaaccattcgaaggaaacaaaggtgtgagagcaaggctgctctgcagattgcatccacttctctggatgcttttgggatgtgggtggctccagtctccccgttggcctcaggagtgttatcctgagagaaatgaagggagtcctgcctggcagcaccattgcccacaacgctatccagaagacgtgcaatgccaaggccaacagtcagttccctctcagtcgcttcacctcctgaatgcatctcaacttgtattttgccttcatcctgccatttttctctctttgtggcctcttgtgggactgtggctttgcaacacagcatcatcaaataaatcatctttccatgcattctctccttccttcaccccttcccaatcaccaaggtcagttgtcctttatggaatttgaaatgatttttggatttgattcaatcaacaaatatttgctaagcagctaccatatggcatattctgtaccatgtttctgggaatgcagtggtgaacaaaaccactgagataaatgcatttgactgactttttctgaattttaacgcatcttggagttactgtgttttggaggtcaatattgtttttctgagcattttactcctttttaaaaataatcttttttaaaatgacagaagcaaaatgtgaattttaaggcattataaaataggaacaaacataaataagaaaataaaaacatccatcacccaaagatcacactactaacatcagtgcctacttccagaacattctctgtgcatatatgtatatttaaacacaagactgtaatagacatgctgttatataacctgctattttcagtcaacaatctctatttttcattttaataatttttattgtttttaatttttctaattttataattttttgagacagaatctcactctgttgcccaggctggagtgcagtggcacagtcttggctcactgcatcctctgcctcccgagttcaaacaatactcatgcctcagctcctgagttgctgggattacaaccgtgcaccaccatgccttgttaatttttatatttttagtatagatgggatttcaccatgttggccatggctgctctcaaactcctggcctcaagtgatctgcccgcattggcctcctaaagtgctgggattacaggcttaaatattcagaccataatcatattcttccagttatgccataaatatccttttcagctggattggtcggactgttcctaaattcaggaacacgtgttttatccagttgttttgtttatacattttttaaaatctttcatctttttatgacccagaattatagaagagattgagccaattgttttgaagaatgtctttcctctgaatttgtctgggagctttttactgtcatttagcctgtttctccaacccctgtagaagtgatgcataaaacctcgtgggttcaaattggacatttatttttctagaacacacccgacatgtaggctctattgcaatacatctgaaaacacaaaatctgtttgctccaaaattggtgatagcctctgacttaagatgatggtggccaggcgaggtggttcaagcctgtgattccagcactttgggaggccgaggcaggcagatcagatcatgaggtcaggagttcaagaccagcctggccaacatggtgaaacctcaggaggctgaggcaggagaattccttgaactgggacccaggaggcagaggttgcagtgagctgagatcacgccactgcactccagctggggatacagagcaagactccatctcaaaaaaagaaaaaaaagaaagaaaagatgatggctgctgcgttgctccattatacaggtacaacagtttacccacttgctgctagaaagtcatccctatggctctattctcttgctaaatggatgttcagttgcccttcaaccattttcttaatggtttgaacactaattaataatcccttgcttgtatcagtaatttaattgagtttttaaatgatactttttccatatctatcagcagactacaatcattttgttggctcttaactttgattctttcatcatggcttttagaactcaggtgaacattagtccaagtcgagggttactgtgaatggtgccatcttgggactggcacttgggtggatttcttactgacataaagagggctttaatcagccctgctgcaaacgcttccaatgtctctcctttctcactatgactaacattgatttggcttctccctatcacacgctcttattaacttgattcatatttccctttgatgtaagctggtggaaggctggggccagcttgtgttgtccagctgttgctatttgtgtgcatctctctttccatctccttcagtggctccttgcaattgtccatagcaggaataattataccattacaatcatcaaatgtttcaatttaggacattcttttagagctgggtattaaagatttaccagctcaccagtggtttaagccatcggtgttcaaacctggctgaaactcagaattgcctgaagacttttctacaatacaactttcaaaaacccactgcaaacgtactgaatcagaaaccctaggcttgaagctctgcaagtctgtgtctttgataaaatactgcaagtaatagtttgagggtttggggtcaagcagtcagctctaggaagaaaactctatatgtgctcacatccatctcactttttctgagtggtctcaggttgccatcctcaccacctgtattgttttcagggcagcatgtcaaaccgaggtacccccattattgaagaaggtttcttttcacctgcctgcaggcattcatcacaccacctctcctctctgccacccgcctttgctttgagtcttttatcccatttccaagtcattctctgtctggcatccacctaaatacaaccacacgggggagggaggcagcagccgtattaacaatctcccctcatcaatcacttgggggagagttacttctttgcaatctaaacatgaaagcttgtctcctcttgggggcagtgtgtgcgcagggacactagggtttaatatatatatatatatattttggggccaggtcgaaagaaacccctagggcataatctccttaattacacttctgccatttttcatggagcctggtagttcgaggagcccctttctttgtgtgtatatagccaaaatgagttttaagctgtggagggagcaacctaatcaatttccttggcctgggccttttagaatccaatatagcatagatacaggacagtgataatgatttgacactcgccgcacgtctgggggctacacatcgctggtgaaaaaatgtcatgcccagatgaatactgttggcctctggttccaacacaacaccaagaaaacattgcagtattatgagaattcctgttccttctgtcgatacgttcaagatggttcttacttctgagcaggtatcgattgtgtataggttaggccccacctgtgccatttgtcatttctgatataatatcgtgttatcgtttaaagctgtaatgggagaggtgtctgtgtttaaagcaaaccggtgtctcgagctttgataaatggctagatggtctttgtttctgcagcagtgagcagttggcttgctatttgctttaccttttatccaagaataactgtgtgaggagttctggaagcgagcagtatcattttgtcagatgtggtccgtggctagccgggtggtcccagcagaacagctgtgggattttagcacccgacaggatgttagcagagggcctgtgtaaatctgaaacaactcaagctccacatggctgcatttggttgaaaagttctcagtgctgtttttttttaaggtgagaggacaggaaatgctgatgggaaagaaaaaaaaaaatatgtgcttgggataataattttattcagatggagcatttctgagaaaaagtgatctgagggaaaagggtggtgctatcatgagggaaaatgggaaatcagtaaagtgtggctgtctctaacatatgcatacctcccatctccaaaagcgtggctcaggcagctcctgctacccttaaaccacccgcctcctggtaacatggctcaccctctccatatatcattagaaccctcagaaatgtggcacgaagcaagtctggaagactttctgttcctggaactgaaggtattcgtgggttacaatcatgacacttaattcatcagaacaggcagtttgtcaggacaaatagcagtagttttgtgcccacagttcccttctcaaaattcatgaaaaccaaaatgctcccacaattccaatgcgactttgcatggcggcaatgactatcatttctctctgccttctttaagggggaggggagggccagccatgtatcattacataaatggtacaacatgcctgttcccccagctctacagccgaggggacttttggagaagcgcctgacatgaatctgctcctaactgggagtcgatcaagttattttcagaaaagttcaccaggttttcaatgttcagtgtaaaatctacattggactagagatacaaggcaatgctaagcaaccttgtttcctggagcctgctcttcactttgatttctctaggacagagaagctttttggtgatgagtccatactttctcaacagcatctttctaaattaatgaaatgcacttgctagacaatggagagggtctgtagaatacacaagggctatgagacagaataaatgtccacaagccttgttaggatttggtgctagtccatagaagaaataggtccaaataggtatataattaaatatatatgtctagctccatcttacacacacatatacatatgaatacatattaataaacattcatactctcataaattcagtatacctatgaaccagctgcctaagttataagaacgtaaattgcctatatatatacggttcttacgtatataagaacctgattagcaagtacttatatgtatcaatattttaaattatatacctactgtataccaggcatatatgtacattagtgcatttaatccttataacatgtctatgaggaaatatgattatccccatttttcagatgacagagatgaggttggagagagctaacattctttgctcaaaagcacacagcttagaagtagcagattctttcctcatgccatttctaataggtcacacaaggatttgcatatcatttatttattgtacatgtttgaaattatgacaaggtgtacaaatgtaacgagaaaaactttcccctgaaattctaaattcagaatctagcagagttctagggaaaaagatttccatccttttccatgagctttccagagcaaagaaacctacaccttggaaggcccgttctattaaaccagaatatgcaaatagctgcaagaagcaggtagatgacataagtcaaatggaagtcagaccataaagtggtgcagacaatggtgaactccagggcacacatttaaactgaaagggaatctctgttcagctctgtgcaagaaatatggactcagtggtatcagatcacctgatttttctgtttgcttgttttcagagaaaatactctgtagaaacattaataatggtacctcacatggttgttacaagaattaactacatgattattggtagaatgcttggaacaaattcataaagtgtttggaacaatgcctggcacattataagcaccatattcagaccacatattagtatcctcatcctcatcatccttttccacatcaagagtgtaagagccacgtgagcagagatgctgtctctcttcttcagctctgtatccctggtatgcaatgtaaagcaactgctcaggaaatatttatagaataaatgagtgatagaaaggaaagtacaataaaatgcacttatccctgcttgattaattcttaaatgtctgggccagacacaatggctcacgcctacaatcccagcactttgggaggccaaggtgggcagattgcttaagcttgggagttcgagaccagcctgagcaacatggtgaaacctcatgtctacgaaaaatacaaaaattagctgagcgtgatggcacatgcttgtagtgccagctactcaggaggctgaggtgggaggatcacccgagccagggcaggttgaggttgctatgagccatgatcatgccactgtactccagcctgggtgaccaaacaagaccctgtctcaaatatatatatatatatatatatatatatatatatatatatatatatatatattttcttaaatgcctctgtttctttttgtatatcgctatctgtgtttctgtgtgtttaggtctctctttctctttctttctctcattaaattaaaataaggatgagaatagattaccaggcaagctggcaaaatggctaagtaggttgtccaaccagttgtttccttgcgagctggtatctgaataataatgtcccacttgaaccacacagcccccattaatgacttacaccaagggggttcaaagacaggaagtggcagcagcagcagcaacacccctctagtggttctaatgatgcagggcgagggtgcctcttgctcctgggcagaatggaaaatggagtagagagccccaatccgtgtgcagaggtgccgttttcaacaaagaaatcctgccattccaaactgtcgagacctttaaaaataaaagatgtgctgtatttccagcactattcagtattcatgaggcttcgcagcttgttgtaaggcaagatgaaaacaatactcagtagattttcataagtgacatgtaactgcaagattgatagatgatgcagttttaatgtatgtgaagttcaaaaccaacataaaagcttccaggtagctgaacaccggatttcaaacccacatttcttccagtgataagccctagactttccccaagtctcctgcatctataaaacaaaaagtgggcatcaccctaccgagggcagaatttctactgagcctccaaggacaaaggctgggatgtttccatgggtgtagcagggggtcccagggtacattttttttgtgaaatgaatgtgatgaatcatgaatggttaaatatcactatttgcttctgctaatgaatgctaaagaaaaagaaggttgaccttcctgatggttcagggagcacagaaaattagttacatttctagtcatttcccaaaacgtccttgctgtatatctcatagcttcttggccactctgggtttgttatgtattatcaaaatatacacacgtatacatacacatgtgcatatatatatatgtacaaatcaaacattattacgtattgtattgtatatgtaatgtatatgacctatgcagttaaatatattattcataactatgcattatacagtgaatatagggttttatgagttttcatggtcagcctcaattaagcaatatttctctactccattccatgaatatccattacataacattcatgaaatgttataaaaagttaaactactggccaggtgtggtggctcacgcttgtaatctcagcactttgagaggccgaggcgggtggatcacttgaggccaggagtttgaaaccagcctgggcaacatggtgaaactctgtctctactaaaattacaaacattagctgggtgtggtggcacgtggctgtagtctcagccacttgggatgctgaagtgggagaatcacttgaacccaggaggcggaggctgcagtgagctgggattgcaccactgcgctccagcctgggtgacagagccagactctgtctcaaaaaaaattgagttaaactacacatcttcactttggaacccttctttccttttgtcttatcacttgttccccagcactgattgaatattaggacctgtcaagtaccgaacagaaagtactgtaaggaagtctgacatagacacaaagagatgacatatgttaaagagaaatatacatacatgtcagcaggcatacatacacatgtgattgtttctatattgatgagtcttcctttcttttcacttattctttgtcttttttggaggagagtgctgagattgtctctttttattttgctttggttccagtctagttaactcaaaatgcatggggttagaaaaattaaattaaattttaaaaatcacaatagcagtgaacattttataacattcagtgcttaaagtatgtgcaaaacaatcttacaaggagataatattattaacttggttttatgaacagggaaatggaggctcagagtggttgatcaacttgcagaaagtcacacagctaataagcacaagaggttgatttttcattgtacctgttaaatagacatcagcgagatgcaagtgccagagcaacataatggacaattttgagatccacgctgttctaacccttctctggctaaaaaaaaaaaaaaacaaaaaaacaactttgcttgtgcatgtcagacaagaaggcttccaaaggacaaggacaacctcctttgtgtattacattgtcactttctaacacagggcctggcacagagcaaaagcttagtaaatgtagagtaaaaaagaaagggagaaagtggtaaggtggtgactcccttgtgggcatttgggagctggaaaaccaatgagatctttccaattttaaggtgagcacaaaaggaaggacaatttagtgtctggaaaaaaaaaaaaaaaacccacaacaactggtctatgaattggctgcccagagaaggggacagggcagaatgtaaagaccaggacagaagggctctcctgggtgtctcctgacagaagatgagagaaggaaaatacacaaggtgaggtatttatctcgaggtctctggcttctcattggcaatgctggaatctgaagaaaacctgggtctttctcctacaacttgagctcacatctcctgattttcatcattgggcaatttttccaaacttttcattgttttggctggatcctgttgagaaagatgatttttctcagggctggaatacaagattcctcaggttgagataggatctaagccagggatgctaaggtgtcactgagttcaaagtgggaatcttctatgatctttgcccatgggcagagcggctgtgccagcaggtaaacaccacagtggggacatgcggaacgctcttatccactctacttgtccataggatggtgtggaagaccccaaaacagagtatggtaaccacctacctgtgtcgtctgtatagaaccatgaagaatgttcctcctttgggcaaagggttttaaaaatactttcaaaaaaaaaaaaagaaaaaagaaaaaaaaaacaccacctctggtttcctgtattcagaaaaggatctcatatcaactcctagagattcagagaaaaaataagaaaatgtttccagtcttctgtttcctaccctctttgtcttgttcccttctcctgggctgacaactgctccagacacattgccgttcgcaatcctgttaagtcaagagcatgtatccttaggggctctgcacccaggcagtggctgctgtcatcaactcgttatgcactgcctttgccccccaacacacccccttttgtaacattcatcctatttgttctctcttttgtatgttgtctccctgtgacactataatgtaattgatgactggaaccagatctgtctcgttcatcactgttccccaaatctaaccaagaaggtgcctagaacacagctgatgttaaataacttttttcaatgggttgaattcatacaggcacccaccctttcttttcagtgctcgtaccacaggaatggtctacagcctggcaggggctcagtgtatatctgttgaataatagaagcagcacatcagagattgccactgccatccgctgtaggaaagcaggtctcttcttgagctaagaggaaacccatgttgagttgacaataagagggaggaaccttgaacctgagggagttgacagtaagagggaggaaccttgaacctgaggaagaggagtcagtttctctagcattccgcataaaagacaaagtggacaacggggaggttctcatttccctcctcctcagtgctcagactttggaacacaagttgtattgcttgacctatgtgtgtcttttgaccacctctgatgattcatttatctgatttgagtgctttcctgatggaaaacacagtctgttggatggtagttcactgattccctcttgatgtccatcatctctagtgatggccttccatgagcacaatggcaggattcttgaccagttccccgaactcttctgttttgttttgttgatatgtgtcttctgttttgttgggagcctgctgttgcttacatagaatgtcctctgccactggtaatgaccttcatgaaagaggctcaaaccctgatttgtaatctctaagagcagcctcccacgaggtaggatctcccagctgaggtgaatacctctagttggcttttttaaattaaggctccacattgtaactagtcaacgtacattattgggagagtgaatgtcaatgccactgcgttttctttctctcctttatctttgtcagtgattcaaagacatgatttatggttagtctccgactttcagcatcatccatcaagtcctggtttcactacagggctccacattgtaaatcataccgaagggttgtcactcattccccttaaccctttaggggtatgtttcagggtcgctgtccaagaaggaaactttgtaagatggcagttgagggggcttgggcaattgatagggactcattaagtcagtggcattaattacttcacctaatgtgatcattattaaggcctgggtaaggcctgggccagctccacccagcccaggcaggaagagaaactcgctcccggtgacttgagaaacacacagattcctgaaccagctctattctgttttgaaatgtccattatggatgtgaagtgctgagtttcactttggaatcaatcacaggctagttctgattgtgaccttgcaaagattacagaatgagtgcaaagacccattagcagctgctatttcaggctttgtaaattaacagtcctctcctcctcccacactttttttcatgtctctatcactctgtgactctctgtccctttgtcaccttcgggaaggtggggattggtggcaaggggtgagactgaaacttgcaggcagaggagcaggacttttgcagggccagatctccccttctggctgattccagtcatgcaggattaaggctttgagacatggcacacctggtagaagcaaaatccaggcaactggcattgaatgaatgggcgtgctcacctaccagaagtctgcaactagtaattgcgggtcattaatgaaaaaataaataaatatatatatatacacacacacacatatatattcttgggatctatttgttcagagtctgcatttggttgaaagcgattttgttcctgaattgtgcatagctctgttttcccatggtaagctgatgaaaacaactatattggtgaaagatatacaggtaaataaagtgaaggtttgtaaaatatgaacgttcatcatctaaactgtgttttcataagaactcctcctcagatggtgcttgaggggctcaggacttggatgttttcaaatacaggtcacaaatgtgcctgcggtcttcatttttccaaaaattagcacttatttagtcttcaaggattaaggcacctcagtttaccaggacagtgaccctgacgggtcccctctttacccagcattctcactttccagcatacaaagtggctagtcttaggattttatctttcttggaaagagcacaaggatcttttcaaactttaaatgacccagagccatgaatcctcctaacagccttggaaggcaggtaaactgttgccgaactagtatttcacggagcagcccttctctcttctgccctccctcctgctcagaaatcagatttatatggtatacacagtgtctgcagacctaactgcaggtgacttagaaacggagagcctgcagattaatgtgcccattcagaatgatgtattctatttttttgtgctaagagcagcgtggatggctcgttgggaaggcataacaagggggccagtctcggcttctgcgtcgcagcctatcacagaaagggcttctgtcgggtctctgttgtgaagtcagctactgactgccatttgaattccatcgatacgacgtcttctgtttatgccacatggatttcattatgcctctgatcaaaagaattttctaggcgctgacaataaggaagcaagttgttcagctcatggaactaatagacaactttgagagtccctttccctctcaatgagcaagaggaattctcccttctcaatattgtctgtccctagaataattgtacatttctgcaaatcttgttcaggccaagagacaacatcccggaggcatcaagaatctgctgctaaaaaaaaaaaaaaaaaaaaaaaaaatgtgctttcaacaaattagaatacgccacctagtgaagttcttaattagcatggcacctcagatataaagttaggaggcctgattgcggtcaactcaccccgacctcttacttgaaggaacccggaattataggaaggactctggaaagaaaaagaaaatgtaattaaattaaaatagtcctgctctttctgtctgaacctagcccattactatgataccttgtttcatgatgtcttgtcggaagcatttagaatggtgaattaccccccttttaaaaacaggcagacaaaaaatatatatacgatcttattcacacaacatgtgggtcagtgttttctggttagcatcctgcctagaattccaggtatttctaaggtattcaactctgagtggtgcaagtcttcacagatctgtatttggtgaggcatatttgccagatttgccatggtggcaaatttaaataaattgtccagatgcatacacattaatccactggctggaagccaggaatatgcagtacagcctcagcttccctatgtccaatttcccctgggacttttctttttacacagaaaatttcaagctgtgtgtgtctaaacacagaagttgccttcctccttcctaccttctctctccataatcggtaatttttcctcccatcagccccatcctcgttttcattttgtcaaataacagtgtgactttgtctttgacattaaacagttgtatatacttttagcagtttgtttactccatctgtatttccaatcagcgaggaaggtttaccaaagtggttcattactgatttatttatgatgtatttagatagcaaatatgaaactgtcagcagttgctggctaaacagtgttgacagacattaataacatatggtatagcaatggaattatgatcttttaatttttaaaaaaattttgattctcaacgtgcagttttgggttttgcatttcttaggtaggtgcgtgcaaaggagaagacttttaacaaaactatgttttctttttatttgtaacctttggggtttcctgttggtgacattaacatcttctgtgtctatttagctgttcaatttaatggaagacaaatcctcccaaaggtttaatttactcttgcaaactgaaatcaccgtattcacactgtgggaaatggccctaattttcccaaccttcagttgccatcaagcatataatttatttctcccccttcgatacattccccattagaaaacaaagtttttgatatttaaatgttaccaagttcaaacggaggaaccgagtctcccgtttctgcaaaatgctgttgcaggcatggctgcttctacctgacagccacccatttatactgggccagaacagacaaacatttgaatttctgacctttaattggctgttcctttgagcttatatggttttttccagcaccaagggaggacatttttcagctcaactcaaaggaaaaacaacaagcaaacccaggtagcagtaaaattcagcccatttgctttgaagtaagcatgggcattttagccagaaggtgacccgacaggcaataaagtttctctttggccaagaattcttccatggttccgtaaagatgatctcgttttccagactccaattcgttcccttgaatatgtccaaaggacatgaaagttaacattagaaaaaaaaataggagtcttctagggcaggaaatatctgtgatggggatccattgagaatttggtaaaagctaacaccttctcactcagcatacacataagcattacctgtaatttcagggttctggcatcctgggaagcccatccagtgtctctggagcccagttaagaatcagccatcattcaggtcattacgggatttttgtgtgtgaagtacaagaacttgccttcattttctaaggttagagtggggaagagatggctcatgtgccacatgaactgagtacctctggaagctcttttagtgttttatacacgttatcacactggatcctcaaaacaccctaggaagtaggtataagacttaatcccattttgcagatagggaaattgaggagtaatgaaattgaaattgaggtcacatagctgataagtaaaggaaccacacgtcaaatctcaacactgattcctgagccaagtcaaatgggaaattttgcttaaaatgaaaaatgtaagttaatttataagcttttaccttcttgatttttttttcactatttcaaaactgcaaagcatattggaaattatccctttcaaatatcttactttacctttgaaataactaaacccagaggaactccaagacttgtcctgagttaaacaattagaggctgagccagagctggcttattccgacttgggattcagctttgataatcaatgccataccatgtccttgggcatgttaaggcttgaacttaaacataatggtggctagttttgaaatatatctaatattttgagaatattaatgacactagaaaataaggatcagagagccatctctgtcctaatcctaatcccttcactgctgaaactcacaagaaataataaggtgccccgactagagcacacacttcctcagatcactattggaatcccacctctgatgcccactgtgtgatgttaggcaggccccagcacccatctgagtgttgctgtttttcccatgtaaatggcttaaataaagcgttctatacaaagccatcgttacagagcctgacgtagagccaacattcattaaatgttagtttgtagaattatatttattacaagtgtgtttagaactaaaatcaagacatgtggctgggagcagtggcttgttcctgtaatcccagcactttgggaggccgaggcgggtggattgcttgaggtcaggagtgaaaccctgtctctactgaaaacacagaaaatcagccaggcgtggtggcacacgcctgtaatcccagctactcaggaagcagaggcatgagaattgcttgagcctgggaggtggaagttgcagtgagccaagattgtgccactatactccagcctgggagacagggtgagaccccatctcaaaaaaagtaaaataaaataaaaaatcaagacacatgaatattgtctattcaatgtagacatcttctacagtccccagtcttcaaagccagagacagcgaaactccagtatcacatcccaacacatcaagtctctgactttccttatctctgacatctaggggctcatgtgactaggttaggcccccactggataatctccccattttacagtgatctgatttgggagctcagttacatctgaaaaactccgtcccagcaatgcctagactagtgtttgtagaacaactgggcaaaggtgtgtgtagtgtatatcgggggcaggaagcgtgtgagccaggaatcattttagaattctgcccaccacagcctcagtcttctaatctgtcaagtggggatgtgcagtggtttctatggcacaggtgcctgtgaggagtaaatgtgtatacatcacgtagtatagcatgggacataacacacatccacgcggtaccttgcagctatggttcttggaagggaaaataaaactcagatgtggaatagtttatcagatgagggtagtttagagctcaatcctgggaggaacaaccaatcaatcaatcagcaagaacatattatggaacaccaagacgctttgccagggattgggtgcgattgccagaagctgcaatggatggcgaggaagagctgcttcttgtgggcgggtggagggggacttcctcagggtatacacagtctccttgggaacttgccatcttgcctctcctccctgccacagtggcaatgttcatgcagtgtcacatgaccaaccaaggggtgggtttccaggttgtgtgacagcgagtgcaagggccctgaggtgagccttcacctgaaaaccaggaaacaccaaggatgccagtaaggctgagcacagtgaacgaaggagagaggggaggaaactgagtcaaatctgggagtgattggaaacttgaactttgagtattttatgacgttacggataactgtaattgttactatttttttggatgtgagaatgcttatgtttcaaattaggaggagattggatatgcattaaagacaagagtgctgccttcaccactcccatgtggatgaggatgttctgtaagacttcttacagtccttcttgctgcgtttttggggatttgggggatttttgtttgtttgtttgtttgtttgtttgtatcctgttctggttttggcttcacagagcagaaactatagttggtaccgaccatggcccagacatccaaataaatagtactggttgtttctcaacacaaatgaacaaacaaacaaggagaatagttcttttcttttggaagtacatactaaaatatttatgaataagaggatatgaagtcagagatttgctttaaaataattatggtgggaacaatggttggaggtttagatgaagcaagattgtcctgggttgacaaatattagaatgggttgatagtaaatgaagatgtattattcaattggatctattttgggatatgtttgaaattttccattaatttttttttttaagaaaaaaagaaattgagtcaaaagaaatggcaaggatcagatcattgcaggtcttatagctggggtagggactttttacttctaagaacaatgggaaattatcaaagagttctgagcagagtaaactcatctgacttacatttgtaaaggttattcattttggattgctgatataacacattatcacaaacgtagtggcataaggcaacataaattcattgtctttctttctggaagccagaagttggaaaccagtttcactgggctaaaatggatgtgtcagtaggcccacattccttcgggaggctccagaggagattctttttccagcttctaaagctgcctgcattcttcggctcagggctcccttccattttcaagcagggaattgcatcacggtgacctctggttctgctgtcgtatcaccttccctgactccgattctcccacctccctctcataaagcccctttgggtccttctcattttggctacctggaaaatccaggataatctctttatctcaagatccttaattttctaacatcagcaaagtccctttcgtcacataaactgacattcacaggttctggacattcggacgtagacatctttggatgccatgatctcgcctgtcacaagggacaagggtgaagctgagggctgtgaggtttcaagcctcagcactatggacattttgatccacacccttttttgctggtggggtggtgggatggggagctgctctatgcattgttaaatgtttggcagcatccctggccttgacccactagatgtcagtagcacctctcccccatgcaagttgtgacaatcaaaaatatctccagacattgccaaatgtgccctggctgacaaccgctggggtagcgaagtaatggcagagaaggccagaagtgattggatcccagttgtattccaaaggcagtactgacaggtgtaagcctctctctctgcccatcgctaaccaccacaagtaacaagagagactacctttgcatatgtgtcgctcacatggacagtatggaaacaaatggcaacacacctttgttgtcagcttctatttaatgttctctccaagcatttcttttgctgctggaggacaaaggcagtagctgttactccttttacccatgaccttcctcggtgattggagcattgtagagggtcgatgagtacctgctggctttggttttataattatagtctcactacacctttgcttggccattgtggaaaaagaacctaatatcctgtgtatcactttctcttctaagtgaaatgtgagacatcgtgttggctaagtggtttggaatcgtcgcacagaaagaattaaccttaatataaagactttgcaacttggtacatgattctctgcagtgtagctgtgttgatacttactagtaataattttatatgcccccttaatcattgctagaatttagcgaacacttactgcttgttgaccactgagctcggtgctttatgttaatatatattatctccatcttcccagcaactttaagaaatagaagctattattaaacccattctacagatgaagaacataagattgagacttatgcaaatcaccgtagcataggcagaggatacatttcagaaatgtctaaattctaaatctttgctcttgaattctttactgtattgccttcattctaggctgcctggggtgccttgatccaacgaagggaagtcaggtttagcattggaagctagcaagacttaactgttttgttgatggctttaggctttgggttttgatgtatgctataacttgtaatacttccagccttggggagggagaggcaggggtgcttttctgtttcaggagagggatcagccactccctctattcactctgcctttctctcttggctaccatggctatgtacaaagccattagcgatgaatcatacgtaggcagatcaagggacacaatatgagctgtttagtcttttccatccttctcgatatgaatcattgtcagattcagagctgtagctctccttatataactttagctgctccctcagatgaatctatgggcacaactcacctttaagctgagaggacaaatgaagttcacaggtgcaaggcagagaactgggtctgagcagactcaaatttttttttttttttttttttgagacggagtctcactctgttgcccaggctggagtgcagtggcacgatctcggctcactgcaacgtctgcctcctaggttcaaacaattctcctgcctcagcttcctgagtagcagggattataggcacccaccaccatacctggctaatttttgtatttttagtagagatggggtttcaccatattggccaggctgatctcaaactcctgaccccaagtgatgtgcccacctccacccaaattttaagttctgttttgagggttcattgatttggcatgggggtctcaaactcataggtctacaggggccaggctggtgtgggaaatgagaaagatggtgataaatgagacatgagaggctaagaagtgggtgggatggcaggcagattctccagcatccacactgcctcccctaggagggcagactcatctccagccaagggtgccaggtggagtgtggtctcatcgccagacataggctttaccaagagaaaccaggaaaataaatttttatgcgaaatctcctgattttttaggtcttggtaattcgtttgttttaaaactgcatgtcccaaaccaaacccacctaaaaactgaaactgggttataaactctgccttgggaacttgatcccaagctctctagacctgcaatgttcaagcggtatgtcccacataccacatggggctactaagcccttcaaatgtgactggtccaaattaaaatatactgtaagtataaaacacactgaacttgaaaggcttagtccaaaaaccgtagtgcacaatatctccttcatttttataatatgatactattatatcataattttataatatactattatatcatattatatgatactatttatatcatcatatgatgatatgatatactatatcatcatatgatgatatgatatactatatcatcatatgatgatatgatactatatcatcatatgatgatatgatactatatcatcatatgatgatatgatactatatcatcatatgatgatatgatactatatcatcatatgatgatatgatactatatcatcatataacatgatgatatgatactatatcatcatataacatgatgatatgatactatatcatcatataacatgatgatatgatactatatcatcatataacatgatgatatgatactatatcatcatataacatgatgatatgatactattatatcataatatgatataatattttggacatactaggttaaataagatatagttatataaatcaatttcacttatttctttctcattctttaatgtgactactgaagcatatgaaattccatgcatagctgacattctacttctattgggcagcgctgcttgaagccttcagtatctgatcacttgcaacaaaaacagagacataataataatcacagacaccatttaccgggttcctaccatgcatcactgtatgaagttttttgtgctttcttttatttcatactcagaataactctttgaagctataatcttactatggtccccattttatagatgtgaacattgagtattagaaagctaagtaacttgtggccgggtgcggtggctcacgcctgtaatcccagcactttgggaggccgaggcgggcggatcatgaggtcaggagttcaagactagcctgaccaacatgctgaaaccctgtctctactaaaaatacaaaaaaagaaaaaaaaaattagccggcgccatgtgtgcacctgtagtcccagctactcaggaggctgaggcaggagaatcacttgaacccgggaggcagaggttgcagtgagcagagatctcgccactgcactccagtctgggcaacagagggagactccatctcaaaaaaaaaaaaaaaacctaagaaacttgctaagagtcacacagttatcacgtgagcgattcaattctggatttgtctacaggttttcagataataaagcccgagcaattaaccactgtgctaagcaagaaaaacacagagaatttggacaaatctgaggagagttggtggctggcttccaacatgcgcctaagcttaaaatagcatgcatttcagcccagaaattatggtatctctccaactttgaacttgtgggcaatgcttcatttaaattcagaagacagaaaatatttccaaacaggtgtactttactctgtgcaaaatgtacatattctttctgcattgagctgaaaccaactatttgtgacttgaaacacatttgatatgcacaaaggaagttccaaatgttaagaaaactatcctgggtctttttaaaactcgtataaaaagatctacatcttccttcttttgtgaatatgcagccgcactgtccattttgcagggttaggcctttacctacaggtttttcctagacatgagatccgagcatatttacctgaacctgatacttgtccacaatttttatggaatagactcatgggtgtgtttgggaattggagggtccctgggaatgaatactcctcctgctccctctcaatgccttcatctgcttctaaaaaatattcagtaacacttgtagaaggcatggtgatcagtgcagtgtgagctttaggttcagataatcctgagcactgatcgtgatgctataacttatgagctgtgagcctggtgaagccatttacattctttaaggcttagttcccttatctgaaaaataaagacatatgggccgggcacggtggctcacacctgtaatcctagcactttgagaggccaaggcgggtggatcacgaggtcaggagtttgagaccagccttaccaaagtggtgaaaccccgtctctactaaaaatacaaaaattagccaggtgtggtggcacgagcctgtaatcccagctactcaggaggctgaggcaggagaatcgtttgaacctgggagtcagaggttgcagtgagccaacattgcaccgctgcactccagcctgacggcagagccagacgccgtctcaaaaaaattaaataaaaaataataataaataaagacacacatagcagtcaccacatatgattgctgtgaggattaaaagaggttagggtctaaatgtgccagcacagtccctggcacaaaacaggcccccgagtacagtagccattattactaaataataaacacgatgatgaggataatgatttttgttcctcagcccttgcttttacttttctgactctaacactcaggactaaacttggtcaaagggttaaaacaaatagagaagggaaaagatttcatctatgagccaccaaggtcatgggtatttggccgaaacacttacctcttcaaggctttgcatctgggtctttcatccccttgcttttttgaacactgtataccctctgtgaatgtaaaaacatttgaagagtatcaagcactccacgggtagtggcagttgcaagaagtctggtccatttttctacctttcacactgtcagagcacgagaccttgggatttttataatccaaattgatactctctaggaaatctcttccactccagctccctgccctggaaagattcattttcttgtgggcatttctccagccctggtgggtaacggtgactgagggtgaattcctaaccttcccttgataaggttcaagtcttgctaatttgaatctctcctattttgctcccatccacctggtgctgtttgatttatctgtgcttgtttgtggattcactgatcactttcttattactcttccacctccatccatttcagtttgcggtgcctttcaggtgatttcttatgccaccccttaccacctgctcaacctgacaaattatcgactcaaactgttgctcctgacctggcgtggtctcttcccagggatataaatgatgcagttcagagggataatgatgccctaataaacatacagttgttcctgtttcagcctgccctgtttgaaattcaagcatgccacaaccactggctgctgccctagtaaaggcagtgagaaggaagagagggaaattggagggctgagggctgagaaatccacgagcaccaataatgagatcagagaaatcacagaggggagttgttgtttttttcaggggtggggggcacttaacatcttattttgctgtagttaaaaatcaggcaggagtgacaggttccctctccaatcaggtgtgttctgaagccctgaagtttggtggcaagaagcagcaataaggccccagaagcaggaggtcagtagagaggagatgccctcagctgcccatcttgcccctaccctggctctcacttgtagggacatggctgcagaggcctatctgaccccagttttgtccacagccacatctttagagatgagcaccctaaatcccacttttataacttagactctgaaaacctttccagatcacagatttggggctgcagctcttcttttttattttatttttttatttattttagagatggggtcttgccctcctgcccaggctggagtgcagtggcactgtcatagcttactgcagccctgggctcctgggctcaagcaatcttcctatcctaacttccctagtataatagttagggctacaggcatgcaccatcgtgcccagatacattgttttactttttttttttttttttttttttgataaatgaggtcttcctatgttgtccaggctggtctcaaactcctggtttcaagcaatccccctgcctctgcctcccaaagtgctgggatgacaggcaggagccaccatgtccagcctcctgtagttctactaattgctattattactcttcactggagaatcaagtcaaaaaatcaataaaacaacatagatgcaaatatctttgaccttgttggcatgacagttctaccaccatttcccctttagctgatggtaaatcgcattcgccctaagaccaatttctttggagaatgtaagcctctagcataagtaataaataaataaatgcaaccttaaatcaagatgaagaccaccctaatgtcttttctcttcacaaacccactggtggcgctagtgagcagggatcacacaggctggctgttcctcaccctggactgttcctccctttggtagatacagaaatggagaagacagggagctcacagctactgttgcctgccctgtgccaggcatcagctcttgtttctcatttaatcctggatcagttctttgtagtaagaggtgtaaccctgatttgtgaatgaggaagctggaaatcaagcactccccaagtattgtaacttgcatcaaaccctccgagagcacatttcccacccacatcctgcttgacttgataatgactcccaacacgtacggatcgcttaccaggtgtgaggcggtctgtgtgtcaaagcagtgcacttggactttctcatttaaggtcgccaacaatcctgtaggttggaattgctgttctcctcattttacagtcgagaaaatgagctcagagcagttaactaactctttgaaggtcatacagctagaaagtggtaaattctagaacctcacccccacgccctgtaaccactgtgcagtgctaccacaaaggtgtgtttgttttatttccttatgccagaaacacagtaggtggtgctgctcagcagacagctctgggcgtctctgggcccccttactgctctgcagctgatcccagagagcctctaggtttccaagtatgcattgcttactctttcctaagagctttgcctctaccaggacacacctttcacttgttccacctacccattttgacttggcataaaatcagcttctttgcatgtgaaaaagacatttccaaaacaaccatgacggctgtatttaaaatgcaaatatgcacattttttttttcggagatggagtctcactctgtcacccaggctagaatgcagtggtgccatcactgcaatctccgtctccaaggttcaagtgattctcctgactcagcctcctgagtagctgggattacaggcatgcgcaaccatgcctggctaatttttgtatttttagtagagatggggtttcaccatgttggtcaggctgtctcgaactcctgacctcaggtaatccacctgcctcagcctcccaaagtgctgggattacaggcatgagccactgtgcgctgccaaaatgcacatataatttaacacccagttctcctcccagtactctactgtgcagtgcagagggactcatgggctggcccattttatcagagctgtttggggcaatgaaatcatgaaaggcatttaaacgcccatcattagaggtctagttaaatgaattaggatatatcaatactatctagccgtaaaaaagatactgacaggtggccctaccctgctgaggttttaagagtgctaatcagagagccctcccattctacttccaaatcaatcaaaaagtgaatgcctgagtcagaatggaatcagctgctttgcttggggagaagctggtttggagccgagctgaactgaaatgggcctcctaacacttccccttgtgcttctgggaaagcttgaagaacagtgcatacgtggaacctgcagatgtgaaaactgaacaatggctttgaacgcatggaccctgttgcacagcaggctctcaccgggatggcacagagaagacgacagattcttccctgttcttccaggagagcagaagtacctacttcctaggcagtggcaaccacttggggaaaggaagaagatggccccctctacaaatgcgtttcaatttggaaacattgccttgatgtagcgttaagtcggaaagaagcaaattaataatgaaacgggagagttcccagatccccgtcgcaggacgtgagacaggggtgtggcttgcctgttgggtcgttgccactgctcaaacccctgaggggtgggggagcacgcagacagacaggtgcaggagcccgagtgggtgtgtgttgcagtgtgccgttttagccctgccatccacggatggctagagcgttaaccagctcaatggaccctctgcctttttgcaagagcagagagccaatgtgacagctttctgtatcccaagcttttgcccagcatccaagggaaaatcgggccacatgtgggcttgaaggatgaatgagggattttatcgagcggtggaggtggctctcagtgggctggatgaggagttgggagggggatggagtggggaaatgatcttcccctggagtttggctgtccagtggctgaactcaactccaaccgtttccacatgaattcctgtcagcattcagacgttccttctctctttctctgccgtgccattccatcgtccatctgcttgtctccttgtctcctcatctgcttttggagcctggggtttggggtttatacgactacaggatgggggatatggaggaccaaaaagcaacactttgggtgtaagaacagaaatgcctgttcccacttaaagcttcaggtcttcaggcttgatgggggggctctttgctcaggaccaccctcttctatccagtatttccctgtctcctgtccatatcaataagacgtatataatctcaattaaaaagtgtgtgcatatccgtgtgtgtgtccacacaaaatctcttaacagagattacttccaggcagcaggatgacaaaggggtttatgagattgggttcctactttaaatatttctgcagtgtttggagtttctaaagaaatattcctttagtaattaaagagagagaaaggaagaaaaaaagagaaaaaacaaatggataattatgttctcagagaatccatctggacataataaaaacagcagcagcagttgtattagtaggtagtatttattgagtgatttgctatgtatgccagactcttctaagcacattacttgaattgagtcatttaatccttgctgtaaccctgtgaggtagggattattattatgctcaatttacatatgaggaaacaggcccagagactttaagtaactttcccaggtcactaaacagtttcccaagatcggcgtttaaaattaaacctccgatgaaagataaaagctctttttgtgtgaaacaaagcaaagcaaaacaagaggtccatagatgcctccactcagggtccctggctccattaagcactgtaggctcaggaaactttcagaaatgttttactttattttagaatcagagggataaaaggaacattcacagtcaaagaaaatgctttacttttgtagggcccatcaaagtgtaataaattttgcctgaaataaaaaaaaaaaagtaaacattgatgcatttaaagtaatatcaagaataatttttaggtatgagccacacagtcgctcctacctgcaatcccaatactcagcaggctcagatgggaggatcgcttgagccaggagatggaggctgcagtgagttacaattatgccgctgcattccggcctgggtgacagagtgagaccctgtgtctaaaacaataataaagaagaacttttaatattgaaaatattttatcatcgtagactcagagggtacctgtgcaggtttgttgcataatgatcaggtttgggctgccagtgtacccgtcaccccagaagtgaacattgtacccaataggtaacttttcaacactcatctccctcccaccctctccctctttggagtccctggtgtctgttattgtcataatattgataatgtttagtattataggaggggtccatgaagacaaaactgctgatggccaccctgtccttacctgcgttacccagcccacttaagtttcaatcatatcgaagtggcataaatgagctcaaaattgttcctaactctcaatcgtgttcagaagggcctgtttgcataaggactgggggcccagacagcactgcttctctaatgaagttgtcatcttggaatccctcacatggagtccctgagtgacccagcacttggagcataggaaatgaaagaacaatgactttgcaataatttaaagtgttacatgagcaatgacaacatacttgcggatatttgagctatttctttagaggaaaaaagaacagtttggagaaacctaactcttgtcatatggtttatttaatgatgatactaatttagagtaggttcccgctaatgaaaagctgtagcaaattatactaacgaatccttgctgtaaaattctttcttgtaattctttacgggaacacagggcagttttcaaatgaagatgtgatggacattcgttcttgagtttttaactgcccccaaaagggaactctgaattactgggacacatcgagggggagggatatcgtttatataataatcaggactgctttcattcagagtacagaaagcccaactcaaattagcatcaagagggacttcattgggtcttctaactgaatagtgtgaggatagatctcaagtgtggctggattcagaagtcaacccactttcctctgtgccggcttcatttacaaaagattctctccgcatggaggtgtggtcccccagattgagaaccagcaggaaaggaagtactgctttctcctggtggttcccaggaaattctgcaagtcttatttttcagaattggctcaggaacccatccctggaccactccttggggccagggggatgacgtgctccaaaaaagctttggggcttgcgtggcatgctcattaggtggttggtgtgggttgacttctcctgaatcctgtggatcaaaagtaaggagggggatccacttcataagacaattgaaaccaaggtgttgtcaatcaagggaaacagcaatggacacaggggaaagaaaggaaaatgtctactgcaatatgtaattaatagtatggagggttaagtttcagtttttgttgatttatggagtttttcaatgtcttacaaacaatcaaaacaccgaaaaacttttaaataaaatttcaaatagctacaaatctagctaccttaggtttaagtcactggagattactggttgaaagtttgttaacagtttcttgttcatgccttgaaaatttcatgcaaaattgtaccttttggctctctctgaagaaacatgacaatttggagtctggattagtccttgaaaaaagctggtccctgaattccttctgctgctgcacctggatgcttcgttacaactagagctaataggaaccacccagcactcgtcaatgcctgaactgggctgactgcatggctgattaaacccacagcaaaaagtgtttaaagtttaattaatcagtcaacaagaaaaattgaactctataccatgggtaaagcgaggctgcacacacacacacgagagacagagagagagaaagagagagagagagaaatttgatggtgaagtatttcctatagaaacaacctctctttctttggtgacaacattatttgggacaccattaagaatttaataaactaattggacttttttttttttttgcaatttcatgccaatgaacactgataaaccaacttcatggttgctcttcacacttgagatttgaatagtacctttataaaacaaagccattatgaaatggccctgtcaccgtgacttctaaagggtaagactgtgcctcctgacaataagtccagcctgactttgtaacatctcttggctcccttgtctggaaggatgattaaaatcaacaactatttcctgagtgcctcttcaatataggacattgtgctaagtacaatatagtagtaggtgctggcggggaggtcacatacacagataaaccataggtgtcggccttacattgcttcaaattcagtgtgaaaacacaaaactcacacgataaagtacagtgtaaagtgacatatggtaagtagcccaaatcaaatgaaattatttaaattgatgtaattaaatatttattgaaatacttacacctacataacaggcttagttcaaggtcttgaggaaataacaatgagcaaaacatacaagatccctgatctcttagagtttatgttacgggggtggcagggggagagggagcggatgatggacgattgaacaaataagtataaaatatgtcagattattaaatgctgtgcaagaaaaatgaagccgagcaagggcttagttggaggtggaggaaagtgcactttcctaagactggtatgggaaggggcttttaagaagacagtgttgcgagggctcacgcctgtaacctcaacactttgggaggctgaggccggcagatcacttgaactggccaatatcgtggccaagacaaacctggccaatattgtgaaaccatgtctctactaataatataaaaaatagccaggcatggtggcacgtgcctttaatctcagctacctgggaggattaggcaagagaattgcttgaacccgggaggtggaggccgaggtgaccagagatcatgccactgcattgcactccaacctgggtgacagagcaagactgtctcaaaatgaaaagaagaagaagacaatgtgagcagagaaaggaatgaagcagaaggaagggagggtgtgtagagtgtccagtgcctgcctgtgcttagtaagcactcaatcaataaacactattattattataattaatctaagaaggagcccgtaaacctgagaggagagtgtcattgcaatgagcttgattgaagcaagatttgtgaaggatgtggcatttaaaaggttgagataagagttcatggggagatgagggaagggccatctgagggaaaaggaaggataaaaaatccaatggacactgagatcgggcacaccagtgggcgggacccataggctaatgtcctcctgcagaaatgcagtttgggtttgtttttgcagggaggttgtttgtttgagttttttttaaagattatctcatcaaaacctgaatttcaggctactgtgagaaaaagtagaaaatctaacagcactgagcccacttttccacgtggcaaacactggtctaagtccttacagccctgccacatcatcccaagatcacaacaccacttcccgggattccagtatattgcggtggtttttaagagcaaaatagcagcattttgagagctgcctgtcatatgaaaagcgttctcaccacacccttccactgtctaaccatgccacagtatcttgtttctcttttggttctcatttcctggtatatgggagaggttgagtggcttttgccagacatttgctttctttccagagctccttcagctatggtctacagtcagagttccatcatggaggcatcctagattttttttttgcctttgggaggggagaagtgaggaagagactatattaaaaatgtaagaaaggctgggcacggtggctcacacatgtaatcccaccactttgagaggccaaggcaggtggatcacctgaggtcgggagttcgagaccagcctgaccaacatggagagaaaccccatctctactaaaaatacaaaattagccgggcatggtggcacatgcctgtaattccagctactcaggaggctgaggcaggagcatagcttgaactcaggaagcggaggttgtggtgagccgaggtcgcgccattgcactccagcctgggcaacaggagcaaaactccgtctcaaaaaaaaaaaaaaaaaatttaaaaaatggtttcatagggatgggaaaagaggggtcccaggcctaattcccagtctttctcctagggttgagctcctgccctttttcccctaaggccaaacacctgtctctgatgtctgattcctcttctcccagaattcttcattttggccaagaccttcttccccagtcaaattcccagagactcatatctggaggacagaaaggcacgaccttagctcttcctcagaatgaggaatagaaaacagtggggggccagctcactttttaataagacactagtatttcagcattctatgaagtcaacacccaaggaatgtccctgtcatctgttctcaccttgcaattgctggtcctgttgtcttccccagccctctccacacctcacttcaccagccaagccattgttggctcctaagcatttcagttcctgatggaggagtaagacaggtagtcaggtaaagctggagtgaggacaaatgggactggggtggcggaatccctggcagaaagtcaaggacgtgaacatacaaggaaaaataggccacagccagagcactgaaggccacaaatgtgaacccctagctaggatatgtcattttatgccaggcaaaatcaggacaacaaagggttctcaagcataggtgcgacccaaccaacccttcaccagccaggaacattttctggtgttaatgccatcttagaaaatgctgtgaaaagctccttgcactgagctagtttctcatcccctgatgtttacacctctcaaaggtgcatggagccccacaatgtgtcactctctgatttgtcacctggagaacacagcgcagacatgtttggctgctttaatatttctctataaatcaatcctctttccccttaatcatgtgggttgttcttctctgaacttgctccaatttgtctacatcttgctgggactgagttgtctaaaagtgaacacacccttcaaatgcgggaactctccctgcagcccctggcagctcctggcgactcacttcaccgcccggagaattccgtgcagggctccagcggtgagcagagttggaaacggcccatccccagtttccaaagaggccgtgtctttctgttcctgagcgggcccgtttgttatttttagtgtctgattgtcaggctgcggcattagaaagtctgtggtcgcattacatattccagaaagtcacattgctggtgatgtgcggctgtatcgatggatgagtaattgctcgctgtcaggcccacccggtgaagctgtgtcctcccaagttgtgaaagggggatagtgcgagagccgcacctgccgcggccccacctgtctgcgcttggccgatgccagcacctgcagcctttcgtaccagcgccctctgctggtcggacgccccacttctgggcgctcagggagcagaaggggcctggcctcacccgacagccccctggctctaggcaagtgagatattattattcccattttaaagaccagataactgagccccaaagaagcgaatatgtggctcacaagcagaaagggataacagatggaagaacaacaataatcagaacagcaacgccagtgaaccgttgcacatcacttaatttgccaggggctgcaaacccacagacaaataatggcagaaagtgcagagagccaggcgcaatataaggagtggatggggaccatggcagatccctggtgctcagtctagaggaggcaaaagcggtaaagctctgccacgcaaccacacagggccagtaacgtcagaacttctcagaaggcatctatccttaagtgtgaaatttctctgattttgaaacaattcatgggccaaacaaaatatggctaagggctacatttgatccactgcccctgcttgtaacccctggtttacacagagttatctgacttactatctcatttaagtttcacataatcctgtgatatcattactggttttatcctcacctttgcaaacaaaaaaactaaggttgaaggaagttatgcaaatctaatttatgttagaaaggagagtcagacctaggctttcacatcccaaagcatagattctcctccctgaacaatacagacaagtattttactttgggagaaaggagactggctagcccaacaccctcctttttaagagtgagaaagccgaggctcctttgaaggagccgcaaatggcaggctgcactttacaaacagtctcaagtctggttctttcaagtcatgatgttgtcctttattctgcactaaatttgttttctaaagactacgcctataggctgagggcctctcacctgtgattagaacatttgctttgagtagctttcaaggaacagagctgtgtgtgtgctgcaccaaccacatggtctcagctggcacctattataattcaaattgagagatgggaaacattgagatgcattaagcaagatcaaactttacaacagttggcacaggggcaaatgaattcggcttgccgacttatttgttcggcccacacaaaccactaaataaatagataatcgtaataataatgtacacagcattgccaaaatttgtcaatcaggtgatttcgcataaaaattcaatttctcatattcttttgcaaaatccaaacatctaccgcattggttctatattcgcagatgacgagattagctggagctatgttgttgccacctctttccagcagggcattcactcagcaactctccccaatacctacctctttctattgtctccctgaggccaaacatcactagccatttatcattgtgtttgggtctttcttttcataaagaaaatgagttgtctcctatagtaatgtctctcaaaagtgagaaaacagactgagaattcgagaaaaataagagagagcatctttctttacagtgatgaagatattctaaaatattcatatttattgaacaatttagtgttactttccttgtctctggtcagcacctgagttttctacaccattttggagactttctaatacagtctagtatctgttagtctagtaatatgaactacctaatacagacttaatcagtgcagtttaatgaatcagctgattcaaaacaagattgggcaaaatgagaaccacagcttgctaagcccccagctgcactgtgggtagccatttccaacaagaaaacagttaggtaaaagaagcttttactgtgtctcccccttggaggccttttctcagtatttccatagaaagccaatttctcatttctccattggcccaagactttcaggtaaacacagagtctattgaaatgctgtgaattcccccataaaagctgatgtcctcatccatccatttctatggcccacccctggctttttaaacacgagaacaatcttaagcagtttagccaacaacaagaaataaaatttgtgaggcttaacatctccaaacaaaaagcaagtggcagtgttgcttttttcttctgcagttataaaagactgaaaatggaatattcatccctgtttctgcatcattttgtattaaatttgtaactactgcatagttagcactataactttctattggtatgattgagataattattgttattcatcttttaattgataaagctttggagatgttatgggctagcaatttgtgactgttacctttatttgaagagactaaaatcccagaagttgaaattatctgttccttgggtcacaaactccctcaaggacttctccagacaggtaatttgtgtgggcaaagtaaccttataaagagctccagcgatcaaagaagttacctatactcagccacagccaattatatacatggaagaatgcattccagtattactagatcctcaaatttttcaagaaaagccaataatctgattggtgacaccttttgatttcccaatgtcaataactaattcctattttgtttttaaatattctgagtcaaactaaatatgtatgtggatccacatttggttcaaatttaccagttagacacctctaatatagtgttgactcctcgattttgcaaaaggaaactggagatctgtcaagggatactcgaaaaacagagacagagagctagcattcacatccacaccattgaacaagctaaggtgaagcctgactgtgagataagacaagaaaaccactttcctctgaaatgaagaacaatgagggctctcagatttttccttaccatgacccttcattctcagtggaaaccccttcttaacctcattatcaaaataacgcatttagctaacttgccatgaaggaacagattttaaactttcatttttcttggaggaaagtctttggggtaattggagcaaaaagctactaagagtcagtgaatatttcagaatgaaaaaatgaagaaggagctaagtcacatacatacacacgttcatacacacacacttgtctaaaggtggggctttaagagtttgagcactgacttgggaagaattagcctcacatctattgaaagctccctgttgatgagaaaattcctctacagggttactgattaagggccagtttttttgtttgtttgtgttttttgtttttctcccatgtcagggttagctcatgggccaacctatttttatggacacaattttattgggacacagctgtgcccctttattgatgcattgtctatggctggtatcacgctaagacagcacagctgagtcgttgtaccagatgccgtatgtaccacaaagcctcaaatgtctactatgtggtccttcacagaaaaagcttgctgactgctcccggatgtgaggggccggtcatgcatcctgtggcaccttgtagggtattttgtgaatgaaggactaagaaaatgataatgggtaccaggaatcaaaaactcaaatgattatagaaagaagaaaaattaaacacagcaggccatgagaaaactgttgtgaactggagtgcttgttctgcatctcaaggtgacagcatctgctaagctcagagattgccatctggcaggaatgtagacccagtattcccaaaccttctgattcatgaatgatatggtttggctgtgtccccacccaatctcatcttgaatttcccataattcccacgtgttgtgggagggacccagtaggagataactgaatcataggggtggtttcccccattctgttctcgtggtagtgaataagtctcatgagatctgacggttttatatggggaaaccccttttgcttggctcttattctcaccttgccagcctccatgtaagacatccctttgctcttcctttgtcttctgccatgattgtgaggccccccccgccatgtagaactgtgagtccattaaacctccttcctttataaattacccagtctcaggtatgtctttatcagcagcatgagaatgagctaatacaatgagcactcatcaatctggattttcatgtgaaatctcaattttttaagtgttggtaactacatttaaaaataaatactgtgggtatctataggggccacctatttttgttatcttctgggtcagcagggaatgtccttatctttcttgtttctgatcaggctacaggaaaatggattgctagagaacagaggttttgtgacggagtggtataagaagaaatctgatggccaagggcttgttactgggtctgtttcaaatgccagcaccttctgtgtctgccttcagacaacaccaaacacctaaatcatcttggtaaacacagatagaaagagacagaaaggttaaaagtatactcataatcacttgctttttttcccctcctaaacgtgtttgagagcaatattgtttcgtaaaaacaaaatgaccccatttctaaagcaatattcatgctaagctactcagctgttaagtataaccagcagtttgcattatgatgaagctaagccagaatttcaattattttctggacacatttaaaattataatactttactgggttagtgttatagttcattcaaattactcacaaactatcatatcaatctcttgcaactgctaatgccttacagatgcgtgaagttaggcgaaataagaaactgaccagggtaatgactttcatactggcattgtattttaagggatacatgtccctaagtatttggatggctaatggtcaaaagctagctcttacttcttataatatttaggctaaaagatataaaaagaggatagagaccattctttttcctatttccaggaaaacatctgggtctgtacaaaaattcccagcagtccactctacccctcctccccacaaattttacctcttctgacaaatgactttagaattctgtctccaagtacccaagggtggcattgctttattttctccctctgggacactgttgccaccaacccttgaaatcttcaacattcttgcctctctacagacactcagctttcagtggtgtacctcaatgcagaccagcagtgagagcaaaattcatcaagtgcaggtccagttaatcgacaaagatttatgaatgtcaccaccagcaggtgcttaaaatgtggatcttcctgaagaaggcgtgccactctaagcctctcctaatcaatgggagcctttcatgcccttcgcaaagtctggaataccatgtgcaaaaatgcgttcaggttaatttatgactgcctctccaaaggttctgtcacttggccctgtgttctgagggacacggtgtcacttaaaaagcaggaaccatgggaacaagctgttttggacttgctctgaatgctaactgctaatgcagtgaagttagccaaatgcccagaatcagcaagggggcttggacagctaatatgaggcttagccacatgcaagcttacagacccaggtgggatccaatcaaataaatacattagaagcctatttaaaacactttttactattcagattgtctttgcattgacaaagaaactacagcaaaacaagaaatgtatcctttttttagtgtcttacccttcatatctagagttgcattgtccagaaaaaaagctacttggcacctgtggccatttatatgtcgatttgaatcaattaaaatgaaagaaaatgaaaaattcctttcttcattcgaacaagccaccttttaagtgttcagtatctacaggaggctggtggctatggacagcttgggtgtctaatatgtctatcatctagaaagttctgttgagaagtgctgacctagagatttttttttttggtcaaaagcatctttgtggctatattatctgtctgcttgtctatcaggttttattaccacctatggcaggatttcccaagtatgatataggcaccactcaagttaattttaacatgaatttttttaacttctaaaacgtatatagttatttcagggtgaattttaaaatatatgacaagaattatgccaagctttttaaaaagccagactcaaaaggttacttgctcaaaaactgacccactccatttatttatttatttgagacggggtcttgctctgtcacccaggctggaatgcagtggcatgatcatggctctctgtagcctagagctcctcggatcaagtgatcctcccacttctgcctcccagatagctgggactacagatatgtgccaccacttcaggctattttttaaaatttctttttgtagagacaggatcttgctatgttgcccaggctggtctcaaactcctgagccgaagtgatcctcctacctcggccttccaaagtgccgggattacagacatgagccactgcgcccagccccactccatttctatcacattcttgtaatgaccaaattatggagatgagaaaaggattgttacctaagggaaagaaagggggaggtagctgtggccataaagagtagtacaaggagtccttgtgatataactcatctgtggcattttggctgtggtggagagctcatgaatctacacatgtgaaaaaaatgttacaggactaaacacacacacacacacacacacacacacacacacccctaagtttaggtaaaactggtgaaacctgagtaggtcagtggatcatatcaacatctacttcttggggtgatattgcactttgattatgcaagatgttatcattgagggaaaacaggggaaggatatggaggatttctgtgtattatttcttatagctgcgtatgaatctacaatgatctcagaagaaaaagttgaaaaatacatatgaaaggtacatcaaacccaaaatgttttgagtataatgtctaggacaaagctaaagaaacaaatgtcattacaatctattattcaaggaaaaacattagccagcaaagaacagtaaaggggatatgcatgtgaaaataatgtatggagatgttacatgagagactgtttgagcaataaagtgtgaaaggctctgacattgtgattaggaaaacaagttggaatgaaacaaagctaggacccaatgacactaactatctgggtggttttgggcaaattactaaacttctctgttcctccattttcccatctacacaatgagaataagaacagaactgttctcatgatgttgttgtgaagctatgatgggagaataactgtgaaatgttagtgcattctccagttcctactaagaacttaagaaatgaggctgggtgcggtgactcatgcctgtaatcccagcactttgggaggctgaggcggatgaatcacctgaggtcaggagttcaagaccaacctggacaacatggtgaaaccccgtctctactaaaaatacaaaaattagctgggtgcggtggtggacacctgtaatcccagctactcaggaggctgaggcaggagaattgcttgaacttgggaggtggaggttgcagtgagaggagatcatgccacagcactccagcctgggtgacagagcaagactccatctcaaaaaaaaaaaaaaaaaaaaagaacttaataaatggttgttatcattgggttatgtgtaccctgtcccacaagaactggagatgattaattattcctgtaattgcttaaatcagagtcatcaaactttttctgtaaaaggcccaagagtaaatatttttgtctttgcaagcagtatggtttctgttgcaactgctccactctgcccttgtagcacaaaagcagccctaagtaaatgaatcagtatggcgatgttccaataagattttattagtgaaaacaggcagtgggtcagatttggcctgtgggccataggtggccaatcccaggcttaaaccatctcctgttattgacttcttaagggaaagagactattgaaggcagacccactcttctttctcttcccactcacctcctcccatacttacagaccattccattaggaagccaaccagaggttaagtcaaaatatgcctgctaattgtgtacttctattgacgagagcccatcatgggtcccctgggtcttgtacatagtaggctttcaataactattgagtgattgattgattgacccattaacggagagagctggattctgacgaaggttaacggagattggaaggccagagcttcccaggtgacttcgccctcagtgctggaagaagggaatgttcgtattgatgcaggcttcgcattgatttaacactgcagggtctgcaaagcattttattaggtatcatgtcatttaatcattcaaatcttcgcaactccgctatggcaactattggtagttttgttttacagccgaagaaactggtactcagaaaaaccaagcagttttcctaaaatcacaccgcttgttcattggcagaactgaggcttcaacccagttatctcaattccaaaagcaagtctctttccatgatgtccggagctctgctaaagaaatttctgacaaatgaaaagtggcctggttgctcctccaatattattacagctctaaattgtaacagggaaagagggaatcggtttaaatatactcaactttaagttatttggaaaataagtgaaaaattctactatggatgtatttatgtataattccacatttatcaaaggtttttgtaatgctataaagttatataataaggaatatatgtgacataaagaataaatatacatgtatatgataaagtatgtatacatagacattatcatgaaaaggatgaaaaccataagtttaaagaagatggctcacagactaaatttaacacacacacacacacacacacacacacacacacacacacatgcacacaaacacaatgctaactcagctactaataaacccagtggccatgggagctttggggacaggcctaggatttgggtctcagccttgccgtattctgtcagtaaccttgggcagtgtcccttcatctgtaaaaaagacacaacaaaaatatttcccctgcacagttgttataaaggtaaaatgaaatattgtatgcaaagcacctcttacctgctctgtgctcagtaaatagcagctgttattgtcatgaagtgtgtgggtcggtgtgtgtatgtgtgtgtgtgtgtgtatgtgtaactctctctcttaattagaatagtctgtggccagtaaccgtgtcaaatccttattctccaaaggacttagcattgtgagtttcacttagaagctctttaatagatgtgtgtgaaaccagggaatgatttggaagttaggataccatattaacaagggtattattattatcctaataaagctcaggtgttcaaatggtgtatttagaacaggatttctaaggctcggccatattaccatttgggataattatttaccgggtaccgtcctgtgttatcagtgtttagtggcctcctcagcctctacccactagatgccagtagcacccccattcctacctcatccagttggagacaaaaatgactccagatattgtgccctgggaggcaaaatccccccgttgagatctagatccagcggtgtctgaaaagtcctccttatgtgaaatttcaataaatagtagggttgttgttcggggaactgaaactccaagggttagaaaagtcaggtgagtttttgtggtcacggaagtatcagtttagaaaatgcaatttgctttcatatgcagaattttttacttcaacaaaggactttagggaagaaaatgctgatctcacaccggcttattgaatagcattttgcaaactccaggcctatttctgtaaaccttccaaaagagaaagccagcctctcggtgtcctgagcctcactagatgataatatatgtatgagatccggagaaacccatgcattcctaggaaatacttcaaagttattttttaacatcaaaacaaacaagggtcagtgggtctcccgtgcagcctctgtctatttataattatattttgtataaacatatttggtgactgtggaaaagacttcatgggcacacaatggcaagcgttcttcaaaactgtctttaattattcatttggctgtgctatattttatgtttcttttcataaatgttaatctttattattgccttagtaagtggggaggaaaacacacacacacacacacacacacacacacacacacagagtaatacctgttattaaatgacctatcagagtgacatggataaatgttgggagtgatttaattgtttcttatctgcagttttatacagtttctatcaaactgaagggtaattttttttagtagctgcttattttaaatgtacaaaacccttgtgtgtaattccattagctgccctacagcattgcaatctacagtttccctgaggctgttgtgaaatattgatgaaatccttgctttcgtggcttgctctgatacactaaacatttgtctgatgttagttgaacttgaatggatctgttcagagctatatcagtactgacttcaaagggagtgaggctgttacagtattttttcctcatttttctttctttcgttcttccttttttctctcctttttcttatttttaacgaactgaagtttcaaagttttaccacggtatactttataaaaacaaagtttatatcaaatgggcccaagtacgtagcaaactgctgatctttataatttcaaatggtgtttttttttttttttttttgattctggtttgttgctggtatcatttaagatattttgatacagaggtggatgctggcccccaaaacacacacacacacacacacacacacacacacacacacactcacagagacagaatgggagaaggatgtgaaacagaaaccctggttttgtgaagttagcctcaggactctgtgcctctggaagtcgaccacataggactctccctttcaacgttgatgaaaaggcaccatgaatgagaaaactcatctccaactgactttttccagctaaagttgtttgaatggaacttcacaactttcaggactagagctcacagttattcctgtgttttctgctcaggttgtgaattataactgctgagagttactaatttgtaaaaagcgatataacagtcttttaggagcttataagcagtaaaatagcttccaaagcagggtttctcaaccttggcgctattgagattcggggtccggtaattctctgttttggggctgtcctgggcattttgggaggcttagcagcacccctggcctctgcccattggatgccagtggcaccacctcccgagttgagacaaccaaaattgtcctctgcccattggatgccagtggcaccacctcccgagttgagacaaccaaaattgtcctctgcccattggatgccagtggcaccacctcccgagttgagacaaccaaaattgtcctctgcccattggatgccagtggcaccacctcccgagttgagacaaccaaaattgtctccagactttgtcacatgtccagttggggggaaaaatgccccccaactcctcctggttgagaatccgtgcccgaaagacacagcttccctccactgtaatagaagggtccctttatgtctcaacaggcgggatgaccttgcaaaattctccagatgagtgtctcacacgatcattcttcagatcagttttctagaatgattttgacccatactcgggagtcaacacactctttgcacctttgctttttagagttctctggaaacaggaatcagaacaggagcattttgtcttcactgaaacctctagaaacgggctgaaggggcttgaccctgagctggatggcattagtttgggaagcatcgattggctatgaaagctcagtaaattgtaatgaatgagccccaaagtgacttccatcaattttttcttccaatagccccaccccctagaggagcagctaacccagtacgtcacctttgccctgggtcagtacgtcacctttgccctgggtcacttagtacaacttttccaacagatcctccagcaatgccaccttgccattggcttcacgctcacagagagcaaaagcagccatgttttatatcaacaattggccctctgtcataactgtttcaaagacaggtgatttactgtatgcctattaaattgtgtgatcgtatttaattaatatcagccttgcctgcaaagttctaatcgtcatgagcctagaacacctatgtctccttgcagtggtgtctctgttgcccatcccagtacacacggtaggggctcagcttttcgaactaaatagttcattaattaagggtttagaagcctcttcaccctcattcccctcagctcccttcctctttgggagcagcactctcttctctgcctttcaacctggcaattgggagagaaaagaaagaagtgtggctgacagaatcgaaagaaaggagggggaaaggagggagagagggaggagggagggagggaggaaggaaggaaggaaaaaaagagggaggaagagaaagaaaagaaaaaaagaagaaatggaaagaaaagagggaggaagaaaggaaggaaaagagagagggaggggaaaaaaagagaaagaagaaggaagagaaagaaaagagaggaaggaagaaagagaaagaagaaggaagagaaagaaaagaaagaggaaggaagacagaaagagaggaagggaaaaaagagaaggaaggaaggaaagaaggaagggagggagggaggggagggggaggaggagagatagactgtagtctttcctgttctgtcctcccacctgttctagtatgaaccctcaaagaatggacattgttcactcatttgcttttttcatatatttatttattgatgatatctctctatactgtgctaaaagtagacacaggcaaatcccacattcaaaacaaccataatagaaataaatgaacagaatagaaagttcagaattatgattggatcatttcccctgaagtagattacataatttattatttgagggatactggctttatttcttctccttttccctctctccttccttctcctttccctcaaataaccattcacatcaacaaagcagccaccaggtggtggctgtgtctatctggcacacagacatcaactggaaggacactccctcttctttgtggcacagagaacacaaatgtcatgccacatgcacagagaagccaagagaatggagtcacggtgccccgttttctgtaagcaagaagggagaaaccaatgttggctaaatcaaaaagagtcaaatcattgccgggcatggtggctcacgcctgtaatcccagcactttgggaggctgaggcaggtggatcatgaggtcaggagtttgagaccagcctggtcaacatagtgaaccctcgtctttactaaaaatacaaaaaattagctgggcgtggtggtggccacttgtaatcccagctactcaggaggctgaggcaggagaatcgcttgaacctgggaagcagaggttgcagtgagccgagatcacaccactgcactccagcccaggtgagactccatctcaaaaaaaaaagaaaaaagaaaaaatattttcaagttcctaaaaacagccctgaagattaaaattaaattagccatagggatgcaaagtaaaagaggtttgaaaagtcctcaacttaatgtctccttcaagtgtggagaggctggactttctgtctgctttgctttcttgagggaaggagggtatttgtcaaagcagcagcaacttcactttgtctccactgtcagtgtatctggagttgaagaagcttattttctgcaaatgccttcagccctagacatgtctgcagtctatttatgtttggctaaaacaagcggaataaacagttgagaggatatcattcatattgtgacgggagacagaatatagggcattcttgacatcctgcatatacaaatcattgaatgtctttctaactagctgcacttgtaaatcaacccatgcgccccttcagaaagaatctactgtaaagtgacttgacttcaactggcaatagatgaattggaatattgaagagctgtttctcttaggttatctacaaagtcaacattagttcattgatgtggccacactgagaaatggccctggaagccactgaacccaagccatgaaaaggatttaaacactgggtggatgtccaggagagttgctggaggggagaagaggtcatcaatgggtagttgtggtctcagcaatgatcttgacactggtccttagtcattcaacatatatacacatatttactgagcatttactacgtgcctggaagtgcctggaagtctttttttttggtctttaagaaatcacccaacccacaaggaaaggagactcacagatagcatctttcctcaacctctacgggaacacacactcacacactatttgttgctcacctgtcgctaagacatgaaaagccttacactctgaaagccctgttgaatgttcctgagtttttaactcatttgcagtgaatccttgagagttggtactacaggccatacaaaacaatatttttttttctagaggagggtcttgctctgttgcccaggctggagtgcagtggcaccatcatagttcattgcagcctcaaactcctgggctcaagccatcctcccaccttagcctcccaaacagctgagactacgggcgcctgctaccacacctggctaatttatttttttatttttttgtagagatgggatcttgtttttttgcctaggctggtctcaaattcctggcctcaagcaatcctcctgcctcatcctcccaaagtgttggtattacaggcatgagccactgcacctggccaaaacaataattattgagcccacactgatactgaacaatgtctctatctctttataaaacaaacagagcattggaattctccatctacagtcttcctcactggatcctcatctaattcacacgtttatttttgcatttaatcatctaattttccttgagcctaccatcttgcaggctctgaggaaacagaaggacccagactgataagactgagctccaaggagtttaccattgggagggagacagaataataattgcaacatggatcacatttctgatcgaggctgattttactcaaacaaaacattcctctattagacatttctgcagaaacttagatgtgttgcaaggaaacccaaatcattaagtaagaacgttacagttgtgttaaatattgaattagccaggtcctcttcataatcataataatcatcatacacaatgctggaaggatggctggagcccaggagttagaggctgcaattagttactatggcaccactgcactccagcctgggcaacagagcgagaccccccctctagaaaaaaagaaaattattattgttctgtatggtctgttgtattgagcactttctctgtgccaagcaccgtgtgaagcacttttacctttttcatccattcaacaattactgtattttatctaagctaagaggccattcagcaagctgcactacttctagtttgcaccactgagaaaaaaaaatgcttataattaagccatgacacactgctctcctgctatcacttagaatttctattttatacttactgaaagactcttttagacttctttttaaaaaagatctttataatgtaacactcttgtgtttatataaaaagaaaaagataagcaaaataaattggttaaggcattcctgaaatagcttccaactgccccctggcagccattttaagataccattgattgtaagattcaccctaattcccaagatgttaaaatgtggaaggaagatcttggaatcaatgaaatgctatttgaaaagtgaatgctatgctgcaggctctgacaaaatgcagaagatactgcaatgcacaaggcacaaagtccctgccctcatggagtgtaaatggcagagtcaagaatttaacaattacacaaataattgtttaattgtaattttgatgggagcaatcgagaaaaatcccatgagactatgtaagaagagatcctgtctaataggggacagaaaagatcttctaagggtgagacctttacgctaaaactgggaagttgagcaggaggcagaaaaagaattaaaagaaagaagagaactgtagcattttctcatacatgtcctcagtggccatacagatttagtattataattatccttgctttacagatgaggaaactgagacttggagagtagaagtaacttgcctaagaacacatagctagcaagtgatagagctgggattttcctcatctcaaacaataaattatctgcttgttcaaatgggcagactcagttcttgctgcattagagacagagggagaaggaggaagaacttggagactctgtagtataaattcagacattattaaatagtttcagtactaacaaaaaaagaagagtatatgtcagactccctatatcctggaaccaaggattccagcctcataggaccagagacatggaagggtgcaataaaataacatgctttggattttcttccaagcaattaaaaactttttaaatgtctggcttaagtaactttaggaagcatattcaatagccctgatgtgtatcacttatagcccaggccctgcatggttgtggacacaacccggctgaaagcatgggcccagtaagtatttttctgattaagaagcatctctgcctttactgcaagtatttctgtatttctacccttaaattgacttctagatatagaaccagatgggttttgagaaaggctatcatactgagcaaatgttggaagtctgggaagcaagactagtccctgggacctatgttttattggaaaatagaaggtaggtgcaaacccacagccaacccagaaaaattctggtgagtgggtaagttttgctctcctttgggagttgaaaatgtcaaagattcatgaaattttcattgagtcattcaacaaatacttttttgagaacttaccaagcaccatgcacaggtgcctccatacagcatcaagccaaagagacaaagataccggttcttacaaagcttacaaactaacaaagaaagatcacaattaacaatagaaataataaagaagtaaattctgtagtaagctacaagttggtaagtatgaaggcaaaagaaaaatagaacagaagaagggaattgggagttctgaaagaatggggagactggttgcaacgttaaatagggtgactggagtaaagtgccatcaggaaatgatatttaggcaaagatttgaaggaagttaggaaaagtgcagagacagcagccagcgcaaaggcctaagatgggaatgttcctggcttatgggaaatagcaaagaggtcagtatggctggagcagaaaatccaggaagagggaaatagaagaaagcgttggagaccaagtggagagctaacatacatagaaatctgagggccatggtgagaacattgactttttctttgagtgggaagaatgtcccttgggaggttttgagcagggaagtgacaggatctgatgtatctttcattctgactgctaggagtgttaagcattgacagtaagccacaaggatgggatcaattcatggaggagtcaaggtggcatgagaggtgcccagttgagaccattgttcactttcagtcccctaggagcgcacctcgtcacttaatgtctcattgcagaaagttgaggtggaagatgcttgggtcttgggtctctgagcttggttttgttgggcggggcgggggggggggaatgggggagggcgtgtttgtttgtttgtttgtttttgagccaaagtctcactctgtcacccaggctggagtacagtgtcatgatcttggctcactgcaacctctgcctcttgggttcaagtgatcctcccacctcagcctcccaagtagctgggattacaggcgtggaccaccatacccagccaatttttttgtatttttagtagagacggggtttcaccatgttggccatgctggtctcaaactcctgacctcatgtgatccacccacctcagcctcccaaagtgctgggattacaggtgcgagccaccacccctggccaggacttgagttcatatcctgcttctgccagtgtgtaccagaaagccactttcatctcttctgctagcccgaaatccctcacataaatgtaaaaatatctacctcacaggattatttccaaaataaaatgtatattgcatactgtaccaggcacacagtaggtacttgaagaaataaaagggaagctctctctttatatatccccaataatgagagagattttatgagatgcaaattctgtcgcctggaagctatttagatttacaatctttattttaagttggtttgcctgagtaattaattcaaagttaagattttattggtgaggtgcccaggattttagcaattgagttagttgaacatgaaaggtctttaagaatgaaagataaaataaagtctgttccattgtagctcatcttcctgtgaagcagattagttcactcctgattggtaaataggttaatgatatgaatataatgagaacgtcacattgatgcacatgtaattttttccaacacgttattgtttagcaccactgagtaacagcagccaaatgcaaagttcaccaacacagctgaatccagcaaagaaagcagtcaattcataaaagtcaatcctcttagctcaggttaaccatgtaaatctgcctcagaagcctgactgtcacctctccctgatttttaaaaatttgacctgcctgtaacttcacaatctcactacctctttaaactcctttctatctaactaccatcacttctttatttacaaaggttaagtcttttatttgctctggcattcctttacttattatgaattgaacaagtgtatctaacccaaccagtaggtttattatgtttgttattgtttgcttactctctggatgctaagttgcttactttctaagtggtctatcctaaccttatttttcccataagtgctataattttaactgcaaagctgtgcaaaatgcaagatttgtctaggaacacacattgcattatagcagaaacacacgtgcctccactatacacattggtaatggcagggcatcatggaaaactgacatgccacaagtaagctagtacacagctgtgagagggcactgggtctggggtctaatgaactcacttcaaagctagattcaatcagtttctgggcatgtgactgtattagttcattctcacgctgctctaaagaactgcctgagactgggttatttataaaggaaagaggtttaattgactcacagttctgcattacttgagaagcctcaggaaacttacaatcatgacggaaggcaaaggagaagcaaacatgtccttcttcacatggcagcaggagagagaagtacagtatgaagtggggaaaagccccttataaaaccatcagatctcatgagaattcactcactattataagaacagcacaggggaactgcccccataatctaatcaattcctcccacaaggtcccacccctaacacgtagggcttacaattcaagatgaggtttgcatggggacacagagccagaccacatcagtgatctcaggaaagttgtttgacttctggaagcctaagattcctcatcttcaaaaatgaaactgataatatcacctccaccatgggagtgttgtgagactgatctaaaacaactcacatgagatccttactaagtgatagctattaggatattgtagatatagaagtcatttggaagcaaacagggttcttatgaagtgctgtagaataggttgtcttcacagcagaataaggtcagatggaggtctcaaaatcaatgcctctaattgacttaaacagaacagttttttgtgtgtgtttggagcccagcttagctctctgaatcacacacaactgagtgatggtagaaaccttcaaaccaaagaaaggagaatattattctctggtctttcactccctacaattgcacaactggttcaagcccagtttatttgtgcaagatgatattgaccatacatatatgccctgctctgtctctctctttctctgtgtgagtgtgtgtgtgtgtgtgtgtgtgcgcgtgcatctgaatttctttcttctacatacgaaaaatatagacaaaaaaagataatgctcccatgactggaaaaagatgagatcatttgtaagtggcttgttaaagtgcacatcattttcctgatcagcggtagcgaggctgcatctttaggagctgatgtgatttatcatgttattatatatttagagacattttgaaaatgctgctatttactcaaccgactgtgtatatggacgatttaaagcagatttttgacccagtagactgtaccagctctatctatcgtctcaatgagcatgtggggactcttaaatatgcagattattgacacaatagactacgagcactgcaaccgtactcgagacgggtacagtcaagtcattgggggatgatatgtttccagaaagcatttttaaggcaaatccacatatatagacttgctctatgaaaaaatatacatctggatagaggggactctggctttggaagggaatatttgctatctagaaatagggtattcttactaacatgcctttgtgttctgcccttttgtctatgaacatctaaataataatacctaccctctacttaatcccaagcaatgtaccaatggtttgagcttagtttactcaaacatgccaagaaaccattccgtttgggttagtataaatgcattctttgattcaaagtatgtattgagcaccatctatcgaacagtggggtctttgattgcaagcgataaatattatctttggcaaacaagtaaaaacaaggaatttgttgggaggaacatagtgtagttcaccaaaaggggaggaactagtatgtctgtgaggaccaagggggcagaatcaaaagacaatctctctatcatagaattgtgaaatggacctactccagcccatttccacctttgagtcataggttcagaattcacattccatggagcaagagtttggttggccaagctggtgttctgtgccatagtaaagcaaaaacaaaacaaaacaccaaaatgggaaagaagagagaaagttgtcatatgttcatttcacctccctgctccttaaacaaatgatcagatatttaaacacacagacataaacacacacaatgcacacacaggatgtctatattgtttttgctggaaaacagtccagatgcactggggtaccatgaaattaaactcccagagggccagaatctctgttctgttgtctcctttccaatgtgtctgtaagggagcagttttatacagcctggaccttatgatgctataagtcagtcccaagtcaatcttatatctaaaaaaaaaaaaaaaaaaaaaaaaagagctacgctacctactttaacatcaagggggaagggagggtgatgggtgatttcaattgttaattcatccaaactgcaaaattagaagtgcagagcactcccgccaagatggccaacagtaggaaatggatggtggttagacgtaaacaggaaagagttccctcaagacctgggcttgccactagggataaagcaatgaaccagacagataagtctctgtatttgttgcatgaaactgtcctgtgcattgtaggatgtttagcagcatcctgggtctctacccactagatgccagtagcaccttgtctcccagttgtgacaatcaaatgtctccagacattaacgaatgtccccaggagcaaaatcaccccagatgagtcattaagggtgtgttggacattaccaagtgtgtctctaatttagtgtcctctcaggaagctgggaccctctgggggtaaacatcatctctgttgtcctatttaagtaggattctggagttctggctatgtgcaagatcttatgtagtcacaggatacaaagcaagcaaggagaaagaagaacatttatagagtctttactgtatgctcaaaaactcctggtgctgggcatataaagataaacactcatagcccccttgttcttaaagagcttaccacctgggaggggaggtcaagaatcacagtttgatttgtccagcagtagagaagaccttggggaggagatgccatttgaagtggccttggaatttgaaatcgcaatggataaataacaatggatttggtgcttaactgcgagcagcaatcccaaattttacagtatcaaccagatcttcatgaaaaattaatggacagaatagcaaaaaattacctcatattttatcaaacaaaaaattataatattttgctatcataattgttagggactgaagaatatatacaccaaggaacgaaacaatgtgtaacatgaaaaatatcagggcacagcaaggctaatttgtacacatttataaaaatgtatctaatttgtaaagtaacggctatacaaaactataaaatgtgcgcatacaaattagatatattatgaagctctcagttgcaaggaactatgttaagcagtaaagggtattatttgttcatgaaatttcaaagtacaaagacaaaatcttcaggtagagtttgatcaaggttgaaattttcttggctccgtgatgtcatatatgttggcttggttctccagccaccattcctcatactagcaaagctcctaaaagtttatgagattatatgttcttatatgaaaataggaaaaacaaatggtaaaaacccttactttcttaaccatcaaatcaaactgagaatgccaatcaccaattggcttagatccagcctgaataacctaaataggatgctacggcaaggtgattaggtttgatgattcagcgcccacacatagacctgggatgggaccaacctcagccacacttattgggaagcaaccatagtgtctcctatgatgtaccctagaacactagtgatctcttcagcattgctcaagaattagcacatttcatttttaaatgcttataagtaactaccaatgtcctctttgaatctccatttttaggtacaactgcaaattccctttgtacctcctaagggtcactcaaaggtgttagaagctgcatataaggagatgcttttccaggaactcagcccatgcctaataatcctcctccaggtcagaaagaaagatctgggttttgtttttggtaatttctccaagaaaagaaaaactatcatttactcccagaagcaaataaaacaataaactcgactgtgcattaaaatagatagatagatgatagatagatagatagatagatagatagatagatagatagatagatagatatggttttttaggggagtttgacttctataagtgtggtctgagaactggctgaaaactaacatcagaataattaaaaagcaagggaaaataacccccaaaaggagaatgaaacagagacaaaaagccagaaagaatatcaagaacaagacaatggctgtcttaggaaccatttattggtgttcaccactggagaatattaaatcaccagatagtgctgtcttccccaactttcctgtcctgggacaacagccaatttggtactattaggaggatgctgataaagtgacctaaagcctcttcctatttacccattttctctataggtagggacaaagaaaagatgacagctcttggaaatatcattcttaaactagccctaacctaagtcgaagggtcaaaaaaccctggagagttttccattagattctccaaactgtccattcaaaaatatcgaagacctatatattgaaaacctatgtatctcccagaattttggtcttttccaagtactgcttcatgtaactatgtgttgtgggtttggcccagctcagactcgctgttccatataatttggctcatttaaaagctaacctagttaattaagaactgaaataggtcaggatttatttggtggagttactggagtagtttagaaatgctaatcccttttatcattaacttttttattcgtttgtttcttgtaatataaaaatactcaatctgataaggggatttaaatgaatccagaatgaattgattgagaataatgttaggagcctgatgaacatttttttcagccaaaacttgaaaaagtatatacaaaaaatcctgagaaatccagctccataacatgattcttcatgactaggtttttgttcttgtgatggtaatgagaggagacatactgagtgctgatttttaccaggcattctgacttctttccagttatctcacttaattttcaaaatgatctttgaggcaggtactattattatctccaattgatagatggagagaccgagccccacacaagttgttagtttgctcaagatgataatgcaggacatggcagagatgagatttgaacccaggtgggcttgctgtagaccttgttctcttccatcctgtaacacctatgagggtggtacacacactttctcctctattaggctgatgcaaaagtaattgctgtttttgccattaaaagtaattacttttacttttgaaccactctcttttaataatagagtgttcttctctgtgcagacccttgcttcattgacaactagaaagagcatgaatgtcacacttacttgtcgtcaattcccaaagctttagctgactttgactttgcagcatttctaagctattgacatattgaggctgtataattctttgagtaaggaccgtcctgtgcattgtaggatgtttagctgcatccctggcctctacctgccagataccagcaacaccgcttctctaggtatagcaaccaaaaatgtcctcaaacgttgtcccatgtcccctggggaacaaaaaccacccccagaactactaagagtattatggtgacccagctgactcctggagtcccattttcttctctagaagaaaccagctgccaaaaataatgatctaattaactcattcaccctgaagtgcaaaggtgagataagagattaggtttttatatttttataggggatgagttcttggtccacctcatgtcagatgaacataagccaagttgtagggtttaaggcaagaagaagcagagagtaagaggtgtcacaattgcgggctcctgagttcacatcacacttgtacctgattcatctacttcccatagggagtaacccaccctgtgagtttaaacccatgtgcacacttcaaccatccaaagcaatattctgtttaaaagataccttgttgttgttctctatggcttgaaagcaaattgggaccagtgagtaaaatctaagttttgaacagaatctaagtgttggatagaaaagcatacttcactgatgcaatcattcattcacttatgggtccaatcattcatttatttattcatatatccaacaaacacttgaacaaggtgggctgggtatagcaatgggatacagtggtaaacaagatagatttgacctgccctctgggagcttacagtcttatctagaggacaatcaagtacatagtaagtacaattgcaaactgaaataaggtatacaaaagaaaaatgggggactgagatagaaaataactttggttgttggtaatttcggaggagtaagtgggggagggtacagtgatcagagatgacccatccgacgaaaggcattggagctgaaactaaaagaattagactaaaaggaaagacttagatatagggaaagggggaatcttttatacatagggaatggaatttcaagggccttaaagaaggaaagaatttgatgaatttagggaacaaggagaagaattttcgctttcaagtcctaaacaaaatgaacagtgatagggtagttctgagatggaaactgggcaggtcattgcactctatgagtcatcactgcatgcatgttcaagtatatgctgagcagtacctgacagaagtgttgatgaagagatgaaagcatatcataaaagcttaaactgaaagttctccccaatcctttgattcgatcaaattgtaccatgatggaaacacggctcaactcctaagtgtgaggaatggaaatggttcccattcagtgtggtcctcatagcaggctagtaacaatgactgtgctggtggagagtccaacatgaagaagagggttggaaagtcaagcatctgagccatttaaggataccaaggccaggaagccctttcctgaatgagaaattggcccaatgacatgaaaattctttccacttcgggcttctgtgattcttctagagacagcaaagacttttcaccagaaaactaaagtccagcctgctttctgatagtgccaatgtagcttttctgagagaacagtgggtttcttgcttgcttgcttgctttttttttttttctttctttctttcttcttaatgggtagtggtcacagccatgaacttagcaaaagaagcaagttaaaatttgtccattcttggctaatgcagttagacatttttgagaaaaggcaatgagaagtggtcattatccattatctgcatgaaatatttcagagaaagaagcagcatttgccaaaaaaaggaaaagatgtttgacttcaagccaggcaaaaaggaaacaagatcaccttctagctctgtgggatggctgtgctaatgatgttatttcaagtaaaattggaatatatatctgaaaaaatacagatggtgcagcagcttcatatactttctgaaggtcattttggacaatgattcactgtccctttacttgggaaaaaaaaaacctctccagtcttggaaggaactatatgtgtgtgagtgtgtttatatatccttatgcggaataaacgtatagaaaataagcatgcatgacttgctgaaaatatttgttaccacttgaaaagtcaacacctaaaaatcttaatttgataggagagtctcagttctattgtgtagtttctttgttcctgtttcgtttcactttgttttctcctctgttcctgatttgtgactctctgggtgtaaggataatgtaaggataatgatttctaaactggagctaccaaaaagcttataaagtggtccccttctcacccttctccatgaatattttctcactctgcttttttaaattgtcaccaagacacgtcgcaataataatatacgctggactgaaattccaggtagctgaatataaagcatttttcttggagaccttctgctttaaacatttgtcacctctctcagtgcaaagcccgaggcctctaacaaagaccttttttctcagatggtgggttgctttatttcttgaggattgcagacattaccattatggctaatgacctaataacttgctatttgatgtttgtacatcactttctacggaagttcccggcacacataccactggctccttgtacaagtgatttaatattaaataacaaaccccaaactggaggaagctcttttcttatgcattcttatggatgacacataaacaaagctggttcttatctattgtgaataccatctaaaagctgttggcttggaataagatttagggataacacagaatgccagactcaactgatttcagccatctgtgggttcaggttgaagatcagatgtacagtggttggaaagtgcctagaaccagcactgagaagttgggaggtaaccctgcattcttggtgtttcacatactttatcacatgctatactctaaagcatcttaagaagcagatactattattattcctattttatagatgaggaagctgtgcctttgaaagttttcagtaattttcccaagattgtcttgtccttcccaagacattacacagtacaccaaggtctgcctgatcctaaggctgaggggccatcttatctaccctgttaactgatcagttcttgaatcagcaatttatttctctcttggttggtgttttccagtataaactgggagcaaccatctaagccataggcatttagtctcttggtctctggagaggacaggggctgaaagtcctcaaagttgtatgatcttttcacaaagctggttcccacatacactggtgaacataggcatagagaagtagattgctaaatatctctctactaattaactgttttgcaatttacatccaaacttctcaaacttcctggcacataggaatcctctagagaccttgttaaatgatttctattctgtaggcttggggtggggctgagagcctgcatttctaacaagctcccaggtgatgccaacaccattcatcaaccctacttgaatagtatgggtttacaatacacttcctcttttgtcctgataggaccctttcagtcagtcaggcttgggatagtcactcctatttgaggttgacagatgaagaaataggtcaaagagctgataggagagagaaccagaaaagcacaccagattctctaacccctggttcctgcggttcagaggttgcaaatggttgggtctcagatgtatttagttttgtccacacagttgggcccaaacaaaatacctggcaatcccaaactccatgaaagtccttcagtagcagctgtgcttttctttctttctttctttctttttttttttttgtttgagacagagtcttgctatcttggacaggctggaatgcagtggcgtgatctcagctctctgcaacctccgcctcccatgttcaagtgattctcctgcctctcagcctcccaagtagctgagattacaggcatgcaccaccacacccagctaattttttgtatttttagtagagatgggttttcaccatgttggccaggctggtctcaaactcctgacctcatgtgatctgcccacttctgcctcccaaagtgctgggattacaggcgtgagccactgcacctggtgcactgtgcttttgatgtgccataaactttcctcttactcacagccctcggtgtcctccagacaagtgtccagtctagctgagtatacatgattacttaccttcacaactgagaacggattttcctccacctggcccgcttcgcccattttcattacctgccttccatcagtaatgtgtgaccttttcatgacctctctctccaaaacctcagcatccaacttctctccataactcacctctctacttgccttggccttggaagacccactgtgacgaaagtcctagtgaaactccactaaagtgtcttgcatgtggtaactgcagaataaatatttcttgattaaatgaataaacagatgaaccacaaagggatgacagaatatccacttctcctgacttaaactagcttagccgtttttttgctgatgaccaagatgtggagaaattcacaaaatgtgattagaaaacgttttacagtccaaagagctgtaacgatggcccaggaaagaagcaacaagcgtacattaagtgtttagacggaccccacctggtatgcaagcgcggtacatgtaaagcattccaattacccgaaccatcttcaggaaattgaaaaaaatagagagagattgttgttttgatgaccaccagaaacctccccatttatctccgcagagtactcatgggctcaggatggccccccatcactgtacccacgccatctccagcagtgctttaaacaaagaattctatttgtttggttctgactttcagacagaggagggagcaaactcttctctctcgatccgtatatatcagtaacacttatgttatatgtggcatgacagggataaaaatccacgcaccataaatgtcacatttctttttgaacatttttctgtttaaaaatgtgcatgaacgtagatcacttctccagccagcaaacacactgggccctggcctgtggtacctggattctctgtaaatgaagtctgtgctcaggaatggtgcaaggatcccacagctctctagacttcctctctcctgaaacaaaaagcagagggatccctccacatggccctccaagaggccctcactccaggcctggctacccttgagaatagctcagcttccttgaacactgaatcctatatctctttactcagcctgccaacatgcatgccaattagtgccaataataacatacatactaacagacttttagaccacagtcacccaaacactagagactcatgacagggagctctcattccgagtcatcattttttgtacctactgggtacacgctgagaaattctcacgatctcctcatttacgtctgccttgaaccctgtggcatcttcctgtgactttaaacagtcatttagtgcggtagattggcgaaaacgatcctgtcaccatcggatatgtttttaaatgaggtcttggttgaattctggtttagtttttaaaaatcagccttcttgagttttaaattgttcttatgttatgattccacttctgctgccatttttaaaactgtcagtgtttttactgtaaacactattgtggactttcaaggtgactacagaaacgtatacctagcaaaagtctgatatgtaactccataccacccatgaattattttgcacaatttcatttaaatcattctgactagaggtttggaaaaaattgaggtggtatagttttaaaaataattgttttcctccttctgttgttgtttttttgggacagggtcttgctgtgtcacccagactgcagggcagtggcgtgatcacagctcactgcagcctcaaccttctgggctcaagtgatcctcccaccacagccacccaagtagctgggaccataggcatgcaccattatgcctggctattttttttttattttttttgtagaaacggtctagctatgtggcacaggctggtctccaactcctgggctcaagtaatcctcatgcctcagtttcccacaagtactgagattacaggtgtgagccaccatgcccagccattaacttttcatatgaaagaaaatttctctaagaagaaaataaaatataagggtttatttctaatttttacccacatactattagggtaaaacaaatgcagcatataaaatattcttctccaataatatttctccttttttaaatgaagaattcaggggaaggctactctaatatgtatgtctgctaatacatatgtaatgttgtttatagtagaccagctaatggactttatccatgataaaattagtccatactttcaaagttcccatgtgtgaatctttgttgaatcaaagtctgttcacattaagagcatagattctgatgctttgaggtcttgttgcttatttgcagcctttatacttaggagtgtaaatccacagctcaaagaagttgggcagcaaggaagttggtagctgggttgttctgaaaagatgatttatggggatgctctggtattatttcatttcatttcatttcattttagacagagttgcactctgtcgcccaggctggagtgcagtggcagaatctcagctcattacaacctccatctcccacttcaagtggttctcctgcctcagcctcccgagtagctgggattacaagcgtgtgccaccacacctggctgattttctttttttttttagtcgaaactgggtttcaccatgttggccaggctggtcttgaactcctgacctcgggtgatctgcctgcctcagcctcccaaaatgctggaattacaagtgtgagcctcggcacacagccgatactctggttttatcattgagtgaagttgattagcatgattgtaattcacatctatctacatgggctgagggtgggcagatctttacccaccagaagtaccaatttcactgctgaggaatggagccaaagtttgcagctggaataatcctttttactgtgtaatctattcattcattaactcaaatagtttgtggacatcactctgtgccaggatgtgaactgagcactggggaggagcattctgactgcatggggatagatattctaaccttacatccagtagaagaagacatcaatcaataaacaaatgggtttatttcagagtctggtaagtgctccagggatttcaggcagtagggtgatgtgatggatagttacacagagcaggggagacatcagcaaaggcctcactgagaagggcccattggagctgagacttgatggaacctgctatgtgatggtgcagacaaagaacttttcggtcagaaaaatctgcaaaggcagaaagcctcagtcaggagaaggattggcggggtcaaggaggggcaagtagattattgtttcctaggcatgaagagaaggccgtgggtgatgagagaggggcagggaggttggcctagggcacatcctgcaggctcttgtagaccatgctaagggttgagattttattgcaagtgcaacagaaagacactgcaggagttaaaagagagggctgtcatgacctaatcccttttacaaagaatcttctagcagttcactgaagagcagactgtgggaagtagaagcaggaagctcattgtccaacctaggggacaaaacggtggcccaggctagagcagtggccatggagtgggagaaaaatggtctcttgagtcagtagttcagtcaaagaatggaccggatttgctcgtgaatcagctgttccaggaatggggacatctcatgtggccagagtcaagctggggaaatggatgaaactggaaattgaggttggaaaaggaaatttttgccactatgaagtttgatcttcgacccccaatcaacaaggaagttctatagagaacagttcttttgtcctgtgctttggcataactgtgatagttttctttcattaaataagtattcataagagtaaacttgccactcatccacttatcctaagacttacacaagatgcaatcttattaaacaagtcatcaatacagagagagacactgatactcattattcactcagatcacccctgttctggctgcctttcctctcttgccccaactgctggtggcaaacaaaatcacttaagtcaagtgaacagttttagatgtataatattgaaaggtgtttttttaaaaaaaactccttggaaccctcagccattgttaaaatacactcactttgacagatgtttggcactttttgtatgaggcttttcaatgccttaccttatccagtgcatgagatttagtcggctctgcagaggaaaacagacaaaaagggtctctcagcacgagttactcttctgtaaaggttatagtaaacatgtcaatgcctaattaagcagaaaattttatctgtattgtgggggaggcgtttgctgtctctgacttttcttctggggaatccatttagaaggacaaagtagattgtgaggttgagctggtccggaaagctctgcttccaaatgtcagtgggaaaaaaaaaaaaaaaagaacacttcttttctcctagtttgaaaatgactatactgggtgggcagattgtgtgtgtgtgtgtgtgtgtgtgtgtgtatgcacaggtgcacgcattagagtgcatgtatgtatatttcatcaatgtacacacaaaataacatgaattacttcccaacttcttgctagatgtcaggcacggtgctaggcactgaaaatactgagatgaatgaaacccagaaatgcccttagccaattgtgatgacagaaagtcctcatggccaccaaatccccagatttctttacttgcttctttgttgctgtgattacgttacccacaggtgttgtcacatgtcttagttggcctggaacatcctgctgactacctgttgacccagcgtatgttccagagtaatagcaccccttcattctccaagtgaccctatttgattgatgaaatttgtctgattctctgatgtatgttacttggctcagtaacaacttattttatcatttgttatttagtttattaattttataacagagactttctctttgaatggtatatctattttttgcaaacatacaagttaatccaggaaaaaggaaatgggatgataccgacaggaataatctaattcggccatatggtcattttaaactacagttttcctgcaagttgtgaccgcttattaatggttttttgactagattgagtagttgttgtttttttcaaaccaatctttgaagctagagaccagtaacgccaatttaataaaaaatccacctgtcaatttgctaggaaggtaaaacacaccacaccaatagcagtaaaataactaacacaaccataaaactcatggctagactgaatttatacatttcatcttgttttacggtattctgtcactaaaatcatgggctcttgtctccagttttcccacagttttcccctgtgatgtggttatctatttagtgacatttcaatgaaattccactgcttaacctttagcctttgggtctcatcaaagggttcttcttcattaggttggcaatacaaagatagcagcatctcctgtattcgggcattctcccatcaggcagacttgggtgtctgtcctcactctgcaacgctagctgtgtggccttgggtgaatttccttaccttaaagcctcagtttccccctctgtgaaatgaaagtaatagtggctacttcatgcagatattagacaaaatgaaagaatgcatttgcagtgtttagcttacttcctaggagacagcaattgctcaataaatattctttatcttcagcagcagcagcagcggcagcctttggagttgctgattgtagctgctttatcctagcaaatccccttctcttctaattctccgtgcctgcctcacaggatggacctccagcgcatgaccactccttttccaagctttgtccttagtgactggaaataacagagcctgctctaaggttttccccacgtcgctacctgccacagagagaggagacagaagttcataaagaaaatattgcattaagattgtgcaggccttgcaaacctaaaactggatctccttttctttgggacttctttggttgcatgttatctgcatggttctgaaaaggccaggtgaagaaaatgagcccataggcataatgtcacattccccatctccattgatggatatttgcccattaattccctttgcactggctcactcatgtcttcattttccctatgtaattactggtcctaaatcctttcagagaagggaaagcatgcatccccaatagcattttgcatctacaaatcaaatatataattggcatctcatgacgggtacccacaaatcacagtgcatttgaaattacaggcacaagatcgagagggcattttcaaccttgtctggaaaggtcttcacaaacctgttttagaataataagatagtcgccaaatctcccattctagcaccatttgcgattattttcaagtcattatatttgctgagcttatataatttttcaactatcaacagaagattttatttgcataccccatcatctctcttcctgctgtgtgattccctacaaataaaaatgttatagcaaaaagacaggggctatcaaaaaatataatggctgtgtatccaaattacttctgagcactcaaaaatgatttatttatatggttatatgccaatatatccaagtgtcttggtaaactttaccatctagatgccaagagtcaagtcttagtctccctatgagccaacattcttccctgtagacacgtgactttaatgggatatgaatttcaatccagatttcctaaaagtcatacacatgaatttagcaactatcccatcacaggaatattagaaagatattccttaaacctgaaaattattaacttgggatcctaggcatttataaagaattatgactcctgccaattgaaaaaaaaaaaaaaaaaaacactagatggcacgaaagacaccatttggcttttcctgtgtccactgctcacagtgcataaaaatgtagattaaatcaccgttcagttcggcatgggaagcacttagtctatgtgaggaaattggaatggaatatggagcctgttactgtcgtttcatctcttcttcttctcttgcaggctacgcccaggaggaacagctgaaagaagaggaggaaataaaagaagaggaggaggaggaggacagcggttcagtagctcaactgcagggtggcaatgacacagggacggacgaggagctagaaacgggcccagagcaaaaaggctgcttcagctaccagaactctccaggaagtcatttgtccaatcaggatgccgagaacgagtctctgctgagtgacgccagtgatcaggtgtcggacatcaagagtgtctgcggcagagatgcctcagacaagaaagcacacactcacgtcaggcttccaaacgaagcacacaattgcatggataaaatgaccgctgtctacgccaacatcctgtcggattcctactggtcaggcctgggccttggcttcaagctgtccaatagtgagaggaggaactgtgacacccgaaacggcagcaacaagagtgattttgattggcaccaagacgctctgtccaaaagcctgcagcagaacttgccttctcggtccgtctcgaaacccagcctgttcagctcggtgcagttgtaccgacagagcagcaagatgtgcgggactgtgttcacaggggccagcagattccgatgccgacagtgcagcgcggcctatgacaccctagtcgagctgactgtgcacatgaatgaaacgggccactatcaagatgacaaccgcaaaaaggacaagctcagacccacgagctattcaaagcccaggaaaagggctttccaggatatggacaaagaggatgctcaaaaggttctgaaatgtatgttttgtggcgactcctttgattccctccaagatttgagcgtccacatgattaaaacaaaacattaccaaaaagtgcctttgaaggagccagtcccaaccatttcctcgaaaatggtcaccccggctaagaaacgcgtttttgatgtcaatcggccgtgttcccccgattcaaccacaggatcttttgcagattctttttcttctcagaagaacgccaacttgcagttgtcctccaacaaccgctatggctaccaaaatggagccagctacacctggcagtttgaggcctgcaagtcccagatcttaaagtgcatggagtgtgggagctcccatgacaccttgcagcagctcaccacccacatgatggtcacaggtcactttctcaaggtcaccagctctgcctccaagaaagggaagcagctggtattagacccgttagcagtggagaaaatgcagtcgttgtctgaggccccaaacagtgattctctggctcccaagccatccagtaactcagcatcagattgtacagcctctacaactgagttaaagaaagagagtaaaaaagaaaggccagaggaaaccagcaaggatgagaaagtcgtgaaaagcgaggactatgaagatcctctacaaaaacctttagaccctacaatcaaatatcaatacctaagggaggaagacttggaagatggctcaaagggtggaggggacattttgaaatctttggaaaatactgtcaccacagccatcaacaaagcccaaaacggggcccccagctggagtgcctaccccagcatccacgcagcctaccagctgtctgagggcaccaagccgcctttgcctatgggatcccaggtactgcagatccggcctaatctcaccaacaagctgaggcccattgcaccaaagtggaaagtgatgccactggtttctatgcccacacacctggccccttacactcaagtcaagaaagagtcagaagacaaagatgaagcggtgaaggagtgtgggaaagaaagtccccacgaagaggcctcatctttcagccacagtgagggcgattctttccgcaaaagtgaaacacctccagaagccaaaaagaccgagctgggtcccctgaaggaggaggagaagctgatgaaagagggcagcgagaaggagaaaccccagcccctggagcccacatctgctctgagcaatgggtgcgccctcgccaaccacgccccggccctgccatgcatcaacccactcagcgccctgcagtccgtcctgaacaatcacttgggcaaagccacggagcccttgcgctcaccttcctgctccagcccaagttcaagcacaatttccatgttccacaagtcgaatctcaatgtcatggacaagccggtcttgagtcctgcctccacaaggtcagccagcgtgtccaggcgctacctgtttgagaacagcgatcagcccattgacctgaccaagtccaaaagcaagaaagccgagtcctcgcaagcacaatcttgtatgtccccacctcagaagcacgctctgtctgacatcgccgacatggtcaaagtcctccccaaagccaccaccccaaagccagcctcctcctccagggtcccccccatgaagctggaaatggatgtcaggcgctttgaggatgtctccagtgaagtctcaactttgcataaaagaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgtaagttgtgctgtcggacatttgtgagcaaacatgcggtaaaactccacctaagcaaaacgcacagcaagtcacccgaacaccattcacagtttgtaacagacgtggatgaagaatagctctgcaggtatgggtttgctctgaggcattgcgattagcctggtgaggagctttcttacagggagatgggtctgcttagaggcagctagcatctcccaatgccaagcaggatagtagcttgctggagtaggatttattttaatgaaagaccagaacatgaaaactaagtcctaatcattctcttaagtcctctagtttagagctgggaactagaataaaacgggtttagagagataaagttcacagattactactgctttttttaggccttcatcatccataatcctgaattacccaaggcaagctccagtgtccagccaaggctatctttcattttaattattagatactaacttctgtcaccattccatttcaccaccccacctttccatagcaatgccaatgacttataaagtgacaaaaagttgagcaatggaagaaagattggagagtgctagaagtagttactatatagagattccttaatcagctcatgaatagcttaaagttgtctttatgattgttacttgtaatgaatgcttttttgcagcttacttttagtaattgccaccttccacctcttccctttggttattttctacattaagtgtcctatgaatgagcatgtgcccttaacaggttggtagaaaaatattcttctttgcagaacattgagatgaaaagaagcttattttcttctttcatcttttggttttcttgtggatagaccagtattagagcccacctttaacaaagatagaggcaatgtgtgcccttgaggtttcatttcacataaagaaacaaatggctttctgtacacttatgttaatgtgcatggagtcccatagcttgaagataatgtgcatcatgtgtcatagaagttccatgccttatatagtcaaccatgcccagaccatttgtgtcatttttaggaaacagggcagagaccaaggtcaaatgctttggcagattagtttcaccagccattttcaaatgttgaggataagcaaggctgggtcttaaccaatctctttcatttgcccatttgtgttttctctacttctttttctctcccttccagcatgatgcccgcatacactaagggccctcctatgtgttcaggtggtcctccaccttcggccattccccaagatgggaacccaacctgaactaaaccttctgtgctgaccaatccagttgacgtcatgttaagttacggatttgctcctagttaattagctcttaattcacgatcgaatatgaaaaactaataacatataatcgctcaccacaccctattgtcagagcattggtttacaaatagaagactttcagaacaagctagaaaggtaggacactaggagagttccaggtagagagcggtatttacatggcatggctttgggcttgcctcacatcagacagaggggtttactgggtgtgaagatggccaagatgaaataaaaagttaaaatatctgacctgggactttcccctgagtgaggcgatctacgcttctgatggagaggagtcctcctataactctaattgctatctagacccaaatgaagactatctttttggtttgcatgtttttatcatgatgattgaatgtgttattggcagattcttctcattctttccaagcatgatttgttcagctcacggaattgaaagaaaagccaaaatgcatccattgaattcacacctgagcttggggttcaacagcgtcctatttatttgctgcataacattttaaatcttaaataacttgccattatgttttcctggttcttaaaaaaaaagagggggggcatacagagaatacttagagagaagaaagatatttcaaatccaatagtggtgggttgaaaccatggtgaagaggacaaataggtaatatttatttgtactataacaaagaccacttttccacctgttaggtttgtaatcttttttagaaaattaatataattgccaaaacactctgatatgtagatagggagaggtaaggaaaagaaagcttgatccatcgtcagtcagaatctggagtgtatgatacctgttctagggattcaaaggtgaaccaataatttggaaaaacatatacaaaaggtacttccaaatccattaaatacatagataagatagccattttggcacttctctgcatttgtacaggatgagtatatctaatttggacctcgaaagcaccgtattggtgttttcattatacaaaaccaaagctccatccttacaagcaccattaggctgtggttctgagaggattgcagaaaaacaggtttgagtgtttgggactcactcaaagccatgggcgtgtatgtatgttttgtaaacagaaaagatggtgcaggtactggctgtgtttgtgttcatcgtaaaaatactcctatctgcctgaatgtttcccccatctgtacaaaggtcgattcttggtgctttggtcaccttagaaaaaaatgcctccacccccggggtcctcttttagaacaatatttatgcaataccttgcccattgcttagaatgatgcatgtaaggtttctaaatggtcatgaaatgacatcactgttgtctggaactctaatcttagttgtaatgcatagtagcacaaattgtgcaaagtgacatgatattttagaaagtatgatcaagatttcttggaaactatgagagctttaacctatcaatgttttttgaaagacacaacttttgatctgaattttctttcctttaccagatatatcttaaatcctgcaaaatgctctgccaaatattaaatgcaacttttcgttaaaaatttcattagaaaatattaagtgtgcatctctattttaggtcataagtaatctaaaacaatttcaatatgtatttgtatatagctttaaaagccacatgctcttgactaatagaaattaaacagagagcaaatcaatgagtctgaaatgcataaaggcttgaaattatagtcatcactgtgtaatatagtgtacaagcttaacagcacacctagccttgaaattgttggcaggaaagtattctagtccaatgagctgccacttctgttgtgggcggcttgataaaaacacatattcagggtgaaaagcgcgtaaggttgccagacaaaatacagaacggatgtccagttaaatgtgtatttcagataaatgacaaataggttttgagtataagcctggcccaaatattgcatgggccatacttatatttttaaaatattcattgtttatcagaattcaaatttaactgggcatcctgtatttttattagctaaatctggcaaccctaacagcatagattatatggcagttgggaagaacaaaatagcctggacaaattaatatctattaatggcatcaaccattccttcctccattaaataaatattccttcctttcatcctcttttccctcctttgttccttcattccttcctctttcccttctttccttccttccttttttcttctttccttccttcttttcttccctccctgcattcctttcatccttcaacaaatactggttgtgcttttactatgcaccggactctattatatttaacaatggaagtataatactgaaccagaagttctaccaattgtaatagcaaaacatgccaagccttgcagcaagcactttgcaaacattattttgctttattctcacaaacagccgtatgaagtagaggttgattcactcatgatagggaagagaaaatggaggcagagagattctgcctgaattccccaaggtcctacaatctctgagcctcactcattcattatgacatatctagaaagccatcgttccacagcaagcactgtgctaattcccagggagtaagccataaccaggacaagagtctgcctttgaggctagtggcagacaaatagatgaaaaactctaggggaaatgctgaaaggagcacacaggaggtggctctgcctggttctgggggaagccgggatggggaacagtggtctcagaggcagtgtttggaaaagaatgctggatttaacccccaactcacttgctttcatgaagacatgccccacttctacatctttatgatgtggacataatatccttctcataggaaggttgtaagaattaaatgtatgtaattattttccttaaagcccatagtaggtttacaagaaagcacatagtaggtctataagaaaagcaagttctaggtagagccactacatgctcttaccatgctctgtagcctcacctgcagcgtagagaacttgcagcaacttctcaactctaactaattaataatcctgcaaaatctcaacctgctgtttgattcagataacaatgacagtgaaactaccgttgactggcctctttttataactcaggcataattattcatattatcctcattttgcagagaggtaaaccaaagctcaaagagtttcatgatttgtccaagaagacaaaactaaacctggaggtaggttttgaacccaggactgtccaatgctcatcaactttctcctgctccttggtttcctcctccttgcctgatggtttctaggtaatactcatggctggatgtacctccaacagcccagagagaaagctgtaaaatgtggcctaagagctgagaggagaaaggacactttcctgggccttttggaggctccagctatcaaacattgcaactcaggggcccaggactgacccgcagggtgaagcagaacatccttgttctctttcttttaatgctcttgttcaatcaggcaattatacatttgccatatggtgtctaaccaagaaatgacccaaattccagtgaaaatacatacacctaatattaaaaaagaacatcctcattctgaccctcaggaattcattttagggaaaggaaatgagaactgaggaaacagggtcaagtacaataatctagcatctctcaagcagcaagaaacaaatgcatcgtcttccttaacgtttgcattttttcaaaaatatttggcttaactccgtctatgcatctcagcctccattgcaccttcccccctcatttggacttttgaatgctcaatcctgacgtgtataatttggtgctttaatatagagtaacattatttttcatttactccaatctgccatcagtatcatcttttcatttaaccagatgcaattcttttttctttcgctaaattgaaaatccatgagcgacagggagtgcaatgttttaattagctcatattttttatatggatttatgtctttaaaatacatttgtgtaattcttcagctaaattaaaaacgtctttgcgaaagtgaggaggggaaaataaagagctaaattgtgtcattagcttaggtggttgcagatgaggagcagaatctggtggagggacacacaatcgccagagctgctctctgtgaggatcttgaacttgcccttcctgcagagaagtctttctccataaagatctctcaaaaatggcttggggaggatttttttttaaggcctctagtaagtaaacaagcagttaccttcactgagctaatttgaaacccaacctgccaccaaacaaacagagaaaaagaagtcataatgataaacagttttccttgcatttctctttgtctttttctttttttaactatcaagtttaaagctttccacgatgcttttttctactttctaggagacaagtgacattctgtggtaaatgggagaaaaagccatgcagaactgaaatctctctaacgcattgacactaacttgccctctattgttggaaatgagcaggcgttcatgattgttcatcaaacggctcctaatgcagttaaagcattcagctataatttctccttgcatttataattactgtcatagactgcacacctcggtgagcagattaaagctataaactatttagcctcggctctaagacgaggaacttgatttgtctggcaggagttatttgttagggagcttgacacttcacataaaaatgactcaacttgatgaagaacaatgcagttttagcaatgtggggattttaaatcagtcatgatgccacgccctgcaagaatcgcagggcagtttgttaaatgatatgtaggccagggagataagggaatgtgttaagggtaccaaaatagaagaggatttggtgtgcagttgctttctttcccgactctctcctggaagatcaggagtttgttgaaaatcagtgcatgtcatgttctcctattaaatccagtgtaaatgttatgtgaggctcacctggagggaaaagggatgccagcagccacaggcacatgtcacatttgggggttttacagaactctgtgtagctgttgagaacattcgcctccagaagcgaagttctggagtatatggaaaagccaggagtatatggaaaatagttgtttggtttggtttgtttcctggaacatgttcatgtatttctttgtgtatttgtttgtttacttgcaggaggcatagaatatatttaggcacagaaggtgtttccatggggctgattctataccttttatctgtgaaaataaacaaaaaatagatactttccaactcagacatcttctgattgttgagacacagtgatcaagagctttttctcaatgaattttgggcaagtttgacttgccatggaatcatctcccacctacccacacttcatagccataaatagacacaaatttcccttaaaactggcattcagcatcaagactgttgaatgtttatttgccgcaaacagtggataccggtgcccaaatattagggatcatgaatacaagtgctcccaggactgggcgatgacctggaggaccctagcatgccggcaggggccgtcacggggaagctaggaggccttgcacagcaccagtggtttccaaagaagtagcaaatccagatctttgtgtgagccccccagtgttctagtcgagagggtttttttaatggatgtgttttggtttagttcggattttagtttgttttgttgtttttgttctgaacacccttcaagccaaacaaagtacatcaaagaccagattcaactcctaggctgctagctcgcagcccctggatctggtggcaggtcaggtggagacactggacctgtttcttggtgttctttgtcccctctcccccaaggtaaccccactaggactttgggctctaacatgagtgccacttttccgcatctcagaggatactgggctgttctttaggaaactctacttccttctgaagatttcgtcaagttgctgctactcagaggaggggggcaggctgggctcccctggagaggagccaatcattcaggcttacccaggacttggccgggagggttccagggatttgagaatgaaaccagaaaattccaggcaaatcaggtgagttggtcaccctgctctcctgatatactctggtttcttttcagattatataaatcttttgccttctactaatacatctcttgccttagggcacaatactcattgccggcgtagcttgtgaaatggtgtgtgttctctaatccttatgatatttagtcaatgctgttacccagcacatttgacctatggtatttgtctaatcctcacagcaaaactgcaaagtaaatattatacccattttagagatgagaaagctgaggctcagagaaggcatttcaggtgcaggtagcaggtagcaggtagcacacagcagtagcacagcagcaggtagtggagctgagactccaggccacagccatcagaatcggagcacagggctccttatgcagcactgggccaccagtgctcaacttcagtgtatatggaacagacaatgtttcaaagcatggtgcctttaaagtgcatagtcttaatgagctgatttttgaacatgtgtaacggtgccttggctgtatttgctacaaagagtggaatcttcttgcatgccaaaaaccccagcccaaaggatgcatgtccagaatgagcaagtgtttctaaagttttaccaactttagcccaaatatatgccttgcaagctacccagcactcatgccagtaggcaaaggactatggctaaaggagattttgttcaatgaagttagccttcaagttattgttccgtgatatgtgttgatttttttttatacaaagcttctccctttattcacttgggtgctctacagggagcactcactgtaggttaggagctggcattcctgtcggggagatgggcagacaaaaagtgtcataatgatggaaaacatggcagtgtggagggccagagggcaccatggcttacagggaactcagggaaggcctcattgggagaatctgtttatgttgagactggccaagaagcacttagagagaggggttcccaagaagcggtaagagtacctgctcctctccaaccaccgaaggcgagagcaggcctggtggatctgcagatgtatcaggggtcaggggagacacagcttggggagcaaggggagagcattgaaaatgaaaactggagaaagaggccagggccagagcgttcaggggtgggggagatggggagaaataaggcctagagaggttcagtgacttaacccaggccacacagctaacagacttcacatatccaaagaaagtcccagtgagaacattcaaatgcattgagccagacagggaaggcacacttaggggcttggaagatattaaatttcacattttcaatgccacaaaggctgagacaagggagagactggcaagcatgagaggggcttgaggggtgttggaggtgagcagggacaggcgggggtgcagcaagtcatggcaggggagttaggaaggaggaaaggaggtctgttggctgccaggtacaacacaggggaagctgctgttcctttcctcctccagccccgcagcgttaacctactccgtgggggctcagcccacctctgtgagctggactttctttttctgttgtataataggcgccatggcagtaaatgccacctccctggctccctcggggaagccccacgccttgattattcctgagaattggtgacattctgtggctgctccttgtgggggaggcacaggtctggcccacctgatggtttttgttcacttcttgctgtcacttttgaaagagaggaaggttttacatacacataagtaattaattttgttctttcttattctgaacgtcccacacatcagcagaaaaccagaaagacttcttcaggacagagaggcacaggagagcaatctaagagaaatgtgttttcccttcctccctccctcctttcttccctcccttcctttctttctttttaccaatatttgtcagacacttcttacaggcactgagactataacagggaaaaatgcgagctccctgcccttgggaagcttagagtctgaccctccactttagactgaggctcgagagaagatatttggccacagctacaccagttttacctgcagtgggataagatctaagcagttagacttactgggttttatgggaacaccaaggagaaacatctaacccaggatgggggtcaagggtggaggaggacacagggagtccgggagggcttcctgcatgggagccctgattctgagacttgcaagatgagcagaaagaagtcaggagtaaagagatgaaggagggacacagcatgaaaagagaataacagaaaaggaaatcttctggaaacaagaagttcaatttgaaagtatttgtgcgctctgccccacgcccagaaattgttttctcattttcactaatttgatgtaaataactgtacactcaagctctgacaatgctgggaccctgtgttttcacccctccacttacaggatcactttctagttcaaggcaacacagtttgttctctcaatgcacctatgcactctcacctcaaataagaaaccaattaccttggcttttctgaaataccaaaaataattctcattgtcccatcattactactagtaagaataatatggctataataatagttaattgtaccattcataaatccaaaagtgtttgtgtgcatgtacttttttctcaagccctatacaaggctctagggatagagtggaatcacaaacaatgacacttcttggccttgtggagttctagtctagcaggggaggccgatcgacgatttttttttttttttttttttttgagacagagcctcactctgtcgcccaggctggagtgcagtggcacgatctcggctcactgcaaccttcacctcccaggttcaagcaattctcctgcctcagcctcctgagtagctgagcttacgggtgccaccaccacactcagctaattttctgtgtttttagtacagaaggtgtttcaccatgttggccaggctgatctcaaactcctgacctcaggtgatttgcctgcctcagcctcccaaagtgctgggattacaggcatgagccaccacgcccggcctcgatgatgattatataaccacacaggtaaacgttgatggcactggtaagagtaccacctatgaggctgcaagggccacaaagtctctagcagaggctttgacctggcactgagatcaggataggcctcgagggaagatgggaagggcctcagagctagtgagctgaaacaagaagtgtgtcccaggcagagggcagagcctgtgtcgaggctccgaggccagtaagaagagggacaagtacaggtgcctgaaagaaagccagtgagctggaagggagagggagagcatggatggtgtgaaatgaggctccagtgatgcagtttcttttaatatttcagcctctgctcagatccttaaaggcgctattcacatctttcaataatctcacaggatgggtgatagtcatccattttacataagaggaaactgaggtttagaaataatgaaaagccccagcctcacagtccatggcagagagaggatgggagtccagcttagaccctacacatgtgttccttctaccacatgactcttgtagtcatgtcatctcctgtctgtacctacaaagggctgtttaaagatgcccagtgtatgttagatgcttgcaatagtcaaggtcagatactcacaaacacttagtaaataaaactaagtaaggaataaatgagtgctgacatactcatcaacactgatatttattgaatgcctcatatgtgctaagctcaggctaagcacttttcacatagtatccttcttaattcttgcaacaactttttgaaataggcatttttattactattccccctgtgctgctgagaaaactggagctttaagagctctagtgattgtccaaggtcacgcagctggtgagggttgaaggtgggactcaaactcccagccagagcctgaatcttaaccctccctggactgcttctggtgaagcaaagcaaagtccatggaggctcagtgtgcaagacagttggcttggccacttggggatggagccttcggaggccttttcaggagaaagtgtggatttgaactgaagaattgcataaaaaaggcagggggcgggcatttggaagtcctttggtcaaaaacacctttccattttcatgttggagcctccaatacattatatgttccatgcagaatacgaaagaagtctgtgcaagatacagacccagattgaattacttactattcatttcgtgtcacgtcaacaaagatgggaaccagttaaggaatgggggtggatctttataattgagaaattcagatgttctgaactttgggacctgagatgatctacaaatccagacatgggccgagacatggcaatacgagggaagaactcaagcaggaggagaaaagactgcctatccaggcaatagcgtgacttagaaacaggatttgagtaccacttcatggctaagcatgtgcgggatggaaccggtcttcctgggcttacatctttgctttgcctcttctttccctgtgatgagtcttggggtaggcctcaaaggctgaatcttcaatataaatacaacagtgaatgaacaacaaatggttattttaaagatctatcttggatggctatttaatttcactaaaccccaggttgctcacctgttgactggaacaaacaatagtcccttcttcatgcgggcatggtgagggttttaaccccgcattgtccacaaagaccacttaaattatagtagatgctcagcaaatctgagctattatttttatcacgactgtcagaggtcagatcaggcttcggggtcagacacacctgggttcaaatcccagcagggccacttactgttggagccggggcaagtcagttattctccctgagggtcagttttctcatccctaaaattccaactaataatactcatctttcagtgatgccgtgaggtcttaaaaataatataggttcagattgataaaacaggctggcacaaattggatggcagcaaatgtccttgcagccctgtgtctcctgccttagtttgtgttgaggattaggtcagatagtgtacaggggtgggggctgtcagcgtggatctggcacacacagcaagtgcctgaggaactgctttcctctcaattcccttcccctcaacccccagcccttgatcacctaaagaaaaaaaccctttcatttacttaaggtttaaattaagatgtgaaatggatggtgccactttatttgaaggaataaagagagattgtaagtatagatttatctaaaacagctctgggaggggtgggggggataaaagatatgcccctgagaaaaaatggaatgtagcattaacctgcatttccttccctccaactttcccattctcttcctgccaccagccaccttgcaaagccccacttgttacaacacacatttgctggtggctaagccatgcttgggaagaactgcactggagttttcagtgaaggtgatgatgatggtgatgatcatgatgatatgatgatggtgatgaggaggaggaggaggaggatctgatgatgaggatatgatgatgattaaatgttgtaacacacgaacttagaatagtgcctggcacagtatccattatcagaaaatccatgtcattcacattagtgggtgcagcgcaccagcatggcacatgtatacatatgtaactaacctgcacaatgtgcacatgtaccctaaaacttagagtataataaaaaaaaaagaaaagaaaatccatgtcattgatattgacagagaactaacatttattgagcactgtttgaatcaccacataggttaattatattatcagtaacaatgaagtgaaaggaacctcttcttttaatccttttttatataaaataatatattctcatatcatctctgagaggtagatggagaccctaccttcatttactaatttacctttaaggaaactgaggcatttttcaataaaactgggagctatgtaggaatctggccacagtgaaatgcacctgtagagggtatggtggagatgcctttggatgtctgatactatatccttgtgcccacgcctggcttctgcttgttttcccctctaatagatgcacctgcagctctcttctgaggacatctcccagctcctggagctactctgcttgcacacacagagcacccttggtgcctgcaagtgtgtgcccctggctggccttgagttaatgactgatgtggagtaccagagcccaattcttgcctcccgagaggccaagctctgagtcctaagctgctagggccttatgtatcctatctcaattaatctttctcctaaattctataaagaaggaactatgattgcacccagcttacaggtgaagaaaccagccctcagagatgtgaagtgaccaggaaggccacacagctagtaagtagcagagctggaaactaagtatagacaaatggaggatttgcctgaagccagaattttggctgaaatgtcagcaccattctggcatcccttggtgaaattctgtgcatagtacaccaaagcgtgagatgcagacacaccacttatttgaaggagagaacagatgaatgcctcccccccaaaaaaagcttaaatatccccaaaattcaaatctttgaccaaggcaactttctaccactcggggccttcagcaaattgacacttcaaatgtgcatggttttatttggtatttttttatcgatggagaaaaaaatgatgtttcaggttatgcttttttcaatgctacatttctcaatttcacagtcaaataattctatttttgttcaccagaggattttgtcatctttaattgtttatgactaccccctccccctgtacttgcgggagcctccacttttccccctgctgcctttcgttagactctcccgtgagcagtaaccatggagatgggtccctattggatagtctctgctctggcttagaagtcaaagagccaatcaggacctcgtcatcccagaaatgtaagaggatgaaaaatgcgaggcctttgtaagtggaggggagacctgatatgcagtctccagagacagggagttcctgatgcctagaaatcctgggaaggaaacacacagcagctaagctcagtggggaaaaacatgggtcctggaactgctggagtctggccccagggctgagtctcctcttcctggctgagggacctgggtcagggcacaccacttctttgaacctcagctgtctcttctatcaagcagcagcaggaaggctgagctcacatactgttataaagataaaattaaatacaacccactaagcacctgcctagccctgtatcaggcatgtagaagtcctcaattaacaagagctactctcataataactaaaaatatagcaaccctagaattgaggctgggtgaacaggtctaacagccctgccctcagaatgtttgctgcccatcacggaaggaagacaatgaaaccacaaggcttagcctctgctcactgctagcacaacagaagtacggagccagtggggaaaagaggggtcaaagaagtctaaccaaatgagaagagatctaggctgagtctggaatgatgaaaaggagctagccaggaggataagagggaaaagtgttgcggaaagaaggaacggcaagagtaaagtcttgttaagtgagagagagggtgtggttcattccagaaaatgcatgtggctcagtatgattgcagagagcccagttttggggagcagatggcagagagaggaggctgaacagacaggtggctggtggatgtgcatacaatggcttctccttgggtgcacaaactttgtcttttcatgatcatagagacagatattcaattgaggtttgctttatgaaatattggagcattgtttccatgaaattgactttgcagggctgggaagtgagtggagaagtggatttttttttttcttttgtgacggagtcttgttctgttgccaggctggagtgcagtggtgcgatttcggctcactgcaacctccacctccctggttcaagtgattctccagcctcagcctcctgagtagctgggattacaggcacgcaccaccacacctggctaatttttgtatatttagtagagataaggtttcaccatgttagtcaggctggtcttgaactcttaacttcatggtctgcctgcctcggcctcccaaagtgctaggattacaggcatgaaccaccgtgcccggccgagaagtggacttttaactgagcctccagttgacattggatacaaggtcgacctccacctcgaagctctgggagggcaggggctgcatctgactggcttcctgttgtattccttggaacccagactctacaaatattggataaaagaaaggaaggaaggagaagagagagggagaaagggacatgctatctaggaagtgattatacttccttttgccatcctccatgggcgaaatgacaataatacttacgtctctcatccgtgaggcagatcaaatacataaaagtacacaaaacatgaagcacagtccccagcatctaacataagcccagtgcaaatgaatcttcaggctttgcacagccagaaaagtatgaggatgtaagaaacatttccagcctgccgtagaaaggactaacactctgccaggatgtttttgcatccggggtaagaaatgtctatgctaactcttggaggaactgctgtgtgccaggctctgttctgagtcctgggctacaccagagaataagagaaacaggggatgcaggttgataataatactaagggctaacatctattgagcacataaatacaagtaacaatttctgagaatgaggggctaccaaggaaatatggggtagtgcaagggactgtgacagggccacctactttaaatagaggagattgaaaagacaggagtcaggtggcaacttggaagcagaacatcccaggcaggagaaacaggagcagggctgatatgtttgattcagagaaaggccggagtgtcatgagctgggcatccagtggtgggacatgaattgtgggatgagcatgggacaactcagggctttgtagaacatgctaagaactttggattttttgagaccatgctaactgggtggggaaataaaagaacgttggatttgtttttcattaggtccactgggaagccattgaagcagcttgaacaggcatgtggcatgatctactttctttctttttttgagacagagtttcactcttcttgcccaggctggagtgcaatggtgcgatcttggctcactgcaacctctgcctcctgggttcaagtgattctccttcctcagcgtcctgagtaactggaattacaggcatgtgccaccacgcctaattttgtatttttagtggagacagggtttcactatgttggccagactgctctcgaactcctgacctcaggtgatccacctgcctcgactttccaaagtgctgggattataggaatgagccaccacgcccagcctactttcatttttataagatcactctggctactgggtgtggaatggacaagagggtcaggagtgaaagcaggaggccagcaaggaggctgttgggagaccgggaacagatggccttggttggagcctcagtggaggcggtgagcatgggaaggaatgcgtggacctgggagaattctggatcactcaggaccatgcttgcctagggaggagaagggacttcaaacaaagaagacacgtgttcatggggacagattctctcagcttcacactgtggggccccgggtgggctctagaggaccaggatacaactgctcttcccgaatctcccctggaccacccggactcccaagcatgccatcactgcccatctcccaagaggaatccattccgataaaagtaaaccactagtggccgggcgcagtgactcacacctgtaatcccagcactttgggaggccaaggcgggcagatcacaaggtcaggagatcgagaccatcctggtgagacctcatatctactaaaaatacaaaaattagctgggtgtggtggcgcgtgcctgtaatcccagctactcaggaagctgaggcaggagaattgcttgaacctgggagacggagattgcagtgagccgagatcgcaccgctgcgctccagcctggcgacagagtgagactccatctcaaaataaataaataaataagtaaaccactattttcatgcttctccaggaattacgaagtgtaaagacaaaaggtcccgctgtgctcgccttcctatttttcaatcctaatttcattcctctctccattctgtaattcagctccccctcctctgagcctccacagtaggtggtcctgacttctgtgggagatttactggagagatgacatggaggaacacattgtctttttcaaaatgatttagtgacctttttggcatccccgtgattactgaaatcttgcgtaattattcagtttgccagcagagagttctgttgatcaggggaaagctgaggtagatgtcagatgacagtaaatttgcaatccataattgtaaccacttgatgctggagcagaccagggaacaaggacttggtcacaaggccatggatggttgaaccaatacgagcaccaaattatctcacgcatcacacatgcagaaacgttgcctatctttctttcctcgctagcgctctttctctttctttgcctctttttctctatctctatcactgtcttcatccccttccctagagatgggcacgttgaatactctgctctaagtcttctaggtccatttccacccagagccagtgatgccgtaaatacagccacaggtttttcccccaagaattcccataagctctttctggtcttactgttctggtctgtttggcccctgctggagctcaagcattgatttttttctgctttgcttgctttctgacagcacggcttatattggaaaggtctgtgtcaggaattagagaacattcctaacaatggggaaaagtaccctaatataaatataccatttgtggacttgcactttgacaagtgcaaatgaactggaagacactggaaaagctctgaagtcatggaaacatgtaacagaggcatttacttaataactcatctcattccttgagctcaccttatcaagctttaacctctgagtctctaagttcctagttcaaaaatgcagagtctcctctgtcctcatgttaatttttaaattatatatcattgtagagaggcccttatgttgaatattatgagccattttcatatctgaaatggggaattataactgaacattagcaattgcctataaatctcagcaagcaaagtggcatctataatacatggcattaactggggagaaatgtggtgcacaaaaagggggatttagaggggtggaggtgattttcaagaggaaaggctgcaggtcgatgagcacaagccccctgtgtgctgtataattcctaaaatcttagtggacctgggtggaagtttgttgacacttttggaagcaatggttaaaactgttcagcatgttgcctgggcacgctggctcatgcctataattccaacactttgggaggccaaggtggatggatcacctgaggtcgggagttcaagaccagtctgaccaacatggagaaaccccatctctactaaaagtacaaaattagccaggcgcggtggcacatgcctgtaatcccagctactcaggagactgaggcaggagaatcgcttgaaccaggaaggtggaggttgtggtgagccgagatcgcaccattgcactgcagcctgggtaacaagagcgaaactccgtctcaaaaacaaacaaacaaacaaaactattcagcatgttaagtctacattgtgtatatcaaaatctcttatttacaattcactgcaaaccacatcaaagttaagtaaaataagaaatgtaccgtctcatccaaggagagagttggattcatacatggaggaatccttggttcaaaggatgtatgccgtcagaactttgtctttctccacctttccactcagatgttccttgtgttgtctcattattaggcaaatggcaagattacctggaccagctccagggtctaaagctaggatttagctccaggcctggctctttcatttttttttttttggaaccacttttttaggtggaaacttccttggaagttgagaaatttgtcctaaggcttactaggaattggcaaaagggcaataggatatgtcattccaggacagtgtgtctgccagccaactggaatgcgaacagggcactctgcctgggaatatgagcagctgcgtagatctatccacttttgctggggatcaccagtgaggaaccatggtcaggctgcctgggtttaaatttagggtccactactcactagcagtaagagcaaatattctaacgctctcagacacagtttcttcatctataagatggggataactgttctacctcaggaattgatagagttaaaagaaataatccagataatgctttaagccagtggttctcaaacttgactgtacatcgcaatcacctggaggtttgttaaaacccaaaggactgagcgccatcccccgagtgtcagattcaataggtccagggtggagcgagaccttgtgaatgtctaacatgcacccagatgataccagtggtgttggtccggggaccacacgttgagaaccattgctttaagtacctgggcatgttgtaagtgctccagatagtttgcttttagcagctttcctcctgtctttgagcctgtctgacactctgtcctttgtgagatcttagcttactgcacaaaatcaagtcaaaccaacataggggtccatcaggatgacctattacaggggctaaacagagagcaggagctgaaatagagaagcaaaacaaggagaggcccaaaatctagaaaaggagtgggtagccaggaagtttgcttgagtctgctgagatcgcttaaagaggtggacaacctcagctcagttgcttgtactgtattaagaggaatttctcacctgatgcacatgaccggctatcaagggaagaggtcttcctcttgacttagcttaataccttccttaattctgaattaattggccctaaaagtattttggaagcaatggttaaaactgttcagcatattagctctatattgtgtttatcaaaatcttttatttataattcactgcaaagcaaatcaaaattagttaagtaaaacaagaaatgtggcttctctgtctatgaagttgccatcctattgtttctttgcttctctactaaacttgctttcactttgcaaaaaaaaccaaaaaactaaaaaacaggaaaaaaaaaaacaaggaatataacagctcatccaaggacagagttggactcatgcacagagcaatccttggttcagaggatgtatgccatcaaaactttgtttttctccacctttcagctcaggtgttctatgtgttatctcattctcaggcaaatggcaaacgtggaccagctccagggttatatcctatcagtttagatgcaccagtagatagagggcctgtttcccaagggtaccaagaaaatatggacatttggtttaatcagccgggaataaggaaagcacatacccttaaagcaatgcctgcaacttggagaattggatgctgtctttggcctgggttcaagtctctcctgtggaagcagtgagcagactcagcactgcacaacttgggctgagattggtccacccagaggagttttgatgtcattgttgcttggggaagaatgacctcaaatccaactaacacgctcctcctgccaggactgatgcagtagccaccttcaggtcttctcatctctacttactaccctgtcccagtttggccagcacagaacttccagattaagtcataattcaaagctcatatcacaatgagaagagctaccatttcacgagtgtttattctgtctcaggtgcttcagttatagtccttctgatccttatattagcctttctcatcatttaaatctcagcttaaacatcgtcttctttaaggattcttgcctgaaagcctatctaaatcagttgttgtctgtaaaagcccagatagatagctggagcttggcctaagccatcttctcactttcctgatattttctaattctgaaatggtaggtagccttactcttctcatgatgtctcagcttaggatctatggaccttccttttttctgtcatctctcctcacactcttcatttattccatcactcatttttcttgattggacctccatgatgcttttcccatgtcacttccacttccatttccacaggagccatgtcatttgaagtataccctcctgttgccaggactgatgcagtagccaccttcagttctcatctctacttactaccctgccctagttttcccagtacagaactgccagactaagtcataattcacagctcatatcacaataagctaacatttcatgagtgcttattctgcctcaggtactttaattatagtccttctgatccttatattaatctttcttatcatttaaatatcaacttaaacatcatcttctttaaggactcttccatgaaagcctatctaaatgaggagtcatcaatttctttctacaaagggccagatagtaaatattttcagcattgtgggccatgcagtctgtgtcacaactacagctgacccttgaacaatgagggagttagcagtgctgatcctctgcataatcaaaaatccacagataacttttgacttcacgaaaacttaactacttatagcctattgttgaccagaagccttaccaacaacataaagtcaattaacacatattttgtatgttatatgcgttatatacaatgttcttacaataaagtaagctagagaaaagaaaacgttgtcaggaaaatcataagaaagagaaaacatattaactattaagtgaaagtggatcatcataaaggtcttcatccttgtcatcttcacattgagtaggctgagaagaagaagtaagtagaggggttggtttgctttctcagaggtggcagaggcagaagaaaatccatgtataagtgacccacacagttcaagctcatgttgttcaagggacagctgtattcaatcttccattgtagcataaaagcaatgatagattatatcccagtgaatggtagtgactatgatccaatacaactttatcaaaggacactgaaatttgaatttcttgtcatttttgtgtgtcataaaacatcattcttcttctgatttttcaaccatttaaaaatataaaaaccactcttactttgttggccctatgaaagcagatggcaggctggatcaggcccacaggcaacagttcaccaacccctgatccaaagcaatccagctctctcacttttctctttctcgtcaccctgttttatttccttcataaaattacaactatctgatatcatgttgtttatgtattttctcatatctagcactgtgctaggctccaaggatacagcaatgaacaaaatgacattttcctttccttcacagatcttacattcttgttggaggaaatagacacaaaattaaaaaataaataaggccatttaggatcccatgaagggaatagagcattatgggcctgggtagcagtggtgctaatttactttgggtgctccaggaagactcctttgaggggcagcttctgacatatgaaggactgagggagccacaaatgagaagaagaggatttcagacagggacagcaagtgcaaaggccctgaggcaagtaggagctgggctcgttgtggggaactgaaagaaagccagtgtccctggaatgctgtgagctcaaggtgacagactcaattgtgcaggccatggtaatgagttcagattactctgaatacattgagaggctttaaatagggaaagagcatgacccaatgggcatttttgaagatgactctgctcctgtgtgcaggaatggattgcacacaggacatgtatgtgtgtgtgaatgtacctttccttccttatcaggaagctccttgaagacctcaggcatatgaaggcctcaacaaaaactttataaacttaatgcatcaattaaaaccattaacacagccacataactttttcttaacctcctcactagcaatcctttttatagcctggttcccaaagcaggtcaatttatatcataaaactcaaaaattacagcttatagcataaaatgacctcccatgatataatgtggcaaaataagcgaattaataccagaggtagtaaatgtctgggcactaatgtgacttgagtatgaaatatgtttccatcgcattaggagtaaggatccaaaatgagagggggatcggtgacctggcaccacctacatggagctagctatgctaagtcctggtttagaagatccacttggtatgaatgcaaccacttaggtatttttgattcttctcatcatttagtcaacaagtcgtttttttgtttgtttgtttgtttgttttttgttgttgttgttgttgtgtgtgggggtttttttgtgtgtttttttgagatggagtctagctgtcgtccaggctggagtacagtggcgcgatctcagctcactgcaacctccgcctcctgggttcaagcgattctcctgtctcaacctcccgagtagctgggactagaggtgcgtgccacgacacccagctaattttttctatttttagtaaagatagggtttccctgtgttaaccagggtggtctcgatctcctgacctcgtgatccgcccactcatcctcccaaaatgctgggattacaggcgtgagccaccacgcccggccagtcagcaagtattcctaaaagtaaactgtatttagatactatgccaggcttgtatccagaaatgagcaaggcaaagaaagcctctggcctcatgcagtttatgtgctgttgctgtcatggagcaaacaatttaatcaaagagaataatttcagtgctgttagttgtaagaatgctgagccaaaaaatggggaaatggaaggctactttagatgggtggtcagaaaagtcttttctgagaaactgacatttttgctgagacctaaataatgagaagcagccaggcatccactgagtcaaggaatgagggctccaggcagaaggaacagcacatgcaaagttcttgaggtcaaaaaaagcttggtgtatttaaagcattatctagtacagaggtttgtaaacctcttttgtcaaaaggccagatagtaaatgtctgaggctttgtaggccatacagtgtctactacaaatcttcaactctgccattgtatcacaaaagcagccataggtgatatgtaaatgattaagcatggctgagttccaataaaactttatttatgaaaataagtggagggccagatttggcccacaggctagagtttaccagcctatggtctagtaggatagtgtctcatgtgggggtcctagaagcagatcctgacatcagggttcctgggctattaaacctattgaatccctggtttctcaggaatgtgctcccaggaagaaccagtaagggagtagggaagcaggacagggaaggaaagaaagccaagcaagtcctagcctctgcctgatcccatggggagcctcagagttccacctgtctgtaagcaagggctgggctaccttggctaatgactgattgactccacatcaatcagtcattggctcaaggatagccaggggtacacacttgaaggcagcaagggcactctgtgtgtactggcagagcagcttcagcgaccaggggacatccccagaagagagctgcaggtgcacctattagaaagtaaaacactcagaagccagacgtgggcacaaggatatagtatccaaaatccaaaggcatccctactgtgtcctctacagatgcatttccctgtggccaggttcttatctagctctcacttgcatagaaaaatgtctcagtttccccaaagttacctttgtgaataaaggtagactctccacctacctctcagagctgatgttaaaatatatcaagttcttttgtccaaaaaaaggatcaaaagaagaggtgactttcacctgattgtcactgataaaataattaatttacatagcaattcaaaatagtgcaaatatacaggaatcacgtttttgaaagtgatcagagaagcctggcctctggcttagcctttcatatgcagatcagtgagggagagggaactggcattgactgagtacctgctgtgtgcattgtgtcaagagcttttctatcttttttctgatttaacccttaccacacgctttaagtagcgatattacccccattttatggatggggaaaccgaggttcaggtataagcccctcaagggcagaacaggggctgtaaaatttaaaatccttaactcatattcaccgaatggacctcagaaaggtctgtaacatactgagggtgaccatgactgacaggtgacagagttaggatttaaggccggttctgacactgaagtctgtgcatttttctagtggcacctttcagactggtgattcgaaggaataaatacaaaatggctagccagtggcgtcatgcagtgctctttgtataaggaggtggcattcctgtgccaagcatgtgatttgtgtcaattgcttgctgtcgtgaggaggccttgccgagactccttcacacattctcactgtgccactcccagatcagaacagacacatgcagtcctcttatcctgttccctggacaaatctttcccaagacggaacctgggacatgcctaataatgatctgacttgctggttcaatcaacaaatatttattcagcatttattatgtaccaggcaccatcaaagccctgaagacacaaacttttatgacaatcataattaacatggagttagcgccctaccagtgttatctcattattcccttcccacatcctccaaagtaggatcatgggtccccatgttgtagaagaaaaagctaagccttaaagaggttaagtaagtggcccattatcatacagttaggaagcagcagaacaagaattcaaatgcaaatttgccaaacttcattatcactgccagaactcatgccctgtcctgattcttgcaaaaaatcagggctaatagttattgaatgcttactatgtccgaggcactctttaaaactctttacatacatcatgccattttatctttcctgccatcacaccagataggtccctgtcatcacccctattttacagatgaagtacctaaagtcaacagaaattaagcgccttgaccatcaccacacagctttcagctggtggagcttggatttaaaccccagctctgctggactttagggcttgctgggaagcagagttataattttttaattaccaaaaaaaggaaaaaataaaatagtaagaagaataaacatatactgaaagcttacttatgtgccaaacactgggtttagtacttctttgttttagcttattcaagcttccgtgctctgggaagtaggtgattttcttattcctattttacagttgaaggaatggaggtatagcaaagtgaggtcatcctacccagtcacacaaatgttttgtgatgagggcaaaattcaattacagattggtctgactctccaagataaacagattaaccctatttttatccagggaagattttcctgcatgcttggtctgtgacctgggtttatgaagaatgaatagaaacctgtgctcgcctgctccatccaattgactgcaatatgcaaaagaggcttgaatgtagagcttcgaggagtttggggtgaaagaaggtggcagaaggaaagtaaaaacgggtacagtaattcccagggctctttgtcaagttcctgaccaaatgcccggcaggggctttcttcctcttcttccacttcttccttcattcataagagttttaccgcctcgaacaacgtgaaatgtgtagcttgggcttgttgagaatggagtgtgtctgttaagtgttgcttcttgaatgctggaccgccacctccatcttagttacgcacgcccatctttttcaatctaatgaactccaaccatcagtgcaacttaagttcggctgtctgttcgtgcatagttaatattaaaaatgtactaacagtgtggctgagaaatcaaattatgcacataaatatgctggcatagcacaggcggcggcagaagctgaagttagcaacactgatgccagttcacatttgcaaatctcccgtcaatctgtcattaaacatgttatcaaatgatgataagtgtatgcttcttgcttgcattggtgagccgattcccgatgttgatgcacattaatgggataatacgcattaacatagttgtgcttggatgaacacaaaacattttttatctgtctccgtttgtttccccctgtggccccgaagtaagtgttttgtgttatcaaattgccaaaaacacgggaaaacatattacttttaattagcaaatcttgttgggattttcccccctacacgcccgtcccccccacccccattgtgtgatggcaataagagagagaaagagagaggagagagaaatagagagaggaagagagagaggaactctactgtcttctttcagtaaaacgattaatgtcagcaactcagaagctggcaattatgttctgtcttaatgcactggcctttcatctggggcccttactcttgacaggcctgatcgtttcagttcagtgatatgaaaggcagcagaggaaatgatcgtagacatcccgggtctgtcacgagggccggcgctgcaattcggatccagctccacgttctgaagctgttcagcagagtcagaagcacaggagacagatggtggccccaggcattgcccagactttgggtgtcactgtgctgagtggggaagttgtagctaccaccatttcccaaacttaagaactgggaaaatgtgcaagcccccacaaagtgagaaacacggtattaaaaagttaaatgtccttttgcgttgatcacagagcaccagctcaacgcaaggataaacgtgaatgcgggcagtgatttcatacagcagtgtttggataggagtctcttctcctgaggatccaggagaggattggattcatttttcaccaaaatgaaaataaaatttagatattcttgattgaaaattcagaactttatgaaatttttttgcagatgttgggtcagtacaatatctgagaaatggggccaggtgcggtggctcacgcttgtatcccagcattctgggaggacaaggcaggcagatcacttgaggtcaggagttcaacaccagcctggccaacatggtgaaaccccatctctactaaaaagacagaaattagctgggcatggtggtgcctgcctataattccagctacttgggaggctgaggcaggagaattgcttgaacccaggaggtggaggttgcagtgagccaagatggtgccactgcatttcagcctggggccgcagagcaagactccgtctccatctcaagagaaaaaaaaaagaaagaaagaaagaaaaagaaatggtagtggtgcccagcttcctttgtgaagtgatgttctgagccattagggttatatatgtttccacaaaggatctgtcaggacatctttgagattggattgattcattcattcaacacagatggattgaatatctactatatgccagaattactgtagcatcagggagtaggacagaaatgattcctaccctcatgaagctttgggtatttggggaagggaaaacagaggtttttttttaaattgctacataataatcaatttatttttattatgaaaagtgaaggtagaggtatatggagtgcagttgttgtagcatttacttctcgagctcagtggaaaatgttttctgccattaataatgccaaaaggttatgtgtttggccttcctggattcttgtttacatgtgttttaaaattaacattgacttcttgccatttgtgtttgttcctaagcggagtgagcggcttattaatgattagaattattgttgctattatgaatgcactaattaaaagaaaattctgtcatgaggctttgtgaggcaacacaagactttacagttagagacgtcaggtctggaagtgtggagacaaaagtgtgaaataagaaaacagagttcaggatgaggaaaagagttctcaagatgtctacagtccttcattagagattctttttcagggcattttccctagtaagggtatgatgaaaatccagttgttttttgattggaggtgtcacctttattgtttttctttttttttggtcttagggcagaaatagccggcttctctccaacttgaattctaagaacattttatcttctacagctttattcaaatatgtaaaaacaggcacagtagctcacacctgtaatcccagcactttgggtgactaaagtaggaacatcaacggcttgagcccaggagtttgagaccagcctgaacaacacagtgaggtcctttctctacaaaaataatttatttttacttagtcaggtagggtagtgtgcacctgtagtcccagctacttgggaggatcacttaatcccaggagttcaaggctgcagtgagctatgattgtaccaatatacttcagcatgggtaacagagcaagaccctgtctcaaaaatacacacacacacacacacacacacacacacacacacacacgtaacacttctgaattgatgaccagatgccagaccaaggatgccagaccaggacacagttcctccccgaggttcatcatctaggggacaaggaagtgaagcgaatgcacaatcgtagtgcctggacacattgctgtgatgggaaagatacaggtgcacaaaagaggggcacccagtcttgtccttcgtagtaggaacaaattatttctttatattgtgaataagtatttatttaacatactcaatatactgaactttttcaaggagacaaaaatagacataataatgatacgagcttatatttattgaaaaattacatggcacttctctaattgttcatttgaattgtctgttctctaattgtctgttctcttgctggtctttcccactctaccttgagcctcaccagggcagacactgtgtttatcagaactcatctccagggtctggtccacaaggggtgggcattttcatgtgcattgacttacttttcaggagttacagtttagatgttggaggttaaaaggtgattgcaatacaagtgcagtataagtaacatgtgtaccctaagatctgtcatgggttcagaggaatgaaactgaacccaccgcatcccacagagtgagcagctgttacttatctgttgagtatccccagaagaggaagtgttgcttgactgtctaagaggttagtaaacttgcatggagactgagattggaaaaagcttgggaaataattagttacagtgagtgccagggtagtggtattttggatttcttgtccttctaaaattgtttttctgtggttaatatcaccttgaaaacaaacaaaaatcatggtagatgaaagtagaagtcattttttaggagttaatatttttcttattcaacctgaatttcttgagtttttaaaacttttaatgactcagctttttttcccctccaagagtatttcaaaatggaaaattttatattctataaaaatatttttcaaatctcttcctgacatttattggagaagattaaagtctttaatcctcaagctaatttctatgtggtcctcataaaattccactataattccattatcgggaggctggccatagaggaaacttgagtcttcaacctaatgtaaaaatctgcctttagacagatgtgtagatttttcttaatgtcaaaaactagttaccggtaggccaggtgcagtggctcacacctgtaatccctcctgcactttgggaggccaagatgggcagatcacttgaggtcaggagttcgagaccagcctagctaacatggtaaaaccctgtctggactaaaaatacaaaaattagccaggtgtggtggcagatgcctgtagtcccagctactcaggaggctgaggcaggagaattgcttgaacccgggaggtggaggttgcagtgagccgagatcacaccactgcacactgcactccagcctgggtgacagagcaagactccgtttcaaaaaaaaaaaaaaaaactagctactgttcaataagttttaggtttatattgacattaaaatttgttaatagaagtctagttttctcacatctgtgtttttttgccaaagtcttggagaatgaatagtcttggcatcccatcaacagtgattgggaggaccgctcatttattcattcaacatatttttaggtgcctaccattgccagacactgtagtaggttctggaagcttaggactgaacagagacaatatttctgctctcaaggagttgtcattctagtgggaaagacagatcctacacaaatgaaaatataatatgcctgatgctaataagtgctaagaagagaaaaagaagagcaatagagaggaaggctattttatttattcatgttttaatattttattttattttaatttaattcaatggttttggggaaacaggtggtttttggtaaaacggataagtcatttaatggtgatttccaagatttcagtgcacccatcacctgagcaaagtacatggtacccaatgtgtagtcttttatccctcaccaccccccaccctttgccctgagtccccaaagtccattatatcattcttatgcctttgagtcctcataacttagctcccacttaaaagtgaaaacatacaatatttggttttccattcctgagttacgtcacttagaataatggtctccaactcatccagatagctgcaaattccatgatttcactcctttttatggctgagtagtattcagtggtgtatatataccacattttctttatccactctttggttgatgggcatttagactggctccatatttttataactgcaaattgtgctgctataaacacgcatgtgcaagtgtcttttacatataatcacttcttttcccctgggtagataccgaatagtgggattgcctcattaaatggtagttctatttttagttctttaaggaatctccacactgttttccatagaagttgtgctagtttacattcccaccagcagtgttaaagtgttccctttctaccgcatccacaccaacatctatttttttttattttttaattatggccatacttgcaggaataaggtggaatctcattgaggttttatgttgcattcccttaataattagtgatgctgagcatttttccgtatgtttgttggccatttgtttatttccttttgagaattatctattcatgtcctttggaggaaggctattttagagacatggtttagggaaagcttgtctgagaaagggatgtctgagctgagacctgaatgaatcaaaaaaggaagacatgcaaatatctgggaagttgaaataaatcagcttctaattctgatggcaattagctaagtcataaaaagaataaaaccatgatcaaacaatcattgaaaattgaaatgattgaaattttgcaatgagtgcaaaagactattaattatagccaggggatcaaaagacaatgaaatctaaacattttctacattgctattatttcaatgataactttcatttctgttcccagaaattgcatgaagagttgtaaatggcctgagaatgagatttagtggtttttaattcagaggattagttgtcaatatttaaaatcagagaaatttacattaaactccatattttcagcttctcttgaaaaactagaaaaattgtcaatggcgttccaccttcctatgtggagtcagttggagctaagggatattttcccctttcaacaggacgtgctctcttcaggttaccacaatccccaccacctcctactaccctaccccaagcccccaccctcgtttatattttctgcttggcccctatatgcactgcaatttgtgatcacaacttcaaaggtttatagggttaatacttcactgttcattttggtggattcatgatcatccaaaccttagcttacatctatcactaatttaaaaagtactctaaatcaaaaactaagtaattttttttaattgagcaaacatttatacaatgtctactatatgaaaggcaaactactagaaaaaaaaggattagagttaaaagacacaggttctcatctccaggagttcactgtttattggggaataaaagtatcattctaacaatgtcccccatatttttaaacacttttaatatagtcaaagcactctgagatctgttacttcgtttggtctatccagaattctaggtaagaggaaacacaactattattggtttcattatgggtattacgtgcaaagacaggtatagagaggtaaatgtatttgtccaaagtgacaaggctgccagtattaaggccaaggctagacctgtagtcagtgtccactctcaaaagttctattttaccaactataatctccaaagtgctacctatgtcaagggttggcaaatccagcctaccacctgtttctgtaaataaagtttttttggaaacagccttgccatttgtttacatattgtctatggctgcttttgtgctataatgtcatatttgaggggttgcaatggagactgttatgatctacagaatctgaaatatttactacctagtcctttacaggaaaaatttgccgacccatggcctatgcagtagctgcttagtgagggtagatgtgagcgtaggggagaaagccatattcccatgtctcctcaagaacatgaaaactgaaggaaaggtcaccaattcacggtgaggggtgctagtcagttccaaataccctggtcaaaaatatcaagagcaggctgggagcggtggctcacgcctgtaatcccagcaccttgggaggccgagatgggtggattgcttgaggtcaggagttcgagaccagcccggccaacatggtgaaacccagtctctactaaaaatacacaaaattagctggatatggtggcacacacctgtattcgcagctactcaggaagctgaggcaggagaatctattgaacctgggcggtggaggctgcagtgagctgagatcaggccactgcactctggcctggacgatagagcaagactctgtctcaaaaaaaaaaaaaaaaaaagatcaagagcaaaattgtgggttcagttaggattctcaattacacatcacagaatctacaccagctaacagaaaaaaagtttcatcaaatgttattatatagttcatgggaccacccagagatccagagaatcagatttgaaggctacacagtcaagagttttgccaggactgtgctggtgggaccactcttgcactggctgtgctggacgtttgactttcctattaggagttctgaaacagctccctctgcagggcagatggctttcacccaggtcatgataaaatccgcctggcacctgcctcctcacagcacactcttctgaatcaaagccctacgttggtacatttggtacatcaaggcaaaccttaatttctgccttgaggaatgtccttccttccagtcaagttattgggatactgacaccatggtacagatgatattagtaatttctgaagggaaaaaatatagatatcacagaaagatagtcaggatagcatttaaaaaaaaaaaaaaagaacagatagggaatttcgttaaggggaattccaaaattgcccatgggaaaaggacatctttggttatggaacatttagtgtctggcctatgatggggaaggtctcacatataataatcttaataataatgactaattattgaggcttcggtccattcatctaggaggagagcatgattctgtccacatgttttctataccaaaactgctgcatggtgaactggtaatcctgacccttacaggggtagagagttaatctgagaccatctgtgccttaaacttccacactggaaatgagaggatttttgactgcttgtctggaacatttctgaatccagtagcaaagcaatcctagtagcctctctagccttccaagaactctttctgaagttcattagaatttcaccctcctggccagtaaatgcacacaaaccacctattttttttttttttttttgagacagggtcttgctctgctgcccaggctgaagtgcagtggtgcaatcatagctcactgcagccttgaactcccaggttcaaaccatcctcctgcctcagtctcccgagtagttgggactacacatgtgcaccaccatggccagattttttttaatatttttttgtagagatggggtctcactatgttgcccagtctataaaccaccttctggctacaatttccttttccatgctgcatgtgtactaacagtaactgcattacccagaatagaagctaacaatctgttgagagtttgctcactgtcaggctccagagcaatggctcctttaatccccctcaatggccctgttatcattttccaattcagacagtcagagagttgaagtaacttgactaaggtcacagatccagtgagtagcaaggctcagataaaagtcacatgcatctaacactacatgcttcttatatgtcccctcaggaatatggaataatcagagaagactcaatctcatcattggtccattcacagtcaatagtttaattaggtgggtagggagttttgatgatataagggtcgccattgaaaacaagagcaagaatttgaaacccaccaccattagcacaaaggccacgctcttaagcacagattgtatgagttatcttttaaaatctccgtggcatttctatactttttagtataaattaatacatgagccaagtgcagtggctcacacctgtaatcccagcactttgggaggccaaggtaggaggatcacttaagcccaggagtttgagaccagcctggccaacatggcaaaaccctgtccctactaaaaatacaaaaattagccaggcctggtggtgcaggcctgtaatcccagccactcgggaggctgaggcacgagaattgcttgaacacaggaggcagagattgcagtgagctgagatcatgccactgcactccagcctgggaaagagagtgagactctgtctccacctcaaaaacaaaaacaattaatacatgagaattccaggttattcttcaggccccctcactcttcaggcaacagaaggctgaccagtcttggatgttgtccagagggcatggacactttgagaagggggaaggcaaacaacagtgtggcaccagacagactggttatggatgctgctctgtcaattaccaggcatgtacccagtgctgtgctggtaaattttaacaactggctctcaaaaaaaaaaaaaaaaaagaaaagaaacaggtcctggccaggcatggtggctcacacctgtaatcccagcactttgggaagccaaggctggcagatcacgaggtcaggagatggagaccatcctggacaacatggtgaaaccccatctctactaaaaatacaaaaattagctgggcgcagtggtgcatgtctgtaatcccagctactcgggaggctgaggcaggagaattgcttgaaaaagggagtcggaggttgcaatgggccgagagatcatgccactgcactccagcctggcgacagagcgagactccatctcaaaaaaaatagataaataaaataaaataacaggtcctgatttgccgtgttgaccaatttctgtggtgtaaatacttccacagtgggaagaggcgcacacaggcagctgtcatgagctcttgtgagctaggaggggctggatcttggcaggtcgcttaatcgctctagcctccagagactgagcaaaaggcaggtacctccctcaaaggttgttaggcagattaataacaaaacatggtaaagcagttagtgccgaacctagcactgtggtagacgtttgctaaatggcttgatttactagttgagattccattaggtaaagtcctaatgtcttatgcctcaaatgttttaatcttaaaaatagtcataaaatactttccccacctcttgctcaggataattggaatgattgagtgagatcatctgcatcaactgctttggaagtccacaagcttataaaaaaaaaagagagagagagagacagagagtattttattaaagtcaagtcaaacccagagaataaatttttgctgggcaaaaattatacaactgagtcataagtttttagttcttctgtcatcattttttcctgagctttcaggttctcctcagctcctgatacttaaataattcccatttaaaaagcatttaattgagaggagcctggaaactcaccagctcagagaaaaattcagtccatcaagaggttctgagagtctttgggtttaagtctttctgatcttttactcctcaatcctctaatcctttttgtgaggaatctttcacaatccttgtttttagttcttatttctcaagtttccctttgaaaagcaggattcccatcacatctcaaaggtgaaggcagcataaagcctgcttccaacaacactactgcggttacataaagacacgagtcatttctgctgctggaggctccagtggagtgttcccttggatttgctcatttctttgcttggtcctccctgtgatcttagaggattgcagtatttatgaacatcatcttgttactttccatttagtacatttctgcctagtcattggtttttaattttgtcctcgtaccctccatttacaaacagaaatgtttaactaatgcttcaacaacccaggttcatggattgacactaattgctcaccatactcatttccatttgcaggcaaagccagacctcctggttgcaggatagcacagttataaaaaatttgcgttctgtggtccaaaaccctcctgttcaaatcttggccttgcagctttctagatgtgaattctgggcaaattacttaaactctctgtatgtccgtttttcctataaaaacatggataataataagacctatctcaaggggtagtaaagaaagttaaatgagtttatgtatacgtgtgtgtgtgtgtgtgcacgtgtatgacttaaatagctcctgataatcactaaaaacaaagaaatgttagctattatcatcataaagcggtgtttccctaattgtattcacatgatatttgtactttttgccatatctgcaaacccctgtgcttttatttacttatgataaatacttgtattaaagaggaaactttaatcactagactaaatggaaaccagtataacttaacaaaaaaaggagcaaatgacaaaagatacataaagtgaccacaaaacaatgttttcatatctggccagatcctgatgcttgcctaagtcttggagctgagctctggtttctctttgttgggacaagaggttaaaaagtgttagtgggatgttaaaaccttgaacttgaatttgaacttgacactttgagattttcttttttggagcatagaagaaaatttaaaacagccatctttcactttatagttctgtgttttttgttttttgcttgtattgctgcctctatggacctcctaaaagtttctctcatatatctaatgttctgcacctcatgctttagctaaggtgaagttgaaggattcattactatccaggtctgtaatgactgcaaaaaaaaaaaaaaaaaaaatccaggcagtttgatgcatattattcttgaagactgtttctcctctcagccttagttctgttatctatccgtcccatctccaaaattttttttaatggtgtgcttccttcataaatttttcagatctaggtctgcgtttttgtctcctctgaagtccagaaattgatgtctcattgaggaatttgcaatttgctctgggcttcacaatgctgagctgcccacttcctgacttaaggaaaagaccagatgtcagtgtttattagtgtgatcatgcagtttagttgctgtaaggttttattcttaaaagattgcaatctatcctattgcatgatcacccaacattcaatatgctggcaatttccaatatgtaacctccttcaaattaggctcagtgttatctccctcatccatcagtacagcaagatgggtgaaaagtgctgtcgaaaacagctggtcagctgggctagcatttccagggttgtttcatctcaagccctttcactcccacacactttatctttttcttaaaacacagtctctggactatctttgtcctttatcataacttgagtttgttctgttcttccttggtctgaggtcaaagccatcttcctagaaacttctttatatttttggtccaaggctaaggttagggtgatacaaacccagaaatacatctcttatcttttccctgttcaaggcagttgacagttttgcatagtcactcatatttttcatgcaagctttggaaattttccccaagcaaagagactgagatgaaaccaagttttagaatttctgcaggtctagggacgccatcacaaaatggactttggagtctgcttatgctgcagatggaatgaatgaagtagaaagggaaatgatctgcccaaagtgaatccaggatctttgatttccaatccatttaccccagacaacttcaaggtagagaaagtcacatgatatttacatcccctcacagtaccctgtcccatgacccctggtgatctggccatgctggcaagtcatatcaccttattccaagttattatagtcttgtaatctctaactgcaaaggattttagtataccttaagaaatagcaatgggaaccaggtcaggaaataagctcagtgtcaatgataaaggctgaaatgcaggggaaattgatccaatgagagaaatctcagaatcttttttttttttttttttttgagaccagttccggctttgttactcaggcttgagtgcagtgatgcaatcaggctcactgcagccttgacctcccaggatcaggcgatcctcctgcctcagcctccagagtagctgggaccacaggtgtgcaccaccacgcccagctaatgctttaattagcgtgccgtcttacccaaggtagtcttgaacacttgggctcaagctatcctcctgccttggtttctgcgattataggcatgagcctataaaatgctgcgattataggcatgagccactgcacctggccatagagacttgatatgacttataacctatcaaccagtgtattatcttgggcaacctgggggtaggacacagttagtagcaggaactctgcagtctcactaacttggtttgaatctgggctccatcatttattaactctatgaccttaagcaagacttaacttgtccaagccccactttccttgtgtatacaatggagaaagtaatagtaacacttctaaggctgcttgaggattaaatgttataattaggcccatgcctgacacactgaaacactagataaatattgcctgtaattatcatgtgacctatttgaatatccctcaaccctggaaggtttactgcagaatttagtggcctcttacagatatcaaagaattggctatgaaattgtacaaaatgtcgaaacttattctctcctttccaggtgggtgagcaggggagataatgtatccataaaggagcttcttggatgggtggtgtctccaacttctttcggtcacctacctattatgggtgatcctcttcatgaggcatgtccttcttgacccaaaatctgtaaccccaccctttttgttctaattagaaaaacactcatgcattcatttagataaatattcattgaaaacccactatacgccaggtactctgctgtacacggagacatcaattgtaactatgatatgttctcctggcccttacattctagaggagaggggcagagaacaaacacgtaaacaaaaataaacacaaaataatttctaacgcagtgtgaaaggatacaaaccatcgcactgggtctgagaacagtgagagaatcagattggagtgtaagttggatggatggactatgtggacggggtcatcaaggaccccactctgaagaggtgaacttttttgctgacacatgaataatgagaaagaactggcttcagagatctggggaaacagtgtttcagggaaaggcaaaaggatgtttcacatacgagaaggagcttggcttgtttgggaaacagcaagggggatagtactgaggcagggagcgggaggttggcttgctgtgcagaagccagggtgcaggggatcttgtcagctgtctcagagaggaccttgagaagtcactggaggcgggtaaacccaggagtggcagcatcgatttaccctttgagagaacatactgggatgctactgagtgaggaaaacaatagcatagaagagtgtgaaatctagtctccctccttcttaatcaagtaaattgtatattgcagtccttaaaagagattggtcacaaataattttcaacacacctgataactgtgcaaaacttctttttgtctcatttttgagaagtgctctggtaaaatatgaagtgcctctgtgaaggtgtgagcctctgtcccaaaagggcttgtgggagttgttttggagcttatagatgagactctgctttccagctcctgtgaatttcacaatcccaagagtcagtagtgacatagtcccagggtaggtggagaagattagagcctgggaattgtcttcttcctgggcaaacccccaacttaacagatgatgtatagctaactagaccccatctgttctataaaagagaggaagccgcaccctgtcttatagcagcactagaatgtttgaacacagtttggaacagtcccaccaacaaggtcaagaaagaattgaggcaactaattggataattcatcaattagttgaaatcctctgccccaaagattttatgtaaaacaacttgaactgctcttttccccattaaattacaatgactcctcagctcaccactgcgtttttgtggatatgattgtctttacaaaaaatattttattataatatgggtaaagactttttcccttgttttgcccatttataaatgtgtacttttaaaactgttctgtcccaagtataactgctctctttacttattttgtcattaacgtcatcttttttgtttgtttgtaattctaagtccgattattctctgccccatgcctttccaattttgctgtcttattctcccaattgctaaataattagtcaatatggcttcaccatatgtacagagctccacagataagcaattggcctttgacactactcagccagtaagctctcaatgcagaagtttgaattttgaccacatgtccctacttgctggtgaacacctaagaatgtaattagatgactacagtttggttgttcttccttggacaattcattttgcaacttaattcccaggttctcagagacaccaacttctaaacattatacagagcccatcagaggatgacatattcccccacatgatagcatattttttatctttaaaacttaaaaagtaaaataaaataaaaaagtaaaacttcagcacgtttttcctctccagggtttatcttatttacttccctcgtgctgttcagctaattccctgccagggacttattgctgtaactaagccatcacacagaggcatgccaaagacacttgtgaacaaagtgtttatttctcttaacagagccagcaattttcagattttctgaagtgcagcccccagcaaaccctcactacctgttttagtaacttcccacagacgttcacattttcataggttctgtggtattgtttcgtaatgatctttaggagagagggaaaaaaaactgcagcaaatgtcaaaccttaggatgtattcaagaggccttcaagtcactgcagattcaggatctgcaagataactaaagcacttacatctcaatatatggcttttaaggtcagaagtatcataaaatcactcaggacatcttgttctgttcaagttccttttcattttcccgccctaatggtagttgctcaaacttcttgagaaaggcaatttctgatgttcccctggaagagattttcttgacaaaggatttgaagggttagtattttctttctccttcttctctctcctgttttaatctgaaacgtaatatttattatctccaatagataaaatacaacagttattcccccttccccctccatgtcatccttttcttttaaaatgagtagtgtctgcctatgtcaggatgattttggtgagtgaatggatataatttgcctcagatcagcccaacacatcagtcaacatcactaagtggtcaaacactccagtttcaaatatgtttctgagaatctaactgctgaaaccagggagctttgactaaatttctttggaactttggagaggaagcagggaggagaaaaggggtcgcaattggcaatgtgtttcctttttgcccagtggaaggtgttgcatatttgtttatatggatcaaatagcttcaagggtaggaggacttacagacagagtgatttcttttcttttctttctttcttttttattttctttttgaggcagagtctccctctgtcacccaggctggaggctggagtgcagtggcaagatctcggctcactgcaaccttcacgtccccggttcaagcaatcctccctcccacctcagcctcccaagtagcaggtgtgagccactaggcccagctaattttcatatttttagtagagacaaggtttcaccatgttggccaggctggtcttgaactcctgacctcaagtgatcctcccacctcagcctcccaaagtgctgggataaaaggcatgagccactgcgcctagcccccagagtgatttctaaaagggaaaaagaaatacatgttagtaacaaagtgaggtagcagaaagaatatgccactttgaaatcaaggagactgaagttcagattctgtctttctcaatgactgtgtgacctcagacaggccatttaatctctgggttttattttcctcaactgcaaaatgaagatttaaaaatatgtttatctaccctgctcctttgccagggaaattaaacagttgctaatggtattaggatgtagtaaactctctgaatgttggtgtctgcccatcccctaagccgaactaagcctttaatatttatacattagaatacctcaaccaaacgacgtaggagcaagaaggtaaaaggaaaagcatagagaacgacagatacacgtttgcaaaaagcaatacttctgttcagtagataccctcttctccttttattgttacttggttgcttggcaactttaacccgctcatccctaaaagcacagtgccacctgcaacccccaactttcaggtttttaaaaaaggaaccttctattaggagaaaattcaccttcgtggcagcgccatttgacgggagaaaagtatatgtttgaaaaggcaccccagccaacatgaatacatctcgcatttagcactcggagatgagaatatcataatatttaaatcagttttgagaactttccttgaaaaggaaaagtggggggaaaatccactagttgaatacccagggaggccgcggggagtggttaccatagcgatttcgcactggcaagtggtattggggagcagattggcatcgcttaatcctttttatttgtaatttatgtatgttggctcattctctgtgccagtccagatttttctgtttacctgccattccgcttgatatgagtgaggagcgatgatgccaggttgcagccatttcttcaatttgtcaacatcggggttcagaaggacagccgagagtacatgggggtgtcctagcactcggttttgcccgatgttagcaaagcgttgaggaaaattttgtgggaattgctgggagtgagggagaaagccatgaaattctctatgataatccagaaacggattgagacccattttggccttataaatctggatttcatcgaaccttgttagtgaataatttttattctctagtgaatgcaaaagaaaaggagatggaacacttttggtcttatctcatcatcctgtggcaaacatgatccttgaaaataaatattctgttgcctaacctgctaagtaattgtctttctaaccgtgtgtgggtgctgggttcccgggagaatgggtattaacagtgtttctcgaaccctcttcacacttcctcaggattaggccacaggaaaatgtcagtttcactgacaattaaatggagtaagttccttattctcaagaaaggaggaaggagatgaacattttctagacaccttcctttagtctcagtgagccttggactaagaaaggcaagccttcaaaatgggcttcagtagatgtcaactaataaatgttcatttccataaaatttaaatgaaccccgtaaaatctacctcttgctgtgccagagccctatctcattactcaaaatagcagcaatgtaatcattggaaaccacaccctccacggccaaggtggctggtaggaaagaaagtcatagctaatttccacacgcttgcccacaaaggtggtgaaaataagtagctagacctcttccagttctttctgctgtaggccatatctccttccaaccacatgtaccttataaattaataattttcagatgtagcgctgcattttgattaaccaagaggcagagcaaggatttctttttctctcagtacacacaggcaacagtccaaatatctaaatacttaaaaactgcacgtgctctttaagaaaatttcaaaactttagacaccccccaagacagggaccgatttactgctctagatgagttctgcgccctctttgcattttaagtgacctttaagcaatgatgacgtctatcttgttgagacttaattgcttaatcagagaaactgtttttcagttacacaaatatttcctttaaggcccatcttttaagtttaaaaagccttcatttaaatttagacacattgagatattccatattttcatcatcaacagcacaactggaaggtggtttacagaaacactgagataagcagtattcttctatgaacggtatcacagacagcgattacatgaagttttcaagtgattaaaaggcttgcagcctgtgcagatatgctcaaactcccacccatcttgaaatccagtgccctcttgacgtttctgtgagttcccagaaattgtatttttcttaatagggaaggcaatctggggttgtggataagaacttagatgctagaattcgactacctagtttcaattattgtatgtctatggacaagagaagcagcctctctgttcttcagtttccccatctgtgaaatggagaaaataataggtctgtcttataggttcttgagtagattaaaaatgttaaacttttaagcactttgaaccagggctcaccatgttgtaagtacccaatacacatttactgtaattattttttgtttcttcagaattcttttttctcaccttacctttgtagcaattcttttatcacttccctagagttaacccaaggtggacccagccctttcaccttaatcattgaccatccccaaccttcacacatcattcaaacaacagattctttattattattattattattatactttaagttttagggtacatgtgcacaatgtgcaggtaagttacatatgtatacatgtgccatgctggtgtgctgcacccattaactcgtcacttagcattaggtatatctcctaaagctaaccctcccccctccccccaccccacaacagtccccagagtgtgatgttccccttcctgtgtccatgtgttctcattcaaacaacagattcttgtagtaaacttttattggaaggtagaggtgagtacagcaaacaatctaatatttagttttagagctcccggtacttatggcatatggcattgcaccatgacatgccctgcttgtagcatatcgtactgtggggtaattcaaaagtccagtcttggtctaggctgccatgatgcttgtttccttcctcaccattctaccaccccaagaaaaagcaaaacaaacgaacaacaacaacagcaaaaaaagcacctcctccttaattagcagacttataaaattgcctgccccaaacctaaactcagcccacaacttatttcacatagcaaagaactattaatgaagttttttgtttgtttccttgtttgtttgtttgtttgtttgagacacagtctagctctgttgccaggctggaatgcagtggcgcaatcttggctcactgcaacctctgcctcccgggttcaagtgattctcctgcctcagcctcctgagtagctgggattacaggcacgcaccaccacgcccagctaatttttgtattgttagtagagacggggtttcgccatgttagccaaaatggtctcgatctcctgacctcgtgatctgcctgccttggcctcccaaagtgctgggattacaggcatgagccactacacacggccttaatgaactttttttttttttttgagacggagtcttgctctgtcgcccaggctgaagtgcagtggtgcgatctcggcccactgcaagctccgcctcccaggttcacgccattctcctgcctcagcctcccaagtagctgggactgcaggtgccctccaccacgcctgactaatttttttttgtatttttagtagagatggggtttcaccgtgttagccaggatgatctcggtctcctgacctcgtgatctgcctgcctcggcctcccaaagtgctgggattacaggcatgagccaccgcgcctggcccttaatgaactctttaaatgctgaaaacacctcgtggatattattcttttctgcccccatccatctaggtaagaaacaatggaatggatggagctacatttattatgctgtagcccggtagaaggcacagtcagctctggttttggatagccaagtttttttctttcttttttttttcttttctggtacaatggtcattcagcttactaggcagagaagtgcctgcactgggacacgccaagctatatcccagacaagtgaatgactggacttataaaaaacgctccttatacaaatgtctgacaatcacagggtctcttcatttcctgctccaatgagtttggctctggttttaagttggctacaaggaggtgctttgatctcaccttgaacatgcttattttcagtgtctggctctttctgggcaccacggatgtacaatataaaaatgtgtttggctggccgggtgcggtggctcactccggtaatcccagcactttgggaggcctaggcaggtggatcatgaggtcagaatttcgagaccatcctggccaacatggtgaaaccccatctctactaaaaatacaaaaattagccaggcatggcggtgtgcacctgtagtcccagctacctgggaggctgaggcaggagaattgcttgaacccgggaggcggaggctgcagtgagctgagatagtgccactacactccggcctgggcagcagagcaagactctgtgaaaaaaaaaaaaaaaatacgtttggctgcaagtaacagagagcccagccctcactggtctcagaccacagaaactggcttttctcactgaataagaggcatctgctctggtggttctgctcactcatcttggggtctccatggctcttttggcctcatcccttgtgcttgcaccacggtcataccatcatcctttctccgtgagcgtggcaaccgtgtgcaagacaagaggactgggtagagccaccacccagctcatctgctcttcttgccaaaaaagcaaacactttcttggaccacccctccctcttggcaggattccattagcatcttattcaccaaaattgtgtactcagccacacctagatgaaagtgaggctgtgaaaaacgtgtattttgcttctccagcccctacagtagaggaagcacagcagagagaggtgacagtgctggaggtggtgtttgctctagaattagccacccagtagctatagccacccaaaaggaaggaaagtctgagatgtacagatttgaaggggttaggattttgctgctgcgtctcaatgcttatcagctacacaatgctaagagcctgcatgaaacctcgcggaggaaaaaaaaatagttaaatatttaaatgatttgccgacatggggaacttgccattggcagcaaagatttattaagcaggctgcaaaacaagatgtcgttaaacagtttgaaggcacgccctcataattaagaaaggagaagttttctaatttgggtaatgaaatctgtggctcagatgaacatttattttattaatatttatcgtgtgcctactgtgtgccaggcacctcatgaactaatcccattaaacaacagaaaagtttccctaatgccaaatctactggtaataatagctgccattagttggacaccgacatgctaccaagcaatgtgctaagcattttacctaacagtttatcctcacaggaattctaagaagtaggtataattgctgtcaatttatacatagagtgaggaaccaccccaagtttgtccggactgaggcatttcccaggacacaggactttaagtgttaagccagagacgtctcaggcaaagtactgggaaatgaacaaagtgaggctgagtgcgggtaaatgaccaatccagggtcacagaatcggcaggtgacgctcctggaatgcaacgcaatgccacctgttacctgctcctcccaggctgcaacttgattcccaaacctccccttgaacccagaacactgaccacttcccttccctgccacttccatcccaccatctgctcttccaagtacaaaagagctgacccaaacccaaaagagctgaccctctctctgagctatagagctgtcaagaaaaatcctggtccccattggatgggcttgggtggtctttcaggggcaacagcactgcatcatagcagctgtttcgacccttcaccacagaggcctgcatgctccctccagccccttctccaggccattagaacttaattgcctgcagactgtttctcagccctggtcgcacattagtgtcacctggggagcttttgcaacatactgaagccagcaccatccatagcagaatctgtaagagtgggcctggatgtagggctttttttctaactttttaaaaaattcaggttatcttttctgcagccaagttcataaatattagtaaagttcaatggattttacataggttcacacccatttaaccacccgccagatcaaaatatgaactatttccagcccttgggaaattccattatggccacggatatggttttaaacccccagaggtgattctaatgtgatctgggcggctctaaaccagtagaatgaccctggataggtcctttaccccaactcagactcaatcagattggaacgctactggtttagagcccagatcctctgtagccagagaggatgcatttttccaaagatggcagtggctacaaattcctctctcactggacagagaagggagaaaaaaataatcctcagtagtgcatcccgctgtgtttatttgcacatattcttctcccacgacatagtgaacatcttgaaggcagaaactgcatctttccgagagcctgacaaagggcgtttgcatagtaaatatttatcaaatggagaaaaataaagaagaaatagacatgtgtactggggagtcatgtttggtctccagttaggttcctcaagtttctctgagaagacagacagagagcagcattcagtcctttttgcagtctctgctttctttctttgacctcaaaagggcgagttcaggaaaatgttgattctgggtcttgttcttctgtagagttcacacgcggtctgtgcataggtgacaccagtgacttgtagtgtaatcctgccgtgttgaaagctgatgtcaactgctaaatgggggaaagcagggcgtctcgatggtgatgtgtatgtatgtacacgtgcagccggaaaataagcaaaggactcaggaaatggatgttgtaccagcaaaaggccaccgacacttaggaatgatccatgtcgaatgcacgttgagctgccctgggtcaccgggggaggcatttcttttttaatgtataaaacttacaagtttgaaaaatacgtatttagcctggagggcagttaaaaagactttattgtgtcagcatccccagatcatttatacatttttgtgcccacatattttattcataatgtctattttattcttctttattttgtcaacttggtgttcgacattactgtttctcttagaaaacaaccccgttatcggaaccaggccacatgactgtggataaaggcgagagcattgtcgggcaaggttaaaaatcagcacggtgttaagcacctgggagggcttcatggtttgggcttgagtttattgttatatggttcctgaggccttgcatcggggcagcagttggggaagagggctgcggttttaacaatgacagagaactcagggggcaaaagactgaaggccattcaggttcttcacatgaagggaggaccaaggtttgttcgccaacaggcaagacagagcagagtgctcacatcacaccacccccgaaaatggcaaatagagcaagatacaaatcactggcttctcaggaattatctggacagcccaagaggtcttgggaaatgactgccatgagctgagggctcaaaaccttatatttattcaaagaacgactgccctgttgctgtcaggtcacacagattgttgggctacttcaagaagtgtttcttctgaaatcaggttctgggctgaagatgtgagaattttaggatattagctcttgtttctgccctcccaccccacttctataccaaagcatgcaaagcctttcactgaatgcaatgaaaaaagaatttatcaaaaaggaagagaagcaaagagaaaggagaaagaaaagaaagagaagaggaaaagaaaggaaggaaaggaagataaaaggaagaaagagaagaaaccactgtacattagacaagtgttaatgggagagttcaggagaaggagttttacaaataagaagaagacattttattctccagggcaacaagcatgatgtgtatttccagtatatgtcatgtacatctcccaaattagcatgctaccaatggagtgatatcaccatattaatattgctgcttcttcaactgtgtcagcctggcttttgcaacacacgtctgtcagccatgagatgttggatctcagtgcatctaaccttcctgtcattcaaagtcatttgaaagtggaaagagtaggaacccttctgacttggaagggcatttgcagaccttcctttagtgtgctctgtgtaacatgaatcccaaaaccgaggaaacaaaagcaaggagggctcatgatcaaatgagtatggataatgcttttaactccatctcgttattggacattcccagtggaagtgagcaaatgaatagctctgaaagccactgaaataaagaaaattgttgagcatctaacatagtacctcccaactctctctgaccatggaatgttttttctccacctggaattcttttaaacaagtattctaaagaacatgctttgaaataaaagcaagagcccaggagacaggagacctgactaaagactaaattgcctttgcaggtcagctagtccaacgtttcattttagagataagaaaatgaagaaacagaagttgtatggtcagtggagggtcacagaggcagaattagaaccaaatgacccagaacaaatgcatttacctctgtgggcctcagtttccctgtccctattggactagatcagaggatatcaactagtaggccttgaaacagtcttagatgtgtcacctaattctgaataatgcgtgtatttgtagtctgctgctgtgaaactaattaccccaaacttaatggctttaaacaacatgtttattatttcacagtttctgtgcataaggagtccaggcaccagttaggtgagccctctgcatcaggatttcacaagattgcaatccaggctttggccagggctgcagtctcatcagaggtttgactggggaaagacccacttccaagctctcacacatcgatggtaaaattcatttcctttcagctctaggattgagggctctggtttcttgctggctgttgactgatggctaccttcaactcctagaggccatctagtattagacctccaccatgtgggattccccaacatgaccatttacctcatcaaagccagcaagggagaaagagtctctttcaagatggaggtcaccatccagtgcattataattatgaaagtgacatcccataaccttgccgtattctattggttaaaagcaagttacaagtcccacacacactcaaggagaagggactacacaagaaaaacatgcacatcaagaaatggggattataggaccactgtaagagcctggctgccaaaatgtgcaaaatttatttttgctgaaaatgagtataccattacagagatatttggtggggtagaccattgtgctgagatgatcatctgatgtgctgtaaagcaaggtataccttgcaataagctaaaagtaagaattatagcacagagcagaattgcatctcacaaggtgtaaacttctaaaagcagctcataagaggaaaattgcctatagtcaaaattaccattaaaaatcttttaagccattcataaagtacagtgcacttattttgtgtattactacattgtacattaccttgaactgtaattcttatgcagctgaagtttaaaaattattcagccagactgaaggcatgtctatacccagaatctgggcattcaaaccatcctgcctcaatataaacttctaacagtaaagcaaatatggatgaagaatattaaagcatctagcctccagagattatttcattctgttttaaaagtatgcttcagaaaccttataacatgctaataggtttgtttggttggtgagagttaaacaagataaaacacatgaaacaaatcagccctcagcctggcacacacagtgggcagtgaatttttgcagactgtgaacgtgcatcttgatcagacactcagacacacgtacactgccttttgaagagctgcagaaaacaacttggccacatgtgtcctgcttgtccaagatggcattttcctctgtagtttcccagcagtttccactctcatgagcactgtgcccatcttcatgaggagaagattctatagtcaatgccttatttgaatgagcaaacaggacatcttacctgtagtcaggcatggtggctcacacctgtaatcccaacactttgggaggcggaggtgggatgatcacttaaacccaagagtttgagaccagccttggaaacatagggagatattgtctctacaaaaaataaaagattagctgggtatggtggcacatgcctgtagtcctagctactcatgaggctgaggtgggaggatcatttgagcccaggaagttgaggctgcagtgaactatgatcctgccactgcactctagcctgggtgacagagggagatcctggctcagaaaaataaaaatttttttaaaaaaaatcttacctgtaatgatgcaactgcactcacatgacaagcctacagtaagggaagatgcggcggagtgcaataaatatgtctcatagatatataagcacataaggacagggcagtagagcatcctacttagcagggtagcgcagtcaccctgaactcttttacaaatatcaagagacgtggagacattgtaacggaggctgcctggtaactaatcgctaacttgttcagtttgggtgaaatctgccaccagcatgtctgtcttttgacgatatgtcacacacacaccaaaagggtgcaaaaccctgaatggcagtgattgttcccttatctttccttccctaaaaagaattagggttctaagtctggtgtcaaaaattcaaaagcgacaggagccaggcaggtaatgtatatgagaagaggagacaatagagagggaaatggagtaggtgaaatggcaccagtcgctctatctctctaaaagaattcaaatttggagatttttccaagcaccgcgtgggtgagacataacaggcttacagctggattcagccaatgagcacgctgttccgagttcttaattaagggcctgcaggtggcaaggtctgtttatattgtccccaaaatcctagattttaaaaaaggaaaatatgatgaccctgtgtggaaacaaaatagtagattttttgttgatctgaccacactgaattattagagatttggggtgataccacattcattcttgaacttgtagccaaacacctctgagcaaggctaggaggagataagatttttattttcattttctttccatgaaggactgtctctcagcaactctcactactgttatcccatctggttgtaagtgaaatacagatttggaatatcatttttatctgcacatatttaaaatgtaatgtccaaatattatgctgtttgaaaagagacacctgtccaaaaaattcccgggaaggtttcagagagtgcacttaagctcagatttagacacaagtaaagctcatttttcatttagcagaaaccttcagactagccaagacttggaatacatgctgaacattttgcaaatacagcaatgcctcatttatttgacgtggactgttccatgtaaatgcattttccacataactgaagcttatcccattgcacatcaaatcatacatttattttagccattttgcatgggaatatttctgagagtgcattacacacttccctacctccttaaatagaatatgagaaacataatttaatctttgctatctgactcagggtcatagtcatgaatatcaagtattgggctgctttaggctgaaataaagggatgccctggggtccctacagcataaaaggagttgtttgacttcactttgcaggagctgaggtttccacacttttgagagtgtgcctgccagctctccatctcatccttcagtgctctcattatacctaaaagtccttttgttccaaacctctttaaatttgtctcgtctatggaataggaaggtaaagtgaagtgccttacttggctgaccagaaaccctgggttattttcccatttttaatacattcttgtactttgttaacctgcacaagctacttgaccctcttggcctctgttccacaatctagaagtgagagaattaaacacattgtctaaaatccaccgaatctgcttccatttgcataattttatgtgatctttggctctgaaatgaacaaacttgttaaaattgtgcttaaacatagagatcgtgggtcccaagtgagcacttcaacatccctgttagaagcagaattcactggctgtgtattaccttatttgtttattggttccattatattctacattgttgaagctgtcaaagaagtgaccactcgataaattgaaatacgatgctggccaggcacggaggcactttgggaggctgaggtgggcagatcacttgaggtcaggagttcaaaaccagcccggccaacatggtgaaaccccatctctactaaaaatacaaaaatcagtcagatgtggtgatgggtgcctatagtcccaactacttgggaggctgaaacaagagaatcgcttgaacctgggaggcggtggttgcagtgagccaagatcacaccactgcgctccagcctgggcaacagagcaagactctgtctcaaaaaaaaaaaaaagaaagaaagaaatatgatgcagtttcagttatctattgctgtgtaactaatcgaccccaaacctagcagcttcaagcagcaaaggtttgttatttctttgatttctttcattctgtgggtcaggaattcaggcaacattctgaaacagcttggtggggcatgatctggagaagcttccttaatttcatccacctgcaaatgggctgaactaggaggtcaaagaagtcctcagccacatacctggtgctccatgctcctccacctgattgctctccttccaatctccttacgaacagtcttatttcataatgtagtcctagctttttttttttttttttttgagacagagtctcactgtctcccaggctgaagtgtagtggcatgatctcagttcattgccaccttcccctcccgggttcaagttattctcctgcctcagcctctcaagcagcagggattacaggtgcctgccaccacgcctggctaatttttgtatttttagtagaaacagggtctcgccatgttggccaggctggtcttgaactcctgacctcaagtgatcagcctgcctcagcctcccaaagtcctgggattacaggcgtgagccaccacacccggcctagttctagcttttttgcaacatgaaggcaggcttccccaagggaaagcaaaagctgctaagcctttaaaggatatacaagaattgacacaatattacctctgccatgttttattggtcaagtcacaactcaaggagattcaaaaaaaggagatgcagaccctacttcttgatgggtgcagttccacgcatgtgtatgaagaagaggaattagtagctgccatctttggaaatcgctacactcttaagacatcttcacattatactttagaagactaaaggttttctttcaacatcaaaactattaattagttttgatgtgtgtgcctaatcattttcttaagtagtgtagatttggtaaataacacttttcctctgggaaaggaataaaaagacaatccacacttttaattggatccttctcttgaagtgaattccaagtctgtattttctcttgtaaacatacagcaaactttccacgttttgatcctgtacttcatgaatcaaagtgaaatcttgggaaagaaaacattacctctttctgaactttgtgtataggcgtgcttgcctttggttgttgtcaaaattctttgaaagtgtttgcccaacaaaccaaattaaataactgcgatattctatgtgctctcttgtcaaaggaagataggttcctttctcctttaggtttttgtggattcccgttttttgtttgccctgttgttcatttgttcagttacttatgcagattgtctcagcatattctatgtgccaggtttttaaaacaggcagtgaacaagatagacatcacggcgctctcatggagctgatgttctagcatggaaaacagataataaataaataactaatccattataattgcaacgaatgctatgaaggaaaagcagaaagggtagaagctagattttaggggcctacgttggtatgagaaatacacagaggcctcctagaggacgtgatgtttcagctgagctctggaggtgggtgggtgttccataggtgaaagaaccatggaaaaaggagccgaggaggacattccaagcagagggaagaacacataataagaccccttggaagggaatggaagctagtgggttcaaggaagtgataaaatccagtaacagaagccaggatgaagatgtgtgtgatatttaaactaaagtagccatttaaaagttgtgcaaactaaggcatagtactcaaactctttgagtcttggggtaaggaagagaaaggaaaatgatgtcaaccctcagtcatccccactcacaaagaggcacaaacggaaatctcactcatcacttggttcattgttgttgagcttgtaaatgtattgataacttctcctaagtgccaggcattgtattacatgctgggagcacaaagatgaataataacaataggttcacagaaaagatgaattgattgagagaaaaagaaccctccaggagccctcagcgtagtagggggttggtgttggagggtggaggaatggaaaaggccctgaaatgcaggcagagaaatgatgaaacaattcaggggctgtggtgaggttaaatgaatatctttacagcagcctcgaagactgatcaggttactataccctctcttctgtccacgtgcatttcaaaatagtattttatgtttaaaaatgacaaaaaaaaaaaaggatgtacactggaaataaaagaactttctaggttttttgtgaaatatgtaattttgggtaagttcatcaaagctgaactcattttgttactcatttacttatttatgtagagattttgggtgagtcatgctctcactgcaaagttaagtagttgctacaggacccgtatcacccacaaggctgacactatttactatctggcactttgcagaaaaaggttgccaatccctgcttttttggtgcattcatccttttcataaggagaaattgctccaggtaaaagtcatcacaataaatggtttcttttatttttttttaataacaccctgtttcaatgagctgcctacaatcccaccattaatgcttcagtgttttggcttaatgctggcttcaagtagttcttttcaagaagcaaatacccctgagagcagtagctcattatttagctaataacagtgtgagaaagcagtgtggtgtttagcaaaaggcagtggtccaaggaaaaggccaccaatattcccaaatgcaacaatgtctagttttccagtctgatttcccagagtgaaagaagctcgtgtagtccaggccacaggaccaaaaggctcctgccaggctgaactccctagtcttgggcaaaatatgctggggacttacttatcctatttgctggatcccaaagaatcaaagataaggattagaatggttgagttcacacagagaattgttgattatgttttatccttttaaatatgtgtaagtcatagaaagctctgcagtcaaaaatattgattgcattgatctctgccaaccacagaagcatggggctcatgtgggctgcagtggaaaggctgtgaaatacttaaaataaagacgttatctgatggaagatgctttcctcctcctctcccccaccccagaagcaagtttgaactgaaaatgcacaaatgccagtcagcaaaaggaaaaagtacttttgcagctccatttaaacatcagcatgcaggcctcgagtccagcagcacgttccagggcagcaagaatacaaatttctgcagcatgcatggattttacaagaagagtgtcggcgtgaattgtattacaaggcctgatgagcaatgttggttttcttacagagagcagcccctttatcattcaaaggacattgccgatcaaaaaccctctttttgcacacacagcccatgttctggagcaaagtatttacgcatcattcccttactcggttaatcagccctctgttctgcagggtggagtccctactttgggtcagcccctgtgctgaatgttggcaacaatgtctatggcctcaacaagtctgtgaggaaagatggacatcaatttgaaggttctttggtggcaaaaattttcatcttgttggtcattctaagagcacaaggccagacatgtagtaggggttcagccagtatgtgttaaacaaatgactagatgaacaggtcgaatgtaatacaaggaagagaaaataagcttggatcagaaaaataaacaactaacagccagggaggctgggaagcctccagagaccaggtgagatttgatgtgggccttgaagaatgcctaaaagttcaggaggtagagagagaaaagggcatcttagaaagatccttctggtaggagagggcaaaggatgggttttcccaacccctttctggaaacaggcactttataaatcaatacagctaaggctccccataaatgcacccaaaccttccagaattccacgcggaaacactccccaaaggcattcagaatgcaccagagcttcatcctgctgccttttgcatgatttctcagggcctggcaattaagacaattgtttcatcttgtgtgatgatgtgaagaggatccaaggagtggcagcatatcactcccaaactagcttaggacagggcaagcaggtacagcacaaatgttgcacagaattttccaggtggagggacagaggaagatagaaaaagttggcatcgtgggcaggaacacaatgtagcttccctgggagaagaagggacagttgctaggctcaattctgctcagcctttactgaaccccaccaggctgggcaccatgcttggcaaagggcataaaacaaggaagtcagcagagggggcagcttggtacagttagtgagaacataggctttggaggtaaatattctgtatcaacccattttcatactgctttgaagaaatacccaagactggataatttataaagaaaaagaggtttaatggactcacagttccacatggctggaaaggcctcaaaatcatggagaaaggcaaaggaggagcaaaggcacatcttacatggcagcaggcaagagagagtgtgcaggaaactgccctttataaaaccttcagatctcatgagacttactcactaccatgagaatagcacgggcaaggctctcccccatgatttaattacctctcaccaggtccctcccatgacatgtgcaaattatgggagctacaattcaagatgagatttgggtggggacacggccaaaccatatcatatgcattcactcatttcgttcagctaatatttattgatcacctgttatgctgtaggcactgagtacagttgtaaaaaagccaagtataagtgctgctcttgtagaatttatgttccaggagagaaatgcaataaatattagtgcttactacaggccaggcattatctccagtactttgtatatgcattaaatgttactcacaagaaacctttaagttactatgacactcccattttacagatgaggaaactgagtttcagagagtttaaacaagagttagaacacagatacaaggattggccttcagagtctggccgttaaccactaggttgtcccatcacaggacagagagtggacagggtttgggaaagggacagaatgacccaggaagccccctctgagcagtgacatttgggctgtacccaaatgagaaagagccagccatggctagagtttcatgacaaggctgagagtggaatggagcaaagcagaggggacggctgtccggatctcatgtgggctctgtcacttactgcttcatgcacttaagctatttaacttctctgagtctcagtttagtcatctaaaaaatggggacaaaatctttaagagaatgaatgcaatgcactcacccaaagcctagagcggagcaagcactcaacacatgtggccattattcctgttaacaggacaattgcttctctgcagaatgtcacagctgagagagagactgattattactctacagtgtggctagataccaaatgtttctcatttcccggactcactgacattctgggtgtggtgcacttctagcatttgctttcccttcttcatgagaaagcccaatcaccctttctgggccatcaacctaaacctcaatggccaagcatctttctgagcctatgcactaccatcatcatcactgccaacactgccatcatcatcattatcatcgttacggtcattatcttcattgtgaacctcagcaaagcacgtactgtgtgccaggctttgtcctgagtgcttgacccttgttctcattcactcatcatagtggcttctaaggttggtgtattattttccctgttttttcaaatgaggaaactgaggcatagggaggttgagtaacttgcccacagtcacacagctaggaggtgcatctgaactgaggcagtctggatctgctggtcctgtctagaaacactatgtttcccatcttcaggatttttgcctctgggcaatattttcctgccactatttgcatcagttcttttcattgcctcaattcacacttttacttaaatgaacactttgtaaaaccacatcctagatgaaaatcagtcatatttgtcattaaaaagggagcactataacaatgaaaatgcaataacaagaaaactgtagcatcaaaatcctttctagaagtgttgctggtagaaggctcagagcccacggccagctctttctttgcagaaaggggagataacaagtgttagggggtgttaaaaacacatcagcacaaagctcaccctttgactcaacagaaaaaataaaaaagaattaaaaaaggaattgtcctactcaactacctgtcttcctccagcattccctcccactttgggagagactgaagtagaaggggtttggggcctgtggtcgggggacatgtctgtaacaagctgtgtgtgcttaagcaagaccttgtgcctcctctgagtgatgaagacatcgttccagtttagggtcatcatcatcaagaagcaattagctggccagtgcccatgtacgataaacttttctctagacaaattagaaacataagtcccagtagaaatgagatttccataaagttacttttagtgaatttaatagactctttcttggtctgaaattcacccaacaacatgcattccacaatttttgtggagcaaccacaatacaccatcactctagggcgcaacaggttttcaataatgaaattgttccttcttactttagaaaaatgaaaatatcctccatttttattacacaatgttcatagtaattcatctttcttcttttgtgtgtccatctttagcaaaattaaagtttggtcccttatatcattccttcatattttttttctggaaatttcgctggtctgtctcttatatccccaaatctgagaactcctggactaagtgggtccctctgggctcaagtatgttggcatccatttgtgtgatgctttatagaaattccttgtcaggtgcggtggctcacgcctgtaatcccagcactttgggcagccgaagcaggcggatcacgaggtcaggagttcaagaccagcctagccaacatagtgaaaccccatctctactaaaaatacaaaaattagccaggcatggtggcacatgcctgtaatcccagctacttgggaggctgaggcaggagaatcacttgaacccgggaggcggaggttgtggtgagcagagatcataccactgcactccagcctgggcaacagggcgagactccatctcaaaaaaaaaaaaaaaaagaaagacattcctaagccagcagatgacaaattgagtgaagggaggtggagacaccaagcaaattgaagtctgatgcctcatctaaaggagtggctgcttctcacctctggggaattgttgtcatggacagtgtggacccggtgatgcctgatctcatgtggtctcaagagaaggcacaagcctgattttcatggggagtccctgtgagctggatctggtggatgtgccacaagagggccgccatcccctgctttttttcattaactggcttaagtcatgtcacagagacaggtggtaaaaggaggcagcagggatgtcatggagaaagcttggactttgggccggtggatctcagcaccttgccattcatagctgggtgaccttgggcagaaaggacaacctctctgggactctattttcctatctgtaaatcagagatttttattctacttcctcaattttattcgagatcagaaataacatctagtgttacaaggcagaggacagtgattttattttgtaagtaaaagacttgagtctgagccaggcacctgtaatcctagcactttgggacgccaaggcgggtggatcacttgaggtcaagagttcaagaccagcctggccaacagggcaaaaccccatctctaccaaaaatagaaaaattagctaggcgtggtggcaggcgcctgtaatcccagctactcaggaggctgaagcaggagaattgcttgaactcaagaggtggaggttgcaatgagccaagatggcaccaccacattccagcctgggcaacagagcaagaccctgtctcaaaaaaaaaaaagaaaaaaaaaacatgactttagtcccgctcttctgttctcattccccatgatcatttctgggtgccactggctgacctttttctagctttctgcctcctcttgagccagtgacaaagcccctgaccagtgactatccaaggctttccaagcccaagctgccactggggagggccctgatgcaaatgcagggagctgggccttgtgtttctaggcctggctcctcttgagcccagaattcagtataaagccatcttcttggcaagaaggcaaacacccacgtaaaacgctagcctacaggaaatcatgactgcctcctgcccaccacggaagtaaaacatcaccctgttctcttcctggagcctctgtgtttggtgctcatggaaaccagtatctttggggctgtgagtgaataagctcaactcttagcagatttgcctccagggtgggttgtagaagaaggtaaccagccttcccagtttatctgggactaagggacttactgagatgccagacttttctgtttaaagccacaaaagtcccaagcaaatgggacaagtcggtcaccctgctccagatcttgatatggaaaaagcatgttggcctgggagaagattctttccagctctaaaatgtcagtgctgtgagtccaggtgtgttcttggaccccaagccactccttggggctgaggcacctatctgagctgctaagccagtgcctgagagccagaggctggcacacatctgccaaaacagacagtactccgggtgactcttataaaatgaccttccttggttcacaaggtgacatcgatttgctatcttggcttgagtctctaccttctaccgtgtgaagtctgtagaaagtgccctggaaatacttgtttgatgaatgaatgaatgaatgatgtagttaaagtttaaagttttaatggaaaaagaaataggtgaataaataaataagtgaaaggatgacttggtttcagttctaaggattctttcttcccatcaaagccacccgttttcattgccttggagggcttttttttttttttttttttttttttttttttgacagagtcatgctctgtcatccaggctggagtgctgtggtgcaatctctggtcactgcaacctccgactcccaggttcaagcgattatcttgcctcaccctcctgagtagctgggattacaggcgcacaccaccacacccagctaatttttttgtctttttagtagagacaggttttcaccatgttggccaggctggtctcaaactcctaaccttaggtgatccacccgccccggcctcccaaagtgctgggattataggcctgagccaccatgcccgggctcctcggagggctttattacatcctcttgatcacatcatttaagaccaactgacttggagtaaatcctgggctacaggggcagacgggtagggcaagtcctggctcttgtggtccctcctgacctctctggacgccctgttcatctgtacacagagctgcaggggaacttcccagtctccttcactaacatgcgacggccatccctcaaactgggctcctgtcactcccttccacagcaaacattttctttttagctccggcgtttttgagagaatgcctccactcacaggaatggttccagtggcgggatgctcgggtcctaagatagagatatatgagtgaggtttttgtgtctcggaatcatcagagagcaggcagccatctccactgggcacagcactcatggtccaacagcaggcgggtccagtgtagaagccctaggtaggatgagggagaaggaggcagtttccttttctactttttgtttttggttttgttttgttttgctttgttttttgagacaaggtgttactctatcacccaggctggagtacagtgatgcaataggagctcactgcaggctcaaactcctgggctcaagcaatcctcccaactcagcctccccagtagcagggagcacaggtatgcatcactatgtctaactctttggtattttttgcagagatggggtttcaccgtgttgcttaggctggtctcgaactcttgagctcaagtgatccacccacctcagcctcccaaagtgctggacagattccttttcatcctcaaagcctctgatcacatcacctcctccgtgaagaccttgctgacctcaggaagagctagtagctctttctcctgtaatcctgtggcactttgcccatctgctatgattttgatgcattacaaaatgtattgcccctactattctcctctattagatcaagagcacccgggatcaggaattgtgtgcccaggcttcaaccctgtgtcgggacagccagttttgtgctcaacaaaattggctagttatatttgtaagctaacaaatagccaaagtaataataaacagagtgacaacagtcaatgcaggtctagccaccgccaaatgcatgaatctggcagaattcctgaggcctaattatcagggaaaagacttggcaagtggcatggaataatccagaagcagtgtttggtcttggttaaactgtcttacgaacacagggactgtgaaaatggagatccatgtttttccaccagaagcattttatttttctatgtttttcttggttttttgattcttatgttgtcatttccctgagttgagatctccagcagttcctgaattttcttggagcactgctctgtgcaatttcacctgacctccttacatctctgaggggagggcttgatttaactagggtattgatttaacagggactttccctgaaaatctagatctaaaaagtcatcatcttaatcattagtaaagaggaaggtggagaggcagtgatgggttgagagccctggggaagaagctgcatgtgtggacattgaagcaggcctgggagagcagctggccgttgcgtgtggacaccactgccttccagtgaaacacagggcagttcagctcagggagagtcactcctcccctgggcgggacttcagtgatgggccaggagtgtccacacctgggttcctgccatgaactgccttctagaagctctccttaaggtctacacatcgtataatggaggcaagttgctgcatgagggggaactgctttgtttgttgtttgtttgtttgtttgtttgtttttaactgtgtgaagtttttgtaccaatggaaataggaggaagtaaagcaaattaaggccctcccggctactttagtatcttttttttgttttgttttgttttttgagatggagtctcacactgtctcccgggctggagtgcagtggcacgatctcggctcactgcaaactccgcctcccaggttcaagcgattctcctgccccagcctcccaagtagctgggattacaggcatctgccaccacgcccagctaattttttgtatttttagttgagacaggattttaccatgttggctaggctggtatcaaacttctgacctcgtgattcccccctcctcagcctcccaaagtgctgggactacaggcctgagccaccgcgccccacccaaccttggtatcttaaagcaagtgtcttacacctgcaccacccctgctgcctctttctcggctttatgctttgagaatgggagagaggactgtgcttgtcacaagagaatgcattgctaatggtggaattttagatattagaggaacaatgacttttgtcggatttgtccccatccattcacatcagcaaatattccatgattgcctgtgatatgtctaagcaaaggaacttggagtgctgagcaaaggaagacaagacagggacttctatcctggttgagttgcactattaatagataagacatctcaggccatagatagttaagatctcagtatttacaaacttatcacttgtaatttagtctattcctcagcaacgcccatgatagaggtgcagtaacttatcttttagctgtacatgaatttgatttgagctgcaatattaatgggaaggggtgattcaattggtcactaagcgcctctagaaagcccccccggcaaccacctcccaataaggctttgcctccctccatgcatcactgtgtgcgccatcatgctgatgatgtggtataactgtttggtagtggagatgtgccatcgttggaggaggaaatattattagtaagagctgaaatatcttattgcagaaaggtatttataggaaatgtgtgactcttgaagaaagtaagaattaggagaaacccaggagcctatatcagcaaacctctgttcacaattttagtaatctgggaaaatcttacactacctgccttgcaaactggcgaaaattagcaggtctacaattatgatgatcggattctccgagatgaaaattaggtcccgtgatacataagttcagatgtccctggaaagatccaaggaggaaatatttgaaatagagcttgttctggaaaatatttgaaattgagaaggttgtggaaaccgtacatgcagcactgtgcatgcagcaggatgtgtataaagtctgatgaggacatagatgagagtgcttgtgagcccacattctcaaaccacaccaagtacacagcccctgatagcgagaccaagcttgaccatccacatttgttcattctgttgggtagaatttatcaaaccagaacatacaggtcacaagttgttccttcaatcaaggaagatcccctcgtcatctggacactagctgtgggatgtcaaagagttctcaggcccctgagtaactaatgacgtacagccattaactctattatttactagaaatgacagatgcgtggtggcgggtgcctgtagtcccagctactcgggaggctgaggcaggagaatggcatgaacccgggaggcgtagattgcagtgagccaaaatggcgccattgcactccagcttgggcgacagagcaagacgtctcaaaaaaagaaaaaagaaatgacaaatgcattggtccaaaacctacagtgcttcctggaagaccttccaagtgatgtaacaagggttatcttccagagatgcgatattagtcctgtgattgcctgtttactcattcattgatacaataaatattgaccgagtgcttgctatgtgacaagcactgagctagggctgggaaatcatcagtgaatagtcagagaaagtccttgtttgcaagagcatagactctagttcgaggagagaaaatgaacaagaccacttcagggtacgataagagctttgaaggcatcaaaacaggctagggagcctgggtggaaactagtgtaaagaggatgacaaggaagtcctgaccaatgtgagacctgtgcagtgaggagtcagccacacggagagcagcaagggccagcagcccaaggcgagagtgcactttgcatttgaggaacagaaaggtttcgtgactgcagacttgtgaatttggaagcaagtgggaagaggccaaccagggcctgacccttggtaaagatatgcaaagtgaagccttgggagtcatttaaagcagggggctgggatgtgtgctggttatacattgagggacgataaacctgacaatggtgctcacccttagagtccaacacactcttccatcatgaccagtaggaggaaatgtgtgccgagattgctaaatttccaagattgcatgtaactcccagcatgcttcatctgtgctgtattttataaaatatctgcataaacagaaatatttgaaatagagcctattctggaaaatactggaaattgagaaggtcgtggaaatcgtacatgcagcactgtgcaagcagcaggatatgtataaatccaactctgtttgtaagtagttggaatctcagcatttacagacttatcatttgtaatttggactctttattcctgagctactcacattatagaggcatagtaatttgtcctctctgcaatgctgatcagaaacagtgatgtgaaccgtccggaacatctgtgcactagccaataaatgattgaatattgataagccattgataattgattattcaacatacagaatcagtagcaaagcattttcttgtctaatttgatgaggaattagcatctttctattctaatcataagagcattaaaaattatattgttcctttttcccagtggttgccaggaagctcatatacgaagtgaatggttaatcacagtagccattctaatttttatcattaagatatttgctttatcctcctttttaagctttttttatttatttccattatatatcaccttaaatctttttgtagctaaaggtggaatatcaatttttttaattgcatgtttaaagccataaccctggcctgcttgatagatactttagaaatgttatatccaccagtggcagggtgtgaatagttaattgaatcagcaattaaatacatcattatagataatttctagaaaatgttaagcttcaggactttagccaagaatgtatcacccaggcaagtaacatttctactagaaaatcaggttctaccataaattcaaggtctgactattgccatcggaagggtttcaagcttaatataaaccaggaatgtttctcatcactcgaatgcatttgccaaagaacttcaacttctgtctcctttcctgttgaactttaaaaaccggagaggcaactgtctgtcgagactgttttgtctagagcagggctggaggcaggaatccagcattataagtttcaattcttggtcctcaactcaaagctttgggaagcaccttcattgtaccctgttaatcacaaaattaacttaaaactaaaagagtctgtcttctctttgcttcctacaaagcaggatgtatgggggcggtgattatacacagaccccaggactgtatttctgtgatctagcatcgaaaaccatttatggctgaatttaactccggaaagccctgctttctcttttcttctgatcctccatatcaatatcagtctgatgactctggcatttactggcacagctgaccgtaaacacactgcagccattaaccagaaatcacccacatgtgggatttggtcataaacatgggccttgcgtctagactaattatatggataatggttgtggggggcgggggagggcgtaaaaagaggaagaatgccaaaatctggaagatattctaggtagttttccgtaacttttctaaaaacaaagaaatcagctaaaaacagcaagcactttattttttaataatataactaataggcatccactggaggaaaagaaagagaaagagagagagagagagacagggaggacagagccaggccaatgttaatttgtatcactaacattttgggacactttaaggtttactacaaaaattctagatcagggttgatacactgaaaccctcaggccaaatccaacccactgcctgttttataaataaagttttattggaacacagccatgtccatttgtttacatgttatctatggctaatttcacgatacaatggcagagttacagagaccatatggtatgcaaagcctaaaatatttctttattatctgcccctttccagaataagtttgccagctcctgatctagacttttttgtctctacatatttatcttttacatagtctttcaactttttttttaaccttttggcttgaaataattatagattcataagaagtgcaaggaaatgtaagaagaagcccagtgcaccctttccgaagcttcccccagtgcttgcataactatagggcaataacaaagccaaagctagttcagatttcaccagttcacctgccatcatttgaggtgatatgtaggctttttaaacataaaaggggtatgaaatacaatgcctttaacgttaagagtgataataatgagaagccttcaattgacagactgaagagaaagaaacgtgaatacggttagtgcagcctgagaatctcctaagagtccgatatgatccaacagtcctaagaaaaccagaactatttcctctgtaccagtagtcactcctaagtcataacagccaggacatttaggtggagattgtatgttttattttctcctaaacttataatcctctctactttccttcttctgcatccccatcatcttgacactaaaaaaagaaaaagaaagacagaaaatgtgtgcatgaaatgtgaccagggaatcaaagatgacagagctttgataaggtccagaaagtctcagcccctccaaagcaagcgattaaagagaaaggtgacgttcggtttattcaaatatgtttatctgacatctgtctgggtttcatctgaagtgtgtaggctccttctggatccttccccacaagagcctggcttcagtatcatacactttgcgtgggatgaagttctcaagcctcaacagctaaggaaatctgccagggtgtctggcaaactgtgtaagagggagaaacaccccagctctgaattcagcctgctgtgaattatattataaccaactggttataatatatggacagagttaccaggtgtctatgcgggatttggatgtactaatgtttgcttgtgttgagtgaggctgggctaatgagcctcggttacaggtgtttgggagaagtatgaatacagttggtagggcatagtgataaagctttgctctgttttgtttttaacaaaggctacttaagaagctggaattataaagcattgtggtctgagaaatttatagggcagcttgaacggaaggtagtaactaaccagggagaagccacggaaagctctgaatcctctcctggacaccagagggtgtgccagaaaagcaggcaaaaaccgaggtgcttggttcttcttccgggacctggtgggggccaggagatttaatgtgagggagcacagccgggccagggggaaccaaaatcctgataccaggtggcaccgccaaccatgcacgacctctgaggggagaggggagagggccaacaggaaagccaggcaggagccagaagaatgaggagcacaaaagagccaggcgtagagaatggacagtaggtgtcagaccctggtgtgtgtgggagaagtgaccaccatggctcaacggaagtcagtccctcagccagatgatgaatattcactgaattcctgctgcattagtcagagtcccctaaggagacagatggcaaactcagattaggaaaagggttatgacaagcagaatgttttcctgggtggagtcggggcatgtgagagaaccacagggacagggcaggaaccccttcctggtggcggcagagctcttgacacctctgggcttgatgggccaaggggaatggatgatgtttggaatctgcaaatagaaagtcatttggagagaagggacagtgactctcggtcaggggttggaacaagcttgagggaagtgtgcagggatggagccaggaggacagagactccatcttcactgccctcctctggggtcccattcactgaatacatctgaagccagagggcaaggaggcctcctgtgcagaaggcagggtggggaagggcagatgaactggagcgcaccccactgaagattctggcatggctaccacatgccaggcactgtgctgagcctgggactcaccctgccgaagcctgaaggcaaaacaaatcatcatgactgagctaaagccatgaagaggccccagtgctctggaatcacctaacaaaaacagctcctagcctagtcttggaggtccagaaagatgcctctaaggcttgggcattagctatggaaagaacaaagaagaatgtcaaaggcaaaggcaacagcatgttcaaaggtcctggggtgcaacacagcatgtttcaagtcagaggggaaaaggcaagaagaatgaaaaagacgatggcagaacacagggcctgatcacacgaggccctgtggctttttaaggaattcacacatgatcctgtgggggatgaggagaacccaaagtattttaaatgcagaatggattttaaagggtttgtgtgtgtatgtgcacatacatgcaggcacgcatgtgtttggagtggtgtgtgaagctgaaagccaaatggaatgacgaggcgaaactggagatgtctaagaagcccgagtgtgctaagctagttcaggctagattcaggaggaatcagcttgtgtaccaactttttccttttcttgtgtagtttgcactgagagatctttagctgcaagatgagaaggcgcagagacctgatgcctattttcaaatcctggcagatgcattataagaaagggggactcaatttgttttgtacagactgttccttcaagaacactggcatgcaaaacctactgcatctggtgccagcccagccactaccacctcttcttttactccttctgacaggccgagatccttccttctttcagctcctgcattaactacactggtgtgtgtgattctctctcccagatcttcctggggctgcctccttctcagaactcagatctcaactcagaaggtatctccctcttctatcccataagctccatgacatcaagcatgtcatttgtcctgctcactcttatattaccctcagtatctagaaaagagacacctatgttgtggattctcattattttgttgattgaacaaatatttatttagagctttgcaaaatctgattaaactacctaggaaatactgagtttcctaaacttggaggtaaagaagtagggacaagttggttagagagagcattgagttataaaagaggctagatcgcagattgaaaacacaattagaggcctttgaagaacaatctattaagcagattttgaagtggagagaaggagatgtcctggttgaatgggagttgggaggcccagagcactcctccagatctctctgccaagcatggtttctttttttttttttttagatggagtctcgctctgtcacccaggctggagtgcagtggcacgatctcagctcactgcaagctccgcctcccgggttcacgccattatcctgcctcagcctcccaagtagctgggactataggcacccaccaccacgcctggctaatttttttgtatttttagtagagacggggtttcaccatgttagccaggatggtctcgatctcctgacctcatgatccacccgccttggcctcccaaagtgctgggattacaggcgtgagccactgcgcccggcctgccaagcgtggtttcaaacccttgagctacatagctcttatgtttccttcctcctaggatgcagcgactgcatctctagcatgggcaggaaggtgactcttgcatctccacttggtaacagacaaaagcctgcatctcaagggccagatcactgggagacaaatctctaggctggagacttcaaaatggcagtctagataattcagaccacagattggtgcacatgatatttgcaatgttctggaattagtggccaaagtctgttgactacatgcagatattcccacacatcagaacatctgttcatcctgggcccacattctctcattcttccatgtattcattcattgtgttgatataatggagagcaaagtagacaccaatgttgccctaaggagcttgtgttctaagggtaagacacagataaaaagtaagtcatggaatgtatcagatagtaagccctgagaaaaataaagagagaaaaaaacaacagctcgtgggagggggttaggggaggtcaagggatacagtgtttcccaggatggttggagagggcctcactgtgaaaggagtcatctgagctaaggtctgaggaggtgaaagtgaaagccacacagacattggggaaggagcattctaagtgggggaacagcaagtgcacaggccctgaggtgggagcatgcctggtatgttctaaatgggggaaccctaagggggtctgcatggctgaagcaggatgggggaggcagggcactgcggtcaaagagaaaatgtggggagtgaagggtccgaccggcaattgcacttccagtgtgcggccaaggggagaagcactgatttggggccttgtagagatagtataaagaacttgccttctactaagtgaaatggattttgaacagaggagtgacgtggatttactttttttttttctaatttaaaaaaaatttttttttgaggcagagtctcgctctgtcgcccaggctggagtgcagtggcgcactgcaacctccgcctcctgggttcaagcgattctcttgcctcagcctcccgagtggctgggactacaggcatgcaccaccacgcctggctaatttttgtatttttagtagagactgggtttcaccatattagccaggctggtctcgaactcctgaccttatgatccaccagcctcggcctctcaaagggctgggattacaggtgtgagccaccacgcccagccagatgtactatttttaaagaatcctgtgttgagaataaactatgagtaggcacgagtatttgcccagaggccagttaggaggctgttgcaataacccaggtgagagacgaccatgccttggaccagtggttctcaaaacggggttcttaagcaagcagcgtcagcatcgcctggacagttttcttaaagcaaactttttggcctcaccagagacctactaaaccagaaactctgaggatggagccagcaacctgtgttcaaatcaagccttgagttggttctgatgcacagtgagatttgagatccaccactgccttggacaaagatggtcatcatggaagtggtgaaagggcttggttctgtatgttttaaaggtagacttggacaatagggaaaggctaaatagactgggtccctaaagacaggatcagacttctccagtttgccactggccccactcagtcctttctgttcctctctggaccctgtaggcatttgtctttgccctctgccccagactcctggatgagagaggtagaaaactcaatggtgggaatcccacaaacttctgttaggaaaattgccttgggtcatttccttttgcatatcggaagaatcatctcaatcattcgtttgcaagtgtgacaagggaaaagtgaaatgtctgtactgaggctttggggaagggtgagaagggtgttgaggaagggaaggaacaaatgagctcatggtttcctttttccaatctggctctcctttcccagagggaatactcagggaacctgctgttacttctcacaagcactagaaaaaaatcacttcccaacctcatctgccaggcggcaaaatcttagctgtgaactgcagttccaaaatgtgactcttattaaacatcgctatcacattaagcccagacagtgacctactctgtcgcctgaaagaatccgcaattaacatggggagtctaatcaggatattaacgagtctggttttgaattcctataatattttcatcagttttttaaaaaactcatttcaacctgcattaagcttggcaagtggattctgtggggtgaaaagcgacaggatttgggaaagcttatattttctcatcaggtaaaatgcaagcatatggaagattcagtttgttttaaaagaaaccttcattaagaaatgaaaggttgagcctgtgaccactttgttacagggtggctgagctgcaggagagaaggtgagggcatcaggaagagaaagtacactgccaagaaaggctgagaaattctaccacgtctcctttccaggactggttatttcatagcttcacgcccagggaaatcacacatgcaaatcggacactccaaaatacacagcagattaaatcaagtcaatatttggtctgtagctagtatattttattaaacctaagaagctgcagattataagatgtgtcattatttaggaccctttccatgaataaaacaaaaagaagaatgccctgaattcattgtaagatctcattgattggaagatgcattctgattttagtgatattaagatgtctgaggatggagcatccaagctggtgggtaagcacagtgaggccaacacacacccatgttctttccacctctttctgctccgtcagccttagcttccatgtcttgttcttgtgtctgtgttacgatggtagatacaacttcatgcctcacgtgcactgtgcaagaggaaggagagtgtaatcagccaggactttaacagagaaggcacaggaccagttgaagatatcttctcgctttctctctatatatatgcatatgtatataatgtattatatatatgaatagatgtgtgcatatacgtatatgtgtgtatacatacacacactcatacattccacacttgagtaaatacatacaagtgcatatgcatatttatataatgtattatatatatgaatagatgtgtgcatatacctatatatgtgtatacatacactcatacattccacacttgagtaaatacatacaagtgtgtatacatatatacagaaagcaagagagagaatgagatttatactgttgtgcagcatggctgggcaaggctgacacctgcagggctggccagcaaggtggaagctcacagataggagctgaacttgtcaatccacaggcagaatgtcttcctcaggaaaagctccgtttgggccttattcaacggattgaattctccctgcatgcattgttgaagataatctcctttgcttaaagtcaatttcttatggactttcatcacatctagaaaacacgttcacagcaacacctagataattactggttgaatactgtgggactgttgccttgccatgttgacacataaaaccaaccatcacaaagggtgccatgatttttttaaaaagtcccttctaacaaggttttgcctttttcattagagaaggacccattctctgtatgtttcattggacggaactgtcacatgaccacccctggttaccacagaggctggagctggagtatgttgttcctcagccactctaggagggatatacccagggatgtcagctgtgagtggatgctgagtgagccaatccataggatcttccatgacctagttactgaacatctaatgagtacaagaggctgaacaaccacgtgtggctcagattcgattcttgttaatcattaccaaagataattaaataacattgactcccaacgtgaaaaactcatttcccttccatgcgtggcagctgaaactgctttttgatgtagagtagggctataaaatgccttttaaagtgtttaagctaaaatggaaaccctgttaaagaaaaatatttagaaagtgccttggtactaattgtacgctagagcagacattgggaaactgtcatgtgagttgcttagtcatgaatcactgattggaatatggttcttcagtgcttcccctggctaaagcacaggctcaaagctatgttgtccatgtccctggccaggcagcatgagacgtgttcatgaggaagttagaaaacctctctgaccctccatctcctcacctgcagagcagggacacaccatagtgtgtccatgaagtcaaacgtggtcctgcaaactctttgcaaggtgctggcctgtcgcaggcattcaccagccatgaggttattgttactattccacctcataatttatctgagcagagagaatgtcttcataattctttccacataaaattgaagggttttagtataaaaagagtgatgggctgggttggaggaggatttaaccctgccaaaccatcatgctctctatctaacgtgggatggtgagaacaatggaaacatcggtgaagcccattcgcctctccaaggagggtctcctatgatgactgcctgggtcctccctactagaaaaagtaacacaattagtattctctcttccaaaaggagtaattcaggcactttatgattaaataacttgtcccaggtcaaacaagtagtaactgcccacactaacttgaaatcgacaaggtgactttgccttctaggggacagttgacaatgcctagagacatggttgatcatgacttggagggctggggtggtactggcatctggcagatagacaccagggaagctgtggaatgtcctacagtgcctgggacagcccaccccctacaagaaaggagcacccagctccaaatgttaagagtactcagctctaaatgtcaggagtactcagctccaaatgtcaggagtactcagctccaaatgtcaggagtactcagctccaaatgtcaggagtactgagggcgagaagtcctgctccagagtccctgtgagcctttcctcacaggttttcatgagggtcagatgaggccagcactgcgtcagcgttctgtaaacctcaggcaggagccaggcatgcattgcagtgatgggaagcactgatgaagccttcttagcaaagcacagacgtgttggccaatgcatacatttaagaaagtgggttccaaattttctctctctgaatcattggcaaataacaacaaatgacaaagaattaagctcagcattgtcaccaaactagccatgtcacacctgtaacagttaaatacctcagtccacaagcttgggtgcagaagaaatctaacattctcttattttcttcacctgaacttaatttatatttccagtccctaatcttagtggcagatacttcatcttagtcaactcaggactccttcctcttccaagagatacagctaataccaggccctatgcagggagtggtgggcacattcaggccagggaaagagggttcattggccaaggtggctgcggaggcctgagttgtccccagcctcaagctctcatagtattttctggtggtcaagggccagggcattactggctgttcctgagccactttgaaccctgaaaggcctcatcatggcgtattctgccctcaaacttgggagacagctccgtccttctcacactggggcacgtgggagctctgtaaggtggccacagccagctacatgattttcagggcccagtaaaaaatgagcattcaggatcccctgttcaaatattaataggaatttcaagatggcaaagtgcatgaagccaagcacaggacgctatgcagttgcacaggtcaaatgcccatgaagctggccctggaatgaccttcaggcccatctgctgagatgctcctctcagccactgtgctgccaatcctcccctcctgcactggagcccaggaaagctgggggactcgctgctctcctgggcactgctggaggaagggatgcaggttattgctactcctaaatccacgcaaaacttttaggatttgtatcatctccccttcctctggaacaccaggcagcatctcacttcccagcccacctgcagctctcatctgccccccaaatcccaatgtgtgtctgctcaggcccagcagggaacacctgtgctttactcatgccttttcctttgtctgagttgtctcaagaatcttgcttttgcaaaaattgcatctgttcaactcaaattccttttctttgatttttggtgtgatcatctctttccagaagcaataaatgccaatgcctggtggggggaagagcagccaatgcaggaatgctaggataaaacaaggtgacttttctttcttttttcttttttttttttttttgagatggagtctcgctctgtcacccaggctggagtgcagtggcacaatctcggctcactgcaaactccgcctcccaagttcacgtcattctcctgcctcagcctccgagtagctgggactacaggcgcccgccaccatgcccagctaattttttgtatattttttagtagagacggggtttcaccgtgttagtcaggatggtctctaactcctgacctcgtgatccgcctgccttggcctcccaaagtgctgggattacaggcgtgagccactgcacctggctgctaaaacaaggtgatttttcaaaaaattattgcacaatgtgcaatgagccctatatcatcatcctttcaaaatattctacacaggttatttccaaagacaaagaaactcagtggggattgcatgggagaaactgtgttgcgcactcctatgaaggatccccatgtagccttcacagtttcacttagattctgtctcttccaggacgtcctctcttatttcacctaacttgggctagttcgtccttctgaagctcctgtaatgtaacagctgtgcctctagccctctctttctctcttctttgtcttgtagacatgagagacagcagtgagtaatgggacaatcaccaagcatgggagagggacaaaggtggggtaggccctgcatctgtgttcgcttggacaagctgcctgagttctccagacatcaactcctcaatctgaaaaaaattgagcgcaattattcctacctgctggcttgttggtggctgtgcttgccattgtcattttaatttttgttattactgttgtataagttttaggtctgctattagatttaggatccttcaggccaagactttattgacctttgtgttcctagcccccttctatgccagcatagaggacagtccctggcacatagtagatgctcaatagtatttgtcggggcagtgagtaaattccctgcctcagtttgcttgtccttgaggaggtagatacaaaatcagaactcacagcttcccttatccacctccgatcgccagccttccagagcatttgctgagctcaccaccagggaacgaatacaacaacattgattgcgatgctgagttgtgccagactctgtgctaaggttggagtgaccaataatcccagtttgcctgagactgagggatttcctgggacataaaattgtcagtcctaaaactgggataatcacagaaggaggaacaggttggccacccttgctaaggcttttcatgcattatctctttctgtcttttttctttatttttttttttaatagagatggggtccttactatgttgaccaggctagtctcgaactgctgacctcaagcaatcctcccatctcagcctcccaaagtgctggaattacaggcttaaaccgccatacccggccgaattatctcttatctattttaaatatgcttcatttcttagaacagttttttatttatgtatgtatagatatatttgctttgtggggcaggggggtgcgggctggggggacagagctgctctgttgcccaggctggagtgcaatgatgtgacctcaactcactgcaacctccacctcccgggttcaagcgattctcctgtctcagcctcccaagtagctgggattacaggcgtgtgccaccacacccagctaatttttgtatttttagtagagaaggggcttcaccacgttgaccagactggtctcgaactcctgagctcagttgatccacccacctcggcctcctaaagttctgggattataggcgtgagcaatcatgcccagccagaacaattttaaatatacagaaaaattgagatgcttgtccaaagagcccccacatgccccacacccagtttcccctatttgtaacaccttacgttagtaccgtaaatttgtcacaacaaatgaaccagcacggatacgttattatgaaccaaaatccatactctattcagatttccttagtgtttccctgcgtcattttcctgctccaggctcacactcggaataccacaacacatctactttccatgtctccttgggctcttgttggcagtaatatcttctcaggcttttttttttttttttttttaatgatgaccttgactgttttaaggcgtactggtcaggtatactgtagtatctcatttaatcctcatataaaccttaaagaatgaacactattgttccattttaccaatggggttgctgacgcttacgtccggtataaccagtaaagggttgaatggtaatttgagtttccactgggggcaatgattccttaataacatcaattcatagtaagtattatcttcagtgcttgttctgtctcaagtaccctgcaaagaagcccgtccctattgtattctttcatcctcataagcacagcactgtagacactcacgtatgcccattttacagataaggaaaccaaggccaagaaaggttaagtctctggctcaagtcatgaaactgatggaagaatgtagaccccaatccagggcctctgcaatctttatgctctgtctttctaggaaatactttctccctattaaagattgacccgtttggaggaatattttctcccttctgctgtggaacatctacagcagggtttctcagacttaactgtacctactcatcacctgaggatcttgttaaaaatgcaggttccgtaggtctgggatgaggcctaagaacccgtatttcttttcttttcttttcttttctttttttttttttttttttttttttttttgagaccaagtctcaccccgtcacccaggctggagtgcagtggcacaatctcagctcactgcaatctccgcctcccgggttcaagcgattctcctgcctcagcctcccaagtagctgggattacaggcgtgtgccaccaagcccagctaatttttgtatttttagtagagatggggtttcactttcctggccaggttggtcttgaactcctgacctcaaatgatctgcccatctcagcctcccaaagtgctgggattacaggcgtgagccaccgcaccgggccaggacccgtatttctaacaagacggcaggtgcggccacactgggagtagcgaggctggacactgactcctacctcacattttcctttctttccggaacaaacacggtaactgctgtgtgggcacacaaggcagtggccagaattctcaggtcacttcctgactctctggagctccaactgtcggcagataaaaagaaatctaggcactgagaaatcccaggcactaacattccggacgaccaattggcaactccaacctctccagcagggtttgtaaagaaaacgtaatgagcccaggtgaggctcattagagccagcctggaattctgccagtgctaccatgagctttatgccaacccttgattttcatatcagtggcagtactgacaaggaagctggaaggcaggctgggaggaagctttgtacccatggagtcctctccctcctccccatccagtagctctcgccacgaggtgaggcagttggcttcatcaaatcagaaccagctcatgagtaattttcactgtcttccctttctaacaggctgggccccaggtgatcctaaaaattaaatgaagctcagaaaatgagacacttaggagagccaggcatgaatagcctatccccggctctagcggaactctttacttcccttgtcaatttccttggacttcctttgggcctttgactagtggcaaagtttcactccagaatctcacagctctggagtatttctgccagagggtcccagtcccctgtgtgttttcttgttctcaagcaaaatttaaaatgggcaatggtagccaatgctgtcttttctccttgtaaattgagatatttatgctgatgcaatattttcagaataggactctaggctgcctccaagcttccaggtacttcccagattccagcaaaaaattcttactaccatcaccctcctcctcctcatcatcatcatcatcatcatccccattatcatcactgtcattactgggaatttattgcatgttaagcaccaggcttgcattttgcttgtattttctcaattaatacaagcattgaggaaggtcatattgttattcccacattaccaaggataaaacaggcttaggtaaaatagcttcccaaggccaccctaccgctgaattgaccatactgtctgcttggccactgaagttgagaccaaagatgtttttcactatgcacatcccccaaagatttttggataaaaactgattgacttacagttctggccaaaagtcaagctgatcattggtttttatatgagagagcgaatgacaaagagagaagaaaagaagagaaaaatcactgaattcacaaaatagtgccctagtggtttataaatgaggggaaaaatggcaccagtgacactgtatttatactaatcactaaaagcaaatgaattccaactgggtatgttaaaaatagatgcatgttgatatgtatatattaacctaatatgagaaaaagtaaccccattgagaaaagttagagataaagtttacaaccttcactttctcccctgcacaatagaacttatgccatgataaaatcccacaacttagtcatttgtttatttaaaatgcatttgttgagcacctcctatgagccaagaagtaaagattgtgtaaaaaaataaaatacgtgggtagatggacaattcaactagcaaatgcaatgcactgtgattgacaagtttgagtgtttgtgttagaattatttgtgtgcaagcaacagaagctgactctggtgaatcctagcaagttcagcatctcatgagaaaaaaagagcatctaacacagacagaagggaagtggtcagggaagcctcctggaggaagtgacatttcagttgagacttgaggaagaggcagaggaacctgtgccaaagtgtggatgtgtgtttttgtggatatggagcagggcagagaggctggttggcaagtgtcctcagcaggggacagcacaggtgagatgacagggaactaggcacagaaaattctctcacaaggcagtcactggaaccacccccaccattgcctgttagacacctggaaatagctcttggtggttgggagaaatggggctaggtgggaaacaacgtcagggaataacacacacagaggacttgtctggtcccccgtcccccagtgtagaccgccataggaaagctatgttgtaagaaatcatagaggaaggagacagcacaaattaaaactcctactatcataagcatctagcaagcattttatgaagctgccttgtgaggaactacttcactctaggaaaaaccctcctggttaccatgactcagagaacgatctgcaaaataattcaccaaattagagtttgccgagtgcacatttgtaaatctgatcccgcctgcccgcccccccattctgttgattatatctttcatccccaagaatgaggccaagagcctcctccctgcccctcctcccctccctctgtaatcctcacccctcatttctctcccctccccacttctcagcatcctgccacccctaaggcggtggcgtgatcacgtgctgatttcagggagttcattaaaaaccaccaccctccccgctgaccacgaggcaccggcagcagcccctggggccatggcgctggcaagagcatgccggtcactcaagaggggccgacccactccgaggacagggacccccttgcacaaatgagaagagccagcaaacagttaatggttgaatcctttgcagaaaaagtcaaggcagacttgtgattcttgatgttaatgaaggtgtcacacattgtctagagaaagttgtgcctggcaatcttccctgtttcggatgcctaccccagtgacatttcatctcacatccaccttaatgaaatgcataattaacatattctaattgtgctgagcgctgcgatgattttgacagaactcactttccatgtctaatttgatgctaatttaatctgttcctctcccgctgacatgacctttcttgattgagtttcactgaggaaattttttgatggattgatttatcagcattgcagagacaacaaaggctcagggtgcacgacagaaaataggaagggaacggccctcgaagccagcacgctctgaacttgccggctggaatgtcctctttccagagacggcttgtctgacctactgatggaatttgagaaatgtgacatctgtgcgtgggtttgatctctccgataaagacagtaaatatcttattgtggttgtgaagctttgcatggaaaacttctctagggctattcgaaggaagcttaggctcctcctgttgaccaaaaccctaagcgtgtgaggccaggccacaggttgagggccccgtctagggtagagtgtttgctcattagctttaaccaggagaaagcacgaagaggtggaagtgtccgtctcaaattaaaacagagaaacgtcgcaactgcgtaggtcattgagcatggatttcctacttttagatattctgtagacatctacaaaaaggggagttaaacctagatcttatggaagcgtctgtggaatgtcctccaatacctgcccccacagatacacagagtctcaaagctattaatataaacatctctttgtccagttcctggtctttgtagaagtaggtgctcaggatactgatgacagtcttggagtgtcccagttctcacaggattaagtggctgagggcattagactccctcatcctgaagatacaggggtcaaaaccagaaccatagctgaatgggctcctgggaaagcagtccctcaccctaccttatacaaaagtggctgcttttcaacagctgtgaaggcttggattccaaggggcttgatcaaaatttctcaggtttggcactattgtcatttgaggctggatcattcttcgttggggtgggaggggtctcctgtgcactgtaagttgttgagaagcatctctagcctccacccactaaaagccagtagcactcccattcctgagttgtggtgactaaatttgcctcagattttgccagatgtgtcctggggaggcaaaatcaccactggctgataaccactgaggtagagggccaagtgataatgcctgtgacccccacatgtctgcattgctcaacaccccctacttcctctgcccagtgtcacctccccagctagacgttgtccaatggagcagacaagtccttatccaccccccaactccttattcaacttctcccttttccaaatcatatatgactacactgtattaaatattgatttatttattgtctgtctctactcaataaaccataagctacataaggctgagatgttgtccatcttttttactttttttttttccaacttttactttaagtttgagggtgcatgttcagaatgtgcaagtttgttgcataggtaaacatgtgccatcattgtttgctgtacagatcaatccattgcctaggtattaagcccagaatccgttagctattcctcctgatgctctttttttactttaattatggtaaaatatacataacataaaattcaccgttttaagtatcataaagtatgcaattcagtggcttttagtacattgacaatgtgtgcacctatgccactatcgagtttcagaatattttcatgaccccgaaaagaaactcccatacccgtaacgtggtaaccctactctttccctcctcccagcccctgataaccgctaatctgtgtctactgatctgcctattctgtacatttcacttaaatggaatcatacaataagtgaacctttgtgtctggtggttcctcaataagataaacatgaagtgaccacaggacccagcaattccattcctaggcatacatacaaaaaacatgggagacaagtgttctaacgaaaacttttatatgagtgttcctagaagcactctttgcaatagccaaaaggtgtccatatgctcatgaatggataaacaaaatgtggtatatccatacaatggaatagccataaaagggaatgaagtgtggatacatggtgcaacatggatgaaccttgcctgtcttttcatcgttacatcctcagtagtgaaaatactgcctggcatgtagtaggtgctcagtaaatacaagtggaataaatgaaaggcatataaaagtaaatgaattgaggatagtcaagaaccatggataactagttagaagggccattcacattaactgtgtttcttttaatttagaaaaaaaaagaaaagaaaaaaaatagacccccccaaaagaaacaaagaaacaaaaatgaacctgatattgagccggaaattttggaggcggggaggatcgctgtatgtgaaaaatagttgaatcatggaggggagctggtaatgaaagtgtcatgacagaatactaaaacttccctgctttctgttctattttgttttgtttcaatgtcaagctctacttcttcttcccaaatgtttctttcagaagcagatacttaagctatccatagtaaatagatattttccttcaaagtactctcctgggaggatgaaacatttattccaaagtagttgccctgactgcaaagatttttgcaaaatttcttcaggagctgccttccgagccccgcaaggataccaagctaacgagattatcatcattatgattacacttcatcatagatcaaaagcagtttaactcggcaaaatgacctggcctgcttcactagtctttattctaaggggctgctggctttgttcaaaggctaaaatctctctgcaaagcccagttgaacagtgtccaggtgtgcccccaaggcaggggcaaagtggagcatggtctaaggggtcaagctacttaggtctcaatccttgctctaccactaactgggaaagtgtgcctcagtttcctcatctgttaaaactgcatagtaatagtcctacctcaaagagttctcttgaggattaacttagttaataatacataagccaagcattagaaacaatgcccaccacatagcaaagtcttttaggtataagctcttcttataagatatgtgtctgagccttttcagtaattgtgtagtggccaagtgaggtggcccatgcctataatcctagcactttaagaggctgaggaaggcagatcacttgagtcctggagttctagaccagcctgggtgacacggtgagaccccatctctacaaacaatatgaaaactacctgggcatggtggcatgcacttgtagtcccagctactctggaggctgaggcgggaggatcacttgagtctgggaggtagaggttgcagtgagccaagatcatgccactgcactccagcctgggtgacagagtgagaccccacctcaaaaaaaaaaaaaaaagaagtgtagcttccccaggtgaagtctgaaagtggtacacttactatttttaaaaataattattaagaaatcaggcgtgcagttttaatgcaatcttcagtggtatattcattcttatattcttattactgttgtaacaagttagcacaaacagtggcttaaaagaaaacaaattcattatctttcagttccagaagtcagaagtctatgtcagcttcgtagagaaaaaattaaggtgtcagcagaattggttccttctggaagtcccaggggattgttttcttgcctgttcagcttttagaagctgcctgcattacttggctcaggggcctcttccttgaattactccaacctcttctgccatcatatcctactaatgactgatcctcctccctcccttgtataaggacccctgtgattacattgggtctgcctgaataatctaaaccaaggttcccatcttgagatcctgaatttaatcacatctgcaaagtcccacttactatagaaagtcacatattcactggttctagggactcgaatgtagacatctcagggacatttattcagcctatcacatatgacttcattttaggtggaaagtggttctcagtggaggatatcaattcctttctatctctcagtgcaactctgttgtgccattttgaggacagaaaaacaatgtggagttagccactggaatccaaggttggatggacctctaggacggtgaagtctcctgtagttctcttcctcagtggctttgtaaggattttgttatgtttgaccagcaaccccaggactggagttattcaaggggtctaaccccaaacacatgtcacatgagagaataccaatttggctgtaagtttcattgtgaccttgtatcctacttgataggtttaagatagcacagtcctccagtgcacctggctaaagtcattcttacatagcctccatcaggtcatgatttttgttctgttctcgtatgtttttgcagcaccaaaagaagtccccagcaccttacaggattgatattgagagcttttacagtgtttaaaggtaactgtttttcacaaagatgaaacactttttgtctgtttcaccaatatcccacctggaatatcctgtatttctctgaatattatagtaacctgtggctatcttgaaacttccaggttttcccatatgaaactagaagacagacttggaaggcaatgttgcttagagcaatgcttgctcaccaaatctttttcattagaatagttcacttagatactgggcagttttgataaaccagcattcagggaacaaagcttttatgaaggttccagccataatttttggcctcagaatattgctgggtgttttttcctctgtcaatctaaaatgaaaatgtaacatttcaattgcaattcgttaggaagaagcaaagaaggggatatttgcatttgatcaccaaattggacgagactaactttcatccgcatctgatctgccaatatcagcttttttctgaaatataaaatagtcattaattcactgttttcccttattgagtgaatagatttttttttctgtcacctgtgtttttatccaaaatcagcaatagaatattttgcatggttaaaaactggggaggtgggaattgacatttcctttgaactccaaacaaatggcaaacttcaaaaaatgtttgatgaaatactgcagtattataacccaaagaatctatgatggagaaaaatatgaagaaaataaagaatttttttaacgaatggattatgatacttaccttcagtaggttagctttagtgtttacaagtattaattgattttttgtcaaaaaaagttacataaaaaattaactcaattatcatcaatccaaaattttgaaagataaaatgtggcaggtggaattctaaaaatggcctctgagattcctgtcccatgtttattcaaacactaacctaggtacagcttgtgaagggatttcacagatgtgactaaagtgtcaagtcagttcactttaaaatacagagatgaccatatcacacgagtctcatccaaacatgaaatccctttaaaatcaaagcttcttccccaggtggtagcaaaaacagacatcttcctcaaggaggaaaacaggaagagaatcaaggtcagagagatttgagttcaaattttccacttattggttttatgaccttttgaaaagtttcctcataccttgtgcttcctttcctaatttgtactgctagtcactccctaaatttatgggaaggaattaagagacagaatgtacacaaaatacttagtcatgtgtcagacacatactatgtgcaccataaaagataactattattactttagaaattgttcactctataagattatccttcactgactcttgcaaactgtattctgattctaaaaccatgtgagttcacacaaaatgacactgaaaagcataatgcaagtgtggagcatcccaccatgtgcaaagtttggttggggccagctctttaccccactgcattccgttttggcccctctcctaagctctttttttttttttttttttttttttttgctctatttactgcatatctgaccaacaccatgaatttccagaaccccagtcctttatcaccaacatcattctccacaaaatttaagtaggctgtgcactattcttacagggtccaatgaggaaatagtcttataaactaagttaggctaaattgttaatagctaatgatgacttagcttcccatatgcacttcatcaaagggatttgaagccttacccctaagaaataaggtgggaagtctgggggcggtggctcactctctcagcactttgggaggccaaggtgagcgggtcacgtgaggtcaggacttcaagatcagcctggccaacatggtgaaaccttgtctctactgaaaatacaaaaattaaccaggcaaggtggcacgcccctgtaatcccagctactcaagaggctgaggcacaggaatggcttgaacttgggaggcggaggctgcagtgagcagagatcgtgccactgcaccccagcctgggcgacaaagtgaggatctgtctcaaacaaaaaaaaaaaaaaaaagaaagaaataagatgagaattttaggcatcaacttcggagaggaaagaaaaattatttggaggtgcaaattcctttggtattagtaaaaattgactcacatgggccgtagtctccaccatgtccagtaaatgtcatcttcctctgttgctaatccttctgcttatatatatttgcttaatttttgccctgaccaccaggaaaagatttcccaagttccttttttctcatgtaaacaatttgtattacttagaataaggatagtgcatgcttatttataaaggactagaaaacagggaaaatgaaaatagaaaaattaaaaatcatctatagtctcacccttcgtagaaaatgatagtccaggatatcagttaaggaggggtttaaggttggtaaatcaggttggaagatggcctggaagatttcccctgaggctgtgactgcatagcaaacacccagtgatacctgagagtgtgagcgggttgctgatggagattaagggaggaatgaagtcttggcccctagctattcaagaccatctgcaactgcccattctcaatattttgtttgtatttctcatatgtgtgtacacatacatgtcatagaattatttaatttttggtaaaaactgaagtcatacctacataatgttttataaatcgattcttcctagcctaaaattgtgaatgtcattcccgtgccattaagcattttcttctacattcatttttaaaggccatacaagaatattccatagaccaaatacgtattttttcattggcctagggttgtatatttaggttgtttccaactctgattctaattaacagcatacaactgagcacctttgtaaccaaacttttacacatatacgtgattaattccttaaattcctataagtaaaattgctgggtcaaggagttacatattttaagacttttctgaaataactatgtcattcagtttatctcagatttatcatcaggcagttgaaacaagggtattagaaatcattttagaccaatatgaaagacgaatggacattaagcatcagtagtctttaacatgaacttttcatagataccaaagagtagggggatcaactgtttctatttgcccaggactgaggggcttcctggcatgtgggtcttttagtgctaaaaccaagacaatatcaggcacattgggacagttggtcaccctatcagagaagaccagggactgactgaccataatggaaggattcagtgtaatgccgtcgtaggcaccattgccagaaccatggtcagaacaaggtgaaagtttaactacatcattagccctaacatggtagaaggcaagtaatgagtttcagaagccatgttcaagaactttgaagtgtaacgacgtagaattatggggtagagagcatagactagagaaaatgcaagcttctaagagtccaatgacaatttcgggaaacatgaggagacatggtgctcttgtggtggcctgtattggaatctggtttgcccctcaagtgaatagtgttgatttgaaaacttctaatattctttcttttaggagatcttcttgatagttgcagaaattctgactggaatagattaatgtcttgctatttggcttgtatagtagcagcataaaattccacttcttcttaactgaagaaagcatttaatttaagcacaagaagatgactcaaactgagccactgcaaagcaggtgaagggctcaaaacattatagtggtttctcaatttgagtcatattttcattctcttgaatcaaagggtcacttaacaaacatgatttaattatatatgtcttgcctgatttttagtcacagagaaattccgagatgaaaactctggaaaggtgtcattaactcaaggaagacaagggcagagttaggctagcaactagacactctgtgtacagtttcatatacaagcaagactttcctttaatattgataaagaattgagtatcatgtatgcattcccttttatgatatacaattaattgtaagttatttccccttgtatgcaaccatccacatttttcttctgaccttttcctcaagtcttacaactacttttaatgactgcattttggaggtggtcccaggagaacagatgttgccttataatggtgtttttccatttttttctttgattgggcaagggggttggaagtattatttagtcattatatggattcctctaaaaattgttcaatagaatatgtattcatttattcacttacttattgtttatttattgcctagagtatacccaacactgaggatacaataatgatcaagacaggtctaatttctgtcccatagagcttaaattgtaattagaaagaatttttttaaataagcaaaaaggaaaagaaaaaataactacaaatgataagtgttctgagggaaattaacattctaagagaacacctgggagacaagagccctcctttgggcagtatggccaagaaagtcctttctacttgcatgaaatgttctcagtagcatcgttcataaatatccaaaaagaggaaacatccaaatatccttcagctagtgagtggacaaataaaatatgatgtattcataccatggaatgctaaagagcaattaataaaagatgaattacttgttcatactattataatgataaacttcaaaaacattaagctaagtgaaagaatccagacataaaacatactttatgtgattccatttatatgaaatatccagaaaaggcaaatctatagagatataaaataagtaagtggttcctaaggactaggagtgggaatgaagagtgactgcaaatgggcactagttttctttttgggaagaaaaaaatgttctaaattagattgtggtgaaggttgaacaactgaaattatactaagaaccactgaattgtaccttttaaacaaatgaattttatgacatgcaaattctatctcaatgaagctgttaacaaaacaaaaagaaggatgaaagaataagcacaaagaagaaaggatttcctaaggaggtgacatttgaactgacataggacttatgcaaagagaggtcttggctgggactgggagagaacactccaggcagggagagtctgtgcaaagatcctgagatgagcgagcatttggcatgcataacaaactagtggaaggcaaggatggcttgagtatgttgagcaaagtttagaggtagtgagaaaagaaattggagaggcagatagcagcaaattcacacaggacattgcattgcaggcctgatactgagggtgcttcatgtgctacgaagacattgagagattttaattgatgctatgatgtatacttgacaacattctaccttaataagaataaagtcagccaatactgttgacttactattctatgaattttacacatactaccctatgaggtaggtacccttattattatgagtaaggaaagtgagatacaaaataatttactcaagaaatctgagggataattatgatctgaactcagttagtccagcaccagagcttgaaatcttaaccactgccctacccttgaaagtaggactagcttcataggcatacaacctatgcagtcacacagggccccatgcttagaagagtcccacacttgctttaacagcctgctgtcaccatcttgaaatgcttaaaaagtttttaataaagagacctcacattttcattttgcactgcatctcacaaattatgcagctagtactgcttgaacagtcttttagacattttactaccagaggaattattaatccattgaagatcatagataaaagctggccagggaggagaggcaaacccttagaattaacatcctatgtcttatgcatgtccattttgggacagaactctcaaaaggatccataagtccaaaagggttaagactccttgatttaccagcagccaccattctgatatttaggaatagctagataatgaagtagacttactattcagcttcctgttgtcctacatctattgataaagggttgcattggcaacactctttccagaaaacaggaaaataataataataataataataaggatgaatgaaaataaatggaaaagaataaattctaagcaaaatattttctttagtgtgtgtgaatgtgtgtgtgcgcatgtgtgtgtgcatttttctcaagggacctaaagtttgtctttttcactatcataataattttttaaatccctaaaacacaaaaatcaaaaccaaagggacagttcttctgaatttatactaatgaatttggtcaaatatatcactcattttccgctagtttgcataaattccatttctcttgtttcagaggctgacttgggttataggagaacttttaataatcactattacataggacaatattctgcatgcaataattccacaataaattcatgtcacgtgttaattttgacattataattaatgtatcaataatttgttactattattttcttataatctgggcttacttgtaaccagaagaaaactaaagtttaatggcaagttttcaattgcatttaaaatacccccaggccaggcttagtggctcacgcctgtaattctaacactttgggaggctgaagtgggagaatcacttgagcccaggagttcaagaccagcctgggcaacttagtgagacgctgtctctattttattaaaaaaaaaataaaattaaataaaataacccccaattaatttctaagctagtaaaggcaaataataaaaaatgtgagctcttgatacaaaattttttagaatttttttgtgctcaagaaacaattacgtactcatgaaaatgtgattatccactttaagaataatagggattaaaataggcctctgaatttgatatcgtgaaatgattaattgttcttcgtcactgaggtgctgctttctttgtatgcttcattgttcaacccatgaagtccctagatctttgagctaccagacaagtgatatttgtgcctcctggggctctcccagtgtgaccccacaaggagaccttctgactctgtttattcttagagtgagcaactgcatacaaatagaagatgttatgacacaggccaccagaaccaaatacagagacaagaagatatttctatgaaaacaaaatactaattctaccctaaactaaggctagactttcccaagtggaaaactattcctggaaagaaccagggagagatggtataatttcattttcacatggacgaccgcaaactcaagcttctttaaaagtgccataatgaacccagcacacgaacactctggctctgagacaaaagcaaggattttctcatttgccacctaacatccttgtaatttcccagttttagcctgtgtctttatggggggaagcaaaaaaagcaaaaccagctttgtattgttttcatgcagttactgagcctgggtaaactgggacaaaatcctagcaactgagaccaggcagaaaaaaaaaaaaagtttctgtggttctttttttttttttttttttttttttttcccaaacagagtctcattctgtcacccaggctggagtgcagtggcaggatctcgactcacggcaacttccgccactcaggttcaagcagttctcgtgcctcagcctccccagtacctgggactacaggcgtgcaccaccatgcctggctacttttttttgttttttttagtagagatggggtttcaccatgttggccaggctggtctcgatctcctggcctcagttgatcaacccaccccggcctcccaaagtgctgggattacaggcgtgagccactgcacccagccgttcttcatctttttgaaaaaaaatttacttccaattatttgatggtaaaatccaccaatttatgcataaaataaaatggcaagttagatttatttggagaaataaattgtagaaaccattcatccgttagggttttttaaacggtcttgtgccacttgatgaagcaaaaataaaacttcactcagctgacagataatctaggtgacaaaatcttttgtctctcccttatgaagtgaccgctttgaatatttttcttattttaaaaaccaaaaatcctttgaatgctatttattattttaggaatcaaaaaccaaatgtctattgtgaacacaagtctaagaaagagtaatatgaaccagtctttttcaagatggcctgctttttctgcttgaaaacattcccatgttaacgtttttcttcctggttgctctgttagccttaatctgtaagtactatttttttggagggcctactctaatccagttgttttatagacattatttcatcattcgatcctaccaacaactttatgaattaggagttacaaatttgcttttgtagataaagaagctcaacatcacagaccttcattcataaaaagggtgaaaactgtctagggtcaggcagactggggccaaacctgttctggctctttcttgctgtgtgatcttagccaagttatttaacctctctgtgcctcaatttcttatctgtaaaatgaaagagagtaatacatgcctacaattccttagccgtgattctcaaatcaaaaaatctctgaaaattaaagtgttttcataaataggacagcagggaacatacttaaacaaaaatattacacgttgtttatctgaaactcacatttaactgggtttgctgtattttcatttgctaaatctggcaacactagtttggcgccaacattcatttggcataaagattaaactgtgctggcaagaggctattacaatctttatttgtcccacgtggtgaagatctgagcagcggggccagcaaatacaacagctctgagccatgtggttggtatgttcgaggacagagagaaggccactgtggctggaacagaaagatggctagacaaaagagggaaaggagatcaagtcagaaaggcaggcaggagtcagaccgtggagggcttcgagccaggctaaagatggtgagaggtaagcccaagatcacaccgatggtgagcaacaaaaccaggattcaaccctaagtcagtcttattagtgcattggtcagtctgtcaacaaacatcgtgggggaaagtcatccttaagacatcgttataaagatgtcttcaggctctggaactaattgaaagattatcaacttggcagccaatcagctcctacattgactttagtactagaaagaggtacaactgaaatggacttttcagtccaaggtgataacattgatgcccatttcatagcccttgctgagtttctgtgcaataggaaagcatcttaatgaaaaaatcaagatttccaagtgaagggggaaatgatacactttgtaaatgtagtataaataaatctaacatataagacagtgtaataatgataattcagtataagacagcatatgtcattttgtcacctaccttgcacacttatggttacacatatcacctccttttatgtcctaaggtgtaatttacacagtactagaattggtggaacgtgctcatctggtcagcctactttaagtactctgcccgtgacttttacttttgttaaccgaagtcaataaatatttcgagcttctactccatatgaagcacagtgctgggcataagagacatagaagcagacaaggtctactcttgaattcaccaagtttgtagtgactatatatttttttgtttctagaatgcacaacgagtgatatttcatggttccaagatggtgtgatttttgtcagggttttaataataacatcacagttagacagtcttacaatgtgctaggcactgtgctaagcgtttatggggattatcttacctaattcttagaaagcccaaaaatgtagcattatccccatttttcagatggggaaaccagagattaagtatcttatacaaggtacagagcttgtaaacaatagacctggagtatcaaacccaggcagtttgacttcaaagtcagttcttttaatataaagttgtgctatgacaaaccttatattaaaaacttttgtgttcaggataatgccagaagccaagctctcttctattttagctaagatgagatggtttctcgcacagcaggacttcctcaagcctcttctttttctccctctggggggctagttcgggcttttcttttgaaccagtgaagcacaggaaaaatccacacgtgctgaattctccacattggctctgtacccgctgcccgcccagcccccaggatttgccccagcgtggctgtgctcactggccccatcctctctgtcaacactgaggcatcagtaaataaagaacaccccccaaagcttgtcagattcttctgcactggtgcacacaccccagtgatgagcaaactcctctatcatttgcccaggatctttgaatttagatgctgggtcaagaaagaatgacacttttgcaggaagctgttctttgggagaaatgatattttttagcttcttcctcaggcctgcaacataataggcaggtattgtcctggtgataaatgatagctcctctggaagaaattacaacactgtgtgtcataagccgaggcttctccaacattcctctctgctgtggagtgggtatagatctggccacaaaatcagaagtacctgcaaaacaaactcttttttataactcaacttaaattttttgtttcaaattcccattgatctcaattaatggcatattgtgtctgagtcactcttgaggccttccttccaccctttcttttgatcaatagtttataaatgggaataatatcgcccttagtcagctttccagaaattattttgggggatcggttgtcacaaagattgagaggtgacaccgacatttatttggtggtcagaggccagaggtgctaaatgtcccgtaatgcacaagacagtcccacaccatgaagaattgtctggcatcccaacttttcaatgtccagtagacattcatgcaggtgaaacattggtttctaactctctgagccatgcacacaaagcatccttcacatagttggttttcttttgttgttgttgttgtttgtgttgttgttgttgttttgtgttttttttttttctggagacagagtctcactctgtcacccaggctgtcgtgcgatggcgccatctcggctcactgcaacctccacctcccagattcaagcgattcctctgcctcagtctcccgagtagctggggtttcaccatgtttgccaggctggtctcgaactcccaacctcaggtgatccaccacccgcctgggcctcccgaagtgctggcattacaggcgtgagccaccgtgcccagcctcttcacacagtttgttgtttttttgttttttttttgagatggagtctcgctctgttgcccaggccggagcgcagtggcaggatctcggctcactgcaagctccgcctcccaggttcacaccattctcctgcctcagcctccagagtagctgggactacagacgcccgccaccacgcctgactaattttttgtatttttggtagagacggggtttcgctgtgttagccaggatggtctcaatctcctgacctcctgatctgcccacctcggcctcccaaagtgctggaattacaggcctgagccaccgtgcccggcccacacagtttttatatgctctgaactgtatagaaatgtaagtaccctgtaaattgagggaagactgtacttcgttctaactgtacagaaacttgttcagcatatcaaaaactcatgtcatgaaggcaatattatgagaggcattcgattctctgacacaacacaccagtccagatctgtatttgtgctgtcacattcagtgtttctatgtataatggtaagaatctgattgctttaccatatgttctagtatgtcatgccgaagtatttaaatgttggaatgtacattaatttattataaatacttcccttgtatttgccccttaaaaattgtgcttgtaaataagggatttcaggtgtggacaggagtatttagcagactatgtgcatagcccactcattcctctgaacactcatctccacacatcaaaaggtgtcctccgccaacacctgccaccctcaggtgctgctattcttggcctcaggacgttttcctggctttgggatcacactcacagccatgcagcatcataggatttaacgaatgccccagaagcagcccttgaccaatggtgcacagtgagtgggtggacaatatgcctgtcaccccgtaggaggggtatacccgaggcatgtgctgcacgtctcccggaggtccccagtgggaatgagcctctgctgcccatggtgggccctgccttgatctcacatcctggattggcttctggccttttcctatcttgctataccatcaccctagctgtgcttcctgggatcatcttctgcatcagctacttaaattgatgactttgtctcaaggtcaacttcttagaagcccaacctaacgtgggccattaccaagaatttgcttccaagagggacattgagtgtaacagggttcaaagccagtgctccagacaccgtcaagatttggaattttgttcaatgccaaggagcatatcattgggatatggattacccctttccatgtggccccttcaggactgagatctcctgattttgaacctagcttgagataaagtcaattctccaacatggagtctgtgaatccatctctggtctccaggggatgcagaggagattcatcaaaataaagcagataaatgagtgagtggagctgtctgggtgcatggaaagtcatgcagatagaaacatcttttgtgactgggcgtggtggctcatgcctgtaatcccaactacttgggaggctgaggtgggaagattgcttgagcctgcgaagtcaaggtcgcagtaagccaagatcatactactgtgctccagcctgagtaacaagcgagaccctgtctcaacaacaacatcaacaacaaaaatttgtttcccactgtaaatagaaacctgattcatagaatctcattcttttatttgagaaagatttatggagcatctattctatatcacgtactgggcatagagtggtgaacaaaacagacaaaattattttttctatcaagttgggagagactgataataataaaaacatatggatggtgttaaatagtaataaatacctttgagaaaaaaagaaacaggagaggggaagaaggaggactggagatgagggtggtgagtttttaaaagatagatcagggataaatggcaacagacactcagcattaaggtcgagggttcgactccttgcagggcatggttatgctggcaaggtctgcctgggaggaaggtgcttctgctcagctcaacaaggaccgccgtgtgggaagacaaagcccagctggcaggtattctcattttccagaggaaacttatagacataccacctgcccggagagctgctagcaacaaggcaaagctctccatatttttaagagttcaaacttgccttcccgctcagcatgttcaaacaagagtcagggagtcgcgctggtgccctctcctctctatcctgccccatgcctcccctgaagccatcactttctgcctgaatgacaggaagggaaggagaggggaagaatgtagaaagaaaacaaatcacagattaggattacccagccccacttgtccagccagttttctcttcttctggatgcaaactgaatgttggaagcattgccttgcaaagtcagtagtcaacagggaaggttcagatttgtttcttccttgaaagctgcagaatgggatgttgctagagatcccagtgggaaatttcccagatagaaaagccatgttggcttgtggagtgccggggcttggcatgggggcactgccttggcagagctgtcttgatgtttctggaaggcattgccaacaccagcggaacttgcagcaggagttttatgaccctttttcatccaagccactatttgggcagatgcctgattacttctaatgactccatttctgtgataatggccaagtcctctgtcatcctgctgtggcctggaatggccctggttttagaaacgagatgctccttgtaacgcgtggaggcactaatggctgctctccaggatcctggcctcctgtgccaacaggcagaacagccaaaagcaacaatgcaagtgtgcagaaaccattcttgagacagggggatcattggtctgcccattactaaagatgcccaactctacactagtcaagaaaatctttgtcccttgaaattttatgtatttctctaacttctgaggaagccaagatctgagaatgaaggaaacttttgtcatgaggactgatggttgggcaaaaatgattggcctgttttctggtgctaaaacatgctcctaagtggccaattggcttctagtcataggctcttggcatgatgaatgcatgtgtgatggtgtctgtaacagctatcccagcttgggggggtcgggggaggctctagcttattcacttagtatgtacccttaaaatacacatgccagggtttctaaactgccatctccctaggaccccactccactactatttggggatgggggaggtcatactatctgaagttttgcaagtggagattttttacttacagtaagtgaaatggaaactgaccaataccttaggacatggttagatgccgtttacgctaagaggtgaccagctagatgctggatcctgacaaagcaaaggtgtggtcccccacctcaggtgacaggcagtggtcattgaagtgaatgctgagttaccagctggcaatgcttactctaccatgtggcttccaggctttcaacaaatgttcttccctgctcttctcagccaaatccacccatctcactacttccaaaccttggtctctcttctggaaaagtctctccagctcccagatgtcaaggacctcctgggaatccacttccttctccactgactcaaatccctgctagtctgatggtccagagatccttctttttccagagagcacttcctcctgttgcctccagcacaaaaagcctttcaccctcattgttctttgatcttttataatcctcaaccttggagattgtttaggctcaaagccagaatcaaccaaaattcagttccctttcctcaaaggcagagagggcttagctttcaaaccttccagtgtcagaagaaaaagaagggggaatacaaacagctcagtctctgtgttgaaatagtctgagtgcctagtcacctgaaaaagagagttatttggatcattctccagggctgttattttggagtaagtcacaacttacttggtccgggattcactgcccactgtggagacaaagtttctcaaattcctttatcagcatcaggaaccaagctattcagtcccactgtccacagttttgctgagaatttttctgtagagtttataagttattgtcattctgcctgtctgtatgtctgtccacctatcgtaaaagttaggtagtgggaaaggtgtttagtctatttaaggaaataattactcaaaaactagtttttgccttttgtgtgtgccaatacgcagcttgattccaaacatgatgataccatttcggtgcctaattccatctgcctgggatctaacaccacctctgcctcttactacctttgtggaaagcgggtcaacctctgcaagtctgttctcttcgcccaacgcagagtgcaagaggctttcccttgtaaggctgctgtagacattaaatgagagaggctaggtcaagagcatggcaaagaggaaggccccactgcgtattagacagggctattgttattattaaggtgggacaaatagaccacactctgttccatatttcccccctttggcctctaatgtttgctcctgcacattcttgaaagtaacagaaccacatgtcttttcaaacagtaataatgatagatatcagtattcagttctgactctatgcgaggcaatttgcatgcattatttcattcaaacctggcaacagttccatgaggtgccacttctatcagttcaactttgtaaaggaaaggcttgggctgtgcgacttaatcgagggcattgccgttttcagtgtagacgctaggatccaagcctggttcaaactccatagctgatactcttaactagccctgcatagtgcctcattattcaaatgccaaataattcagaattttgctaactctgcaagaactttattctcagccgggcgtggtgactcatgcctgtaatcccagcactttgggaggctgaggtgagcggatcacttgaggtccagagttcaagagcagcctggtcaacatggtgaaaccctgtctctactaaaaaaaaaaaaatacaaaaattagccaggcatggtggctcgtgcctgtaatctcagctactcaggagactgaggcacaagaatctattgaacctgggaggcggaggctgcagtgagccgagatcaggccactgcactccagcctgggtgataaaatgagactctgtctcaaaaaaataaaataataaaataaatttttaaattttttaaaaaacaactttactctcctgagtccagatggggttgactttactgatcctgtgcatttactttgtgtagcaaccctagatagtaggtactgctgaaaacaaagttacagaagtttttcttctcccattttcttattcttttttttctttttgagtctcactctgtcacccaggctggagtgcagtggcgcgatctcggctcactgcaagctccgccttctgggttcaagccattctcctgcctcagcctcccgaggagctgggactacaggcgcctgccaccacgccttgctaagttttttgtatttttagtagagacggggtttcatcgtgttagccaggatggtctcaatctcctgacctcgtgatccacccacctcggcctcccaaagtgctgggattacaggcatgagccaccacgcccagccttcttattcttcttttaaataagcccgtaactagtaatgaaaaccaaggataaatctatttatttgtattgtttcaggaacttcagatattaaaaagcaataaaacactaatccaataaagtaatttctgcacacttgtttatacgtgacgtagcgccgatttcacagcttggactcatgaaattgttttcctcccgcgctgggacaaagacccatgacagcagcttgtagaagctgccacaaggactgccatctgatgattcatttgcttcttggtttttcgggggcttgtgtttttttacttggaggtagggtttctttcaggggaagttcagtaaccgacagctacgagatctttacacagaacgatcactgctaaaccaaaccaaaataccaacggggttttggactcgatggtaattttttgtttgtttgtttgtttggtttgtttggttttgatacggaagctccccctgtcacccaggctggtgtgcagtggtgtgacttcggctcatggcaacctctgcctcctggactcaagcgattctcctgccttcagagtagctgggattacaggtgcctgccacaacccccagctaatttttttattttatttttttagtagagctggggtttcaccatgttggccaagctggtcttgaactcctgacctcaagtgatccaccctcctaggcctcccaaagtgctgggattacaggcgtgagcctgtgcacctggcccccatgataatttttatcacatgatgttatccaaggatgacgccataaactgatagcaatatagggtaacatttacacctttcatgagcaaaatgaggggaaataaagatgctctgggaggttttcaacaagtgaaatttactcagtatgaagtattgaactttatttgatccagatcaataaaatttattgagcacattctgtgtgccaggcactcttctaggcattgatgaaaacagaatagttgttctcagagagttcttattatagtggggatagacagacaataaacaaataaacatgaactgggttcagtagcaacaagggccgtaagaagagcctgcatgagggcataaaggattcagtagaggcctagcatcgtggctcatgcctgtaatcccagcactttgggaggccgaggtgggcagatcacttgagttcaggagttcaagaccagcctgggcaacatggcgaaaccccgtctctacaaaatgaaatacaaacattaactgggtgtggtggtgcacacctgtagtcccagctactcaggaggctgaggtgggaggatcacctgatcccaggaggtcatgactgtaatgagcctagattgtgccactgcactccagccttggtgacaaagccagaccttgtctcaaagaaaaagaagagagaatgcagtagagttagggaagtccatgccaaggaggtgacaatttagcagagggttgcatgaatagaggaggaggtaagccttgactatatctggggaagaatgttacagggaaagggaatagtcattgaaagtccctgaggaggccgagcgctgtggctcccgcctgtaatctcagcacctcgggaggccaaagcaggcggatcacctgaggccaggagttcaagaccagccgggccagcatggtgaaaccccatctttactaaaaatacaaaaaaaaattagctgggcatggtggtgcatgcctgtaatctcagctactcgggaggctgaggcagaagaatcacttgaacctgggaggcagagtttgcagtgggcggagatggaactactgcaccccagcctgggtgacagagcgagactctgtctcaaaaaaaagaaaaaagtccctgaggaaaaaacgacctcatgtattcaaatatgacaaggaggccagtgtgcagagatgagggagagtagaagaaaggcaatgaggttttcaacgacctcatgaaaagcttgttagggccagcatagtttttatttgtactctgagcttgtgtgttttccactacactggtgatagaaacgcctttctttaatgcaaagatggtaaggcagtgttctttgtgttggaaagttattgtgtcgattccttgaaattttttttaatctgatctgtgaaatccagaagtctgggaatgtcaggagacgtctggtggcattctgtaggtgggagtgtcacggtgtcgtaggaagttcaggaatctgaagtctgtgtcccagccatcctctgttccagacatgctgggtgacagtaggcaaggaatttctatttctgggtttcacttttctagtctctaaaattcagagagcagctttaaagaatcctgagccgacgagggcatgaaggacatggaaagcctgagaggaaagccaaggagtcaggcaggtggacttcccggaggaggggacctggggagctgctctgggcaggctctttgtgaagggagagcagccctgctcagtttctccgtggaaagtctcagggttaccatctccgcctcaaatttttcaaaaagaaacagaaatcatggtttttatgttaaatctctccgttcataaatattagcaaccgctttaattaaaaactaaacaaggccaggcattgtggctcacacctgtgatcccagcactttggaagaccgaggcagacggatagattgagcccaggagtttgagaccagcctgggcaacatagcaagaccccatctctacaaaaaaatttttaaaaattagccaggcatggtggcatgcatctgtggtcccagatactcagggggctgaggtgggaagatcggttgaggccaggagttcaaggctgcagtgagccgtgatgatgacactgcactccagcctgggcgacagggcaagaccttatctcaaaaaacaaaacaaaaccacgtgagcccataaaacacatttgtgggttgggtttggctgagggatggcacgttcatttcctggagctgctataacaaattactacaaactcagtggcttaaaacagcagaaattaattctctcgcagttgtggacgctggaggttggaaatcaaggtgaaggcaaggccacactccctctgaagatgctagggatgagcccatcctggcctcttccagcttctggtgttccttgggttgcggccgcatcgctccagcttctgcttccttgttcaaacagctttctccatgggtctccgtcctctcttcttataggactgtcagtcattgcttttcgggcctacctcatcttaactgaattacacctgcaaagactccatttccaaataaggtcccattcacaggtaggaggggtcaggacttgagcctgtgttcttgggaggacagaattcaagccaccatgatggatatgacctctattataaattattcagtatagagactctggcctaggaatctgggaaccaccgaatgattaaaagctgctctgtaaagtttacaaaatctgtctctccaggaagtgaatgatgaatgtgagagagttcatacgggtttccaaacaggattgtcctggctgcaagacccaggtcaagtcagacacattctagtcttcagaacagtgttaggcggtgtatttgtttcctgggatggctgtatgaaggaccacacactgggtgacacagggcaacagaaatgtgctctctcacagttctgaaggacagagtctgccatcaaaagtcagcaggagctggggaggagggggtggctcacgcctataatcccagcactttgggaggccgaagtgggcggatcacttgagaccaggagtttcagaccagcctggccaacatgatgaaaccccatctctactaaaaatataaaagttagcggggcatggtggcacatgcctgtagtcccagctactccagaggctgaggtacaagaattgcttgaacccaggaggcgggtgttgcagtgagctggatcatgccactgcactccaatctggactacagagagagactccgtctcaaaaaaaaaaaaaagaaaaaaaaaagagtcagcaggacatgctccctcagaaggctctagaaaaggagtcttcctgcctctaacttccccgtgactcccaacaatccctggtgcccctcggcttgtggcagcatcactcaatatctgcctccttctctgtgtttctgtgtcctcagtcattgaattagggcccaccctaattgagtctgacctcatcttaattacaaatgggaagaccctatttccaaataaggtcacattctgaggttccaaacggccatcaattttgaggtgactctcttcagtcagtactcagttcaggccgagtgcagtggctcatgccgtaatcctagcactttgggaagtcaaggcaggcggaccacttgaggtcagaagtttgcgaccagcctggccaacatggtgaaaccccatctctactgaaaaaagaaaaaattagccaggcgtagtgtcacgcacctgtagtcccagccactcgggaggctgagataggaaaatcgcctgaacccaagaagcagaggttgcagtgatcggagatcacaccactacactccagcctgggtgacagagtgagatcttgtctcaaaaaaataaagaaggaagaaaggaaggaaggaaagaaggaaggaagggagggaggaagggaaggaaggacccagtttattcacccaataccagttctcttgtctccaaggtctcttccatctgcctgtctctgtgactctaactttcctatctttccttgagagtctttgctggcctttccattcagccattttcttaaggaactttcatcaacttccaaacgcccccaccaatctaaagctcagcttcagctggaaaatgtcttagtggcaaaatggtttagggaggaaaaaaggctttatttcttctgatatttttaaacccgatagctcctcactttgagactttaagcttcattgaacctctctgaaaatctacctcctggaatcatgggatagaacatacaggggaggaaaagcaaaccgctttttcactttctatgtcccagggaataaaggacttcaagaaaactgcccttacctttccagccacattccacaatggccttttctaaccacagttctttatgaatctcctttccatcacatctctgatgagtctttctattgctttgcatgacaaaatacaccaaatcctaaacttgttcttgtgagaaaatggaaaagttcacaaggaaagaaaatgacctaagatgagtgagcaatggtattcaaaaataaggagattagataatgacgcaattagagtccatttctatggttttctataattctgaacatttgctgacgactttgactggtttggtatttattcttatagcacatcaatttaaaatcaccctctgtgctctaagaggaatgataaattatgaagaaaatatgttcggaagaattttttagtgggctatctgatgctgacctgagatgttattatgaggccatccaatcattctgggtttttttaattctatcatttgcattccaagcattttaaatatttaaatggcctttcttcttgctccttaatgagagtttgtttgcatttagcacataataactgactagaaatggctttcttcttcttgtgttctcaatccagtggaaatggggaaatcagtgaggaaaccaatgttgtcaacccaaagagagacggtgatgacttaaagttgggtggaagtgatgagaaatagttgcatttgggatgtatgttcaagttcaagccaacaggattttctggtggcttggctgtgaaatcttacaaaaagcaatgagtcaaacatgttattacaattctgaatgaggtttttataaagtcagagctacaggtcaaaggcaccaggttcctagggccaggatctgagtgggcttcagatggggcctatgtagaattcttcctagaccactgattaccattacagtaacaactccaggttggcttcctattaaaaacagaccagatcaccttggattatatgactgcttcccaaagtgtgatatacataatacatgtactaataggaagcttttatgttttacaaaaacctatttattttaacttttattttagattcaggggtacatgtgcaaatttgttggtttgttatataggtaaattgtgagtcacaggggtctggtgtacagattattatgtcacccaggtaataaacgtcgtatccaataggtagtttttgcatcctcaccctcctcccttcaccctccagtaggcctggtatctgttattcccttcttggtgtccataggcactcaatgtccagctcctacttatgtatgagaacacatggtattggtttttctgtttctgtgttacttcacttaagataatggcctccagctccatccatattgctgcaaaagacatgatctcattcttttgtatggctgtgtagtatttcatggtatatatatgccacattttcttcatctagtctaccactgataggcatttaggttgatcccatgtctttaccattgtgaatagtgctctgatgaacatatgtgtgtatgtgtctttatggtagaataatttatattcctttgggtatatacccagtaatggcattgctgggttgaataataatttcattatgagcactttgagaaatctccaaactgctttccacaatgactaatttacattcccaccagcggcatgtgaatattcccttttctctgcaagctcaccagaatctgtttttgttttgttttgttttggttcttaagagccatttgcactggtgtgagatggtatctgattttgggtttgatttgcgtttccctaatgatgagtgatgttgagcattttctcatatgcttcttggccacatgtatgtctttttttgaaaagtgactgttcatatcctttgcccactttttaatggggctgttttttgctcacctttgtcagatgcatagtttgcaaattttttcacccatgaggtaggttgtctgtatactctgttgatatgaaaaaaaaaaaaaaaacactatttttaaatagccttatcccaagtcataatccatgaaactatagtttttatgggcatatttttaaaatctattttgaggcatttatttcattgagaattacatatacacatgtgtacatacacacacacatgcacagaaacacacaccagcccatcaaacccaggagtgcatggattattgcctaagggtgagactaactttaaaaaacactggtcaattttttaaatcattaggagaataataataaaattgattctagaatgtggcaaaaattgtgaaggtggcctgcaaatgattgcagattgaaaaacacaaaattatatcaagtcttatctgcatgcatatgaaaatgacaggagaataaaattcaaattcagttagtgaaaaatccttctaatacacagtctatgtacttctacaaatcaaggcgacaaaccagcataaatgaggagatgaaatgacaggatgtgaggggtgatatgagtggtacttattccccaaatgaaataatgacttactaaaggaaagttgagtgaggaaaaacattgataattgtccaataaatctttccataacctcccattagtcatcagagcatttcagtcccttttttacctaggaagggaagtcagacgtaaagcacaagcaagcaattgctgaagccacaccagggaaccacagggctgctgcttttcccatctcggggtgcctatgggtgttctccttccctgtagcatcaagaccatcagatggcctataagcccattttaaattgccatttgccctttttagaactactgggaaacattcttgtgtgcatcaaaattattttttctcctctggccttgggacctcggtcaagttaagttagctcctcattaccaaaaggatttgaaaacagtagttctgggtactaactcctttgccagtttgccttcatttctttatttattatttcagcacagaactgtgaatctcatactctaacaggataggaaatacttatcagataaatacataaacatttgccaattcagtttggtgttaccaagaagtacaaaatgttgtaagggtctatattaatgaggaagccttgccttagaagtcctgggagtcagggaagaccaccctaagaaattgaagtttggggagaagttagccaagtgagaagagggaggaagaacattccagacagggataccaatttgcactaaagctctaaagcataacggacttggtgtgcttgaagaacagaaagaaatttgtcatgtcatgcatagggtggccaactgtcctggtttgctctggactaagaagtttcccaggatgtggggctttctgtgctaaaatcgggaaagtgttggcaaactggaacagatggaccatccttgtaataagcaataagtacagtgatgttaaaccaagctggagagatgagcaggggccatttatctgaatcaccacttgttactgctaggatcctgccatcttgtctgacttcttggggcctcaagataacaaagatattctcttctgcatatcttcccaaaacttagaggcttaaaaaataatttattagtatctctcacagcctaggagttgacctgactcagctaggatgtctcatttagggtctcttatgcagttgcttgggctagaatcacttgaagcctttacttccagttggatttctccactcatatctggtatctcacctagaatggctgaaacaactgagagctagctgggcatctccccttcacctcacttatgttgtgcacactcatgtgcatagccaccctatgcgactaatctggcttcctcacaacatggtggtctcaacacagtcagactccttacatgggccaactctccctagagcaagcactctcagaggcccacagaagttacaaagtctcttatgacctagcttcagaagttacctcttttgcattctatgggtcaaagtgaatcacaggcctaggccaaattcaaaaagagtggaaataggctcctctccatgggaggaatagcaaaaatcggtggccatctctcttcttctatagatgctgtgggtcagtgtgcctcacagaatcgtggtgtacttcactgacagcaagatatgcttggcctcatgaaaacaagcgaggagtcattgcaagtccaactcaaacatgtatagtttgaacaagacttgtgtaagtcaaggcctcattctgatactgcaacattttacagtccctttcaagaaccttacacttgctctctctactgcatcaaggaatactgcctgatgggctagagaaggaccaagcctaccagtgagaccgtcacctcagttcaaagctatctgccttaagtactttcttcttgtgacatgttggggagttctagattcccctgtgactttcttacagtccccaagcaaatcagagctctctcactcggtagcttggaagcaagactactccttggctctctcttgtttatccagaatctatcgactatcagatgtcagcaaactcattctttaaaggacttgatggtaaatatcttagactttcaaggctttgctgtctctgttacagatacacaacctgaggtttataaactttataaaaacaggccactgggccgggtatggtggctcacacctgcaatcccaacgttcttggaggccaaggagggcggatcactttagcccaagatttcgagagacgcctgagcaacacggcaaaaccccatatctataaaaaaaatacaaaaaattagctgggcatgatggtgcatgcctgtaatcccagttactcgagaggctgagatgggaagatcgcttgagctcagcaggtcgaggctgccgtgagccatgatcgggccactgcactccagcctgggtgacagagtgagaccttgtctcaaaaaaacaaaaggctactggccaagtcccgtggccagagtttgctggccctggattagatgcttgtctcaaggtctcagggataagtattctctctttccactacgggaaatgtgaagacaaaatatcctaagatgagagaaacttcagcttttactcggtggttctgttcaaaagataaaaataatagaacctaggccaggcacggtggttcacgcctgtaatcccagcacttcgggaggccgaggcgggcgatcacctgaggtcaggagttcaataccagcctggccaacatggtgaaaccccatctctaataaaaatacaaaacatagccaggtgtagtggtatgcgcctgtaatcccaactactcggaaagctgatgcaggggaatcgcttgaacccaggaggcaggggctgttgtgagccaagattgcgccactacactccagcctgggcgacaaagcaaaactttgtatcaaaataataataataataataataataataataataataatagaacctaatgcagagcacaagctaaatgactagccaaggaaaatgtcattcaaaatctcccacaccttaaactggaagccagaaaaaaaaactcttcaaatttgtactgaatttgtactttaaagccccaacaggttttccccctgtttcagtgtgtctctgaatattcataacaaatttaaaaccctgtgtagtgtttttcacatgacaggagttcaatggcttcatctgaaaattaaatcagtgttttccaaaatgggaaacatacatctctggtaataaatgaaatttgaggtaggatagctaatgaatactttttgtttgaattgtctatttattgatcacaaaacttattgtaatatgtctttaaaaaaaaactgccacatggaacctgttaccttacagatgttgcttaggacaagggaaagaagatatttacattttttaaaagtcagttgatgtaaataaaaccactaaagaaaaataatatgagagatgatatgaggatgtagaaaaaatttgtgagaacagtaaacaaattattctttctcgggaaacactggaataaatgtttcctatcccatcctggctgttcaaacactggcctaaccacttggttagcacaggtaccatgtgggatttttttgtttattttttattttatgttcttcatctctctcacctagcacagtgcttgctacataaaaggcccacagtaagccaggcatggtggcacatgcctgtaatcccggcactttgggaggccgaggtgggtgaatggcttgagcccaagagtttgagacaagcctcagcaacagggcgaaaccccgtctctataaaaaatacaaaaattagccagccgtggtgtcacgcgcctgtagtcctagctactcagcaggctgaggtgggaggatcacctgagcccgggaggtaaaagctgaaatgagccgtgattgtgccactgcattccagcctgggtgacagagtgaaaccctgtctcaaaaaataaataagtaaataaataaaggctcacaataaatgtagaatgagtggataaattaattaagttgtcactcagattattaggttaatttgagtcacggaaaataacctgacactaactcaaggatctagtatttcagatgttcttaagaacagtctgaagtttgcagagcggaagagatgagcttgtttaaaatcagtgaattagaagtggacagtctcttgggatgtctttgccaagcgaagcccaatggtgccataaatcaggatgtctaattgaagcaatgttttaggaattaaacagcaattaaatcaaatgggaaagtttctaagggacacctttgacaccatggggagaaaagtcaaaacaaccccaagagtctatgggaaaaaaaaatggctttcttccaaagggcttgctggttataattatcaaacatatctgtgattaaaaccctctttcttccaaagactttatgatcttaccatagatttccctcctgtaacatcgtgagccaaagcagaaaaatcaccgaagcatcacaaatgcaggaaaccatggaaaaaagacttggaaaggaaatgtgtagcaaaaactttcatcctgccaaaaactagttttgtgaaaccggttctcaaaatagatggtataacctgtatctgtttacccagcgaaagtaatttaaggcatttcagcctcaatgtcaccaacttcaagagaagcctaacttgagcttgaaggttgatggttggagagtgtgtgtgtgtgtgtgtgtgtgtgcacacgcatgtgtgttataaaaggtttatttaaaactgtggtaaattctttcataacagtgtttccaaaaatatgggactcctacctgcaatagaggtgattttaggtaaaatgtgaacaaaaaacaaaggctttcttattttagcagttacagagtcttatataaagcaaaataaaaatatactcaatacatccatgatagtatgaattattgcttagaatgaggtgaagtttttaaagtatgttaatttctctaaaaagaatattaaggaaataattgaacataggagtaactctcaaacatggcaaaatttgtaaaagttgcttcccaaatggctgaggattgtgaaacactgttctatagcacagctaggactctttctaacacacaatgcaaaaaggaggagcttgcatccttcatttaataaaatccaacaaagacagtaaaaagaataatggggcagaaggtagggatgaagaattcacttttcaagttcagattatcccagctgattatccaagtgatcactttgatgatgagattctggaaaaataaacttcactgccaatacttcaccttacaagcaggtgaacactcttctgcatatttaggaaatatttattttgtgagggttcaagagaatggcaattgtgtacatctcatttttaaaataataactattatcattatattatcgctagcattcatttcattagagaatcctctctatcccaaaaaactagaaaccacgtataagaaaatagatactatagtaatgactatgctggtctcatcaattcagactgtattgtgagtccatcctatgcagaatcctgcgtttgtgattctaattcaggatccagcattttgtagctctgtgattttgtgtgactcactcatccacgaaatcttggttgtaacatctgtaaaacagggatgatgattcccacctcagattgataattaaataagagaatgtataaaatatgtacaaaacaccaatcatgaagttagtccacagcacatgttaattactgctagttttctaggcctctccactttcttttcacccccatcactcactttagcagttctactgtacatcaggtctactgtacatcatccacaaagacctcacatacgaaaggtagaaaatgaacccatttgcttgccagtaaatgtctaccactgcctctaatatcatttgctggaatccaacttgtatttgcatcctgaatcattcatgccttcattcaacgaaaataaatggactgcctcctcatgccatgcaccatgcttgctccctggtaaggaaacaagcaattaaatgcatatgtcaggtacaattttcacacagcacaagctccagtgtgtgaaaaatataactggcttcatttttatcctataaattaatttctttcttggagccctcattatatctaaagtgaagaaaatacctcagttactgcagggtctctttggtaaattcagggatttcccacttgccttcacttggattgcttttatgacttaggtgactcaggtagggatgagtcaagggagaaattggcgatttgtctggtcctcagtgttcatttcctccccatgacttttggtgtctgtgtatggtccctactggcaggtagtagggactgctcttcctacactgcatccacagagatgtccccattcccaaatccacagggttacctgctgtcccatgtctctgtccctttgtgggcattgctttctctgccagctctttcttctctgttgagctctgtaccttttttggggacaaggaaaatgttggctgttgcaaaaagctattctaaacctatgaaaatggagacaggctggctcacaccctccttgcaggtggagctctgagggcttcccagtgctgcaagcatgggtctcctttgcccctcaaacttacctgcggaatctttccatgccctccctaggtctagccccacctaggggtaggaggtcaaacttcaaagttctttccagagatttatcccagtatcttactctcttgtgctcctaagaggctctttttcctccccaaatcccgacattccttccctgctggtgctggggtcagggctaagtaaggttacaggctggctcaggaaatgttcctccgaatctgttgtgatttggccatgcccttggcctttgactctccaaaacccaaagttccattcctctgccctcaggttcaggctcctccgtgactatctcccgtccaaacaaggaacggtcccagtggttaaaagaactggagaagggggaagaaatcaatgaagctgtcccaagattatcccaccatatgagccaatgcaacacagagtgaaaacagggacccaaagagagcacagagcagctgcaatgggaggtcagacaagaaatagaagcttcgggataatgacattcaaattgctcttcacgagccctggtggcctttctcaggcactccatggctccccccgggccacagtttcctgtctggattatatcactcagcactgcaggagaccaggatcatatagttctgaagatgaattaatagtaactgctgcacatgtgactgcaaaactgcagactttcatgaccaaagagacaacctggtgtgtggggaaggacagagtcctgtggcttgggtttgagacaggacttctctagctctcagttctatgaccttggccaagtcactgctcctctctgcgtgtttccttatctgcaaaatgggataccgatccctcttttacagggcttttgtgagactatctgtgaaactactttctcaccgggcacagtggctcacgcctgtaatcctaacactttgggaggccagggcaggtggatcacctgaggttcggaggtcgagaccagcctgggcaacatggtgaaaccccgtctctaataaaatacaaaagaaattagccgggggtggcggtgtgcacctgtagtcccagctactcgggaggctgaggtaggagaattgcctgaacctgggaggcagcggttgcagtgagccgagattgtgccactgcactcaagcctgggcaacaaagagaaactctgtctcaaaaaaaaaaagaaaaaaagaaaaagaaaatgctttatctaccagaaagactacacaaatattaggtatcatttttattggtagtctgtcattagcctgaatatatagccctaatcttgagatgtaccctagaagttcttacaaataccctagaagttccataggggtggataaatccatgacttttattttgtaactatttaattgttattaagggcctggtgcggtggctcatgcctgtaatctcagcactttgggaggctgaggagggtggatcacttgaggccatgaaatcaagaccagcctggccaatatggtgaaaccccatctctactaaaaaataataaaattagctgggcatgttggcccatgcttgtaatcccagctactcgggaggctgaagcaggagaatctcttgaaccctggaggtggaagttgcagtgagctcagattgcaccattgcactccagcctggtgacagagtgagactccgtctccaaaaaataataacaataataataataattgttattacaaaaaaaagcccggtttccatttcctcataaacgctccatctatttaagcttgctaattatttcaatcctggaaaattaccaggataaatgattaactgttcccttaatatgatttcaggaagtaaccaaaaagctaggcttcccaaagtaagccagatcctactttggcagtttaacttgttcccaaaccctcttccggatgacatgtgagttccacctggggctctgcatttcacctttttgctattttcgaaacccgaagacatcagaatggtgcccagggaaggcccccagagacaaaaatgcaagaccggggccaaggggaggtgtgagagccgaccagatttcccaggagctgggagaggcagagatttcttccagaaacagggaaatttatgtggggagcacacagttgggagccgtgagccagttcttgcttacaaatagcaggaagaaactagacggggaagaaaggaagacattcattactgaaggcgagggatttgactgggcctggaaactccaaaactgcagccccaaattgcttcatgaacgaagccattcacttttagccacacgcagacccgtttatttagatcaaattaagatccgaatacagcaatcttaatcatttaattgtttggtggggagagcatcatatagtctgtatcttctttgtttatggcttcaccttgacgagctgtgtctgtgactcatgcattgggtttgccatccactgtcctgacgtctagtccctgcctgaccacttcccagctgtgtgacttcagcaaggggcttgacctctttgggcctgtgttcaattttataaagtgattgtgaggcctgcttcacaatcacaattaaaacttgaagttgtaagtaaaaatgccccctgaccaaaaatgagataaagcaataatgatccaggtggtacctgcattacttagtatcctcagtggtttttttagacatcaatggaggatatgtctaagtctacaattaaatgacattgtactttctcattttaaaacataaaggagtcggctggacgcggtggctcacgcctgtaatcccagcactttgggaggccaaggcgggtgggtcacgaggtcaggagatcgagaccatcctggctaacacggtgaaaccccgtctctactaaaaatacaaaaattagccgggcatagtggcgggtgcctgtagtcccagctactcgggaggctgaggcaggagaatggcgtgaacccgggaggcggagcttgcagtgagctgagaccacaacactgcattccagcctggggacagggcaagactccgtctcaaaaaataaaaattaaaaaatgaaaaatcaaaaataaaacataaaggagtcaacccagatctagatatatggggaaagcatgccatgtatagtaggaataatataaaaacaggaggcggaaaagagttaagcctttcttaaaagggatttttttttctctttggaatgtcatattattgacttatgatatttcagtttctcagaattggaaaataaaggaaaactcagaagtgagtactgcacagacactggctaagtatatatttgcacccccacagaaagaaaaaggctaatggagatactggggcgccccaaaggatcactcacgcctccctcggtgtaggaaacgcagatcacagccatcagatggtgaaaggacaactctccatacttagcagtcatgggaagaatgggaataccattctcggtcgtggggcgtgacagccttcctcataattcttccttaagaatctttatcttatcctctgtcgccctggagatgtttttaaggtcgctgttagggctccagttttaacccagggttcccaagccaagctctaccccgttaggcagtacttggtccacggggagcttcattcattcattccatcaatttgatttaactccttctgagccagggaccagggataacaacgaggaacaaagcccaggccctgcctaaggcaagaaggagcctggaactttcgagaatctgaaaagaaagctggagaggctggaatctagtgagcaaagcaggagagtggcccagacaagcctggagagaaaagtagagaccagatcactccggacacaaagatgatgtcccacctgccacaccggacgagggtgttagacccatagtctcaaccgcaccttcatttttaagacagcattccaattggctattccccctgcctccaaatgagcctggctcctccactggagaaggccaggccctgggtctcacacagtatttagacagaactcacccctcacctcttagcgtggcctgagagcctcagctgcaatggcaaggctctgtatttatataacaagccctgctcaagtatttttaggcctactgtttagaaacacacagagggggcaagaaagagaataaatatggaaatcaaatgtaaaaacttctggctcttgcaaccggcttcctgggggaatattcctctgtgttctttccacttcttctactcagcggaatgactgctagtcattaaggaaatctgtgaggagctcacggtacaggaattgtacaccaatgctcccatcctcatttgcatatcccattttttgattggcagctgtacatgaaatgccatatcagttgaaagtatgttgtgagctggcactaatgatcctatggctccagggaagcctgccatattgtaatttggctatcaggcatgaaagaaataattctaagtgccaggaatgcaagactgaataaatgtttcactgctgcaggttgtcaagggcgacacttctgatttagtataaacgaatgccccgttgcctttggggtaccgggagtttgcattgtatctgagctgtgtgtataaaacattagtctaagaaaatggcttcggtgtaagatgggaaacagaggcctgctcccagaaggcggcggaatgtttacaactaatcactggatgaaaggattttgctaccttctataatgacaggcaaacaggatttgcttttcctgagatggagaataatggttatgttaactctgcctcacctagcctttttttttttaaatgaaatgctcttttgtaaagaaaatcacatctgtttccttttatatatgaaagggatataaattctttttctttccctccctctgtgtgaatagcccgtggtgtaccttggaattaaccctttctgatgtcctcgggtttcagaggtctggaaacatgaccaccacttccttctccctggctcctgacttcacacacctgcctagacagagagcgtctttagaagtggacagcgatcgttttcacttgaattttcactaagatcccaaagccaattcccggcataccgagctccacgggatctcactttccactaacaaacttcccgagcgttcactgtatgcaatgtagaaaacagtggtctaaaaagcagtgcctccctagaagaaatgccactggaagtttcttcctagctgtggcctctgttgaccatctgggacctggcttcaggatcatcttaagatctgttttattttcccttgattctatgtggggatattctttgaagatggtttccaccatgtacttccttgcttggatgtcactaaagtaaaggctcgggtacctgtttagacatgacagaacagcagtcacaggaaaagaccatttttccatttgttctctaggcaaaggccagctggggtaaatcaagactgggctggggagcacctggacctcttttgctctcaagtcttgatttgggaagaaaccaacctgacacttggactcccctcttgaagtgaaacttcattattgcctctcgcctacagttgaagtgaaactgcattgttgcctctcgcctgcagttgaggtgactctcaggtgggcttggcaagaatgggagtgaaaatgataacttaaaagataactaggcgggcatggtggttcacgcctgtaatcctagcactttgggaagctgaggtgggcagattgtctgagctcaggagttcgagaccagcctgggcaacatggtgaaaccctatctctactaaaatacaaaagaaattagccaggtgtggcagcatgcgcctgtagtcccagctactcaggaggctgagacaggagaattgcttgaacctgggaggcagaggttgcagtgagccaagatcatggcactgcactccagcctgggcaatagagcgagactccatctctacaaaaaaaaaaaaaaaggataactaagtgtatggtcagatggtcagatttactcatccctatcaaactgacgcaggagattcccatcatagcaatcccttcagccattccactgttgtagattgtgtcatagggttgtaatacaatacacagatcccataagagacagcatcttacaatgtttctcttcagtaggtgaagaatttttaaattgtaggtggaggacactgaagatactgttcattcaaactcacatttcttgctccttcacttaaatgacacacaaattattgggtattcgctctgtggtgggctttgggggtataaaaataaatgaggcaggtcctctgccctcgagtaagtcatagttaacaggaaatgcgcatcaaaacataaaagcaaccacatctactgtgatgatacaacactgaaggtgggtgaaacccacagtcgagagcctgacagtcacagtcgcaggagaaaatgccagttgaacatactcacctctttaactttcttcttctacttttcttttttttctttctttttttttttttttcttgagatggagtcttgctctgttgcccaggcgaccttggctcactgcaacctctgcctcccaggttcaagcaattctcgtacctcagcctcccaagtagtcggaattataggcgcccaccaccacacctgcctggctaattttgtatttttagtagagatggggtttttcaccatgttagccaggctggtctcaaactcctgacctcaagtgatctgcccgccttggcctcccaaagtgctgggattacaggcatgagccaccacacccggctgcctctgcaagtttcaagggccagcttaaatttaggtttaaattgtgtacccactacatgccaggtacaatatttagctactttcacttatattatgtagtttaattctcttccagtggatgattattcattgatattaagattacagaggttcaatattaagagaaaatgaagtaaaccttgcaggcaagcaggaacatactggaatgtgtgaccttttcctcatcagttatgggagattttccaaaagtatgaatgtctgaaaacccaaacatctacagatagggtcccctcctagtgttcctttcttccaggtaatccaaaacttctcagaacatcagcactcgtaaaaatgaccaaacagagttaactctgcaatatcattcataccacattcaaggggaatttcagagattttctaagtgtaactgggttatgtgtagttttcacttaagcccggactcgaagctcaactcctacacgattgtgtctctattgcttgttgaaagggtgatatatgttcagaggaaattgtgtctaagtccacattaggcctgaaagagggatggtcatggaagacttcattgaggtggtgattttccagaatgcatgaattaggagaggaaattccaggcagagtggccaagactagcaaatgctaggaggaggtgacagagtatggctggctttgggttgaaagactagaagaaaagtagtggcagaggtgaagttacaacagtaggcaggtggccatgctctgctggttgatgttattgtgttgcctacccgcttgctttgagatctccagacctgtggttttcaacagggagatgacttggcccccaggggacatttggcaatgtctagagacatgttggttgtcacagttaaggaaggggtgctactggcatctagtgagtagaggccaggaaagctgctaaatatcttacaatgcctgggactatccccgacaacaaagaattgtccggcctgaaatgtcaatagcgctgaggttgaaaaagccttttcgtctagaccatggccacttattttcatgctgttctggtgtcatggaggcaaatgcaaagcaagtttaaactttgtgtgttggaataaggatgtctcaggacaaatatttatttggaatccctgttccttttgagccagggaatagggtggggaggcagcagagagagcgactttagggagaaatattaaccttgcaaatgtgcgcattttcaattcacatcctagtgacaggctacaacttgtaatcagtataaaatgattttccgggagagtaaatgcttattttcactgtcttgatgttggcactggattacttggtattaatcccagggtgacagagtcacatttggaagccgtgagatttatttggatgtctcgcagggccaggggcagccttcattttacatccttgatcttggataatttaaataatagagctgcttttctgtatacactagtggtgtgaaaaggaagttatccacctaggacatattccaagagccacagaaagccagggaaggaagaagagaggataagaatgtctccatatttattgttatctccatgcttagcagcagcaactattattacaacaaacaatgaacacttattaaacaccgactgtgtgccttcttccctggcacaagagagcaagaaagtctttgctattgtgagcagtgctccaataaacatacatgtacatgtgtctttatagtagaatgatttgtaatcctttgggattataatggacccagtaatgggattgctgggtcaaatggtatttctggttctagatccttgaggaatcgccacactgtcttcaacaatcgttgaactaatttacactcccaccaacagtgtgaaagcattcctatttctccacatcctctccagcatctgttgtttcttgactttttaatgatcgacattctaactggcatgagatagtatctcattgtggttttgatttggccagcaaaatttgttaagggaccagagagtaaatatttttagctttgctagccatacagcttctttggcaactactcagctctgatgcaatgtgaagcagccatagataatatataaacaagggagtgggactgtgttccaataaatctttatttacaaaaacaggcagctgggccagatttgtcctggaggttctaattcatccgctcctgatcaacagcatatactacacttttgttttgttttgttttgttttgttttgttttgttttggtttggtttgagacagagtcttgctctgtcgcccaggctggagtgcagtggcacgatctcggctcactgcaagctccgcctcctgggttcacaccattctcctgcctcagcctcccgagtagctgggactacaggcacccgccaccacatccagctaatttttgtatttttaatagagacggggtttcaccgtgttagccaggatggtcttgatctcctgaccttgtgatacacctgcctcagcctcccaaagtgctgggattacaggtgtgagcgacagcaccaggccgttttttttgtttgtttgtttgttttttgtttttgtttttttttttttacaatcacagctcactgcagcctcaaactctggggctcaaacaatccttccacttcagcctcctaaagtgctggaattacaggcatgagccaccatgtccagcccagtgtactattttaaagacattccttctgaatatttaagcaatgatattaagaatggcaaaatagccgagcacagtggctctcgcctgtaatcccaacactttgggaggctgaggtgggtggatcacctgagatcaggagtttgagaacagtgtggccaacatggcgaaaccctgtctctactaaaaatacaaaaattagacagacgtggtggtgtgcacctgtgatcccagctagtggggatattgaggcacgagaattacttgaacctgggaggcagaggttgcagtgagccaagatggtgccactgcactccagcgtgggtgacagagagactttgtcttaaaaacaaaacaaacaaaaaaagaattagtaattttacatctctgaatctagtcctaagaatatctttggctttgcacatacaaatttttgcacaaatatgttcactgtggtaatacttagaataataaagacatggaggtaattttattggtcaatgatagggcatcagagaaatcttgctctgtgatggagcaatgaaatattgggcagtcttagaaagtgatcattctaggccaggtgcagtggctaacacctgtaatcccagcaccaaggcaggtggatcatctgaagttgggagttcaagaccagcctgaccaacatggtgaaaccccatctctactaaatacaaaaaattacctgggtgtggtggtgcatgcctgtaatcccagctacttgggaggctaaggcaggagaatcacttgaacctgggaggcagaggttgcagtgagctgagattgtgccactgcactccagcctgggcaacagagcgagactctgtctcaaaaacaaacaaaaaaaaatgaaagtgttcattctgaagggttttcatggtgtacttaagatgtaatattaagtcaggaaaagtgagatagaaattgtgccaacagttttgtagcaataagtataaatccacattgcatggaaaaagagtaggaggaaatataccaaattgttaaggatggtgaggctatggggtgacttttcttaaatttaattccaacatggattctttttagcattgtattcattcttttttattttttaaaaaaacttcatctatatttctttggggtacctatgcaggtttgttacatgggtaaattgtgtgtcttgggttttggtgtacagataattttgtcacccaggtaatcagcataataatgcaaaagtagtttttcttttttttcttgagacagagttttgctctgtcaaccaggctggagcacagcggcatgatctgggctcattcaacctccacctcccgatttcaagcaattcccctgcctcaacctcccgagtagctgggattaccgcatgcaccaccacgcccagatagtttttgtatttttagtagagaggtttcaccatgttgcccaggctagtcttaaactcctggcctcaagtgatccacccacctctgcctccccaggtgctgggattacaggcaagccaccacacctggcccaataggtagtttttcaatcttcaccctcctcctatcctccaccctcaaatatgcttcgatgtctattgtctccttctttgtgtccatgtgtactcaatgttcagctcccacttataagtgagaacatgcagtatttggttcccttgttcctgcattaatccgcttagtataatgaccttcagctctacccaccaacataaaattattaaaagagggcaagtgttggcatccaacagatttagctttgcagttctctggctaagcaggtgaccagtgcaaggtgacttaagctgtctgagcttcagctcacttctttgtaaaacacatgtagcatctgactttccagattgatgggaagattaaatgaagtaatgcacataaaacagccagcagagtgtttgtaacatagtaggtaccaaacacattgtacctgttaatatcattattctgtttgttccaagcagtctgtatcttagtttcggtggtgattacataaatctatgcaagggacaaagttgcatagaactacacacgcaaacacacacacacacacacacacacacaaattgtaaaaactaaggtctgtagtctagttaacagtattgtaccaatgtcggtatcccggctttgatattgtactccagctatttaagattgacgtctccacggggagaaactgggaggttacataggactctactatttttacagcttcctgtgaatctatgattatttcaaatgaaagagtttttaaagtacagtaaaacttttttaaaaattctaacgacttccataatttgcatctcatctattcaggtgaggtaggaaaagttaggaatggtttgttattatttataaaaggaaaaactgacagagtgactggttgctcttctccaggtcaatcagaaaataagaagaaaaagaaaagccatgtcactgaatgttcaggactttttaacggttgctgatcctgcctcaaaagttgtcctgtgtttaatgggatttatattccctcaataaggaatgtgacctctgaggtttaaggatagacctgctatctcattctttagatgtatgtaaaaggtggtcaatggacaaggatgtcagaacagaacatagaatcccatgaaccgatgtccccagttgaggtttggaataaggcaaagcaggaacaagtgactgtctcaaagaaaacaataattactcaagtgtttacatgtgcttatcagttttattatttttatgtgtactattaaaactgaaaataagttgtctataaattaagaaaactggcttaaggttgctacagttacaactctccttgcaaaaactcaagtcactaactcaccaaatatctgctaaatatctgccatgtgcagttactgttctggatgttggagatgtgataatgaactagacccatccagtcctgctcttcaggaatgtggtttaggtcaaaaggcaattgattagagcctgccttttcccacttgcttgccatgtgcttttaacagttgcctgggccttaatctccttttcctggccttatttatatagcaatgacaaacacacatgttcacttaccagccccacctcttgcattcaaagcaaacatcactaatcaatctgtctcaaaaaaaaaaaaaaaaaaactgttcttcaattgcctttacctatctgattctctcaaagctccactcatgaaatcccacctgtcccccagaactcaccaaaaaaaaaaaaaaaaaaaaaaaaaaagatccaaagtcccctccacatgcagcctccactggctctgttcctctttgccacttcccactcacctccttcttgccttcccatgtctctgctctttcttggatttaaacaacaaagcctagaagctgcgctagtcaagccaagttctcttcagcatgcggggaaggtagaggagctttaaagtggaggaaagtagaattcagtcatgtgaaatcaaaggtgaaatgataaaaagaataaggacagagcacaacccaccagatcaatgaaataatgtctgagaaagcacttcaaagagtgtccagcacaataaaaatagattgtcctggagaagcagtttctggagtaagaaaaatgtgacttttagatggatcttgaagaattaatggaacctggacctatggaattagagacgatgagtaagcaaagaagaaggaagttgagatggcagtaccagcaggagaaagattctgtgcaggaaagggttgggtgtgttcaaggagcctgcatcagtctctaaactgaggtttcctacgtttatttcctgtctgggacattctgtgacacatgtccaaatggaaaaatcattctccattgagctagccaaatatcttcaataaataatgcaaaaattattaagacattttccagaggaccacaccatttcctgtcttgacaatggagctggatttgacatcagctaattcaagaggttagaaataaaagctgtggccaattcaaacttcccttccaaatgtttttcaataatctgaaattggtccaagagacaggacttgtaatcaacttttttcaaaccatcttaacatctttcatgaagtcatgaacatgaccgtgcagacgtgccattgactaattattgtcctggattgtgggaataggaaggaacattgaaataaacgatgacttcactggtcaacctatggaatgttaaaagaagagggagctaaagggaagatgttccaatagcatgcaacatgaccttggggtaatgagatagacacacattggaaagttttaagcgtgtttgtttgtttgtttgtttgtttgagatggagtctcgctctgttgcccaggctggagtgcagtggcgcgatctcggctcactgcaggctcctcttcccaggtccaccgcattctcctgcctcagcctcccgagtagctgggaatacaggcgcctgccaccacgcctggctaattttttgtatttttttagtacagatggggtttcaccatgttagccaggatagtctctatctcctgacctcgtgatccacccgccttggcctcccagagtgctgggattacaggcgtgagccactgtgcccggccattttaagggttttaatgagaataatacaaaatatccagctcacatgtacgtatcgtggttctgatgcaccagctgctattctaagctgttgacatataccatgtagtttattcctgacaatgaccctgaaagaggcaggcacttattcccattgtacagatgaagaaactgaagtggaggaagttaagtaacttgtccaaggtcacaccatcaaaaaatgaaacagtcagcatacaggtactatctctccaaggaacctccagagacaccaatcaaaagagaatgcatattctccttgcaatcccatcagttaaaaaagagagagagaccaggtatgggtggctcgtgcctgtaatcccagtattctaggaagccgaggcaggtggatcacttgagctcaggagttcaagaccagcctgggcaacatggcaaaaccccatctctacaaaaaatacaaaaatcagccaggtatagtggctcatgcctgtagtcccagctactcgggaagctgaggtgagcggatcacttgagcctaggaagttgaaggctacagtgagccaagatggcgccactgcactccatccagtctgagtgacacagcaataccctgaaaaaaaaaaaaaaaacagagagagaatgctgagaaaatcctgccccaaatctctaaaaattaccaaggcaaacatgtagaaagctgaaactggatcccttccttacaccttatacaaaaattaattcaagatggattaaagacttaaatgttagacctaaaaccataaaaaccctagaagaaaacctaggcaataccatttaggacataggcacgggcaaggacttcatgtctaaaacaccaaaagcaatggcaacaaaagccaaaattgacaaatgggatctaattaaactaaagagcttctgcacagcaaaagaaactatcatcagagtgaacaggcaacctacagaatgggagaaaatttctgcaatctacccatctgacagagggctaatatccagaatctacaaagaacttaaacaaatttacaagaaaaaatcaaacaaccccatcaacaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgatcattaaaatgtcaagaaacaacaggtgctggagaggatgtggagaaataggaacacttttacactgttggtgggactgtaaactagttcaaccattgtggaagacagtgtggcaattcctcaaggatctagaactagaaataccatttgacccagccatcccattactgggtatatacccaaaggattataaatcatgctgctataaagacatatgcacatgtatgtttattgcggcactattcacaatagcaaagacttggaaccaatccaaatgtctaccaatgatagactggattaagaaaatttggcacatatacaccatggaatactacgtagccataaaaaaggatgagttcatgtcctttgtagggacatggatgaagctggaaaccatcattctgagcaaactatcgcaaggacagaaaaccaaacaccgcatgttctctctcgctcataggtgggaattgcacaatgagaacacttagacacaggatggggaacatcacacagaggggcctgtcatggagtggggggagggggaagggatagcattaggagatataccttatgaaaatgatgagttaatgggtgcagcacaccaacatgacacatatatacatatgtaacaaacctgcacgttgtgcacatgtaccctagaacttaaagtataataaaaaaatgaagaaaaaaaattacaaaggcaataatgcaaccacctcagcacatccaggaagactggatgacttgcccaagattaagtgaagtcaaaaccagtacttgaacaaggattttctcactcccaggtatcaagcaatcccctgagcattcatttctcatctggacatgagaaatgtgcactggacatccaaatacctgcttaccaaatcatcgattatctgccaaagctcttcagcaagtaatagcgttgtaaaaagtattttataattaggagtatctgaagtcagaccaactgatttgaatcagcattaccatttattaacagttctatcaggccaggcacggtggctcatgcctgtactcccatcatcttgggaggctgaagtgggcagattgcttgagcccaggagttccagaccagcttgggcaaaatagcaagacaccatctctacaaaaattgtttaaaacattagccagtgtgatggtgcatgcctgtagtcccagctactcaggaggctgaggtgggaggatcgcttgagcctggaaagtcaaggctgcagtgagccataattgcaccactgcactccagcctgggtcacaaagtgagaccctgtctcaaaaacacacaaaaaagttttatctgtggataatttagatcctgctcaaattatcagtttttttcaccagtaaaatgggaataatcatcatagctatttcatgggattccggaagattaaatattatgcatgcaatgcatacactgagcaccatcccttacacatagtaagtgctcaataaatattcaataataataataaggaaatcatagccacaacatgtgttatgctgtgttcattacaataagactgtgaaacctattttgatgaagcaggccattatagcttgagtaagaaataaaataggcaaacaccagaactttaacctaacaccatgaccactcccaaagtttagcatattactggaaatcgctaacggagcactgcccattattcatgatatgaacagtaaggaatcatgcataatggaacagagtccctgctaacagcagattcacacacgataatttaaacttgtttgtatggaaataaaggacgagtctttgaagtgagccttaatgagattctgcttgatctttggtgtatcctgggagaaagagttcaatttttcctccagcatctgactcatgttggtggcgtgcaggaaagaaagggctgacttaaattatgaatggcctttcttgtctttgtgatagcaggtgaggagggtggcactcatccgggggcactggggagatgcagggagacaatcacagttctccgaggtggcctctgcatctgaaacttagaggaaggcttggtgggctggagcctcggaaggcattcgtcatccagaaggatgctttacagactctgaagaagcaaaataagctggtgggctctggcaggagacgcagaggtactagtgtggccccgcaccttttcaaattctgcttgtgcatgaaagggattcagctccatcccaagctcatgctggaggagacctggcaagcagtcgccttgccagtcgctgctgacctggctgctgaccaactctgaagagggctcggtgtttgctcaacgtggcctggctgtcagaaggtcccaggaagtgggttgtgttttggttgccaaatgcaagagagtatgagttttgagtttttgaaatcagttcaagtcatgggacaggtctacctcattaagtggccattagatttatgatgaaaagatgacgactgtggagtgctgtgtacaggctggccactcactgtagagtgcagagtatagactggccactcactgtagagtcctgaccacaggctggccactcactgtggagtgctgagcacagtttggccacatactgtagagtgctgagcacaggctggccactcactgcggagtgctgagcacaggctggctactcactgtagagtactgagcacagcctggctgcacactgtaggatgctgagcacagcctggctgcacactgtagggtgctgaatacaggctagccacacgttgtagagccctcagtgcctgctagatgtcattttatttttctttttacctttatcactttgagggctttttcaagtctatggtctttcaggctcaattaattgtaactaagcctctgagacaaagtgcttgttgaatgtcttccactgttccgacacagaaacgcagcataagtcgaagttgcaatggacagcatacgtcgaaacttcctctgtgccagactccttgtggggactctcttctcatcgcctcctttagtcctcaccactgccctatgaggaagaatgtgctttttaacttcattttacagatgagaaaactgaggcccataaggcgaagttactctctcaagccagtaagcagtaggaattgggatttgcactcagcacccatttgatcccggagtccgctttcttgattgtactctctactgcctcaccttcaatggcttcctctaatggaaaagcctgccctcaccctaatgaatactctcagctgggcacagttaagggatgacctctgtgcatctaatgagttcatctcaatccctccccagggtacagatgtgttgtgtaacttgggcatcgggaagtccaggacggagcaaaacagaggagggtgctctcccagacctgtatcatccacctccgttatctcccctcacacagactcaagaattcagatcccacctatgttgccttggtattctaacaaacatctctcatgtttaagctaacatgtcctaagcattatgttaagagggtttcatgcattcaatcatgtagaacttttattcccatttgaccaatgaggctcctgaggctcctgcaagttaagtaaccagcccgagaacacacagcagctgcctggtgtgtcaggacattcctgcatcgttggtgtgatcgatgcatgcttacctctgtgtgcctgaggcggtgctctgtttggggacactgcagtgactgagacagatcaggtgactgccctcagggacctacactctggaggggagacacaggctaggaacaaatatacaaattagacaacacagtcatgtgtccagtagtgacatttcaatcaacaataggctgcacataggacagtggtcccataagattgtaattctatatttttactgtaccttttctatgtttttaattatactttcttttttattattttgttttttatttcaataggttttgggggaacaggtggtgtttggttacatgggtaagttctttagtggtgatttctgagattttggtgtacccatcacctgagcagtgtacactatacacaatgtgtggttccttacccctcactccttccaacccctcccccccgagtccccaaagtccattatgttgttcttatgctgttgtgtcctcatagcttagctcccacttataagtgagaacatacgatgtgtggttttccattcctgagttacttcacttagaataatggtctccaattcacaggtttctgtgaatgccatcatttcattcctttttatggctgagtagtattccatggtatatatacaacacattttctttttttttttttttttttttttcttcagacagagtcttgctctgttgccgaggctggagtgcagtggtgtgatcttggctcactgcaagttccgcctcccgggttcacgccattctcctgcctcagcctcccaagtagctgggactacaggcacccgccaccatgcctggctaattttttgtattttttagtacagatggggtttcatcgtgttaaccaggatggtctcgatctcctgacctcgtgatctgcccgccttggcctctcaaagtgccgggattacaggcgtgagccaccgtgcccagccatataccacattttctttatccacttggttgatggacatttgggctggtctatatttttgcaattgcgaattgtgctgctataaacatgagtgtgcaagtgtctttttcatataatgacttcttttcccctgtagtgggagtgctggatcaaatggtagatctacttttagttccttaatgaatctctacactgttttccataatggttgtactagtttacattcccactggcagcataagtcttttctatgtttagatgtatctagatacacaaatactcaccatgggtgttgcagttgtgtatggtactcagtacaggcccatgttgtacatacttgtagcctaggagccacaggatataccatgcagcctaggtgtgtaggaggctatgccatctaggtttgtgtagtatgctccctgatgttctcaaaataatgaaatcacctaaggatgcatttctcaaaatgtatccccatggtttagagatcatttctatgaaaaaaagcagcagaaagaggcaaaagaaggcactgaggggaaggatgtgttagtttcaatggggtaaccaaagagatcagcctgagaaagtgacattcgatgcctgacctgaatgagtggagggaggtggaggaaacacatgccaggcagtgggatgcttgtgtgcagagtccccggggcacaaacaagttggggaaacatcaggaaggtgcttctgccccaagtggggtggaggaagtgagtgagtcagaaaggagggttgcactcagccacatcaaaccgaactttgattctgcagcctgttctcctacccaccacactgttcagctcccagggctgcctcaaaaacatcaactcccaaatttcagcttttatttcagatacacggggtacatgtgtaggattgttacctgggtatattggaccaaggtagtggacgcagtacccaacaggtagtttgtcaacccacgctcccttccctcccgctctccagtagttcccagtgtctgtcattcccatgttaccaccgtacatgctcagtgtttagctcctagttatgagaacatgtaggatttggttttccattccttcattaattcgcttaggatgatggcctccagttccatccatgttgctgcaatggacaagatttcattcctttttatggctgcatagtattccatggtgtaaaataaaagctgaaatttaaaaacaactacctcaaatcacttttagattgaggctccataaataaatgaaattaacccagattacaacaaaaaatcaactcctgatgtccactttacctgaagtttctctcttctgcgggttccccaagtctctttctttttagattattaccaaatgtagataccctggaatccattctctttttaaataatttgaattaaactaagataaatgtccaccaagaagtgaggagtagagaactctgtgtgcagcatccacatctggtctgtgtcctccttcatgttcacggatggctctgctgatggaggccaccctgagtgtgtgtgcggtacacatgccatgagaaaggggtgccaatgtggctgctcacacacagaaacgcttccatctctgagagctgtcgaatgagagaatgtgctggtgcttttatactgaagcatatcaatagtggatttgtcaaactagccccgtattcaggtgcgagtcttcagtatttccagctgaaggtctgcggctcgtaggctctgggcatcttcccctcttctggcacagtttggcttcttccttctgctgaatggatgcattctttacacttttgattactaaccacagccgtgagccaaaacgttataattaaataaaataaacagatcctgggatgagtctttgaggaaaaagcagtcttttaataatcaaaatcttcatgcattttatttcatcattatgctaagatgttgagagaaatggatttctagaatatgacctggccctgactttgtgtctagtcaattacaagttcgagctaaccacctcaacatttcaaggatggccttttctttttctttttttaaaacagcaggactaaaatttcattgtattgaacataaatgggaaaacgtgcattgcagagtaaaatttaaaatgcttttatggaattttcattataaaactgcctgtaatggagttgaccttatattcacctaagatttctctggctccgagttcagatttcatgccaattaacatgttaatgacatatatcatttaaaaagcccatcataacttttatcacatcatgttacatctatttccttgtaattaaatcagaattacagggtgtaattacttttcttttcctgaatacccattccttttcagacatttaaattcaagtgcaagtactaaaagacacttgaaagtaacaacctaataaaaatattatcagttaatgaaagcgttgggtttctcctactctctggtttctttttgacaaattcctatctccccatgtactttgcatgacatgtaatgattggtcgtatccagtcaaatgcttcctaagctctttaaatcctcagggccctagtctctattaatatgcaacgttctcacacataaatataattacatacaattattagcggaaaaggatcagataaggtttattaacgaaatatcctataatcatccaagtccaagacttccccttacatgctaattcaatgaagggttagagtctgtaatcactacacctgcattgatcactgatggcaggatcaaagaaggggaacacctttgtttaaaagacttaaacaattattttgtagacaattctattatctgactgcttctgttcttccacgcactcttcgacatccaatttaaaacttaaagttggccgggcatggcagttcatccctgtaatctagcattttgggaggccgatgtgggtggatcacctgaggccagaagttcgaaaccagcctggccaccagggcgaaaacctgtctctacaaaaatacaaaaattagccagctgtggttgcgcgtacctatagtctcagctactcaggaggctggggcaggagaatcacttgaacccaggaggtggaggttgcagtgagctgagattgcaccatggcactccagcctgggcagcagagcaagactctgtctcaaaaaaaaaaacaaagttgcatcatacttaattttggaaacttgttgtaacttgaagtagtatctaagaactgggaagtaatcttacaggcgtgtgctgtcctatgatgatctattaggattgtgtgggcagaaccaccggggactgacatatattatttgaggaagtcagcacttgaaggtaggtagaaaacgaactcctttgctgtcaggaagttctgcatacatagatcaaatcactcattcatttggcaaatatttattgagtgcttataacagctaggtacttttttagtcctaggtactattttagtcctggtcaaggtcattgttgccaaggtgccaacattctagggaaagagaacagaccataaactagtaaacagaagaataaataagataattgcagctagtgatgagagacaagaggaaaagatagcagaacaaggtgataaaaagaaatagtggccaggtatggtggcttatgccagtaatgccagcatttcaggaggccaaggtgggtggattgcttgagctcaggaattcaagaccagcctgggcaacatggcgagaccctgtctgtatcaaagatacagaaaattagccaggcgtcatggtgtgtgcctgtggtcccagctactctggaggctgaggtgggaggatcacttgagcccagggggcagaggttgcaatgagcctatattgcaccactgcactccagcctgggtgacagagcaagaccctgtctcaaaaaaataaatacttttttttaaaaaaaagaaaataaatagtggtgaggtggatgattctagacagggtagatgatgaaggcatctctgaggtatctaacttttgagctgagacctaagtagtgtgaaagagcaagagaggatcagggggcacagaaccaccaactatcaaggttataagagggagagagctgatgttttggaagaaaaagagcaggtggatgtgtctagatcaaagggagcaggatcacaaagatggcggtaaaaagatggcaccatctatgtagactctccgggctgccaaaagcttacagattttgctctaagaatgacagaaagcagctagaaggttttaagccaggaggtgacattattcaaattacattttgaaaaggatattctgggtgtagaggctggatttggagaggcaggggtagaacatcagacatttaggaggctgttggtgccatctgggtgagcaaaggaaccagcttaacctcagcttgacctacctgtgccaggacacaggtagagtccctggtatggcaggtggacaagcaagggccactaaacaggcatgtggcagcttgcaggaacccccaattcctcctgaccatttcttgaacaaatatatcatatctaccatgtgccaggcattgttttaagctttgagaatgtagaagtgagcaaagcaggcaacatcttcttcttatgggtcccaaataatgacagaagagcaagtcaggcgatgaaaggtgtattggcaaaaactaaaacatggcgtggggattgggaagaacagggaaggagggagagacaggtactttagattccaggctcagggaaggccacatggaaggcatgatatctgcatagtcctgaatgaggtgacatcaaaatgcaacccaaatgtcaactggtcccacgtcttcctaatccctacattttgcctctgttttcctttgatgccaaccccaaactcagccccacttcagggtctctcactaaagcaccaatgagcaatggggatgtcagaaaatgttcaccagggaaacacagcagtgggggtaacatcatgtgtacagtgacccctgacgaagcctctcccacatttctctagaaaaatcctaaagatttcttttctcttccccgctgcatgtgacctccagctttcttcttgaattcctttcttcttgatttctcttgtttccacaatatctagtcctgctttctgctgcaatgcagagcaattcagcttggcccccaatccacccaccaagccctccagcatactcagcaaaacaatgctcttctgtgaaaaggtgacacagtggtcatttttgccccttagagtttcacctcctcattcctatcacaagtggctcaatatggtatttctccttaaaacactcagtgccctcactaagagaaattcttttgaatgcaattatcaccttgcaaatgggttatggacaggcatgtgcctagaagttccccacttattgagcccagagattcatttccatggaatctcgtggaaatgaagaggatcagaagccacctaagtttgcacagcttcttcctgtccatggttacctatgtttactctctctccacatataaagtcaggctgagatgagaaagtaagggaattcttgccatacatctatggactttggtttaaggcaggggttggcaaactacaaccagtgaaaaggtcttattagaacacaaccatggccttcacatgcaggttgcccatttctgctttttcactatggtgcagaacaaactcattatacagcacaaaagcagtgccatgtgatacacatgggtgtgactgcattccaataccactttacttctggacactgaaatctggctttcatgtaattctcacatatcatgaaatactattctttaattttttccaaccatttaaaaatgtaaaaacaattcttagcttgcagactttacaaaaacaggccacaggatgcatttggcctgtgggtcacagtttgccaccctgatttaaggggttgttaacaaacatgagaccctctgagttactgaatcaatctcagcatcacgaggtctcagcattctggggagaaagcagagctggtgtccggctgtgtctggactccccctgaatccgccaggtggccagtctccagaatgcctgtccttccacagaaatgctatccctttccgttctccaagtttggagtctgagccctttgaggaagggtcctccttcttcatcctgatgtccccagcgttcgacacagagtccagtaccaagcaggtactcaaaccacattagtggagaaaagcaacccaggaacatatgaaagacacagcatcttttgtgtggttctcaagccagtctctaatatcgttaatgcatttgataagataaaatcattacttactagcaaaatgaataattagccatttctcaaaacctagtaggataggcaagaaggaggaagacagggagctatgtgtacataagagtgatatgtctaagtgacttcttgaaatacagagcccattgtccccactctgcagtggaaatccatcgatttccaaatgagttgaggccatttcctgacagttgggaggaaaggggccaaaccgttgggctcctattcgtcttcagcattttacaattaagagctggccttgtttaaagcccaacctgtcattactgttaatattgagatcggacactttgatccgaatggaacctgactgcctgatacaacccaaagttaagctgcttccaaacgtatctttcactctgtatatcatcctagctggctgatgtctgtttcaactgagcagtggggtgatctcacgatggtgcaatggagaactgatgttgcatgaacttttctgctgttgtttcttttccaactgacagcttagccctgcaccctaggccagcctattcttctcgtagagacggtcactgattccctctcttctgattagcctgggcaatgattgggataatttaggacgtgcactgtttgatcatctgtacacttacaacaaataaaacattttaatatgagcagtcactgcatgtttactgtatcatattgctgagagctgaacaaatgccaaacgctataacagaaggggggatgtgaactccagaatgatgacactaataaggaaattacaaaaggcccaacaaatggcatttatgttaaatcaataatgctctgtttgttttttttaattctaatctttcttcagaaaaaaaaaattatctttctaaacagttggcgattcctattcttgttcgtcttcctgaacataattaaaaacatgttgtggcgcctacttaagacatcaactttcccaaggctgtcttgtccactgtgttttaaacaaagacacttgttttggcattgtgcccttaattaatcatttgaggctttattgctgtaccaaaaaaaaaaagtgtctttgtttaatgattcatcacaagcccaatttctgcagaacttaatcaaatacagaaccaactttctaatcagcttgaatattaaaaaaattgatgtagtccttgttttcaggatgttgtttgataaaagaaatattggtatgtgacactctgttcatattggctttctttcatggaattctttcatgaagatgagatgaacgctttgcttttggagtcgagaatggaagtccattgttgattgagaaaatagaaactttgacagcccagtgaatgtcatttagcatctgggccttgcagagctggggacaaagccttgaaaaaggtcttcagaattcacatctttgttttcttttcttttttttttttttttttttttttttttttgagacggagtcttgttccgtcgcccagactggagtgcagtggcgctatctcggctcactgcaaactctgcctcttgggttcaagagattattctgtctcagcctcttgagtacctgggattacaggtgcatgctaccacacctggctaatttttgtatttttagtagagacagggtttcaccatgttggccaggctggtcttgaactcctgacctcaggtgatccacccacctcggcctcccaaagtgctaggattacaggcgtaagccaccgtgcctggttttgtctgccatttttaatgttcactctgagaatcagagggcgcatcccaggatgaaggtgactctgggacatgctgaccgcagctaccctccctgacttaccacttacatagatcaggccatgggctctcccctactttcactcagccttcaaaccaccagctccaccagcttcctcatcaaacttgctttctccaggcacatccctgagcagaattcacttaaaagttactgatgtaagaaaaaacagagcaaatcaaggcacctgtaagttatgccaaggcacctgtaagttatgaaaaaggtctcagtacgataacaaaatcggtggaggaggaggcatagcatttgaattaaatcaacttacaaaacacataactctctgggcttggcatacataacaacctaagaagaagtttgggaattctgttattatcgtcacattattattattattattattattattattattattattagctgtgttatatttatgaaaatgtaaaatccatggtattgatcataagcaccttttttttttttttggcacggagtctcgctctgtcacccaggttggagtgcagtggaactatctaggctcactgcagcctctgcctcccaagttccagtgattctcctgcctcagccttttgagtagctgggattacaggcatgcaccaggacgcctgggtaacttttgtattttagtagagatggtgtttcaccattttggccaggctggtctagaacttttgacctcatgtgatccacctgccttggcctcccaaaatgctgggataacaggcatgagccaccatgcccggccattggtaccatttttaaagcactttaatatgagctgtaattcaatgttccctggatcctgctccttcaagtcaaatattagtgcaaatgccacttatgaaacactttcctgttcataactgtgaaccatgttcagcattttgggggtatcttcttctataagacgggaagtggggccttcatgtcacagaagagtgagtggaggctacgtttgacctgaagtttttctacagctaggaccatggccttggcctccctcaaccttcctgacatgatgtggagtcccaggggcctccagtctcaactcatcccagacttggcatgaacttatgtaaagggagaaaactgtgagcacttccctaaaatctaagggcagcctgcggactctgggtctccaagtgagctccatgtcttggcctggggcaattaggaaacagtggttaagagcagagctttagaatctgacagacctggcctcaaatcccaactcctactgtgagcccctaggacacttaacataagctctctgaacctgtttcctcaccttaaaaaaagtaacttaagagtacctaaggctgaggatgatggctcacatctgtaatcccagcacttcgagaggctaaattgggaggactgctcaaggccaggagtttgagaccaacctgggcaacatagtgagacctcgtctctataaaaaacttaaaaattggacaggtaggttggcacgtgcatgtaatcccagctgcatgggaggctgaggcaagaggatatcttcagcctaggaagtcaaggctgcagtgagctctgttcaagctactgcacttaagccaggatgacagagcaagaccctgcctcaaaaaataaaataaaataaaaaaaagagtacctatctcatagatggaattaaattagcctattcaagcaagaacatttaacaaagagtcccacacataatgagcattaaataaatgttaaaacatgcatacatgttgaataggcatgttgcctgaagggtgatcaaagcatcattttctttctttctttctttcaattctgttcagagggaataaacattcccctcccttgaataagacttcaggcaactcatgacttttctgctcactcttagcagggacgagcccatggtcccattaagactcagttcacagatccaattcagagtcagaaaagtcaggttaacacgtccggtcctgctctgggctggaggcacccagtgggaaattggagaagggctcgattcttctctatggctgctcctctggtctcctccccagcctgctgacaatagcttcaggatagttagaaaagggaatgggacaagaaaggtcccagccctggagcaaggctactggttcccagcctgtgtgctccaggagaatgatcaaagctgacccattgttggttttgtttttattgtggtaaattacacataggataaaatttacgcttttaaccatttttaagtgtacagttctgtggctttaagtgaatacaaactgttccacaaccatcaccaccatccatctccagggaaacaagctaactcttgatttctgggcactcacgggttctgtggacggttccctctgggccgccacttatgaagttccctgctccgggcagaggcctccgtctctcagggggtgcacagtgactctccacgctgcttccaaatgtcaagggtccaccttcagcccctgactaagggacagcctcattaaacacgcctcagcaccaccacccacaggctctctcccctgcagggcctgtaacaatcactccccactccttccctaaacaaactgtcagaggtcagctgatccaagcaagcggattcctcctgaaacccatgggagcagctagaagccttctgtttctggaaagacctccgatcccagtcctcaggttggagctagggaccagggctctctggctccctggcaggcctcgacatcttcttaacccacccccggtattcctgtcccaacaatactcgggtttgtcttggctcaggttcccccagaagcctcctctaaaacaaggattcctgatcccaggaacccccaataggggagagcggaagagggacagggaggggaagagcagctgatcatgcacgatgtcatcgtgggtaactggcccttgatcctttagagttctgggagcagatgtagaacatagtcctcagagagagctggggtgtttacaaaccaactcccgctgatcggtggctgaccgtggcaaggcgcggaagtgagggggaaggaggccaggtggagggatttcactttcagtcactttgctgcagatgtctccgccagtgggcgctggctgccagagaaagtccccagacaaaggatgcaggtgctggacttagaaatcctgcagtgtggccaggtgcggtggtgcacgcctgaatcccagcactttgcggggccagcgggagatcacgtgagctactagctttgaatcttagttctaccacttgcaagttgtgtgatgtcggggaagtcgcttcacttccctggctcagtttccccatctgataaatgggactactgaagtatctatttcatatggtgggtaggagatgacacgagttaatatgggtaaagcacttagagaatgtttgacacatagcaaggactactccattgtgaagtattttccatccattggaattgcataagcacattttagttttctatgccaggagacccagtgcagcctttcaaactaatgaaggaaattcttctatgctgatacagagcaattgcaagagttattacttagtggaaataccaagtgtctatagtattcacctttgtgttaaaaataatatctacattatatccaaaaaagttcttaaaaataatattaatatagccagtaatcccagtactttgggaggccaaggcaggaggatcacttgagtccaagagttggagaccagcctgggcaacatggcaaaaccccatctctactaaaactacaaaattagctgagcatagtggcacatgcctgtagtcccagctatttggacttgagcctgagaggtcaaggctgcagtgagccaagatcatgccactgcacttcagcctgggtgacagagcaagaccttatctcaaaaaataaaaatagaaataaaatttaaaaaatttaaaaagaataatatatacatatacacacactcatgtttatgtagagaacatttctggaaagatcagaaatgagccctcgggttacaggggtactttatatttttgtagtgtttgactttttactaagttcttgtactgttttttcccaggaaaacttttatttaaaagaataagccagtactggctcaacatagtggctcacacctgtaatcccagcactttgggaggccaacgcagaaggattgcttgagcccaggagtttgagaccagcctagacaatatagccagaccccatctctaccaaaaaataaaaggattagccaggcgtggtggcacacacatgtagttccagctactcaagaggctgaggtaggaggatcacttgagcccaggagttcaaggctacaggcatggatggcatgactcttttgccagcagcctgccaggagctaagatcataccactgcacttcagcctgggcaatagagcaagaccctatctcttaaaaaaaattttatttaattaaaaaatgaaaagaacaagccaggactattctcagtggtttaatagcactagacttaaaccaagggctcacgcaagcacatttccatgtgaatcttgctgattttcttgttaataaagctgctgagcttggtgaagtgaccagagtgaccaggctcctgagtgggcagacctgggtctgccgccttccagccacgtgacctaagataagccatgtcactgtctgcacctcattcttttttcagatggacaagaacagcttcttcagggtttttagaggattgattgagataatgtttgtaaaatgctgaggacagggcctgtcatatataaataggggttattattatacacggtggctgatttctaactgcgagctttacaaaggtggcagcgaatcaagatagtcactattgtcatttatgcaaattaagaagacaacacctagaaaagaaaatatctttcccctctctctttcatttgcctttaacatactccattattgaaaacccttaaggcttctgttgaaaacttacacaatcaacacattaaaaatcagcaaaatgccaggttggctattgtctaagattcatctttgtagtctaatgaatgtcttaagaaatgccagtgggagaaaaaaattaaatattgcaatgataaaatgatcagtacagatgattccagagaagcaggcactgtagctcctatcgctctgctctccactggggccccaggcccctcattgccccctacagtctctgctccttcctctgctccccaccccttcttcctcttcctccaggcaccccatgcaccccacacacacagcctcctactctacaggcctcccacctagcacactcttactatcctaaaactattacagataatttacctacctgtacttgcctatgcagctgcccccaaatctgtataatatcctaaccccataatataaatagtaaacaaaaagaaagtttattatagtaaaacgtgatgtatgtgtgtatatacatattatatgtgtgtatatacatattatatatgtgtgtgcctgtgtgtatatatgtgtatgcacacatgcatgcttgtgtactataaatgtatgtgtgtgtgtagatatacacacacacacacacacacacgcacacacaggcatgacagtgttaggagacgtaagaggaagtctagatttaagaaggtaatatttaatgtactgttatttcccccttttctttatattgacattttgaaacaaaagctaaataatgcctgtgtatagatgtgtgtatatgtacatcctggtgaatccggtaactgtcaggagggtcatggagctagaaaagaagggtttcagtggggactaacgcagtcagctctgcaatttaggagggttgctctggcacccacgtgaagggcaggtgggtggtggagacgagtggaggcagagaggccatgtgaggccactgccatgctgggcaactacagcaaggattagagggagatgagagagaaaggctcacagtgggcagaacacagaccccagagggcgatttgggtgttaggtacaggtcttagcggtcatcaggatgaaggcggtgggaagtggagcaacagagatccaaatatggaaagagcacgtgctgataccagaggcactggaaataatagcaatatccgaaagtctgctcaccctgcgtcattccttcagacagtagtcgggctctattcacttgttagttttcccacagggctgtgagcttgagagctagttcttcgccctttctaatctctgtagcctctaccaggaaaaagggtatcagcatgccaggaccagtgggctaaatcctacccagcacctgctataaagtttcagggcacagtcacacccatcgtttacatattgctgccttaactctgcaatggcttagttgagtacctgttacagaaaccctatggcctgcagatccaaaaatgtttaccatttgaccttttaagaaactgccaaccccatgatctcccatcatgctgagaacatagtagatgtcccacaaatatttacttagtgtgtaaatgcaaatcataacaacaggacttcttttcgtcacatagagaaataatccattgattctgttttgactggcacaccccttggattgcatccccaaatgtgaacctcttttttcccaagtcattcattctcccatttggttcaatcctttggagaattaattcttgaaaaaggctgatctcaggggagcccctgaagacagaagactaaaagttttggaatagaaaatgttttctcaaccttggcactactgacattgtaggcagacttgttctcttgtgggaggctgtcctgtgcattgtagaatgctgagcagcagtgctggcctgcaccctccctcctcccctgcatgactctcaaagctgtctcctaggagccaaagactccttccagtagaaaaccatgactctagagagagaaactgtaggtaagaactaagcaccatcttgcaaacatccctgaggatatctatatacagacacagacacacacagacacacacacacacacacacacacacacacacacacaccatagttttttttttttatttgtttgttttgttttgagaaggggtctcgctctgtcacccaggctggagtgcagtggcacaatcttggcttactgcaacctctgcctcccaggttcaagcgattctcctgccgcagcctcccaggtagctgagaatacaggtgcataccatcactcccggctaatttttgtatttttagtagagacagggtttcactatgttggccagactggtctccacctcctgacctcaggtaatctgccggccttggcctcccaatgtgctgggattacaggcatgaaccactgcacccggctgttcaccagcatcattttttagaataacgtgataggaatttgcacagcctcccttcataacctattctaatcactcaactcagcctatcagaaaatttctgatgtctaacctaattcctgcttgctgcatttgcttctcttttttttcttatcctatcttcaacaaaaactaaaaaatagggatgagctggtatagatgcttgccataataatcctccttctatggcagtctctttacaaagaaatctggagaatacataataaaagtaatcactcattcagcaaacactgaggacctcctcagctggtcctgctttgagtgctagagacacagcaaggaacaagagtgagcagggctctgagctcacagagctacattctagtaaaaggagcaaatcatcaaataaacaaaacaagataatagcacttattaatgagtgtttgacgccataagagtggctgtggctgaggttggaggggacccttagctaggatggtaaggaaaggtcttgctatggagggaatatttaagcagaggtctatatgattcaaaacagcctgctgagagagtaaaggggagaaatatctgctttccatgtgttccccattccaggttttccatctaaaatgggtgtgggatcctactacttcccaaggttcccttttttctgatgggaaggaaagaagcctctacgtggtcctggattctctgagcagcttcaaaaaacagccctcttgattagcctgatgcagcctgaggatgtcataggcgtattagtctgttttcacactgccgataaggatatacccgaggctgggcaacttacaaaagaaagagagatttattggacttccagtttcacatggctggtgacacctcacaatcatggcagacagtgaaaggcacgtctcacatggcgacagacgagaagagagcttgtgcgaggaaactccccttcttataaccatcagatctcgtgagacctattcactaacacgacaacagcacaggaaagacctgcccccatgatccaattaccaccccccaggtccttcccacaacatgtaggaattcaagatgagatttaggtggggacacagagtcaaaccgtatcaatagggatttcctaaatgagaagagtccatgccaaaagttagagactcccaggttctcaataagatcaacctgaacctgaagtactctcctccccactcgctcccagctcagtccaggccgccaaaggcctaacactaaggcaggccacccagacaggtgtgatcatagctaggatggtgtttgggtgggggagaccctctgactaactcctctaaagccaaaatgtaaacatccgggttcatccctctctctcctccagcctcctccactcagctcctgtctgtctttcaaagttcaagccatcctgtgcaatgaagcagctcttgttgggtgaattaacaacatgaggaaaagctagatccatcgggaagttggcgctaattgttagatctaagaggaaaaaagcaactgtctcagcattaagccgctttgtggaccaggttgttttgttctacttgtgactcgggctccccgtcaaaccgcctcagacacatggcaggtgtcactcagacccttctcactcactagggtcctgcagacattagctcacatctgggctacttttactaacagccagacgttggggaagccacttacactctttggactttcatctttttatcttcaaaatggaaggatctcctttggagggttgctatgaggatgagagataaggtatgtgttaataataataataatgccatcatgcagtgagtttctgctatgggttagacactgtgctaaactctttacacaaatatctcatgctcacaacagccctaagtggagggtccattatcactagctccattttacaggtaagaaaggtgaggtatagacattaaacaccatgcctaagtttgcccactctataaagagcaaagccaatatttgaactgaggtttattagactccagagcaggaggtcttaaccacaggccccttccacagcgggcagtcaataacaaatagtcttcattgcattatagctatgaccactgggagaatcagagtcaacaagtggcactactctaaccaccctcactcctgacaaacacgggacatgtgagagatctgtggccaccttgctggggcagaaggggcagctcattctgttaagggacactgatgtcacctattgatgtacagtgtcccagggcctgcatgacaccacgctgccgatctcctaatacgtcctgctgagccaggcagctgacataattatgcaaggaccatctgtcacttagcccctctctgtctctctgcaccgtatataaagcaggaattcagaaatttagtcattcactgttcaactaaccttcactaaatgtccactaagtgccaggcactgctctatacagaagtctacagatggacgtaaatgctgcactcctggtgttcacactggaaggaaagagtccagaaagtaaaatagataatatgtttagaacacagaaagaatcaaatgcctatggtggcagggtgggaaaacagggaaggccaggtacagggaggatgctcagttcaaaacagagtggtcagggaaggcgtctcagagaaggcggaaaaggtgtgtcagccgggcatgcagatatctaggaaaggacattccagacagaggaaaacagcaaaagcaatcaatgacccagaggtgaatttggattgttagagaaaagtttcacaaatttcattcctggaacaccaagctcataagacattcattgaaaaaaagtgggccaggcgcggtggctcacgcctgtaatcccagcacatgaggccaaagcgggcagatcacgaggccaggagatcgagaccatcctggctaacacggtgaaaccccatctctactaaaaatacaaaaaattagccgggcttagtggcgggcgcctgtagtcccagctacttgggactactgggagtagtagtcctgaggcaggagagtgggaggctgaggcaggagaatggcgtgaacccaggaggcagagcttgcagtgagccgagattgtgccactgcactctagcctgggcgacagagcaagactctgtctcaaaaacaaaaaagaaaaagtgtgtggggtccaataaatttttgttaatgcctcatgctgtacaccccacttttggagtttgtgttacccattagcataaaaagggacagaagatgggaagtcttgcagtaaagtcttgctcagctcaggctcactcactcaaacatatttgactacacagacatttcttcacataacacctgatggtatctcacagagctacgtttcaatggaaaccaatctgggaaactttggcataaactcaggaccctttccctaatacagtttcttgattctctgtcccgcattgggtcattcagcaaacgctcactgagcagcctcttactaaatgagagacactgagctagatttggctggagatggagcagagaataagactcactgactccatctaaaaagtcatggccacagccacggtcagccctaccatgttcaatatcaccgcagatggcgagcctttaggccatgtctccttcgagctatttgcagacaaagttccaaagacatcagaaaactttcatggtctgagcactggagagaaagtgctcctgcctttgcagaattattccattatgtacctgagtggtgacttcacacgacttaacggcagtggtggtaagcccatctacagggagaaattggatgatgagaacttcattctgaaacatgcaggtcctggcatcttgctggactcaacacaaatggttcccagtttttcatctgcactgccaaaatcgagtggctggatggcaagcgtgtgatgtttggcaaggtgcaagagggcatgaatcaatatcacagaagccagggagagctttgggccaggaatggcaagaccagcaagaagattgccattgccgactgtggaccactctaatgagtttatcttatgtttttggttttttttttttttttttttttttgagacggagctctgtcgcccaggctggagtgcagtggcgcgatcttggctcactgcaagctccgcctcccaggttcacgccattctcctgtctcagcctcccgagtagctgggactacaggcgcccgccaccatgcccggcgaatttttgtatttttagtagagacagggtttcaccatgttagccaggatggtctcgatctcctgaccttgtgatccacccgcctcggcctcccaaagtgctgggattacaggcatgagccaccgcacccggcctatcttatgttttatcttaaccagcagaccactgcttctgtagctcaggagagcaccccgccaccccatttctcacagtaccgtatcatattgtgctcttaatgcagttcgttgggtttcgtattttctttattcctgtctatggctagctggactgccgagttaaggttatgattatgaaataataactaaataacgaaaaaaaggtcatatccacaaagcaagccaatgtctgccagggaagattaaagtgtgtgcatgctgacccttcccttgaattcagtgacccaaactttccagtggacagttcttggaaatgaacggttaaggaccactcctaccccaaactcctcctcttgtcacttgtgagatttcagctgttggtctcacctgcattaggagggcactaagatgattcttatcagatccatgtggttttaagggaaaggagtggtggttgctattatagacgagacgaaaggaaaaactcacagcaatttatacgttctcaacaccttctcaagaagaagagagttgaaaaaaatctcagaaccacccccctcagatgcaatttcaaacatacacccacatacaacaccccaaccttaatcagcctttgagttagattaaattgacttccagcaccacaaacacacccgccggccaggcctctcattaccacctgcacaggattgcttttcaaaggctgggcttttctcattacaatctcgagtccaaaaaaataggaagcaatgctgggaggaggggagagaacaaaaccttatttattcacacataaaatatacttattctaatcacccctggatacactgatctccttcaatatacagtcaggacttcacgagcaacatgatgcagtgttaagaacatagaatgcaaataataataatatctatacttaacagtagtaatttgatttcctggtttgagaagctgctattaagggcattacctacttaactcctcaatgcgttcttagtccccattttatagatgagaaaacagagatctacaaagttgcagtaatttgcccaaaaaatcacaaagaaaggcgtctagccagatgagaaacccaacacctacactgtctcctggtaaaaggtatatgatatttgggttgggcgccgtggcttatggctgtaatcccagcactttgggaggctaaggcaggcggatatcttgaggtcaggagtttgagaacagcctggccaacatggcaaaaccccgtctctactaaaaaatatgaaaattagccatgtatggtgttggctttcaggaaggctgaggcaggagaatcacttgagcccaggaagcagaggttgtagtgagctgagatcatgccactgcactccagcctgggtgacagagcaaggttccatctcaaaaaaaacaaacaaacaaaaaaggctatgatatttgaaccttggtgtgcttgaatttcagcctgagcacttctgaggcaagataccttgcatggatcacatattttttctgaaactcaacttccttatctgctctctctgcaactctaggcaagagtgcccatttagcccagggtagggcctcaacaaactctattccctttccttcacccagagttttctctagactttgccaactgctttgtttaagacaatctcccaaagtcaatatgtgctggaaactgtgctgagaacttgcacatgtcacctcattccgcccatgcagcgttactgaaaaatgcattggttccccctctgtttgactggcgaggcaactgatgcttcaggatagtcaacaactggtccaaaatgaccacactgtcaagtaatcaactcatagtttaaaccaatggttctcaaagcaggtgagtttcgggggatatttgcaaggtctggagacatgtttagttgtcacgcccagggggtggtgctgttagcgcctacagactagagtccagggatgcagctaaacaccccgacgacgcgcaggacagcccagccccgctgcaaggaatcatccagcccaaatgtcaatagtgccaaagttgagaatcctttggtttaaaccagatttatctgacatcaaagtcgatgaacttgcactgttttgcttccctaactgagggtttctcagcagtactgacatttgcagtcagataattctgttatggcagctgtcctgtaggatatttgtaggttatgtgtaggatgtttgcagcatccctagtttctacccattggatgccagtagcacctcctctcaaatcgtgacaaccaaaaatgtctccagatattgccaaatgttcccagcactcgctcctctttcccctggggggcaagtcattcccgtttgagaatcattttcctaatttaaggaaatgagctatgaaatgagaataacaaaacagccctgaaaaatattaagagaatatcccggatgaccattatttgcatgtgtttttaaaaagtagatatgtctgtttaagtatacacacatgcacttacatatgtagccatgtatatatataatgtttcatacctgggcacatatggcaggaagaaatattgaccaacctcttttttttttaaatttttttaatttctggggtacatgtgcaagatgtgcaggtctgttaaatagataaacgtgtgccatggtggtttcctgcacctgtcaacccatcacctaggtattaagcccggcgtgcattagctatttttcctgatgctcttcctctcccagccaggcaggctccagtgtctgttgttccccttccacccatatgtccatgtgctctcattgttccactgccacttacaagtgagaacagtgtttggttttctgcttctgtattagtttgctgaggataatggcttccagctccatccatgtccctggaaaggacatgatctcattcctttttatagctgcatagtattccatggtgtatatataccacattttctttatccagtctatcattgatgggcatttgggttgactccatgtctttgctattgtgcatagtgctgcaatgaacatatgtgtgcatgtatctttataatagaatgatttctattcctttgggtatataactggtaatgggatttctgggtcaaatggtatttctggttctaaatctttgaggaaccaccacactatcttccaaaatggaccaccctctttctatccctgcatgtgagttctcacttctctcacttgggttccagagactacatagcagagcagaaatatagtgcagtgttccctttcttgttgtccatgttctggttttggaacctcattatcattccaaaatgaattagatcttaatttgaaacaaagctattcactcagagggacttccagccctcagacactggacagcagaagagtccacaaaagcatgagagggtccaaggtccagcatcagagtcaggtgctcatttccctgcaaggaagcccatccttctccagtaaactaaaaatttacatctgaaaaatttgatgcgtcttcacgggtgtatattgagaatttccatgtctgggaaaattgaggcacagccaagttctagcaagctctccgtgatgatataaaacagaggtaggcaaacttgttctctaaagagccagatggtaaacatttcaggtcttgcaggtgatgcaacctccattgcaactattgagctctgccattatagcatgaaaacagccacagacaatataataataggccaggccatgttccaataaaactttatttgtgaacactgaaatttgaattgcaggtagtgtttatgtcataaaacgttcttttgtttttttttttctcaccatctaaaaatataaacattattcttaacacctgggtcatacagaaacaggtagcaggctgaatttggtccatccctcccttacatagaacatgacaaaaaagggaattcctgctgtctccaaaaaaacccataaattcccacttttctatccttaagatgaaagaaattaccctcgatattgggaactcagttcagttaccactataggaattaatctaccaatatctgaacttctggaatgttctgtttacctagcccaggataaacaggggaggacaaactccgagtaactgagtgctggctttttttcttttcctgctatgacttcatgaaagggttgtttacggtaggaagtaaccaatgattttgattgcttcaggacttcctggttaaaaaataaaatggagaagaagaaagaggaaagtcctcaagttgtaagctttggaaatacaaagccctcaggtcctgtgtaaaattgaacatgaaaaataggcctctaatttctgtcctctctccctaagcagtcaaccattggagaaggtgactgggggagacccttggctcagaacttcttggtggttataaattctttatcaactatggcttatgtttttacagggaattttcttcttcctcttcttctttttttaagttacggtgatcacaattttcagatttttgactacttatcaaactttttttccctccccctcttaacagagaaggtcagtcacttttaagatataagagaatttgagaacagattaatgacaaagataaatgatgatttttattttagcggaagtttcagcgcgttttctgcccagcctgggtactgctaataaagtatacttgacatataactgcgtaagttctttgctttaaagttcaatgatggatcaaaagagagaattctctctttagaaagaaatgtcctggaaggaaaaataaaaggaaggtggaggggaagctcatacatcccttttgtctttttctcttctctttgtggcccagagacagagcattgagtgacttcttcagaaaagagatcagtgaaattgtcagttgattacttctccttgattagcatttataagagccctgtgatacagtatttgcattcctatttagccgtgatttttgtggggcaccaatgattaaacttgtcacagggcttgattgacggggtcagatcttcactttctactcttttgaaattaaaaacaaatgtgtcagctcccttcatgggctggagcgccgtgaagctcgcctgccttgtcattgcagataggtcaggaatgttttaattttagggatggattctgcttgtcaagtagagtgtgatggcgtgtggttctggagatgagatgtgaagggtgtagcacaaagaaggggaagaacaaagacaaagacactcacattattagacagatttaattagtctgaatggatattatgctagatgaagcagtgagctgtgaaattaacccttgattacggattggcggatcctactcataaagagaatcaaacctttgtggagagacgcgaggtatgatttcagtttctcctacccttccgggttgcatgccagatccccacccccaccacccacccctgtcgacttaaacaccagaatctgtagggggaaaaaaactgtggaagttcatctttaacttgagcaggcaggtatacctagaaaaggaattccacctggcttcctctcttcaactttagagaaagcaacaagcccagggtggttggatgtgaagctaagaggctcacaaagacacagatttctgaatccaaaatagagaacagaaatagctaagtttgaataagagccatgtattttgagggtctgaagtgaatagctctatccactgcagtagagggtcacctcccgggaatgtttgtccttcatacaatgtgccccccaacttactgctgcctttccatggtcttctccagtgaatcccagctgcatcctgacttccaagaacttcaagcatgttaagaaagggatggaaggcctagagccctcacccagcattgatggtcaactaagaaaagtctctcaaacattaatactaaggactctaacatggagggggacatgggcgagatgggtctgagatcatgtggccttccagaaatcctttaacttatccaaattatctgatttggcacactctggactctactgataaaggctttgtacaaagcttgcaccaactaacatctctatttttaagtgactcagtccaaatcattctccagcactgattccaggaatgagaagtctctgtgggggcatgatgtggaggagaagtatctgttaggctggcccaggtcatgtggaaagtcagcaaattaggaaatgcagaaatggagttagagaatttgctccgcagctctttcacaaactcagtcttctcgttggtgaatgagatgtgtagctccttctttaacaattgtgctgaaatcttaactgtgtactttaagtgccaagaaaggcactgtgtattattattatagctctctgtagaaaacatggcactaattctaagtcacttttctggctctgtctccatccagtcttccttatcacagtttcccactttgatgtataagtggcttcagtttggggaactcctggttgaggaattccctgaacaaacaatttccaagtgtggtcttgagactctgaatcaattgtcatgaattgcagataacttattcccaatcattgttgaaggatgagggtggtcaatgaactcattggcattacactttaattttctgaatggaacagacaaatgggaaattgtaatcctaaccctggctccatttatgaaaatgcaaattctctaactccatttctgcaattcctaatttgctgactttccacatgacctgggcgggcctaactgatactcctcttccacatcatgcccccacagagccgtctcattcctggaatcataaaaatgtcatgcatgtgaatgacaggcatcgcaggtcaggggagggaaactgttgagaatctctgctctatcaggaaatgccagtttcccttcactggcttgtgctttaggtgaccatactgtggaggtcacattgctccaggtagatggttgtatctcaaagtccttttgcttttgtctctggaaaatcagatgattctacaggtaaacacagctatagttactgctattcagaaatgagtattgtttccttcccaaagataggttttgtttctgaagaaatttctttcttagaactaagtgatacaagaaataacccactgcctccgatttgacttcactgaggtttagaggaggaaatctgcctttacgggacttgataagggaacacagagcaacctccaccacagagaattatgcagcccacagtgtcaatagtgccaaaacaaaagggacattgtgatcctaaccccagctccatttatgaagatgataaattccttaccagagaaatagagaaatctcttgatatggtttggctgtgtccccacccacatctcaccctgaattcccacgtgttgtggggggaacccagtgggaggtaatcgaatcatgggggcgggtctttcccgtgctgttctcgtgatagtgaataagtctcacgagacctgatggttttaaaaacgggagtttccctgcacaagtgcttttctcttgtctgccaccatgtgagacatgcctttcaccttttgccatgattgtgaggcctcctcagccaagtggaactgttaagttcattaaacctctttcttttgtaaattgcccagtctcaggtatgtcttcattagtagcgtgaaaacagactaatacacatctcttgtcaggagaatcaaaaaattctattaggggattcctggcacttgatacccttgaccctgaaggtacacagagtggtttagatggtacttgggtgagcttttctatggttatgtatttattttaaagcatattcaattgtgtgtgtgtgtgtcagggtgtcagggtttctcaggtctggcactactgacgttgtgagttgaataattctctggggtgggcagtcccacacattgcaggatgtagcagtatccttggtcctcatctgctggatgccaggactctcaccaggccaggtgggacagctaaaatatctccagatacttccaaatgttctctgagggacaaaatcactcccaattgaaaaaccctactatatatctatgattctatagacattattggacattattgcttaaggggataaggcttctttttttgagacagagtctcactctgtcacccaggctggagtacagtggccctgtgttggctcactgcaacctctgtctccagggttgaagcgattctcctgcctcagcctcccgagaagctgggactacaggctccctccaacacacccagctgatttttgtatttttagtagagacagggtttcaccacattgcccaggctggtctcaaactcctgacctcaagtgatccacccgccttggcctcccaaagtgctgggattacaggcatgagccactgcacccggccaaggataaagctttttaaagttacagaaattaaagaaaaatattatattaaaaaaatagagagagaatacaggtgatagtgctgtggcagaaatcaagaaatcagaaatcaagaaggttatatgtgagagaaagaagtttatgggccatatgcagtggctcacacctgtaatcctagcactttgggaggccgaggtgggaggctcacttgagcccaggaattcaagattaacctgggcaacatagtgagaccccatctcttctaaaaggaaaaagaaaaaataataaaagattttttaaataaagcgagaaatttaggaaacactgatttgatttagtttagtttagtttagttttgttttgtttttgttttgagatggagtcttgctttgtcgcccaggctggagtgcagtggcgtggtctcggctcactacctcctcctcccgagttcaactgattctcctgcctcagcctcccgactagctgggactacaggtatgcgtctccacgcccagctaatttttgtatttttagtagagacagtgtttcaccaggctggtctcgaactcctgacctcaggtgatccacctgcctcagcttcccaaagtgctgggattacaggcatgagccactgtgccaggcctgatttagtttttaattcacattttacgatgtggataactgaaatccagaacatgagatggacttgtccaaaatcatgaagctgtcactccctgtattaacatcactaagacaatgcaggaaaggcacttagggctgggtgcagtagctcatgcctgtaatcccagcactttgggaggccgaggcagatcacttgaggtcaggagtcctagaccagcctggccagcatggcgaaaccccatctctactaaaaatacaaaattagccagatgtggtggcacatgcctgtaatcccagctactcaggaggcagaggcaggaggatcacttgaacccaggaggcagaggttgtggtgagctgagatcacgccagtgcactccagcctgggtgatgagaatgaaactctgtctcaaaaaaaaaaaaaaagaagaagaagaagaaaagaaaggcacttagcacaccacctgccacctagtaataataacaatccctactacatattgagcacttgctatgggacaggtactgttttaggctctttacctgtagcaactcattgaatatttacaacaaccctgtgaggtaggaattattattattcccatttataaaaagagagaagaaaataagttaaacaaatccatggtgaaggtggaagagaataagccattttgtggagctggggatgggaatgtgtgatttattatttatgctttctttcatacctattttaagatatttctctaagtgtctactatgtgccaagtaatatgttgcatgtggcccagaaaatacacataataaaaacacgtaaataacagtcaattattaccattagctgttattcccatggttctgtgtgctgttactgagttagtaaaggaagcctatagctgtcacttcttgcatatcattcatgcaaatctggagaatttgtgggttttttatttaaatagctttaggggtatacacagattttggttacatggatgaattatatagtagtcaagtctgaaattttagtgcattggtcacccgagtagtgtacccaaaatgtagttttttcctcactcccttccaaccctccccacttctgagtctccagtgttcattacaccattctgcatgccttcactcacccataacttagctctcacttataagtgagaacatatggcatttggtttttccattcctgagttactttacttagaataatggcctccagttctgtctaagttgctgcaaaagacattatttcattctttgtatggctaagtagtattccatgctgtgtaaataccacattttctttatccactcatcagttgatgggcacttaggttggttccatatctttgcaattgtgaattatgctgtgataaacatacatgtgcaggtgccttttgatataacaatttattttcctatgagtagatacctagtagtgggattcttggattgaatagtagttctattattagttctttgagaaacctccatactattttccatagtgattgtactaatttacatttccatcagcagcatataagcattcccttttcactacatccatgccaacatctattgttttttgacttcttaataatagtcattctggctggggtaaggtgacaaaatgctcaacattgctaatcatcagggaaaagcaaattaaaaccacaatgagaattttgtttttttcagttgggcttctgaagttttgttacttaagaaaattctaagttaggaatgctttaggctgcaaataaaaggcagctttacttatagtgatttgaataaatcaagattttcttttctcaccatcccaacatccagaagtaggcaacaatggcattgagtcaatggattagtgatgttaatcactaattgacatctggattagaagatgtctctgtgagtcttttgatcattgccttacaactgcaagatggctgcatcatgtccacattcaaggtaggaaaaggagtgaaataacagtactagctacctttgcccctcttctcagaggagcaaatctttcttggaaacccagcagaattctacatgaacctcctcagccaaactgtgtaattttgtcatccttagctgcaagatgctgtgacatatttaactgggcacactgtcacagaaaacaaaactaggattttgtccgggcactgtggcttacacctatagtcccagcattttgaggcactaaggaaggaggatcacttgagcatgggggttctagactgcagtgagctatgatcatgccactgcattccaaacttggggacaaagagagaccctgtctctacaaaaagtttaaaacatacattaaatgggtgtcgtagcatgcacctgtagtcccagcaactcagaaggctgaggctggtggaggatcgcttgagcctaggagtttaaggctgcagtgagctatgttcatgccactgcactccagcttgggcaataaagcaagactctgtctataaaaagaagcagaacaaaccaacacagacacacagacacacagacacacacacacacacacacacacacacacacacacacagaattttattggcaaggaagaagagtgaaatggatattccgtaggtaactaatggtatctgtcccagggactaatccagtagcaagaatgttctgtcagtcctttttaccttttctccccagtcttttctcatcctgtaaccagcaattgactggaaatctgtttatctttctcaattgttaattgatcatcaaatgttgactagatacagtattggccaaaaatttcctaaataaaatgggctttatgaaatgcatttttttgagatgggatctcactctgttgcccaggctggagtgcagtggtgcaatcttggctcacggcaacctccacctcccgagttcaagcaattctcctgcctcagcctcccaagtagctgggactacaggcacatgccaccatgctcagctaatttttttggattgttggtagagatgagttttcaccatgttggctgggctgatcttgaactcctgacctcaggtgatttgcctactcggcctcccaaagtgctgggattacaggcacgagccaccacacccagctggaatgtattaataatgtaatcataatcatcattactgctactaccaccaccacaagaataacctgttgagtatttcccatgaattctaagtgtttcacatacattatctcatgtaatcatcacaatgaccctccaggtattatcatcattcaaatttaaggtcacccagcttggaagaggtggatctagaccttgaacccaagcccaagccactgtttttgcttttaaggtgctgacaatacaataagggagacaagagtaactcataagaagtagtctaccagtactgcaagacaaaataatactaagtactaaactatgtggtcctggaaataggttttggaagaatcataaggaagatcgttttcatgaaggccacatgtagtcaagaaagacacttgagttgtccgttagggggatattagacttgttttctacgtgtagtggttatcagggtcagttctgctctcccagctacaacaaacacacagaaccaaacagaacttaggaagtctggagagccgcaaagcaagcagacaccattagactctgcgtagatttgtttagagtttgtgggcattgttgaggtctctcagggtctgctgacagtcctgtgaccatctgcctggcagcaaggacttcagttgtttgcaatgctttggccaagccgagagcacgcggatctggatgcacagctgctgagcgtgtgctgacgggcctcagctcctcgagcgtgtttgttcagactggtctgcctaaatccactccaaaattcttccgagccagaaaaggagaacatgtgctttcttttcacatagtatttctgaatgcccatgaatataaaagagagaaaacaaaaccaaaaaagtctaagatacatgatattcccaaacaacaaaaaagacaggaagctttcggaatcagaaatctggccctttcttaagggaattccctgttggtttggagaccatgctggttgttagaaaatttagataaggaacaattttatttctttgcagcacagttcaaccattattttctgagtaccaattgtgtgcaaggtcctgtgtcagattctagagcaagatgctaatggatgcaaagacaagcaagaccatcaggaaactttttggcagaagaagcaataaagacttcactgagaccaggacaagagggtgatttggagcactgctaagatgactgtttccttctttgtttttcccccgccccgggtaatgagcacatattgcagaaagaactttacataaaagttgaaaacgtatctatgtgaaaaaacaaaataagggaaggcattatagcatggtaacagggaactttttttaaattaatttatttattttgagacagagtcttgctctgtcgcccaggctggagtgcagtggcgcgatcttggctcactgcaacctctgcctcccaggttcaagcaattctcctgcctcagcctcctgagtagctgggattacaggcgcgtgtcaccacgcctggctaattttttgtatttttagtagagacgtggattcaccatattggtcaggctggtgtcgaactcctgaccatgtgatctgcccacctcagccttccaaagtgctgggattacaggcatgagccaccacacctggctgtaagaacatttatttggaaagcagctttatgcaagctcaaggtcaagctctccctcttgctaagtgtgtgacttttagtaagttatttatcaccctgtgtctcagtttcctcgtgtctaagatgggcatgataataccccaacctcacaggactgagacaatgcaagaaaagcactgagcacagtgccttgcacgtaacaagtgctccgtcaatttttcttttcaatgatagcaataatgataacatattgttatgatcatcaggcgtagtgcagtatctggaatagagtgagcactcagtgatggtttctatggctgggctgttttttgtgcttccactgttgaagtatttaacacagtatctggcaacacctggtgactcaaagagcaagctatgatggttccaaagctggggctcagggtgaaactctctctatgggagatctctgggattctcctgttcaggcttaacgatgaaaggtaatgtgccttcttttcttttatctccaagaaactacgctagtcagtttgatcctgcccaaagtcgccataaagttaaaattcacaaaaccaaacccagaagctcagaggctgcccagggaaggacacacagtgccctgcggtgtgtctgtgtttctacatctgaagccgtggacgacgtacctagacagaagatgccacggatctggccccagggcttattttatttatttattattattattattattattattttttttttttttttagatggagccttgctctgtcatgcaggctggagtgcagtggtgggatcttggctcactgcaacctccgcctcccgggttcaagcacttctcctgcctcagcctccccagtagctgggattacagtcatcttccaccacgtccggctaattttttttttatagttttagtagagacacagcttcaccatgttggccaggctggcctaaaactcctgacctcaagtgatccacctgcctcggcctcccaaggtgctgggattacaggtgtgagccattccacccagcctcctttcctcctgttcacttactcttggccctagcaattctgtgtgattccaggataagcctcatgctttttttggaattccatcttcttgctcccattgtcctccttgtctctttcatatgaatgttttctatatttcaaagccctgctcaaacaccacctcctccagaaaggctcctggtatcctctttcttttctaacctagaaaagagtatgccctcctctgggcacctccagaatattctctcacgtcttatatgacatgtgtcaatctgtaccttgatttataatcacgtgtgtgttaggactatggattgcacatgacagaaaaatccactcaggccaggcacagtagctcacgcctgtaattccagcactttgggaggccgaggcagatggatcacttgaggtcaggagttcaagaccagcctggccaacatggtgaaaccctgtgtctactaaaaatacaaaaattaggcaggcatggtggcaggtgcctgtgatcccagctactctggaggctgagccaggagaattgcttgaacccgggggacagaggttgcagtgagccaagattgcaccactgcactgcagcctgggtgtcagagcaagactccatctaaaaggaaagaaaagaaaagaaaagaaaaaagaaaaatccactcaaaccagtttaagcacagagggattttactggctcctgggaaggtcaagggtgcaacagattcaggcaatgctagatccagtgcttaagtggtgtcactggaaatctggccttctccacccgacatggtttggatctttgtcccctccaaatctcatgttgaaatgtgatccccaatgttggaggtggggcccagtgggaggtgtttgggttatgggggcagatacctcgtgaatggctcagtgtcctccctgtggaaatgagtgagttcttactctgttggttcacaccacggctgactgtaaaaaaagtgtgacacctctccctctctctcttgttctctctcttgcgtgtgatgtgcctgctcctccttcaccttctgcagtgagtaaaagcttcctgagggctggccagaagcagatgccagcactatgcctcttgtacagtctgcagaactgtgagccaaaataaacctcttttctttctaaattacccagtctcgggtatccccttatagcaacgcaaaacagactaatacacagcctctcaaatctcctggaaggatgtacttgggtgtacttttctttcttttttttttttctttttttttttggagacagagtctcactctgtcacccaggctggagtgcagtggtgcagtctcggctcattgcaacctctgcttccagggttcaagcaattcttgtgcctcaacctcccaagtagctgggactacagatgcccgccacgacaccccgctaattttttgtactttagtagagatgggctttcaccatgttggccaggctggtctccaactcctgagctcaggcaatacccaagtgctaggattacaggtgtgagccaccaagcccagcctgcaagggcataattttcatgtggtggctcagaaacctccagcagccccaagttgagccgtcataataagaaaatttattttttaggaagaaatctctcattggactacctagggtcgtgtgctcatccctggaccaatcactgtggctaggagaatagaacatgctgattggccagacttgggtcacatgcccagccctgtagcttggaagtggggtgagccctatgggatcccctgacctaaaaatgagaaagcagtggatccccaaataaaaattagggctgggctgggtgcagtggctcacgcctgtaatcctagcattttgggaggccaaggcaggtggatcatctgaggtcaggagttcgagaccagcctgaccaacatgatgaaaccccgtctctacaaaaattacgaaattagccagacgtggtggcacacgcctgtaatcccaactactagggagactgaggctgcggaatcgcttgaccccaggaggcggaggttgcggtgagctgagatcgcgccattgcactccagcctgggcaacaagagtgaaactccatctctaaaaaaaaagaaaaattagggctgtcgcctgaaggaaacaacaattatttatggcagttatacagttcctgcctgttcatttcttggtaattcatagtgcctagcattttgttcatcataaagtacatgctcaacaaaattatcaaataaatgaataaacaaagagtatgactttaaaatgtacctactgactttgcacatgtcttcctctgacactcacagttatactgtatttggccaagcagagatcacacatcattttgagtatttctccagctcttttagggagtatcttaggaaaccagacatcacaaatccttccatctggagtcagtaataatgcagaagatactaatgtttaataatccaaagtgcctagctcactattaaaaaaaaaatttttaacctaataagagagaattggccgtgaccaagtccttgacctgtctgttggaatcctccctttctagccatttctggtcatgaaaattgggcaggatttctggcatcctttatgcttctttgttattaaaagcaggatcagttaataaataattatgatgctcagtttctagggaacaaggagataaggacaggaacacttgagtctcacaaattacatgctatagtatagattctcacccagagtgaagaatagcctagctttttttttccctgtggcataaattgttctaattatacgtgcaagatcctctattcccaaagatatgagttggaagcgctgtgtctgttcttttaattccaagaagactttgcagttgggtgtttccaccccccttgttttcaaactgaattgtttcagtggtagcttggtgtgtcagcttgtaagtctataaaacagttttataccagctggagattcaacatgctacatgaatacataacagtgcctaaccaagaaggtttgtaattcagtaattagctgtaattaatgaacacaaagtgaagactcatttacagtttaaattatcacattagctcctgtcaccctctatgtacacaaaacagcaggaattcaattatttttattcttcaaagctaatttaaaatttaagggatgccattacatgaaataataggtaggaaatgtaatcgaaatcactgggaacagttggccgtccttagaattaaaaaaaaaaaaatgtgatcactgacgatttggaaatgttttttcatctgtgaacagatgaaggattgaaatctctgctcttttcagtatatttaatttaaaaggagaagcgagtttggtggttgcgggatcttcacgcagggagaatcatggtgcgtaattgtaaaagcagctgataactgataatgctgttgatagtaacaagagggcagcctgggagacacacattccattatccctaatggagctgagccttctgcaattgcagggggttcctggaattgtcacccatttctgatgcatcatttcagcttgggagaccttacgtcattgtcacatttctgtcgtccttaattctttgttcgtatctatgataaatattctttcattcattcatcaaacattgacagagcacctcctcaggctcaggcattgttctaagttccaggaccacagcagtggggaagacaggccacattcctgatctcgtggagccaacactccagtggggagaaacggacaatagccaggggttctcaagtttggctgtgccgtagagttggggaggaagctttaaaaatacatgtgtatcaatgcctggtcccaacctcaattgattgaatcaaattattctcactcctttctttcattacaactctttaagtatgcaaacactttcttagctcaagagctgcacaaaaacaagctgtgaactacatttgacccactcaagccacgttgggaaaaaacaagaccagcaagtgcaaaggccctgaggcaggtttgggcatcagtatttttagcagctttctaggtgactcacatggtcaaccagggctgagaaccattgtcacagactaacaaatacaacaaatacatgtttattggtgatgagtgctgcaataaaaattaagcaattgagtgtagaaggtaactacaggctgctctggattgggtgttccccaatttcttagggaggtggcatgggagacctgagtggtgagaagccaatcttgagaagatctggaaagttgttctatctcagccatcagtaaaacttctgctgctttacttcttccttttttttccattataacccttatttatttgtttattttattttattttattttattttattttattttattttattttattttatttattttgagatggagtctcactctgttgcccaggctggagtgcagtggcacgatctcggctcactgcaagctccacctcctgggttcccgccattctcctgcctcagcctcccaagtagctgggactataggcacccgccaccaaaaccggctaggttttctttttgttttgttttgttttttgtatttttagtagaaatggggtttcacttgttagcaaggattgtctcaatctcctgacctcatgatccgcccacctcggcctcccaaagtgctggtattacaagcgtgagccaccacgcccagcctcgtattttatttttgagatggagtctcgctctgtcacccaggctggagtgtagtagtgcgatctcagctcactgcaacccctgcctcccaagttcaagcaatttttgtgcctcagcctccgagtagctgggattacaggcatgtgccaccttgcctggctaatttttgtattttcaatagaggcagggttttgccatgttggccaggctagtcttgaactcctgacctcaaatgatccacccgcctcagcctcccaaagtgctggtgttacaggcgtgagccatcactcccagccttttcattataaccctttaaatgtgcaaacattctctccactcgagggctgtgcagaaacaaattgcaagccgaatttgacctatccaagccatattctaaagaaaaggatcagcaggtgcaaagctcctgaggcaggcatgagttgagtgtgttgggttgggcagaaagaatgcctgcgtaggtggggcttagctggtaagaaggagtagatgaggttagaggaatgagcaggaatttagattttattttgtatttgttgaaaatataaaggaagattttaagcagggaatgtatgagtgtgtgtacgtgtgtgtaaaggagacagttctgtacccatactctccacagtatgtttccctgcaaccgccactaatctccttccatgccagttccaggaagaaaaggaaaagcaaaccccatgtcaaaagaatgctgtgtctgttgctttggacttctcttttctgcactttccccctcctcttcccatattcatttttctttttcctttaaataggccactcgaagctgcactgtctaatttttcataggtgatcgactgctgagcgggggcttaggtagacagagggaaggtgctgataagccagtgcacggattctattagggaaatgcggtggtaattaatgaatcctgccagtaatcgggaaggtgtgagtccccgtaatatcgtaatgatagtcatctgtctgcgaaccccccatcactctgagagatcgctcatcgctctgtgatctcagactcttagccatgcaaatctccctgacaggacgctatgtctctgtctccctaattgggcattctagagttgtttatggatattgccggcatttaggcctcagttggaggttgttcaaaaagcgttagcaaacttgccttaacaacattgtcaaatatgtattcccccgtttcgatatctgtttttaagccggcagaggtttgtgatgaaattaagtgatgcattgtgtgcacttgagctctgggcgtgattgttattaaaccgtttttgaagtaaaaaccaatttgcagtaatatctcatcccgcttaagatcaaacttcagtttgtgtgcaggaactggatgcttttttaatagcatgtcctcgtttctatagagaacactgagtatgttaatgccatcccaagacacaaccatttgcaaaaattacagttttgcattgagactggtttctaaacatccatcaccatttaattccaaagaagcgtctttactggaagcacttgccacattttcttgccagtatttttttttctgcatacaagtggtcaccctcttgtcttcccccaactggtgtgatcaattgcttgaaatgccatgaaatatatatattttaaaagcctttataactctgataagtgagcttaatatttctgccatgatgtttaagagggatcttttaaatatttagaaaacatgggaagtaccgttttaatgtataatcaacacactttaaaatattcaaatatgaactgggacagtttagactgcatcttgatcaactctaaataggagaaaaattcaagaaattctggcctccattttcttccacatgaaggaagaaagagatgtccatgcaaagggcaacatagatttagaatcctttaaccccgattcttccatccatgagccctgggtggccttgattaagctacctagcctctccgatcttcaggtatcatctgtctcacccatgctcaaatgtcattctaaggcttaaagcaagttaatggctgtgaatgtacatcatttccatgagggaaggggcttggcagtcacacccaagtagctctgctgggagaacttgaacaaatcactgaatgccctctgagccatagtttctgcatccgtaaaatgagccagttatacacactttgtagggtaggtctgaggagcagagataattagttgaaagtacccatgaagctggagacccagaagtctctccaccaatggtggctactgcctgttgaaacccgtggagagctaggcctggtgtgttccaagggcattcgcagagtggatgggggaaccaaggcaccatcaacactgaagagaggtttggagagagggaacgcgtccctgggaatcgtctctctagagtttaagtacggtggccagccatcatcgttttcccgggactgaggcatttcccaggacaagggactaaaaccaggatgagaagtcaccctatgtttgaacaaatctcctcttcagcccaagaaatggacaggtcatggttcactgaagccccagtttccctgagaaccttctccatcttccattctgagctctgtttgctgattagtcgtggttctctgtcgcacattctagcatattctggaaactctcaagaaacaaaagttgctgccagacaatgctctccctccacacacggctccatctcaactccacggacactagtgagagagccactggtggctacccctttcccaactgtgtctctattaggtgagtgccggggacaggggaggagtgggcaccgagggaacaggcaagaaaaggagagagtgagtcctccagtgccggtactgcagtgtgctgggaatcaccaggaagggattgagagaggcccacacatgtgggaggggagctagggaaatcaatttggcaggagttaatcacgagagccctgtcagcatttcaaggacaggcttgtgttttcctgttcatccgtaagtaaacactgaaagcctcctcaactgtgcaaacccgctgagtcttttctccgtggacattctagcccgggaagtttctagggtatgtcaaagtgtccacaagccctgtaacctttggtgtgtaaatcacaaacctcccagggtggtctgcttggacagctaggactttcctaccaaagtcttcattcatcccaagtggccaaccagctggagcatctttaaattaaaggttttattttgccacttggccccccagcccaacccctggctcctttttctattctaaatcactgtcccttgctcctccaagctctgaatgaattgcatgtaacgaacatgtctgctggtaggcctctgtcatgagcattgaggccgatgtggttcagtaacctgatgcctcaaacttgaataaaacacatgccagggcctcccatccttgaatgtgaatgtgctggcatttcacattattaaaaaaataaaggcaggagggatgagagggagaaacttgaagtgtaaggaacttttctgaatgcagcagctaccaatcctggatgcaaactgctgtgcagaataattgtcaaatgcttgcataaacacataaataagataaatttattttcatgattcatattgggtgctctttccttccacttatttatgctttaaacaacagttacggtaaatataacgatagaaaagtgcctacagtggacaggaagatgatcaagaagtcctgatatacagcaatccacgttgcttctttacaatcactaacgaatcttaactggagccatgttccgttcccatgtgagtgataagcaatgatttattatgaagtgtcatgaaaccggaatgccatacagtgagccatgagctagtggaaaatgttttccctgtttcccaacctcattactcaaagatgcagtgtccctttaccaagcctaatttaactgacttttttgagcactctactcattggcaatggaaagtggccaattcgaagatgtccaggaaagcctggtacccaatgccacagcactggtccatatggtgtctgagctggccgacaatgctggaactgtgcaaactggccagtctccagaagtacaatcccaagaatcagctcagctctctgccaaagcagcaaagacactaatgcactcaggaaatgaaacccaccaggggagagggaacccaaagagcaactttgttagctttggaccttgtattatctatatgtcatgccattgtcctacttggaacacgtgccttgatcatgtaagatgtatccaagggtacaagggagccagctgagcctagaggaagaccacaggcctcagaggcaagccaaacctggtttggtcccacctcttccacttacctccacaaccgctgtggtagatgcaccaacaaccccagtactttacccgctctgtattcatgcccttgatcatgtcactgtgtggtgtcctctcgtttggattctaggctcagctatgtgacttgctttctccaagcagatgtgatgcaggcagtggcttgaaaagagcttgaacctctgccattgttattacaacatacacagactagcctgctggaggatgaaagagctatccctccagttgtcccatccttgaaacaggaagtgaatagaaggtcagcttttggccaggcgcggtgacttacgcctgtaatcccagcactttgggaggccgaggcgggcagatcaagaggtcaggagattgagaccatcctggctaacacggtgaaaccccgtctctactaaaaatacaaaaaaaaaaaaaaaaaactagccgggtgtggtggcaggtacctgtagtccgtcccagctactcgggaggctgaggcaggagaatggcgtgaacccaggcggcagagcttgcagtgagtcaagatcgcaccactgcactccagtctgggtgacagagcgagactctgtcgcaaaaaaaaaaaaaaaaagagagagaaggaaaaacaaggtcagctttttcactcttctctacttcctccttttttacacctccttttccttggatgggtgttggtggaaagaaggacatgaattcataaattctcatattgatgaaatgctactgcaatcatctcttgccagtggatgcccctggtaaggcaggtatccagggactgactctctagtgggggcacaaatggggtctacagaagtcccagctcctaacatgggagatgagttccattcaggaagacttctaacttctaacctaaacagctgccccactcatggttcacccttcactctcttgcccctaagagccttcctcccctctagggctggaccccataagcaaaaagacagctcttgacctagtggaaacttacacattttttttcttgccacagcatggagcatgtaggaagctcaactgctttccctttttcactccatcaccttcctccaatagcctttgctccttctcaatagtcacagaatatagatcagagactgctgcataagcataacccaacaggaaattagatgccaatctcctcttcttgctggaactcaatcccttcaagtgtttttgtaggaccactcaccggacttcagtgttccccctccaagaattcctccacgaattcctccagtcttttcctaaacaggctggtgcaagaaggagaaactgattagtggcctgttcttctgccacttaataaatcccatggaaatgtgtctgattgctctcccttcccttttttacaccttttattttgaaatacttttagacttcaagatagttgcaaaaaatcgcagtttatgcatacccttaacccaacttcccctaatgtcttgcctaagcatggtacaattatcacaagcaggaaattaacactggctcaatactagtcaccaaaccacagatcttatctgaattttatccaaacgtccttacgctgtttcaggacctaacttgggctcttacattggatttagttcttgtgtgtccttccctttccatctgtgactgtccctcaatcattccatgtcttttatgagcttgacacttctgataaacactggttggtgattttgtgaaatgtctcccactttgggtttatctgatgtcctctcatgattggattgatgctatggatgtgtggcaagtttaccaatgatgtgctctctcctcggtgcctcatattgttactgaaacaccaggggttccatctgtgtcctgttgctcactgcaaattaaagccaaatcaccaagacagtgagtattgccagggaagaagaaatttttttttttttttttttgagacggagtctcactctgttgcccaggctggagtgcagaggcgtgatctcggctcacggcaagctctgcctccctggttcacgccattctcctgcctcagcctcccgagtagctgggactacaggcacctgccaccatgccccgctacttttttgtatttttagtagagatggggtttcaccgtgttagccaggatggtctcgatctgacctcgtgatccgcccacctcggcctcctggaagaagactttaatcgggtgctgcagctgaggaaaggggagatcagtctgaaatccatctccctgattgagtaaaattaggggtttatatagcagagaagaaatataactatgtgtaggaaaacaggagttaaggagggttaaggaagaggagttggtcaacaggaagcaggtagtcacttaggcaatcatgatgaatgaggtgtctggtgtctcattgtccagatgcagtgatctggtaagtttcagttcctggatactatcagggagtcctgagggttggtttcctgagaaaggaactcagataagacaaatgtaactttctcaagttttaagactgggagggtcaatttctgtgtttcctcaaaataaaccataaacatcagttctatcagataattgggctggtttccatatcaggagtttcttgatgttgatttatcttattactggtgatgtgaactttgatcacgtggttaaggtggtgtctgacagcttctgttaagtaggaggcatacagctcctttagtccttaactttgtgtcattccccaaaatgtcatgaaacaagaaggtttaactcagtatcctgttaccctagctgtgtgatttggggcatataatttgatgtttctctggaccacatatttctcttctggaaaaggagactaaaaataaccacctttcaagattgctgtaaagattagtgatcatccaggcaagatgacagatggcctggtaaaccctcaaaaaatggatacaaagaacatcttgagtaatttgcacacattatcaccaactctcccacacacaaaaaaaagatgtatataatcatcacctatttttagaaaagaaacctggaacttgaggctatgtgactcctccagtcatgtccctcccctgtatcagagtctctaatgactcatcaccccccaacactttactgtggtccttcccagatcactccagattacccttttaatattagtaaccactcttaacccctggaaggtatgattaacatgtggtccctggagtcagagagccctaggttcaaaccatacctgggatattttgtgcctgttctttagattctcttctcctttccaaagtttctaactcattgggttgttgtgagaattaaataagtaaataaaagttttcagcatagtgaatagcaagtagtaagcacacaataattatatatgaaatgggtggtaattaccatttactcattcaacaaatatttatgaggcacccactatgtgtcaggcaccgttgaaggctgtcaacagtgactgaacaaggcaagaaatgtccgtgtcctcattgagtttatgttacagtgggtaagatagacaaataagtaaacaagtaagtaatatactaccacatctcttaagcaatgtgttggttaaatgaactcaccaactattccccaaacaagactgtatccttctgcctggctgttctttccacacagaggactacctgttccatcttcacatattaaaatcctacccccttcttcaaggcttagctcagcctccatcagttaattaattattcatttattgattctttaattagactgactactatcttatgggtctgcttctcccaccattaagagtgtcccaatgctattatttatgtacacattaatcaccacccccatgagcctccagagcaccatttacttccctttggcaacattgatctactttttgttatgtgctttgcattctactttcttcaccagattttaagtttgttctctaaggtcagagaccacatctagctaatacacttactgggtgggaccctcttaatgggcctagggcctgatatgtataggtgctcaaatgtttattgattgaagaaatacatcaatgaatgaacatatcttaaccttcttgctgaattgtgattcatagaaggcactggctatgccttactcatttaatatttgtttaaatgaactgagacacagtagtattgaacatatttgctccactaattattttgcttgtgcttttggcctggtctctcttttgatgtccccatctccccctctttaaaatacatccttccatccttagatagttttttgctacattgcaagaattatgtgatggtaaaagaaagaatatgtgtaaagcattttgattgctttggcaatgaggtgctccaaaaatctcagggatcactttttgttgccagtatatagtccctaacttttcttgaactcatgcaggatccacaagaatgagccatttgcctttattctattattgtttatgatttcataaggcattatcactaattttactgtgaagaagactctaaagaccactatttttttgaggcagggccttgctctgtcacccaagctccaggatggagtgcagtggaacaaacatggctcacttcagagtccaccttctgtgctcaagcagtcttctcgcctcagcctcctgagtagctgggattacaggcatgtgccaccatacctggctttttgtttgtttgttttgagacaaggtctccccatgttgcccaggctggtcttgaactcctgtgctcaaccaattctcctgccttggcctctcaaagtgctgggattacagtcatgtaatccaccactcctggcccacatttttctttctagtacctatgcaggctgccaggaaaagaaaaacaaaaggtgccaagtagtggctttaaggatttatttagtttcctctttacagtgtccacttttctctacttaatactactttccagtctcagaagcccagagggaaaaaaaaaagaccatgaatcttcctctcccagattaaagtacacactttggaaaacagattggaaaacctttctgaaaaaagttgactgaaactccaaaccaacatgccatattgttgatgttgctcatgaaaattgttaaaaacctgttctagataaagaacagtctcaagtttttgtacagcctacacatagtacaagggtcccctatgatgattcttctgtaggacgaaataatgtaattttttcagtttctggtttataactctctcgatctcaaagttgactgattaaaacacctactcatgcaacagagaataaagcactcatatttttataaattatatggaccaaactattttggaaatcttatctattggagacacaatatgctggactaaagcaataattattttattctcaatgtctgtgctaacctcaatgacttagaatgctttgctatattttgcctctatgcctcaaccacactggctttcttttagctcttgaacaagccaaactgcttcctgcctcaggaccagatattttgggacttctcttaagaattctatttccttaattctttatctgggtaacttagttttatccaacacttcagatcctgccgtaaaaactcttcttatagaagcctgtcatgacactgtctctcttctccaacatactcaccagcacacatgtagactagattagaacctcctgtttttctttttcatacttttctctatcatgcttccctccattataatatttttattatgtgtgtgaatgtctgccccaagtcagtttcctcactaaactataaactccgtaaagctgggatccttccaattttgatcaccacttagtacagtaggaacacagtaaagattcaattggtatttgtggaatgaatgaatgaattgttttgctagtaaagtctgggggaacccaggtgagaagagcctagaaagcaggtcgaatccaaggctagatagacttagtgttactcaagaaagggtagcctgaaaataaaggttcaaattatagtcaagaatagtcaagacatgggcaagacaagagtgctgtcatcaagtgtgaagaacaaagggaagtcagtaaccccagatgactaatgaaggggacaggagcagcttcagctgcagttcatgcaatgggtctaggcaagtggcttagggctgaactgtgcacagtgtaaggggcttagaggacctactttatgtggcccaggggccagacttagagttcaagggagaatttgagcccatctcttattagttacaggaatttaacaccatctcttattacctacaagaactagagcaggccaagcgtggtggctcacgcctgtagtcccagcactttgggaggccgaggcaggtaaatcacttgaggtcaggagttcaagaccagcctggccaacgtggtgaaaccccatctgtactaaaaatacaaaaattagctgggcatggtaaagtgtacctgtaatcccagctactcgggaggctgaggcagagaattgcttgaacctgggaggtggagcctgcagtgagctaagattgagccaccgcactctagcctgggtgacacagtgagactctgtctcaaaaaaaaaaaaaaaaaggaactagaacaaatcaatcactgtatctctctgagcccactgagcccattgacttcacatgcaaaatggggttatatatcaacacgtacccctacaacaagatagcatagtataaaacaatattatgtgtgtgaaggaggtacatgtttcttccaagttctactcagttcttctaagaagcttctactcagacatgagttctgcctgttgtttgtgtttttctcaaggaacgtttagtgttgtattgctgttagattgctgccttacatatcctccattgactagaagcttcttgaagggaagaagcatgtcttattcaccgtaattttgtcgagcttctggtagcatgcaggttgagtcgggagataaaaatgccaggccttcaggggtttgatgtatgaatgaggaccatgagattataaatcagctacaaggctccatgtgatctctccataagcatccactccttggaagctgtctgactttattcgtctgtatggcacaaaagagacacttggtaaatattgaatgaactgatgaatgaatgaatgaattcgcctttggttaggcatagcaataaagaaaatgaaatttaactttgtcttctagactttgaatgcctctgccaacaactaaatatcttccagggagggcagatggcggcctgtacaatgaacaatttaatctttagaaactggaacaactttgccagcaaactccatttttctctacgaacacattgtcaataacatgtgctctcaaatatgtggtgaaattgatgactgggccctgatttatagaaacaacaacaaattaaatgtttacctttctctttcctagcttggggtccttcagaccagccatgaatttttttttcctgtgctctaataatagaggaggtttaattacaatgctccatcgtgtgattgtgtgtggagtggaagcaaagcaaaatgtccagggtatcttaatttaaaaccaggaggggaaaagccacttatgtgataatgaagattaacgtagggagccgctggctctcccttctcacataaaagcagatattgggggaatccttcatacaaacatttctgtgaccactcatttagcctcttgtaggaaatcttcttgattttggacaaactcgaagctttagatttgcttgaaaataggccagggtaggagagggatgcccagagaaatggaattctccaaacagtaatcaggctacatgtttgggactattcctgggaatgacagactggtttggaagaagtcaccatcctaggacctcttcttctagaatggtggctctgaactcctacttgggtcaagagcctttttgaaaatatcatgagagctacagattctctctccaggaaaatcaagtctacctataacttcatatacacacatgcaccaaaatgctaaattctgcttacaatgtcatctcttgtctttgccataaacttaaacaacttgagtgacaattgctactgaaaattccaggcttcaccaacctttctgtgatgctcatccaagattaagaactgctagacttagaggacccttggtttctttaggccacaaaactgcttaactgtcttaggctgtggacttctttggctgtctgatgaaacccgtggagccctttaaaatgtctttaaaggccaggcgtggtggctcacacctgtaatcccagcactttgggaggccaaggcaggcagatcacgaggtcaggattttgagaccagcctggccaatatggtgacaccccatctttactaaaaatacaaaaattagccgggcatggtggcacgtgcctgtagtcccagctactcgggaggctgagacagaagaatcacttgaacccaggaggtggaggttgcagtgagctgagatcgtaccactgcactccagcctgggtgacagagtgaaacttggtctcaaaaaaaaaaaaaaagtctttaaaaactaatgttaaatgtgttaatgtggctgtccctttcccatccttcaggtcttcattcagatgtcactccctcagagagggctccctctcccctttctcaaagtagccccatcagaactgaaaccctcccaattgtcccatagaatggatggttatggtttcttttgagtaaacatagaaattgactctcccagtcaatttgagaaagtttcatttgtcttatctgagctcctttctctggaaacctaccctcaggccttgcagacagtatcaaggaactgaaacttaccagatcaccacatctgaacaatgagacagaagacctctcacccattatgactgcctgagcgaccacccacttcatgttgaccaaattctctttcttaccactccctaattcctgttttccttcatgtagttatatttcttccctgctatataaaacccttatttcttgtcagttggagagatagatgagattgacctcccatctcctgagctgcagcacctgattaaagcctttttctctggcaatacttgttgtctcagtggttggcgttatgtgtggcgagcagtaggacctagaccaaacccctggcctttcagtaacgatgcccacacctgcaccactcagtcccatcaccctgcttacggtcttcacagcactcacctcatctgacgtggtcttgatggcttgcttgcttattgtcttctcctccctctggaatgcaaacttaccagaggcagaggtcctatctgtcttgttccttggtgtgtcctctgtatcaaagcggtacccagtaatgggcctgaagcaaatgttttcccaatatttactgaaggaatctatgttcactggtaagtcaagagcaaaaaatacacaaagttttgctacttcacctggtctagtggtcatcgggcattattatttcataaatgtatactaataattttagtagcagttgaatatgtttttctttttttattattattatactttaagttttagggtacatgtgcacattgtgcaggttagttacatacgtatacatgtgccatgctggtgtgctgcacccactaactcgtcatctagcattaggtatatctcccaatgctatccctcccccgccccaccccacaacagtccccagagtgtgatgttccccttcctgtgtccatgtgatctcattgttcaattcccacctatgagtgagaatatgcagtgtttggttttttgttcttgcgatagtttactgagaatgatggtttccaatttcatccatgtccctacaaaggacatgaactcatcattttttacggctgcatagtattccatggtgtatatgtgccacattttcttaatccagtctatcattgttggacatttgggttggttccaagtctttgctattgtgaataatgccacaataaacatatgtgtgcatgtgtctttatagcagcatgatttatagtcctttgggtacatacccagtaatgggatggctgggtcaaatggtatttctagttctagatccctgaggaatcgccacactgactcccacaatggttgaactagtttacagtcccaccaacagtgtaaaagtgttcctatttctccacatcctctccagcacctgttgtttcctgactttttaatgattgccattctaactggtgtgaaatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtaaattttgtcttttgttgcctttgcttttggtgttttagacatgaagtccttgcccatgcctatgtcctgaatggtaaagcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaacagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgccttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccagttgtttgtatcctcttttatttctttgagcagcagtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgacagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaaggttgttgaattttgtcaaaggccttctctgcatctattgagataatcatgtggtttttgtctttggctctgtttatatgctggattacacttattgatttgcctatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgagtctctgcccggctttggtatcagaatgatgctggcctcataaaatgagttagggaggattccctgtttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcagtggtgatatcccctttgtcattttttattacatctatttgattcttctctctttttttctttattagtcttgctagcagtctatcaattttgttgatcctttcaaaaaaccagctcctggattcactagttttttgaagggttttttgtgtctctattatttccttcagttctgctctgattttagttatttcttgccttctgctagcttttgaatgtgtttgctcttgcttttctagttcttttaattgtgatgttagggtgtcaattttggatctttcctgctttctcttgtgagcatttagtgctataaatttccctctacacactgctttgaatgcgtcccagagattctggtatgttgtgtctttgttctcgttggtttcaaagaacatcttcatttctgccttcatttcgttatgtacccagtagtcattcaggagcaggttgttcagtttccatgtagttgagcggttttgagtgagattcttaatcctgagttctagtttgattgcactgtggtctgagagatagtttgttacaatttctgttcttttacatttgctgaggagagctttacttccaagtatgtggtcaattttggaataggtgtggtgcggtgctgaaaaaaatatatattctgttgatttggggtggagagtcctgtagatgtctattaggtccgcttggtacagagctgagttcaattcctgggtgttgactttctgtctcattgatctgtctaatgttgacagtggggtgttaaagactcgcattattaacgtgtgggagtctaagtctctttgtaggtcactcaggacatgctttatgaatctgggtgctcctgtattgggtgcatatatatttaggatagttagctcttcttgttcaattgatccctttaccattatgtaatggccttctttgtctcttttgatctttgttggtttaaagtctgttttatcagagaccaggattgcaacccctgcctttttttgttttccatttgcttggtagatcttcctccatccttttattttgagcctatgtgtgtctctgcacttgagatgggtttcctgaatacagcacactgatgggtcttgactctttatccaatttgccagtctgtgtcttttaattggagcatttagtccatttacatttaaagttaatactgttatgtgtgaattttatcctgtcattatgatgttagctggtgattttgctcgttagttgatgcagtttcttcctagtctggatggtctttacattttggcatgattttgcagcggctggtaccggttgttcttttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctttctggcttgtagggtttctgccgagagatccactgttagtctgatgggcttccctttgagggtaacccgacctttctctctggctgcccttaacattttttccttcatttcaactctggtgaatctgacaattatgtgtcttggagttgctcttctcaaggagtatctttgtggcgttctctgtatttcctgaagctgaacgttggcctgccttgctagattggggaagttctcctggataatatcctgcagagtgttttccaacttggttccattctccccatcactttcaggtacaccaatcagacgtagatttggtcttttcgcatagtcccatatttcttggaggctgtgctcatttctttttattcttttttctctaaacttcccttctcgcttcatttcatcttccatcgctgataccctttcttccagttgatcgcatcggctcctgaggcttctgcattcttcacgtagttctccagccttggttttcagctccatcagctcctttaagcacttctctgtattggttattctagttatgcattcttctaaagttttttcaaagttttcaacttctttgcctttggtttgaatgtcctcccgtagctcagagtaatttgatcgtctgaagccttcttctctcagctcatcaaagtcattctccgtccagctttgttccgttgctggtgaggagctgcgttcctttggaggaggagaggcgctctgctttttagaatttccagtttttctgttctgttttttccccatctttgtggttttatctccttttggtctttgatgatggtgatgtacagatgggtttttggtgtggatgtcctttctgtttgttagttttccttctaacagacaggaccctcagccacaggtctgttggaataccctgccgtgtgaggtgtcagtgtgcccctgctggggggtgcctcccagttaggctgctcgggggtcagggacccacttgaggaggcaatctgcccgttctcagatctccagctgcgtactgggagaaccactgctctcttcaaagctgtcagacagggacatttaagtcttcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagactccatgggcgtaggaccctccgagccaggtgcgggatataatctcctggtgcgccgttttttaagcccgtcagaaaagcgctgtattcgggtgggagtgacccgatttccaggtgcgtccgtcacccttttctttgattaggaaagggaactccctgaccccttgcgcttcccaagtgaggcaatgcctcgccctgctttggctggcgcacggtgtgcgcacccactgacctgcgcccactgtctggcactccctagtgagatgaacccagtacctcagatggaaatgcagaaatcacccgtcttctgcgtcgctcaggctgggagctgtagaccggagctgttcctattcggccatcttggctcctccccctcctgtcacagttgaatatgtttttcagataaaatcttctacagtacccaatatataaaacagatgaatataaatgagagtaagaagttccaaaaagactctctcagacacacactcctgcatgcccttgttggaaatttctacatcccattctcttctgagaagctcttttaaagtccttcttctggtctaaaattaacatctgagattgctcttcttcattaattacttcatggttaccaggaagctagttctgctcagtaagagatgtaagttatggaggtgacaatttccaacaaactctttttgaaacatctaggggattttctttcccaaacacattggtaaacctattcaaaactgaattctaaaagagagctatggcccaggagcagtggctcatgcctgtaatcccaacactttgggaggccaaggaaggcggatcacttgaggtcaggagttcgagaccagcctggccaacataaagaaaccctgtctctactaaaaatacaaaaaaaaaagaaaaaaagaaaaaaaactagcagggcatggtggcgggcacctgtaatctcagctgcttgggaggttgaggtggaagaatcacttgaacctgggaggcggaggttgcagtgagccaagactgtgccattgtactccagcctgggtgacactgcaaaaccctgtctcaaaaacaaaacaaaacaaaaattcattttcttataaggacaccagtcagattggattagggcccatcttaacagcctcatgtttacttaattacttctttaaagattctgtgtccaggcagtcacattcagaggtgctggggcttagggcttcaatgtaagaattcggtggggacacaattcatacccacaacactggcctccacgctgttggtcaataaagcttttgttgttattcctttaccttccctactgccaccctgccccagccctggcttcagaaggagcagcttgtagctatgggaaccttctacgcaagcttcccattaacttcatttagcttcatttatggctgtgcttgggaggactgaacattttctagtaaatgttataaggaaagcatttaaaatacatatcatagctgctcaacagctgatttgggggtggaggaaagccttgaattactttgagaaagaaagcctggttccatgtttctgcagtgcacaaataggatggcagaacacatgcttggaagcttccaccaggaggtcacatgagccagtggttaaggggcaggggtgatgggagcaagtaaaaagggatccaaatccaggttccacctctaataaccatagtgaccccaactacttgtggtcccatgagccagttgacccttctgcataatggtcatgctgatcatccccatctcccttttgttgtgggggcctctctgttcatgtaaagtgcctcacacaatgcctggtataaggtaagtccacaataactgataacagctattgttgttatcactgaaatgcaaataaatcaacagagcccagggactcaaaggtcttgtacaactagaccactttggctctggattgtacataagatttgctgcctttatatgcagtggtgcactgcacttctaaaataaatatttgtgtatgcttgtgaaggaacttagtctatctagaaatgcagttttaggattgggtgcagtggctgatgcctgcaatcttagcactttgggtagagacaggagaatcacatgagcccatgagcctaggagtttgagactagcctggcaacatagggagacccctgtcttgaaagacagagagagagaggaaggaaggaaggaaggaaggaaggaaggaaggaaggaaggaaggaaggaaggagggagggagggaaggaaggaaggaaggttggcttagggggtagggagaggaaagaaagagagaaggaagagaggaatgtcgtagaattatagaagttatgtgttctaccatgtctctgaaagaaggattaactgattaaatggtagaaataagtgaataaatgaatcctatctgagagcagtagttctcaatcttggtagtgcattagaatcccctgaggaacttttaaaaaccccgggcccaagtcataccctggactagtcaaggcaaaaccttggggagtagggcccaggcatccacaggtgactcctacctggagtggggccaagtgacagaatctgcttagaggcgggagcctcagctggacatctctgagtcacttattaggtgtgaacttggtcaagttgcttaacatctctgagccttgatttcctcctctatcttgaggattaaataagatataattggtaaaacacaggctccctatcgacaatggaccgaagtgctgaatagcaggtgtttcccattattaccgccatcattgccatccagtgcgtaagcctgagcctccatgtcaccacccgcaaaatggtaggggagaaaggatgcctgaagaccctttactttcattctgatgattctatcaaggtagagcaatgggccaagtcaacagaaaagttcacctgtcttcaccaagtgacagccatggaccaggagccatggtggcaactctggagactgttgcacaaacagtcccacctctgctctcctagaacctgaatgctagtggggagacatgtcaaacagtgctcgtccagaccaatatattattcatgacaagagggatctaagagagaggaaatctgaggacctcatctggatcccaggagaagaaaagatctttctgacaacgagctctttaaaccaggggatgaatgtggagtaggaactgtctaggtggagttgtgagaagggcccttcaggcaggggtagaacaggagcaaaggctgtgaggagggaaggagcttggattttttttttctaagagacaaattctctctcattgcgcaggctagagtgcagtggtacaaccatggctccctgcagcctctacctcccagctcaagtgattctcctacctcagcctcccaagtagctggaactataggtgcacaccaccatgcccagctaacttttttactttttactttttgtagagacagggtcttgctatgttacccaggctggtgtcaaactcctgggctcaagagtcctcctgcctctgcttcccaaagtgctgggattacaggtgtcagccaccacgcccagtcagtatttttctttctaagagacacagtctcactctgtggcccagtctggagggcaacggtgtggttacagctcactgcagccttaaactcctgggctcaaatgatcctcctgcctcagccttgcaagtcactgggattacaggcatgagccaccacgctcagcttagaggtagacatatttgaggtgcttttacttaaaacatggatacttgaacttttaaaagcatctttttttcttagagcatcctgggcaacttgggttccccataacatacttcaggaaagggcaggggagcccagtgaggccagggttgagctccagacaaatcttgatttcattccagcttcactgggaaatggctgtgtgaatgcaggggacaatttaacctcccgaaacttcatccataaggagaaagtaagaactcatattttgccactcatttgtaaaaattggtaattattgataataatcaaattggtaaagggaaatagttattacttttgtgtgtgtgtgtgtgtgtgagacagagtctcgctctgtcacccaggctgaagtgcaatggcgcgatcttggctcacagcaacctctgcctcctgggttcaagagattctcctgtctcagcctcccgagaagctgggactacaggcacccaccaccacacccgactaatttttgtatttttagtaaagacgagttttcaccatgttggtcaggctggtcttgaactcctgacctcaagtgagccacctgcctcggccttccaaattgctaggattgtaggcatgagacaccgcacccagccagaaatctttattactatgaagcagcagggtacattggtgacagaaacctgagttcaaatcccagctctgctacttcccaggcatgtgctgttggtcctggtacttagatctctgaccctcagttttctgatctctcaaaaagaaaaaggagtttataagagctatctttaagggactattataacaattaaataaaacaatagcagtcaagcttcaggcaaaagatggaaactcaataaatgaaaactaccattaaaatgaatacaaactcttcttaggaagagggtttggctgaattatttaagtgtgtgttccaatctaccaaccctcttttccagtgtagacacaaccacaaacatcgccaccatgagcttagacatataatcacagtggttaaaaaaaaaaaaaaaaaagactgtaatcccagcactttggggggcccaaggcaggtgaatcacaagggtcaggagttcgagactagcctggccaagatggtgaaaccccgtctctactaaaaatacaaaaattagctgggtgtgatggcacatgcctgtaatcccagccacttgggtggctgaggcaggagaaatcacttgaaccggggaggcagaggttgcagtgagccgagatcgtgctgttgcactctagactgggcgacagagcaagactctgcctcgaaaaataaaaataaaaaaaaaaaaagaaagagaaaaaggaaaaaaaaaaaagtctaccttgtttatgtccatacttggagggcataccgttcttattaaatgccagcaactcacattttaggcagcagtaaagtcccctagctgtgtccatgcagtgaatctcgttgggctgtaagttagctgcaataaataacattggctctgcactccacttagagaagatgggttcactgtgaatcatgttgttggcggtttggactttaagctgtccaggttgtttatggtggtgtttgccagcatgtagacctctttcaaacaatttaagtgctcttttggagtatacgaatgtggctcaataaaaatgggtacaggaaaattgcctcctttctctcttctatggccataccccaaaagcaaccatatatgacaattgtcaagtgttaagtataattgctcaacatgaaattataattaacactgaagccaccagggacattttctctctccattgtcaggatgttgtcctgatctggatgttgtcctgatctttgtgacccttttaatttatcttttgaaaggatggcaacagctgggtagtttttcaatccttatcattttgcattatatagctttactgagcaatgtgcctttggaagattctagttagtttcattgacagcaataaatactggttagagaacaggctttgaagtcaggcagacctaagcccaaaggctggctctcccacttgctaactatctgatcttgattacatttcttagccaatccaaggctctctcttctcatcaacaaatacagacaatgaaatctactgtcaggtagtactgaggaaggcagagcttctaacaagcacttaataaaatggtagatattatgactgttttctgctttcttcttcttaatatccacatcaaatgttttgaaatgctattttctccttttttataaaaagggaaaaattttcttagcttcccttctgaattgacaactgatttcttttcaacatttgtttaatgcagcaacgaaagagctttttgacttcattttttaaatttccagaaggaaagagtggtctattttccaagacctaatgactacttatttgtaacacataagcagaattttatgcatgtatttttaatttattctacatctcattccacagcagttttaagatactgtactatatgcaatgcagcaaaattataaaagaaataatagaaatcattaaagatatctacatttcgttaagcacttattgaacgccaggcaacatttgtgaaaagtactatatattattatcctgattttgctgatgcggaaactgagattaagaaaaggtaagttatgtcccccaatatcacacagctagtaaatggcagagccaaactattaacacatataccaaaggaaaatggaaagagaatatcaaaagaagtttacaggtatagactgcagccttaggaggctacataattactaaagttgggccaccaatttgactctgagcttcctggtagtgaaagcaagaatgcaaacatgatccatcccaagaaccacctttccatgaggatatgtgtaccaggctttaaaagcaagcaacgtcttccctaatacgtagtgtctggaagagatttatgacataacttttgtgacatagtcaaatgcaacagagacgacaggaggttcccgtgatagaaccaaatatttgaaactaaaaaaaaacattctttctgtaaaagaaaaaaaaataacaccactccttcctgcaaaaatgttttacttaacactgggctccatctcttttttataattattcaatccaagctttgtcaaagcatcatactgagaagagattcatgttaaaaagctagtggaggggggtggagtagatagcagagaatgcctctctgtcttatcatttttatttagattgacatacctttgattataattagggataactgttcagcagttaagactccataatcccatcattagttgtcaggagattttcacagggcaaactctcatgccatttctctcatttctgtttcttaactacttgggcagcctgcagttgaagagtgtgctttatggaaaagattttctgctgccattgaaatcttctaagctgacacacagttaaggacacaaatgaaacctccactcttgggaggccccacatcttcttgcctgacatttttgttgttgttgttctccaagatatcgccctgtttctgctggttgcgttcaacagccattttgcacacactggtgaagagatcttaaaccatttcagaggtggcccataaaggaggcaaaaggggacttgccgtaaaaattatttccatagacatgcaaagttgattatataaggtagaggtcagttaagattctctggcatccattacgagacaaaaaaaaaaaaaaaaaaaaactaaaaaaactctcctccaacttgaaagctgaaggcagtgggtcgtctggtttgtgtcatgaaacatacatcatgcatttgagacacatattacaaattgtactttaaaagaggaagttcagaagttgggattttccagtgtgtcaattatgacccgaatgctatctatatttaaatgttccaagccgactatcatgatcatgtccccttattcttcaagggtctgatgaagtacccctttgacaaggaatgaatggtctcatcagtacagatccaactcaacatcaggaacaattagcttggcagttaaacctaaaggctctgaaatcgatattttatatatatatatatatatatatatatatatatatatatgtacatattctaattgaatgttagaatattcggtttcacttataattattcagataggtcacttcaagtctctaaacctagagaggtttttttctctgtaatattggataccttgttggattgttttaataattaacagaaataatgcatatgtggtggatcaaaaatgacaatcatggccagatgcagtggatcacacctgtaatccccacactctgggaggctgaggtgagtggatcacttgaggtcagaagttcaagaccagcctggccaacatggtgaaaccccatctctactaaaaatacaaaaattagctggacatggtggtgcacgcctgtagtcccagctacttgggaggctgaggcatgagaatcacttgaacccaggaggtggaggttgcagtgagccgagatcacgccactgcactccagcctgggtgagtgagactctgtcaagaaaagaaagaaggagggaaggaaggaaggaaggaaggaaggaaggaaggaaggaaggacccaagaaagatagatagagagggaggaagggagggaggaaggaaggaaggaaggaaggaaggaaggaaggaaggaaggaaggaaggacggacccaagaaagatagagaaagagagagggaggaagggagggaggaaggaaggaaggacccaagaaagatagagagggaggaagggagggagggagggaggaaggaaggaaggaaggacccaacaaagatagagaaagagagagggaggaagggagggagggaggaaggaaggaaggacccaagaaagaaaaaaaagagagagaggaaaggaggaaggaaggaaggaaggaaggcaggcaggcaggcaggcaggcagacacaacccagatattactgatatataactgttaaaatgttttcattaactcaaccgttctgaggtttgatagaagaagaaaaaaagagtccctcttgccatttggaaactcagccactttgttctttctggtttattttgtgacctccctttccgacagcaattagtctcagtctctgttgtcaacgctgggaaaactacatggaagaaaggaattaaggaaaggcaatacatcagaaagtgttttaaaatagtatccactcacccacatgaagctgtgtctggcatatcaaaagtaaagtattcaatatatttaagcaattacctgtattttattcactctaagaattgaaatttgtccactaaagttgaagggtttcctcacacagagatttctcttaggaaaaattaaatgaaacactaataatgaaattcagcaatgtagataagccaatttgcatttccaaattgtaattccatttgaaaaatattaactacaggtttctcccaggattacaccgctaagcatcatgtgtctccattgctcctttgcttccttgtcacagtctttttaaaataataacacttggccgggcgcggtggctcatgcctgtaatcccagtactttgggaggccggggtgggcagatcacttgaggccaggagttcaagaatcagcctggccaaaatagtgaaacccgcctcctaaaaatacaaaaattagtcaggtgtggtggtgcgcacctgtaaccccagccactcagaaggctaagacagagaatcgcttgaacccgggaggcagaggttgcagtgagcggagattgcgccactgcactccagcctggatgatagagcaaaaatccatctcaaaaaaaataaataaataaaacactaaatataggtttttcttttttcattttcaaccaaacagctttaagaagccctaaattaggagtcatgtgtcctgacctatcactgaatcaccctgagagcaagttacttaaactccctctgcttcaacttctttatctttggggtactaatatttatccaatatgtttcaaaagagaatgtatatgaatggtctttgaaaaaaatgtaaattgcttcaaaatgacagacaaaattattctttgaacttgaaagcaccaaatagatggcaaagcttctggagtccgcttgtgtttccttgggctatttttccagtctctttccatgctctaagttgtttctttcatagaattagagaaataggattctaggtacatctatttttttttcttttgtattgttttagtgataaatactttaaaacccttcatggtttccatgttagaaaagataggcttcaaattagtgtctttagaactccattcattcaacaagtatttatcaaggacccactctgtgacagatagtgggttttatacttgggactgtgctgtgctcaaactctcaccttcctggagtttacacaggcaggcactaaactcaaaattatatatgcgatgatgtgcttatacgctgcaataagtcttataaggacactgcaaaaggttcatgcaagatgataacaaaagaatgtagtcaagtcctatgggtaagaaaagacttatttgagaaagcaccatctgaactgagacttcaaggatgaaaaggtgctggccaaacaaagagtgggaagaagagcatgctaagcagagggagcagcacgtgcaaagaccctgaggccagtgttcttggtatatatcaagtggcagagggacccaggtgaaggcagagggatggcaagaccagatcaagcaggacattaaaacaagtttgtcttttttctaagtgccgtagacacttttcttttcttttttttttttttttttttgagatagagtttcactcttgttgcccaggctggagcacaatggcatgatctcggctcactacgacctccatctcccagttcaagcgattctcctgcctcagcctcccgagtagctgagattacaggcatgtgccaccacgcccagctaattttgtatttttagtagagacagggtttcttcatgttggtcaggctggtctcaaactcccgatgtcaggtgatctgcctgcctaggcctcccaaagtgctgggactacaggtgtgagcccgcgcccggccaggccattgacagattctaagctggaatgaggagtgacccaacttaatttgagattttataagctcactttgtttgctatatggaaagttatcagaaggacaccaagtggactaaaacagcccactgagcgaatgccacagccatccagggcagataggcgcaggcctgaattgtgtgcacaattgcaggtggccgtggaaatacagttcgggaggatttcatgactagggtcagggtgagccattggatgcgagggaggagtgagggcacagtcaaagacgaccgaactttctggctgaaagttgagtcatatgagttccatttcctgtgaagaggaatacagaggggtacagaataaggattgggggtgcaagcaccctgtttggggaaaggttttattgaagtagttgtgagatcttcacaaacagatgccaagatgccagctggatgttcagatctggaactcacagtcaccagcacgcagacgatatttcaagtttcagaactggaagatgctgcttagaaagagctcctcaggggggagggaggagccaagatggccgaataggaacagctccagtctacagctcccagcctgagcgacgcagaagacggtgatttctgcatttccatctgaggtaccaggttcatctcactagggagtggcagacagtgggcgcaggtcagtgggtgcgcgcaccgtgcgcgagccgaagcagggtgaggcattgcctcactcgggaagcgcaaggggtcagggagttccctttccgagtcaaagaaaggggtgacggacggcacctggaaatcgggtcactctcacccgaatactgcgcttttccgacgggcttaaaaaacggcgcaccacgagattatatcccgcacctggctgggagggtcctacgcccacggagtctcgctgattgctagcacagcagtctgagatcaaactgcaagatggcagtgaggctgggggaggggcgcccgccattgcccaggcttgcttaggtaaacaaagcagccgggaagctccaactgggcccagcccaccacagctcaaggagtcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactggcaggcaccccccagcaggggcacactgacacctcacacggcagggtattccaacagacctgtggctgagggtcctgtctgttagaaggaaaactaacaaacagaatggacatccacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaaaaaggcttcagacgatcaaattactctgagctacgggaggacattcaaaccaaaggcaaagaagttgaaaactttgaaaaaactttagaagaatgtataactagaataaccaatacagagaagtgcttaaaggagctgatggagctgaaaaccaaggctggagaactacgtgaagaaggcagaaacctcaggaagcgatgcaatcaactggaagaaagggtatcagcgatggaagatgaaatgaatgaaatgaagcgagaagagaagtttagagaaaaaagaataaaaagaaatgagcaaagcctccaagaaatatgggactatgtgaaaagaccaaatctacgtctgattggggtacctgaaagcgatggagagaatggaaccaagttggaaaacactctgcaggatattatccaggagaacttccccaatctagcaaggcaggccaacgttcagattcaggaaatgcagagaacgccacaaagatactcctcgagaagagcaactccaagacacataattgtcagattcaccagagttgaaatgaaggaaaaaatgttaagggcagccagagagaaaggtcgggttaccctcaaagggaagcccatcagactaacagcggatctctcagcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaagaacaaccggtaccagccgctgcaaaatcatgccaaaatgtaaagaccatccagactaggaagaaactgcatcaactaacgagcaaaatcaccagctaacatcataatgacaggataaaattcacacataacagtattaactttaaatgtaaatggactaaatgctccaattaaaagacacagactggcaaattggataaagagtcaagacccatcagtgtgctgtattcaggaaacccatctcaagtgcagagacacacataggctcaaaataaaaggatggaggaagatctaccaagcaaatggaaaacaaaaaaaggcaggggttgcaatcctagtctcagataaaacagactttaaaccaacaaagatcaaaagagacaaagaaggccattacataatggtaaagggatcaattgaacaagaagagctaactatcctaaatatatatgcacccaatacaggagcacccagattcataaagcaagttctgagtgacctacaaagagacttagactcccacacattaataatgggagactttaacaccccactgtcaacattagacagatcaacgagacagaaagtcagcaaggatacccaggaattgaactcagctctgcaccaagtggacctaatggacatctacataactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaatgaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagtagaaggcaagaaataactaaaatcagagcagaactgaaggaaatagagacacaaaaaacccttcaaaaaattaatgaatccaggagctggtttcttgaaaggatcaacaaaattgatagaccactagcaagactaataaagaagaaaagagagaagaatcaaatagacgcaataaaaaatgacaaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctggaactattccaatcaatagaaaaagagagaatcctccctaactctttttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatataggcaaatcaataagtgtaatccagcatataaacagagccaaagacaaaaaccacatgattatctcaatagatgcagagaaggcctttgacaaaattcaacaacacttcgtgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctgtcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcaccccaaaatctccttaagctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctgtttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggctttaccattcaggacataggcatgggcaaggacttcatgtctaaaacaccaaaagcaatggcaacaaaagacaaaattgacaattgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaacagacacctgaaaaaatgctcatcatcactggccatcagagaaatgcaaatcaaaaccacaatgagatactatctcacactagttagaatggcaatcattaaaaagtcaggaaacaacaggtgctggagaggatggggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacatatgtttattgtggcattattcacaatagcaaagacttggaaccaacccaaatgtccaacaatgatagactggattaagaaaatgtggcacatatacaccatggaatactatgcagccatgaaaatggatgagttcatgtcctttgtagggacatggatgaaattggaagtcatcattctcagtaaactatcgcaagaacaaaaaaccaaacactgcatattctcactcataggtgggaattgaacaatgagatcacatggacacaggaaggggaatatcacactctggggactgttgtagggtggggggaggggggagggatagcattgggagatatacctaatgctagatgacgagttggtgggtgcagcgcaccagcatggcacatgtatacatatgtaactaacctacacaatgtgcacatgtaccctaaaactttaataaaaaataaataaaaaataaaaataaataaataaatttagttatcagattaaaaaaaagaaagagctcgtggggagcagaggtcctccgcctttgcagactcactgttgacattttaggacaagcattttataacttccttttaccatcctgaaataaaatttctagatcgggtggccagcctacacacaaaccgcaaaaagaaatcatctaataaaaaagaaaggggcctggcacagtgacttacacctataatcccagcactttaggaggcccaggtgggtggatcacttcggatcagggattccagaccagtctggtcaacatggtgaaaccccatctctactaaaaatacaaaaattagccgggtgtggtggcgcatgcctgtaatcccagctactcagtagactgaggcaggagaatcacttgaacccaggaggcggaggttgcagtgagccaagatcgcgccactgcactccagcctgggcaacagggcaagactctgtctcaatttaaaaaaaaaaaaaaaaaaaggagaaaattgagacatgaaaatgcaccagaacagggcttctcaaactcgagcatgtacaaaaattgcccaaacattctattaaaatgcaggttccaaatcagcagcttggggtgggccctgtattctgcatttctgacaagctctaggtgatcccagtactgctgttatatggaccaccctcagagtaacaacatcctagaagatgtaatgaggcagtcagatgtgcgccataggcagactcaccgtgaacatgtcagtggtaaacgcagagcaatatgggtggattgaatgggggtcttgaggatcatgaacagtaatacaaaggtgacttgattttctaaaatggcaaataactcccattaaattccaaataaagcaaaatacaggttctctttgtcagataagctttatttctggaaattacaatgtgtgttaaactgtgcagaaaagactttgtgtttatatgtaaaacagagttaagttctagcctcagataattataaaaaggttttgaaccaaagacaattttgtcctccacgcccaatgggcatttgacagtgtctagacacaacttcagttgtcacaactcaggggtaaagcagatgctgctggcatctagtgggtagaagccagggatgaggctgaatatctacaatgcatagacgggcggcccccaccaaaaggaagtatctatctggctgaaaatattaacagggccaagttagagaaaaactggcttgcagagatattttcaaaaatggtacagactgagagtaatggctcacacctataatcccaatactttgggaggacgaggcgggaggatcactcgagcccaggagttgaagaccagcatggacaacataacccaggtttttgttttttttttttttttgagatggagtttcactcttgttgcccaggctagagtgcaacgatgtgatctcgactcactgcaacctccacctgctgggttcaaatgattctcctgccccagcctcctgagtagctgggattacaggcgcctgccaccaccaccagctaatttttgtatttttaatagagactgggtttctccatgttggccaggctggtctttaactcctgacctcaggtgatccacctgcctcagcctcccaaagtgctgggattacaagcatgagccaccgtgcccagccaacccaggtgtttttgtagagactccatctctacaaaaaaatttaaaaattagcctactgtggtggcatgcgcctgtagtaccagctactcaggcagctgaatcaggaggttcacttgagcccaggagatcaaggctgcagtgaactatgatcgtgccactgcactccagcctgaatgacagagcaagaccctaccttctaaaaaaaaaaaaaagaaaaaaataaaaaatgggtgcaggatgatggacaacagcaccttgtgtgaaactgtctcacacattgcaaggagcctcacgttcccagcccctaaccactaaatgccagcagtgcccccttttagcaaccataagacatgccctaaaaatgggagtgtcgcataagaacaacagcagagagtgaagagagaagggggtaggcaggaggaaggcaagaagagtaggagccagccaaaatgctgtgccaggggatgagaaaggctggcatggccaaattaaagcatatgtcattctacgcatctgttggtggctctgtaattaatacaaaaataattacatctcttcgcctggctctccctcacaaactacttaatgaacactgccaagaactttttagatatgtaattaaattttttatttatttccattttatttttatagtagtagctcaatatattagaaaaaaaaatgcagcagcaaagcccagcctcaactaccatttgagaggcaactaacagtatccacttcctttttttctcaatctgttctatgcaattcattctgaacagcaggaaatactaacaacagttctcttattccccttcccttcatttttcaggtttaattatctgccaggatctcctctttaggcacagagagaaatgaggtttttactttacttttcttttaatataagaaataatttggctaggcacggtgcctcatgcctgtaatcccaacactttgggaggtcaaggcaataggattgcttgagttcaggagttcaagactagcctgggcaacgtggcgaaaccctgtctctacaaaaaatacaaaaaaattagccggatgtcctggtgcacacctgtggtcccagcttttcaggaggctgaggtgggaggatcacctgagcccaggaggcagaggttgcagtgaacaaagatcatgccactgtactcaagccactctgggtgacagagtgagaccctgtctcaaaaaaaatagaaaaaaaaaagaattttaaaaaaataatagtgtgttgtcccaaagtggtccaagatttggatcttctctttacccttcttcaagtataggaacactgacctttccaaaagcccccaccacttccatcagtcatggtgggatccaggagacttctccaatagaaatactcccatagctaagtttcataaaagacataggtatctgaaatttaaaagtaactatactcagataatggccgggtgcagtggcttacgcctgtactcccagcacttcaggaggccgaggtgggtggatctcctgaggtcgggagatcgagaccagcctgaccaacatggagaaagcttcatctctactaaaaatacaaaattagccaggcatggtggcgtatgcctgtaatcccagctactcgggaggctgaggcaggagaattgcttgaatccgggaggtagaagttgcagtgagtcgagatatcgtgccattgcactgcagcctgggcaacaagagcgaaactccatctcataaaaaaaaaaaaaaaaaaaaaaaaaagtaactatactcagatattcttgggaaaacgcctctaaatcactaataatgtcaatgttcagcacttgaaaacaataccaaattattacaagccgtataagaagcagtggttgaagagacaagaatgaccacaggcccaacatctttacatctcttaaccctctgtttcctaggttgaaagtgtagaaattatgatctcctgaactgcagcattgtgaagttgacacaaggtgaagcaatgtcacattgtcaccacaacaggatcctttcatgctgagatccaaaaaagccagataacctgagtcaagaatcacagaaagtcaataacaaaatcaggactgaggtcttgagaactggaaaacttccttggttttcacacaggaatctgtcatttgtgcttatttcacattgcatgcctgtatcaaaacatctcatgtacaccataactatatacacctactatgtgcacacaaaaattaaaaatagggctgcacatggtggctcacgcctgtaatcccagcactttgggaggccaaggcagggagaatggcttgagcccaggagttcaagaccagcctgggcaacgtggcgaaaccctgtctctacaaaaaatacaaaaaaattagccaggtgtgctggtgcacacctgtggtcccagtttttcaggaggctgaggtgggaagatcacctgagcccaggaggcagaggttgtagggagccaagatcaagccactatactcaagccggggcaacagagtgagactctgtctcaaaaaaaacagaaaaagaaaaagaaataatttttaaaaaataataatgtgttttcccaaagtggtccaagattcagatcttctctttacccttcttcaagtgtaggaacactgaccttaccaaaagcccaccagttccatcagtcatggtgggatccaggagacttctccaatagaaatactcccatagctaagttttataaaagacatagttatctgaaattttaaaataactatactcagataatggccaggtgcagtggctcacgcctgtaatctcagcactttgggaggccaaggcggggagaatggcttggcctgggcaacatggcaaaaccctgtctgtacaaaaaatacaaaagaataaaccaggtgtgctaatgcacacttgtcccagcttttcaggaggctgaggtgggaggatcccctgagcccaggaggctctacaaaatacaaaacttagccgggcatggtggcgcacctgtagtcccagctactcaggaggctaacgtgggaggatggattgagcccaggagatcgaggctgcagtcagctgtgattgcaccactgcactctagcgtgggtgacagaacaaaaccctgtcccccacctcccccatccccaaacaaaacaaaacaaatttttaattaaaaaattaaaaaacaaaaaggatctgtcatgaaggtatttttcagcaaacaacactcaggtatatttgtgaatcttaaatagggaagaaaagagttatcaaataaacctggcaagtactgagttaagtaaagacacactatgtttggtttgattttaattgcaggacttctcagagtctttaatatgttaatgtgtgttgtgaatttccaagacaggaactataataaaatcattattttctttctccttactttcattcccaggacaaactttgccctaagagaaactcagttagaaaagtctgggtgttgatttaatgtggagccacttcaaggaagtgataataaaacaaagttccatgaaattgatatcatattaatatcatggtcaaagaggagaaaatgacagcctgcagtaggcctggtgtgaaacagtccttcagccaggacttcactcttgtttcacagtgtaatgccattgcagtttccaaaagtccaccaatttgtggtctccacttttcctttgacccatctctcttcttccaaccacatgatcaccctcctttaagcttctagacctgccagaggatctcaaccaactcaaaacaaagattgccagggaccctttttctctcaagtgcacatctaatgtcaaagggaaatggttctctccactgatggtgatcaaggcattcacctgtaatctaggtagggtggtgcctgtcatgagcttggaagcttcagagtaggaaggactaaatttaaagccatcctctgctttttattagctgtgaaccctaggacaagtcacttacttttatctctctctttttttttttttttttttttaagacagagtctcactctgttgcccaagctggaatgcagtggtgcgatcttggctcactacaacctccgcctcccaggttcaagcgattctcatgcctcagcctcctgagtagctggaatttcagaggtgcaccaccatgcccagctaatttttgtgtttttagtagagacagagtttcgccatgcttactaggctggtcttgatctcatagcctcatgtgatccgcccgccgttgcctcccaaggtgctgggattacaggcgtgcaccaccatgctcgtcctttatctctcatttttaaaatgagattgtttcaagagttaacagtaatgtgtataaagtgactggaatttggtagatacataataactggttgctagtattccagtcatactattccttaccaaggaatagtttcaaatgtctgttatgattatcttgtgcatcatttctgtacacatatcaaatgtcatctgattttcaatttgtctttatccttccactagaaatttggaagctttccttttctaaaaagactaatcatatttaggttcagtgttttttctcactaaaatgaacattaccaccaaataacaagatgtaaacaagaaacttcactcagattgggctgaaggaaattgcatgctttccacacagtaatccagagcaaagttcttggaaagaaaaatcaccctgttattaagtagcacttctctaccgaaaacgttcctatcttttgacaggaattccacacttaagaatttaagcctatgaaaatattccagcatacagaaaagcttgaaacgcaaagatgttcatcatagtgttatgtattattgaataaaaattgcaaacattaaatgtccaatattacattatcgtagtatcataaactattataatgtatgtgatagaacttctacagctgtttatactgatgctttccagtgaagaaatacctccagacaggtgcctcatatagtcagcatatataactatgtaaacctaacgaaatgcatgggaaggccagacacagtggctcacacctgtaatcccagctctttgggaggctgaggcaggcggatcacttgaggtcaggagttcaagactagcctggccaacatggtgaaaccctgtctctactaaaaatacaaaaattagctgggcatggtgatgcatgtctgtaatcccagctactcgggaggctgaagcaggagaattacttgaacccaagaggcggaggttgtaatgaacccacatcgtgccactgcactccagcttgggtgacagagcaaggctccagcacaaaaaaaaaaagcatgggaaaagaaaagactagaaggaaatacagcagaacgtgaatgagagctttaagcctagtatgaccataggttaataggttgttttgtttttgtttttccaaaaagctttatagtgaaaaaaatcatacattatgtatatgtatttctaattgcagtaaaatacacacaacataaaatttatcattttcactattaagtgcacagttgagtggctttgagtacattcagattgttgtacaaacataacaatgtccatctacagaatttttcatcttacaaaagatgaaactgaaactgctctgagtgaacaagaattcttattgcttttcccacctcatccccagtccctggcaaccatcattcctctttctgtttctatgagtttgactacctctagatatgttatataggtataaccatataatatatttctttttgtgactggcttattttcacttagcataatattctcagggttcatccatgttgtagaacgtgtcagaatttcttccatttttagggctaatattccgtcgcatgtacatatcacatttgcttatccactcatccgttggacacttgggttgcttctgagttttggctattgtgaatagtgttgctatgaacacgggtgttcaaatatcctttccatacattatattaaaaatattttttttcttaaagttgcaactttttggccagtctaggtggctcaagcctgtaatctcagcaccttgagaggctgaggtgggaggattgcttgagcccaggaatctgagataggctctgcaaaataaaaaataaacctagtcaggcatgatggagtgtgcctgcggttccagccactcaggaggctgaggtgggaggatcacttgggcctggcaggttgaggttgccgtgagccgtgatgatgccactgcacaagtatagcgacaaagcgagactctgtctcaaaaggaaaagaataagaaaattgcaactttctttttagatacagagggtacatgtgcagtttgttgcatgggaatattgcatgatggtgagctgtggggtatggatctcatcacccaggcagtgagcatagtacctgataggcagtttttcaaaccatttcctccttcctccctccccagccccagtagaccctagcgtctgttgttcgcatgtttacatccatctgtgctcagtgtttagctcccacttatgagtgagaacatacagtatttaaatagtttttttctcaaagttgactcctccttttcatgtttcacagtctggttatataactaggactctactcagaacatttggacaaataaagtagtggaggtgggcaaggtgatcaccctggggaaaaaatcacctgggctacacctcagaaaataatgcatctttctgttgttctgattcccattacaggacgaatgccttagtttccactttccagcctggatcccctcacactgaacccttcttcgttgcaccatcctgcttctgacattgaactcattgaactcctcctgacaccctggctctgagaagactgccaaaaaaaaaaaaaaaaaaaaatcaccccagccatttctcttcatcctcactaacaatttggtaatgaagtattgatttccacttctctgcttatgggcggtattagattttcattgataaattgcaatggggctgtctcgtctccacagtacccttttcactgtcacaagaaaacaaagtgccaccgaagaaaagtaatgactgagagcattgatgtacttattttgtcagtttgtaacaggaaagtgggggggagtctaagtcttcatagtctaatgtccaagtgggttgcactagatgtagacacttggaggcttacttttcatggtaatgtccatttcctatttataacccctctgggaacgtttgtctaaaggaaatgtttctgttcagtgtaacaattacagttgcacctggattgcccagtcctgcccctgcactaggggaccattaatcactgcaaagtagaagaattattaagttaaaccagagtttgagccaagaaaacccctgaacaatgttcatcttctgtgaaacttgctcaaatagttaagcttaaccatgttgctgccaaagacttttcctatgcagtggtggggcaccttgatcatcatcattatcttgattggctgaaaaaaaaatagttttaagcacacaccactgtctatgagaactgcaaattgggagaataggtgaaatgcagaatctgagagaacgcgagaagatgagatcattacagggtggaaagttctgcagcagccttttctggtaatccctttctgcagaacctgatgtttatgggctctaaaacgcagcttagctttagaagcaacagaaagcatgaaatagggtgtccattttaaatgtgttcctgcaacttttttcattaaaactttgagggcccaattttaatttgtggaatattcccgttaataatgagatctaattaagacatccattaaaagcccgttaaagttaatttaacgtaaaaattccaatagaactgtattagattttctccattaaattaacgttatggatttttaacggatgtcttaattatacgttattattaacgggaatactgtattacacagattaaaatcaggtcctaagtcaacttggaagagctaagagcatgttttaatattaaaagtcttgcatacctagtgcacagtttggagacgcaaggatagatctgtttactctagttgaacattttctatacaattgaaagcaacctataatagataaatccatcattgcatttaaacaatgaatttccttattctcaaaggacaaatacgtctggattatgtggtaaattgctactcagctatggtgaaatatttatactattctaggcacaacactaggaactaggtgattctgaaacaaaaggaatattttctgttgttgctttaattaccaaggttatttttttttaatctcaacactgacaaaatgaaaccaaatatctcttcctcaccatttctcaaggaggctgcctgttggaattgttttggaaattttgacatgatccctaaattcaacattgggattaaaaaaaaaaaaaaacttcttatttacctcctagggaaagtgttgcccttatgccacatataatagcaaattgctttttttatggcatgcataacctagatgggaaaaaatatggcgcttcggggaaggagggaaaaagtaaatgaagttccaggaatgtcattctgaagtaatgaggcatggacagaaaatatacccctcacatcatcggattgagatggcagtcgaaatagcttcattgaagtgtcagcactcatccatcaatcaatcacccacaaggaaaaatagcaacagtacaacggggtggcttttatgggatttactcatgggcatagggaatagcggctcaaatgtagttctgacatgaaaagcaaggtgctgatattattttttatgatgggaggatcataaagtgaattgagaacagtgaggtctgtctttgcttaacctattcaaccagaaatgaatggagctcgactggaaaggaacagtcttcagatgggttaagattgaagggtggactggactctactgagcaccgtccttcaacaaggaaattctattaaaggaaaatcaatgcattagtattggggttctcgtagctgttaaaaattgtctgctccaatccagggttattaggccaaagttacataattcagatctcactgcaaccatccaaaagtggattctcgagcccttgctccaatggggggaggagatcaatacaattcccaattccatggaaattgtttcccttctaaggaagaaaaaataaatcatctgcttcaacatataatcgatatggttttgttagcgtaatttctatggtgggtggggtgggaggtgagagaaaaaaatattgataaatttggtaagacaggtgaattgccgcctggcaaccgtgcatgtcactgccgagggatggctgctaaggttcaccttagaaaacaagatctgggctggcactggggcatacatcaccactcagcatattcctagaggccaggcctgtcttcactcagccagccctctgaggcttctagaaacttctttctggaggaaaaaaactaaataacataaactcaggagaatgtctttacccaccttcataccactgctttctttttgctgaataaaacacagttctgataagtaagaactttagaattggaaaggaggctgacatgcaaatataatgcaaattaccctcaagtatcgccattcttccaccacctcttggtaccagtgagagcgagagattgccttttcttccccatccctccttccagctaagaccaccaaccagctgcaaattgagatgtccatttaaaaatttatatgtcaatatttaaatgttacatatttggccctattttgtagttcagcaaatcctccaaatacacagcatgttacaaggcactggtggcacagggcacaacaggaaatgatatttatttagcaaattcatttaacaaatattattgggcacctgttatgtgagacactgtcctaggcactgtgggataacaacagcaaacacttcacacaacagcctggccttcctgtgttttacaacagctcctaaagatagctgatatcaagacatttgagggacacagttcatgtagaatcaaaatattagtatttcagaataaggattttttttctgaaaagcatacagagaggaaacagcttaaaaataggtcaagacctaaaaacagaatataatcacggaataaactggataacccagacagtccccacagaatttctttcaggtcacagatttcttaaaactcacccccaaaatgtgcctgcttggttgtttgaatcttgcataattaatgtcacaggcgcaagccgctgaacttagttgagatgcagaaaacaaacaaatgcaatgacatatctgagaagcatttatgtaactccggttaagtggtgaggaggggtgtgtgaagacagtgtgcatgcatgagtgtgtattcatatatatgtgtatacatatgaatttcactgttattttccagggtctatggacaatgtggcagtaagagtctatgatgttctgaaacttttcacagtaaatccaaagattacagaccttacaaggtgcttgcattctgttgcttttccatctgtcacttctcaggttatttgactgtgttcaaaccttcttttctttttcattgagtttcattttttaagcttgttaaatgcttttgtttaaaaaaaaaaaaaaaaccccaaatgtcatttttcacattatcctctcttctctgcaacaaggatagtaagatgtagatgaatgcaaaaataataacaacaataaggaaatatattaaagctttaaaatatgcacatatgtagttctaaagagcaataacggtagtatctatttcgaacatgcattaggcaaaaaagaaatcaaaactgaaattttcgtgtatttttccccttgtaagatgttcaaatgctaacttcattttctcctttcctctatgtggcactttctcaaaatatctatgaaatacttttagacaaagattgagctggagaaagagatacaaatttccatccccccagacagagagacatatttccattgtaggaaggcattaaacattttgaaacttgtgaatcatctttagaatttctactggggaattttacttcttcatccaaagtaaaagccacttatctcctttggttcccagtgacagattcagaggcatacgcagatatacaattttcaggctctagttaatcttcttccaatagttacgaacaatgggctaacaggcgtgggtgtttctccaaaaattattcatgcacaaggcagcccaaagcttcagggaaaactagaaatgtgttatggattagaataggactgttttaaaatgctagtaccaggtggaacgctatttctgcaacaggactctgtccatttcctttggaacaatatattccaagtaaaatggctcttccaaggaatgacacctttacttgacacccttcggcatacaaatgattttaccaatagccatgattattattaaggccttttaaaatacaggctgtttgaaaaaagacagattaaatattcacagcctttgtatcatggttatttgcttaaaacagcttttagaagtacaagtaataactttttgataagaaaccccaggagaaactttttggtaagaaacctcaaaaaatttgaacaaaggcattacaaaaaaaaaaaaaaaactaaccactccattcaactctctcagaaaataaatttcaatgtgttcaatgaattgtcttgaacctgaaacctgcatttagatatcagtcccctgccaatagctaatattaacagaatttgaacaatcatacaattatgtctcaaatgtgaagactttgtacagtaatattttcactttctaaatgacccatataacattcaggaattatagatgtgtatgtatattttttaagtacagaaagttcagccagtcttcagagaagtaaaagtgatgtctattgtgcattgaagtaaatattacaaacattccagtttcgcaatacaatacttgagctttcgaacacctcagacactagaatgtgtaatgcgagtcaaaaaagctgacatacaaaacaattcccatttggctcagggttcctaaatgtcacaatatcttgggtaaaatatactttttgatttcctgatgatgtccttctaatcccttctgactttgattcctaacagccaggcactgttgacatgaatcattaacttccaaacccctttaaaatcaagaagctaggtgatcatacagtcatttcaatggccaaccagttcttgctctacagagcttttacacctttttgggaaacctgatatcaaacacatttatgttatatatttgctcccttgcattaattctagatttttttttaatttcttttagaaagggcaggggggaagtgggtcagagcaaggttcaagaatcacattcatccttgctctaaagtgtttacttgccagcaaagaaaggcaaacacatttttatattcagaaagcagaccggtcattttcaaagaaaaatgactgcaaccatgcctgtagaatgtttctgtgcaagcgcactaattttctatcacctgcatgctgtatataatacatttgcctgtatactaggaagaaaaaccaggctgttttccctgagtacaatgcagcttggatggctgggagcgtaagccttccgtgcatttttatagtgtacatatttgtatatactaactatatcgccatgtatgaacacagattttgttatatttgcttgtttctgtttcctaccaaactggcccacaatggggattcttttgtatagaaaaaatatgcttgtaattttttcctggtcattctctttcaatagcttatgaaagaattagatctgagtttacaaagaaactataagaaccaagtttgtctgtctgcatgagtcccgtccaattgctggatctagggaggaaccaacttcctaattcagagttttccttttaaaggcatgctttacccccatgggaaaactgcacactcatccatgtagaattattctctttgtattttatctaatagtgcctgaaaatttttttaatgtcttcttagaagaagaattcataattgtcaaaatttgaaacattagcttaattttgtttttatgacctcaagattcttctccttatttattcggttgctgttgtaatggggccccaggccattcctgacatcggcgtgttcttcttctgcattaaggatgtttttgaaattacagagattattgagccaacaggctgttttaatcaaaaccatgtttcacttctttttgatgattataaattgtccttgcaatgaaaaaaaaaaaagaacttttctgctaggaagattataccaccctgtggccaaacagattcatcacagataggcatctatgcccatttctctgggatctggaaaattcttcccttggctgaccccaatttcttttactccccattatcctgaatattagctttcaatgcagtcactatttgacatttccaaaggctttgccgcattgtcactgcccaaagacaaacaaccactggaaatgatggctttcctgcttgaaacgaagggggccaggtgcagtggctcaagcctgtaacccctgcactttggaaggctgaggcaggcggatcacttgaggtcaggagtttcagaccaacctggccaacatggcaaaacctcgtctctactaaaaatacaaaaaacattagcagggcatggtggtgcgtgcctgtagtcccagctacttgggaggctgaggcaagagaattgcttgagcccgggaggcgaaggttgcagtgagctgagatggtgccactgcactccagcctgggcaacagagcaagactgtgtctcaaaaaaaaaaaaaagaatggattttcagaaaaagtgctccctttcctgtcctgtggtgccaccatcctgtcctccttcgtaatcatgaacaatctgatcttgaactcccacataacttaaatcaggcaaaaagaaacattcacagcgtccccttgctgaataaaaatgactttgtttggaggcacttaagatgtatgcctgtgtgtggtgccgcagcattgaaattatctgtagaaggggaattttttttaaaaatacaattttatcactagaaataaattccgatggtggaaacgaagaaaacccttaaattatatcacaaaagccattattttttgcatccaaagagtttttttttttaaggaaaatcattctactttgagaactgtaattaaagccctaaataacagacactactttgttgagctattgtgaaaaaaaaacaacacattcgccaaggttatatggagcccctgatttccatcaaaaaggtttctataagtatattatttacatttttatacatgataactcttgcctttgtgttgaaaaaaaaaaagtctcttttttttcccccactcagcagttattggaaatagactgttcccatctgaaaccgtatcgtaatttgcatcaggaaacccaactgctgacattgaggacctgggtgtgttcaattatgattttgctggaggctgtccctcattttaatgctgcagctattgaaccaccttcctgaaacctagctgatacggaatagcagagacatgcctctcaacaccattagctttgcaaatggcttcatttcagtcaacgtcgacttctgctttggccaattgaaaaatgaaaattaaaggagagaagaaaaaaaacacagatgcacttaaaacatgaaaagaattatttatatgataaaaatatatttagcttttcaaagcacaagactgaatagaagtgctctttttatgctttctggagatgttactgttaaatgtctttctacatcaggcttaataaatctgtaatgacatttgatggattga

SEQ ID NO: 736 - DNA, 28972 bp, Homo sapiens
gtgtttatagcatctttattcataatcaacaaaacttggaagcaattaaggtgtccttcagtaggtgaatggataaataagtcatggtacttccagacaatagcatattattcaatgagaaaaaaaaaaaaaaaagagctagcaagctacgaaaagacatggaagaaacttaaatccacattactaagtgaaacaaatcaatctgaaaaggctgcatactttatggttcagaggcaaaattatggagacaaaagaaaatagccaggagtttagaggagtaggcgaaacacagaggattattgggacagtgaaacggctctttatccttctgtaataatgcatacatgtcattattcatttgtctcaacccacagaatgcacatcaagactgaaccctaattaaaccatggactttggccgatagtgtcaatgtagtttcatcaattgtaacaaatgtaccactctgaagggggatgttgatgatgggggaggctgtgtatatgtgagggtaggggatatatgggaaatctctgtaccttctgccccattttgctgtgaacctaaaatttctctaaaaactagtcttttatataaatgggcatacatatacatatatatgtcagcactaaaatatcacgttacaataaatataaaggagaaattattgaaagtcatgtacagtgaaatgtgttttcctccatatttcctggaattcatgaggagtgatacacttaggagtaaggtaaaatgggaataatgaaggggaccagaccttgttctagggtatgttaggaaggaagaggtgatctccaggcaccctcctgagagtcagctgacattgtcctaagttggggataatgttgtatcacaaaatatccaaaactgaaggaagaatagtgaagcttcagatacagtgctggatgaggtgaagggaggtaatgggtgagcagacattggtctaagatgttgagcagcatgtgatgggccatcagatactgtgaagaagtgaggaagcagagctaatgatggctcagtagacattgatctaaggtgaggtaatgggatgtgtcaccaagcactgcccaactagggcttgggaattaaaggggcattgtggccctgcttctttgactatgttctatcctttgggccccatcttcacctccccatactgcccttcttaaaggtgaaaccatctttgcagagcccaaatagttcccactcccagaactgccaatagactggccccagacgccacccagcaactgtgcatctaatcagatcatctgtcagcatctgtaaggccactgctgcctatctagggcaagatacctaatatccaatgaagatccacccaagtctgctctagttccctgctattggcttcaggcactcctctcggggcaggatgagcaggtgtgtggattgggttctggagtaaatgcggctctgtcgagttgcaactgagacaggacagcgctgtgcatgctgaggaaaaatgagcagggagtcttttgcaatcatgttggagctgtgggattctggaatcatggcaggaaatcctggaagcaagcatccacatgggatttcctgtacctgttttcccttctttagcatcagaccaaaaggttcacaatgactttttagctttagggttgagaagggatacagcccaggtacagactagaggtgaaaaagcctggtgtgttttagccaagttggttctccctattagcgcttcttatgctgcaacacagaaaaaaatcagacagaagtcacgcaacaagcatgggtcaactctccacaggtgcatttatggaatgcctgctgtatggcagtcatgggtctagactcatagtggtgaacaaaagggaaatattttctagtgtagaagccacagagaaatgaggaaaatacaccaggcagcatggtggaaattgctagggagaagaataaaggaggaagggtaaggggctggaattttaaaccaggcaggcagggaaggcctgtgtggaggtgtcatggaaaaaaagacatgacggacaagccacagataaaataaagaattgtgctctttgcaacgggcactgcaaatacaaaggccctgagtcaggaactgatgtttgaggcacatggcggggaaggtccttgtggggtgcgtgggacgaagatggacacaagtagacagtgaacatatggtggggttggttttcatatgagttatcaatttcatatgatttatgatttatctcatatctcatataatgtaagataatgatttcatgacttatcaacttatgaaagtcagatcattaaggaaagtaaaatgctgggcttcaactcagtcacaagtaaattaaaaaaaaaaaagaggcaggcaactgagtgagaagaattgtaatagcagaaggaagaatttaagttctcccagatgacctgaaaatcctaacctcaaaggctttcttgagggtggtgggagtgtacaaaacactgtgctgggccgggcgcagtggctcacgtccgtaatcccaggactttgggaggccgaggcgggcggatcatgaggtcaggagttcgagaccagcctggccagcatggtgaaacccccgtttctactaaacatacaaaaattagctgggcgtggtggcacacgcaatcccagctactcaggaggctgaggcaggagaattgcttgagcccgggagacggaggttgcagtgagccaagatagcgccactgcactctagcttgcccgacagagcaagactctgtctcaaaaaaagaaagaaagaaagaaagaaagaaagaaagaaagaaagaaagaaagaaagaaagaaagagaaagaaagaaaaagaaagaaagaaggaaagaaagaaagaaagaaagaaagaaagaaagaaagaaagaaagaaagaaagaaagaaagagaaagaaagaaagaaaaagaaaaaacactgtgctgggtgtcaaacacaatgtgctgagaacctgtggggctcagagagagtcctggcagataatgaaggggactgtaagtctttttctatgacaatggggactcaacatacgctctgaggtctgtgtctgaatacacagggagtttgtcttattgcagtatctcttgcttgatagaaatactcaatggggaattggatatgcacaactgtgttcgattcaaaagaagaaaatacccacaattctactagacagtgtgttctggaacaaacaactcacagaaggattcatcactatcatatatattatgttgtcttaccattcaaactgttggcactatacctaatccacagtaaacaggattatcattcccataatatgatctttcttatgaagaatttggtaacagtattctattgtagttttcatgagaaggcttttcctattcaccaaattgactcggttccttgtcagtatgaataatgacccaaggtttactggggatggtgacaatgtaggaagggtccctcgcctcattcagtgccttctcagaggccctctccagaacagccatgtgtgacattctgatgtggtcatttctatttacaataatatacatatttttctgctgcatgcgtgcaacagtgtacaatcagacccaaccctcaggggggttttctcacactgtttctctcaagcgtggctgctctgatgaacactgaacactgatttctgaacgaagcctttcccacagatgccacacttgtagggtttgtctccagtgtgtgttgtctgatgtttattcaaattggacctgttgctaaaggccttcccacactcagcacacacgtaaggcttctctccagtgtgaattcgctgatgcacttggagctgtgattttttagtgaaagacttcccacagtcactgcactcataaggtttctctccagtatgaattctgtgatgtgtaatcaactctgacttctgtcgaaaggtcttcccacattcagaacaaatgtagggcttttctccggtatgagttttctggtgcttactgagatttgacctgccactaaaggctttcccacactcggcacacacatagggtttctctcctgtgtgaactggctgatgcaccaggagctgagacttggaggtaaaggacttcccacagtcactgcattcataaggcttctctccagtatgaattctttgatgagtaataaagtttgacttgcggatgaaagctcttccacactcagtgcatacatagggtttctctcctgtatgaattttctgatgaacaatgagtattgatttctggttgaaggctttcccacattcgtggcattcatactgtctctctccagtgtgaattttctgatgtatattaagatttgacttctgagtaaaggcttttccacaagtattgcattcataaggcttctccccagtatggattctctgatgtgtaatcaagtctgacctctgggtgaaggcctttccacatttggaacatatataagatttctctcctgtatgagttttctgatgtgtaatgagatttgaccggttggtgaatgccttcccacatttattgcatacatagggcttttctcctgtgtgaattcgtttatgaacatggagttgtgacttggaagtaaacaatttcccacagtgaccacatttataaggtttctctccagtatgaattatttgatgtgtaatcaagtgtgccttccggatgaaggccagtccacatttcatgcatatatacgatttttctcctgtatgaattctctgatgcactgtgagtgctgacttctgagtgaaggctctcccacagtcactgcattcataaggtttctctccagtgtgaattctctgatgaataatcaactctgacctgtaggtaaaggccttcccacactcagtacatatggaagatttctctctactttgaatcttctcatgtgtaatgaggttggaattattgctgaagaccttcccatattcggtacatatatagggcttcactcttgtgtgaacacgttgatgtacctgaagttgtgacttggaaatgaaggatttgccacagttattgcattcatatggtttttctccactatgaattcttcggtgtgcaatcaattgtgttttctggatgaaggcctgcccgcattcaatacagatgtaggatctctcgcctgtatggattttctgatgaatcttgagtgtggacttttgtgtgaacgctttgccacagtcagtgcattcatggtgtctctctccagtatgaattttctcatgtatactgagatctgagttataagggaaacctttcccacattcactacattcatatagtttttctccggtatgaattctgtgatgcctgaaaagagacgatacttgaaaaaaggattttccacattcattgcacttatagggcttctctctcatatgggttttctgatgtgtgatgaattctggcttctgtacaaaagccctcccacattcaatacatacatagagtttttctcctgtaggaactttcagatgtaccttgaactgtgacttccaggtgaagctctttccaaattcagcacactcataggatttttccccagaataaattttttgatcttgagaggaagctggtttataaccgatgatttttctatgttgattatggtcccataatttctctcctgttggagtacattcacagtaagtatagaaagacattttaccatagttagtactcttcttaacattctttgaagcatcgtttctatcatgaatgtgtagatctaaattatgcttcaagccatttccaaataagtcacactgatagggtttttagggggatgtaaaatgtttgggttcacatgaattatccttctgatagccttatattcataatgcctatttgtagtcaatattttcttgattaaagcaacatcacttagatacttattttcttttctgataatattctatctggttatcagtctgtcactgttattctagaatgaaatacaatctcacatcatctctatcatcatcttccctttcattgtggaaagaagtcttttttttttccagagattccctgtaataaggtttgaaatccaaacactttttcaagggataataagtcactttttgcttatagagcagctagcagaggctagaggggaaggtaaaaatggcttatccagcttgaacacagagaaaagggtaagggtgagtaatttcatgagaagggtgtgacactacttaaatgaaacattctggggaacaattcagcagttaaaagaaataaactagatgaacagataacaccatggatagacatggaaaaaggcaaaaaacatgatatatagcataataagatttatataaactaatgatccatgcccctaattcactttaaattttacaacatgcacgaattaaaaaatgcttccattatacaaaacagtggcttctggtgggaaggcagatgggtgaggggaaagagagaaaaggggatattatcacaaaaataaaatgagaatcttcacccacattttcatggtcatagtgtgtcctaaactaaagacaatgattaaactcaaacctcatcaggtgaaatataaaaataaagcaatgacaaaaacaaacaagcccgggcatggtgcctcatacctgtagtcccagcactttgggaggctgaggcgggcggatcacctgaggtcgagagttggagaccagcctgaccaacatggagaaaccccaactctactaaaaatacaatgttagctgggcgtggtggctcatgcctgtaatcccagctacgtgggaggctgaggcaagagaatcgcttgaacccgggaggcggaggttgcagtgagccgagatcgtgccattgcactccagcctgggcaacaagagtgaaactccgtctcaaaaataaataaataaaaataaaaatacaaaaattagccaggcgtggtggcccacccctgtaatcccagctactcgggaggctgaggcaagagaatcatttgaacctgggaagtggaggttgcagtgagccaagattgcgccactatactccagcctgggcgacagagtgagactccctctcaaacaaacaaacaaacaaacaaagccaaccaggaagagagaccctaacagtgtggaatcgctcaagcaacatcagaaggaaatgtgagaaagggtgattaatccatgccatgtcaaacacagcagagaggtattcccaaagattaagtgacaatgattcccaagtcattagctggatgaaaggcctgaaggactgggaagataagagaaatctcatggccattactatagcaaaaatagttagagagcctgactggaaataaagttcttttttttttttttctttttcagactgagtcttgctctgtcacccaggctggagtgcaatggcatgatcttggctcactgcaaccttcacttcccgggttcaagtgactcttgtgcctcaccctcccaagtaactgggattacaggcatgcaccactacacccagctaatttttgtatttttagtagagatggggttttgccatgttgtccaggctggtttcaaactcctgacctcaagagatacacccaccttggcctcccaaagtgctgggattacaggcatgagcaactgtatctggcccagagataaagttctgaggcatctcacagtgagaaagacagaaataaaaggggtgtagcacgagtgggagtgtgtgacacagagtaaattttgaaagaaagcagatccaggaatacctggatgtaaacgagagactctaggacaatatggaaggcagggaaaaaaagactgttacagaaaaggaatataataaagatttatctttaatgaggctgactggcacatgacttataatcaacaaggaaggtcatccaggtagaaggcatttagtgatctgagaggcatcaagcaatataaaaaattcagagccttactgaagagtggtcttaatagcacttcacaggttccagtgtttttcaagacagctgagatttcctcctgtctcccatctaacctgagtcacattcacctcacttcactcacctgggcagctgtgacgtggcctctcaccctgcagtgcccatggttcctttccttgctccaacatgaccacctctggtttaggaacttgataccctgttcatgggaaatgataaaggtctgggtccagctaattacgtttcagagcccaacaaatacagtcttattgttcaatgatggtttgttctttaggaaagtaaccagatatctctgagtaatattctgagtaccctaaacaaacagagaaccctggaggaaaaaaggacaaaaccatcacctatctaagatgccaacagcattcgtcaactgagaatgaaaacactctcagtgaggcctcctttcagataccaaggtgactgtgcttacctactgagagcaggtggctgtaggtctccagcatcacatcccggtacaggtttctctgagaaaggtccaggtgccgccattcctctctgctgaaatcgatagccacatccctgaaggacactgatccctgtaagggcacattcctgttcaatgtgcatagtcagctttgcacggtggagtgactatatatgggattacggaacatgggttttgttgtttttaatttacttcattttttttttgagacagtcttgctctgttccccaggctggagtgcagtggcgcgatcttggcttactgcaacctccacctcccgggttcaagtgattctcctgcctcagcctcctgagtagctgggattacaggcacgtgccaccacacccagctaatttttgtatttttagtagagacggggtttcaccatgttggccaggatggtctcaatctcctgaccttgtgaccttgtgatccgcccacctcgacctcccaaagtgctgggattacaagcttgagccaccgcatctggccgtttttgtttttgtttttgttttttttccttgagatggaatttcactcttttggcccaggctggagtgcaatggcgtgatcttggctcactgcaacctccacctcccaggttcaagcaattctcctgcatcagcctcctgagtagctgggattacaggtatgtgccaccatacccggctaaattttgtatttttagtagagactgggtttcaccatgttggccagaatggtctctatctcctgacctcgtgatcttcccgcctcggcttcccaaagtgctgggattacaggagtgagccaccgcgcctggccaatttacttcctttttaaagaacctgccactcatttccctaatagcttattacgaaaaattttaaacatacagaaaattagaaagaattgtacagtaaaaacctatatatctactacttagatctaccattaacaccttaccctacttgcttcatcacacattgatccatcttacttttttttatgtatttcaatgtaaattgcagtcatcactacactttctcttaagcaccacaaaatgcaaattattaactagggtgtaacatttgttaacctgataaggtaaaatttagtacaatacaaataaatgcaacaatctttattttgccatttgaccttgtgacaaatgtatacacctgagtgataagaaatttctaagaaataatattttacataggtcacatattaaatatccagttttagctggggtgcagtggctcacgcctgtaatccaagcaagaatgtcagagggggccggacacggtggctcatgcttgtaatccaagcactttgggaggccaaggtaggtagatcacctgaggtttggagttcgagaccagcctggccaacatggtgaaatgccgtctctattaaaaatacaaaaaattagccaggctggtggcacgtgcctgtagtcccagctatttgggaggctgaggagggagaatcacttgaacttgggaggtggagtttgcagtgagctgagattatgccacggcactccagcctgagcgacagagggagactctgtctaaaaaaaaaaaaaaaatctagttttacataatttgtggaacacagaaatctaacaaagaattccagctatttgttctgttctacagtcagtcaatcactcatttttcaaaactggccattgaaataggctgtcttggctgggcccggtggctcatgcctgtaatcccatcactttgggacgccgaggtaggtggatcacgaggtcagacgttcaagaccagtgtggccaacatagtgaaaccctgtctctactaaaaatacaaaaaattagccgggcatggcgagcacctgtaatcccagctactcaggaggcttaggcaggagaatcgcttgaacctgggaggcggaggttgcagtcagccgagatcatgccactgcattccagcccgggatacagagcaagactccatctcaaaaaaagaaagaaagaaagaaataggctgccttttagtcttctagcacatggatgaacaacctgccacacagtggctgatcaatttaggaccagtcattatgctactcctgaggacacagaaatgaattatttatgttactagtcttcacgcaacctgaaatacatagaaaataaataagaccaaagtttgaaaaagtgaagacattaagttcattaaggtgctgaaaagtagatctctatctgagacaccctgagggctaaaaagaagaaaaagtgcattctacatgaggaaataagtttacatttcatagagcggaagaatttaacttggaagataagaagagtaatacaaagtatggggtaagggggacattgcccagcaaagacaagaacaaaaagatggggagatgggctccagtgagccacgattgcatcaccgcactccaacctgagtgacagagcgagaacctgtctcaaaaaaaaaaaaaataaaataaggccgggcgcagtggctcatgcctgtaatcccagcactttgggaggccggggcaggtggatcacctaaggtcaggagttcgagaccagcctggccaacatggtgaaaccccatctctactaaaaatacaaaaaattagccaggtgtggtagtgtgtgtctgtaatcccagctacccaaggcagaggtaggagaatcgcttgaacctgggaggtggaggttgcagtgacccaagattacgccactgcactccagcctgggtgacagagtgagactccatctcaaaaataaataaacaaataaataaatattaaaatacacaatgagggccgggcacagtggctcacgcctattatctcaacaactggggaggccgaggtgggtggatcacgaggtcaggagtttgagaccagcctggccaacatgttgaaaccccctctctactaaagatacaaaaaattagctgggcacagtggcacatgcctggaatcccggctacttgggagactgaggcaagcgaatcgcttgaagccaggaggcagaggttgcagtgagccgagattgcgccactgcattccagcctgggcgacagtgcaagactccatcttaaaaacaaaacaaaacaaaaaaaaacaccacatgagtttaaagaacagcaaatagggctggacatggtggctcacacctgtaatcccagcactttgggaggccgaggcgggcagatcatgagatcagaagattgagaccatcctggctaacatggtgaaacaccatctctactaaaaatacaaaaaattagctgggcgcagtggcgggcgcctgtagtcccagctagtcaggaggctgaggcaggagaatggcgtgaacccgggaggcagagcttgcagtgggccgagattgcaccactgcactctagcctgggtgacagagcaggcctctgtctcaaaaaaaaaaaaaaaaagagaactaaggccagggcaggggctcacgcctatagtcacagtattttgggaggccgaagtgggtggattgcttgagcctaggagtttgagaccagcccaggcaacacagtgagaccctgtccctaaaaaaataccaaaaaaattagccatgcctggtggcaggcacctgtagtcccagttactcgggaggctgaggtcggaggatcgactgagcccgggaggtcgaagctccagtgagccgttaatgcaccactgcacaccagtctgggtgacagagggagaccctgtctcaaaaaaataaataaaacttaaaaagtaagagacttacgaatcatactaaccaaatgcaccttgtggactttggcccctaattaaaatgaaccaatcttaaaaagatatttacaacaatttagagaaatgcaagcaatgggtattagatgataacaaagaattactgttattttgttgtaggtgtgatattgacttatttgttatgctaaacaaaagaaaaaagaattcatctctttgagatacatatcaaagtatttttagataaaacattgtgtttgagattcactttaaaataatccaggagctgtgtaggaaggtggtttcagatgaaataagaatggcagaatgttgatgatgactgaaactgggtaaaaggtacaataggtgaacaggttgcttatactattctctttacttttgtatatatttaaattttttcgtaataacatgtttttgaaaaatatgatcctccaaataaaaaatctaatttggaattgcacagttaaaggaatgcctatttccacatggtgtacatatttaaagaaaagtattggctgggtgcagtggctcacacctgtaatcccagcactttgggaggccgaggcacatggaccacctgaggtgaggggttcaaaaccagcctggccaacatggcaaaaccccatctctgctaaaaatacaaaattagctgggcatggtggcgcatgcctgtaatcccagctacttgggaggctgagggaggagaattgtttgaacctgggaggtggaggttgcagtgagccaaaatcacgccattgcactccagcctgggcaacaagagcaagactccatctcaaaaacaaacaaacaaacaaagtatactagggacttgaatacccttccctcacctcagcaatttatcaaaatactagacaggaaatcatcaaatatacagaaaaagaagcaacagtatttaattgatatttatagactactgcaacaaacaacagcagaatacacattcttttcaagaatcatagaaaaatgaccaagatagaccataccctaggctataaaaccaacctcaacaaatttaaatgaataaaatacaaagtatgttccacaaggaaatcaaacaaaaaatcaataacagaaagaccacagaaaagtctccaaaggaattaaaaaataaaaacaaaagctttctggaaaagcaaaaactatttggaaattaataacccacagttaaatgacctataggtcaaagaagaaatctcaaaggtcattttaaaaataaatacacctggccgggcatgatggctcagcctgtaatcccagcactttggggggccgaggcgggtggatcacatgaggtcaggagttcgagaccagtctggccaacatagtgaaaccccatctctactaaaaatacacaaaattagcagggcgtggtggcacgcacctgtagtcccaactacttgggaggctgaggcaggagaatcactggaacccgggaggaggaggttgcagtgagccgagatcatgccactgcactccagcctaggcaacagagcgagactctgactcaaaaaaaaaaaaaaaaaaaaaaaaaaaaattcaggaaaacaaaacaaaaaacagaaaaaaaaagtcaataaaacacaatccagttgttggggagaaaaaatcaacaaaatgcggctgattggcctgttagtcaactagactgatgaaaataaaaagacacaaatcagcaatatcaggaataaaacaggaaatatcatgacagattcaggaaccattaaaagaaaaatatgggaatacaaacacttatttagataaactaaataaattagcttatttagataagataaataatcttataactattaaattacattcataatttaaaagttggtgaaaagaaatttctaggcctagttttgccagagaattctaccaaacttacaaagaagaattagtcttggccgggtgtggtggctcatgcctgtaatcccagcactttgggaagctgaggcgggcagatcacctgaggtcaggagttcaagaccagccttaccaatatggagaaaccccgtctctactaaaaatacaaaattacctgggcgtggtggtgcatgcctgtaatctcagctactcgggaggctgaggcaggagaatcgcttgaacccaggaggcagaggttgcggtgagccaagattgtgccactgcactccagcctgggcaacaagagcaaaactctgtccccctcaaaaaaaagaagaagaagaagaattaatgtgatttttacacaaactcttccagaaaatcaaagaggaagacctcttccaaattaactttgtacagccagtattactctgacatcaaaaccaaagaaagcacaaaaaaagaaaactatagaccagtatctttcataattttaggtacaaacatcctcaacaaaatatcagcaaacaatccagcaatgaataaaaagaatcgtgtactacaataactgaaattcatgggggaaccctctgtatcattttgtaattctctgtggatctataattatttcaaaataaaaagttttaaaaaatatactcctaaagaaagattattccaaaacatttggaatattttggaatagttatgactggaaaatcattgacaagactcactgtacaagtcacatgagagaatgtgaattacagttcacctttgaaccacatgggtttgaactatgtgggtccatttgtaacacagatttcttttttcagtaaaattacaccgagtgtgcctccctctcctgccctcccttttaccttcacctcttccccctttgccacccaaaacagcaaggccaaactctcctcttcctcagcctccttaacctgaagaccataagggcaaagaccttcatgatgattcacttccacttaataaataataaatatattttctcttccttttgattttcttaaaagcattttcttttctctagctgaattttattataaaaatacagaatataatacatataccatacaaaatacatgttaaccaactctttgctatcggtaagttaacagcaggctatcagtagttaagtttcagggatggtcaaaagttatacacagcttttcaactgcacagaggttagcgccccaagcctgcatcgtttgaaggacaactgtgcttagtataattgcggtttctgccattttttctttttattatactttaagttctagggtacatgtgcacaacgtgcaggtttgatacataagtacatatgtgccatgttggtgtgctgcacccatcaactcatcatttacattaggtatttctcctaatgctatccctctcccagccccccaccccacaacaggccccggtgtgtgatgctccccaccctgtgtccaagtgatctcatagttcaattcccacctacgagtgagaacatacagtgtttggttttctgtccttgtgatagtttgctcagaatgatggtttccagcttcatccatgtccctacaaaggacatgaaatcatccttttttatggctgcatagtattccatggtgtatatgtgccacattttctcaatccagtgtatcactgatggacatttgggttggttccacgtctttgctattgtgaatagtgccgcaataaacatacatgtgcatgtgtctttatagtagcatgatttataatcttttgggtatatacccagtaacgggattgctgggtcaaatggtaattctagttctagatccttgaggaatcgccacactgtcttccacaatggttgaactaatttacactcccaccaacagagtaaaagcgttcctatttctccacatcctctccagcatctgttgtttcctgactttttaacgattgccattctaactggcgtgagatggtatctcattgtggttttgatttgcatttctctgatgaccagtgatgatgagcatttttttcatgtgtctgttggctgcacagatgtcttcttttgagaagtatctgtttgccattatttttaatggcaaaaccgcaattacttttgcaccaacctaatacataaagtaaggctataatgttaacagggatgtagaaggaaaatggcactaattattagggaggcagacctgatgttgaatatgaaggtgagaaaaaggattaagaaataattcttagtcatcaattttgtgtcactatgtacattctggtgccaggaatgtgtagagaaggctgaggaaataaaaaaaaatgacttaaattttgtatatgttgagatttagctgacaggatatatacgagggtgtacactaggtggtggatagagagcttatgattaattgtgatagagattagctgaatagagagcttatttatttattttattattattattttttgagatggacttttgctcttgttgcctgggttggagtgtaatggcgtgatcttggcttactgcaacctccgcctcccgtgttcaagcgattctcctgcctcagcctccccagtagctgggattacaggcatgtgccaccatgcccggctaatttttgtatttttagtagagactgggtttcttcatgttggtcaggctggtctcaaactccctacctcaggtggtccaccagcctcagcttctcaaagtgctgggattacaggcatgagccaccaggccaggccattccagtgttttacaagcactttgggaggccaaggcgcagatcacctgaggtcaggagttcaatatcagcctgaccaatgtggagaaaccccaactctactaaaaatacaaaaattagctgggtgtggtggcacgtgcctgtaatcccagctacttgggaggctgagacaggagaatctcttcaacccaggaggcagaggttgcagtgagccgagattgcgccattgcacttcagcccgggcaacaagagtgaaactctgtctcagaaaaagaaaaaaaaaaaaaaaaagaaagctatattattaatatagtcacaatattatttattgtataaagattcagaggtcctttgtatagaggtcactggattcaggggagggtatgagcatgcagatggaagtggaaagaaaagtactaaagatatttataatttttaatatgtaaaattatgatttttgaaagctaccttgttgatttcttcatttaactgcattcagagattacagtttgtctcttgtgatgcatattgattgtgcttatagggctcagaacatcatttctttgaaaatggtacctatatacctgaaaagaatatacatgttctaatttttctctttatcatacacttgtatagtcacaccctacacacaccaaactccccaacccccaaaccctatgttatcaagaatttagtaggaacacgagatgtcatgttaggctggaatagagctttaccacctcaccaaatgagcttcttatacacagtttgtccaggctgggtgcagtggcccatgctgtaatcctgggattttgggaggctgaggcaggcagattgcttgagcccaggagttcaagacaagcctgggtaacatggtgaaactgtctctacaaaaaatacaaaatttcgccagttctattggcgcgtacctgtagtcccagctactcggcaggctaaggtggggggatcgattgaacctgggaagtccaggctacagtgagccgtgattgcaccacagcactccagcctgaggatagagtgagaccccgtttcaaaaaacaattaaaataacagtttgtccaggaagaaacctcctcactcaaagataatactaagcatcgcctaatgtacaaagatactatgagcaaaaaggataaaacaaaaatagagaggagattaaaaggaatacactacaaataatatactacaaataaattgacacacaacagaaaaaacatccaccatgaattcaaggaattcactataattataactacttaaaataattaaacaggccaggcgctgtggctcatgcctgtaatcccagcactttgggaggccgaggtgggtggatcatgaggtcaggagctcgagaccagcctcaccaacatggacaaaccccgtctctactaaaaatacaaaattagctgggcatggtggcacatgcctgtaatcccagctactagggagtctgaggcaggagaatcgcttgaacctgggaggtggaggttgtggtgacccgagatggcgccactgcactccagtctgggcaacaagagcgaaactccgtctcaaaaataaataataaaataaaataaaataaaataaaataaaataaaataaaataattaaacccaaggaagaaatagtggaaaaacagataggctaagaatgtggttatgtaaatttttgaaaaataaattggcagaactcagtaaagtttttttgtttttcaagcaacacagaaataaaggtctccttgaaagcaatgaaaagaccctgctaaaacacaaaaggtaggccaggcacggtggctcacgcctctaatcccagcactttgggaggctgaggtgggtagatcatgaggtcaggagctcgagaccagcctggccaatatggtgaaatcctgtctctactaaaaatacaaaaattagccaggcatggtggcgcgcgcctgtaatcccagctcctcaagaggctgaggcagaagaatcgcttgaacccggcagatggaggttgcagtgagccgagatcgtgccactacactccagcctgggtgacagagcaagattctgtctcaaaaaaaaaaaaaaaaaaaagcacaaaaggtggcaaagacaagtgagcaacataaaatggaaataaggagtttcaaaaagaaaatagaaaaaaagaatttaataaaaacatctaattaaaaaatccttgaagtggcagtatagaacttttattgttattcacagtataaatttaatagtcttaaacgatagatataaagattgggttaaagaaggtaatgttataaagccgccactaaaagaacaaaagaaaaaacagaggccaggcacggtggctcacacctgtaatcccagcactttgggaagctgaggcaggcggatcacctgaggtcaggagtttgagaccatcctgcccaacgtggtgaaaccccatctctactaaaaatacaaaaattagccgggcatggtgacacacacctgtaatcccagctactccagaggctgacgcaggagaatcgcttgaacccggaagccagagactaccataaggcaagatcatgccattgcactccagcctggcaacagagcaagactccgtctcaaaaaaaaaaaaaaaaaattatctttccactgccatacagaagaaatgtacaaggactccaaaggatgacagtaaaaggaggagcaaaggcctatctggaattgccaaaggaaaggaagcaagaacctccaccttaatatttgagctgaattctcaccaaaaaaattaaatatgacaaggacacaatctgaaatgaatctcagatgccattactgtcactgcaccaaattacatagcatcaaaatttataaactataggaaactataggaaaataatagcaagaaatacattggtggtgggaaactttacataatatctcccagctccatttgataaagtagaaaaaaatcattaatactatgaaagcctcataactatataagatatcttataagttaccaataaaatcttattgctaagatatcaaattctatatcctggaaacagatttcctgtttacacagtgccggtgtaacattcagaaatgttaaacataaaattttcaaaacaaaaaacacaaaaacctttaatgttatgccacatgcaaataattctctccatctctgcaatcctaattttattaaaagtagaatattttaaatgaaagtcttaacatgtagaaatgaaaatgtggtaagtggtcaatgaagacttggtgcttggtgggaaacaatatgttactagaatttcattctttttttctagatttttaaatgtaattgcataaggtaaattacttctctaaattatttttggtactgttttgctagactgtgtaccattacttctgatatacagtatttttttgaggtattttactattttagtttttagacttctttgactttggactgggctgctgaatgagaaaacagtgcttgcttcacttttttcccagtgataaactattagtctactgttttcatctactcttttttttcttttttgagacagagtttcgctcttgttgccccggctggagtgaaatggtgtgaactcaccgcaacctccacctcctgggttcaagtgattctcctgcctcagcctaccagtagctgggattacaggcgcccgcctaatttttgtatttttaatagagacagggtttcatcacgttagccaggctggtctcaaactcccgacctcaggtgatccaccctccttggcctaccaaagtgctaggattataggcgtgagccacggcacccggcctcatctactcttgaatacagttagtgaatacatttgacttctgaatctatttatttccagttcttttgggcattgaagttaactctgtaaacaaaataaaacaaaaacctgaaacaaggttgagaataatttctgatattatctgttactcaaaactttggcatgaaaatcaactgtaaaatcacatgatcttttccatcatttttgactgcgttgggggtgttgaatcaacattttaattcctttaagggcttctgtataatttgttcttaccgagttgaaaatttatttcttataaaatttcatccttttgtttaggttttcatatatttgcatggtttttttttttttttttttgagatggagtttcgcgcttgttttccaggctggagtacaatgacgcaatctcagctcactgcaacctccgccacctgagttcaggcgattctcctgcctcagcctcctgagtagctgggattacaggtatgtgccaccatgcccagttaatttttgcatttttagtagagacagggttttaccacgttggtcaggctggtctcgaactcctgacttcaggtgatccactggccctggtctcccaaagtgctgggattacaggcatgagccaccacgcccagccctatttgcatgattttacataatactcactcgtgattgtttgaatcttaggtatagaagtaactattactcctgttttctaacatattttgattatgtttatcttcactcttttttcttgatcattaatatggagaagcaacttgtgtttctgtcacatttttatcaaccattttttgttctctgtgactcatgtctttgcttttctttttttagtcctcgttcttttttgtattttttgactcattctttttgtaacttcttcagttgaaaccataactgcttttttcccaaaatttctaagattccttaaaaggcacttaatctatagttttcccctctatctacagtttagctttaccacacgaactttaaaatgtagtactttattagcagggcacagtggcaggtgcctgtaattccagctaggagggaggctgaggcaggagaatcacttgaacccaggaggcagaggttgcagtgaactgagatcgtgccaccgcactccagcctgggcaacatagtaagatcttgtcacaaaaaaaaaaaaaaaaaaaagtagtactttattgaactattttgcgttgtggtaaaatatacataaaatttgccattataattatttttaagtgtccagttcagtggcattaagtacattcacattttgtgcaagagcctttctgttttgttttgttttggtttttgagatggagtttcactcttgttgtccaggctagaacgcaatggtgtaatctcggctcaccgaaacctccacctcccgggttcaagcaattctcctgcctcagcctccagagtagctgggattacaggcatgggccaccacgcccagctaattttgtatttttggtggagacagggtttcactatgttggtcaggccagtctcaaactcccgacctcaggtgatctgcccgcctcggcctcccaaagtgctgggattacaggcatgagccaccgcacccagccttcaagagccttttacttatttgtaatttaatgctctttgtcagaaaacaatcaatattatagcaaagatttatattttttatctgctttgatcaataagcttctgaaagtagtgtgataaaatggccaatattgcatttaatgatttctgttcatttttacttaaaatagttcaaagatacattattaattaaaaaaatgctaataatttgtataattctttgtacatgattcttttcataaggatgaacaacatgttttcatccctttaggtgattttcatcttaaatcccttttgatctgttcctaaattgcagccctagctttcttttggctcactctcttatttttaaatgaggacaaaagcagtcctaacctctgagagttagcctcgtactatcaattaagcctcagtgttgctagaagctaacctggcaagggccagctaattcatggtgttctccatggtgctacacaaaaacaatctcttagaacaccaacagcaaacaagaccaatctctgaccatcatggtgtaagatgataccaagaccactctgtcgttatatttgagcatagacaaaaatcagaacattcttcaaaccacaaaagtgaataaaagtctccttattctgcctaatgcaagagactgctgcttttttcttttgagacaaagtctatctctttcatccaggctggagtgcagtggcatgctcatagctaggtgtaatctcgaactcttaggctcaagtgatcctcctgcctcagcctcccgagcaggtgggtctataggcacacagcaccatgccagactaattgtttttcttttttttttttttgagacagaggctcactctgtcacccagactggagtgcagtggtgcaatctcagctccctgcaacctctgcctcctaggttcaagcgattctcctgcctcagcctcctgagtagctgggattacaggcgtacgccaccatgcctgacaaatattttttatttttagtagagacggggcgtcaccatgttggctaggctggtctcgaactcctgacctcaggcaatctgcctgcctcagcctcccaaagtgctgggattataagtgtgagctaccgcaccaggcccaaactaatttttaatttaattaaattttttttttggtagtgacagggaatcactacattgccagggctggtcttgaacttctggcctcaagccatcctcccaccctggctttccagtgttgggattacaggtgtgaacgaccgtgcccagccaactgctgctgctttaccaactgtaactttagcctcaagctatccttcctatcttctagaataaaattattaagatactcaatcctaaaactgcccaagagcaactaaagtagaggttcactgaggtgcagatgagactctcaccacgtgactagaaccctgaaatgaaattccactacttctaatatatccaatagaaagagaaggcatgacaatatccactgcgatattgttcataatagtttctgtattttaccaaacaaacattaaaacagcaatgtacaaaaaagttaatctgctatgccattctgaaatcaagagaaaaaaattgtagttgttttcatttgtatacagaactaagcaatcaaagaaaatgaataaagcaggttatcactaccgggagacacaggtagatggaaggcagaggtgggtgaaccacagtcccatctctttcaccataatacttttcaatatattgcttttcatatatttctaacttttgaactaggtatatgcattgcctattcaaaagattaaactattcctaataaattatcacaatatcttcagatggataagaaataacaatacacccaggccgggcatggtgtctcacacctgtaatcccagcactttgggaggccgaagcaggtggatcacctgagggtcaggagttcgagaccagcgtggcccagatggtgaaacaccatctctactaaaaatacaaaaattagccaggcgtggtggctcgcacctgtaatctcagctactcaggaggctggggcaggagaattgcttgaacctggatggcagaggttgcagtgagcggagatcatgccattgcactccagcctaggcaacaagagcaaaactccatcaataaataaataaataaataaataatttaaaaaataacattacatccatgaaataagaacgggatggcaataaaaaaaaatttaggaaacaggctgggaacagtggctcatgcctgtaatcccagcactttgggaggctgaggtgggcagatcacctgagatcaggagttcgagatcagcctgatcaacacggagaaaccccgtctctactaaaaatacaaaattagccgaacgaggtggcacatgcctgtagtcccagctatttgagaggctgaggcaggagaatctcttgaacccaggaggcggaggttgcagtgagccgagatcatgccattgtactccagcctgggcaatgagagcaaaactctgtttcaaaaaaaaaaaaaaaaattttaggaaacaaactagagtttttaaaaattaaaacattaagttaaaatgtggatagtggtaatgagaagctcaatagaagggctggaaggcaaaaggtgtcaaagttacccagaatggatagcaggaaatacatagaaaatagtagagaaaagaaatggagaagcaacatctgaaaaacaagtttcagaaagaaaacagagaaaacatttgtgtttgaggaggtggtttaggaagaaatgaaaaaatgctttcaaaatctcaaacaaaagtcacttctaacaaggaattctatttgcagccaaaacatcaatatagcgtgatgacaaaatcaacaacagttttccttgacagtgcacctctccactgtcacacaggtggcctccagagacggagacattacccacgtgttcattcttgacaggaagatcaagttttctttcaggagcaccaagtctagagtccagctggttcctaaggcctgtctgcctctgccctaaggctgtggtgacagattagagctatctactcttggactgaaattccaccccttgggactcctcctcctcacctcataggagctgccatgatcctctggagccagggctgaggatttctggggtgaggtccaactagctggcatggccacactggatctcaaccctttttgtctagggtgcctgaagtttagtggtcatctgtgaactcagcagagctgctccgaagaggtgggctggagtctggaggaaggtctggcccagggactccccagagacacccaagaacctagaaaaacaatgtccacgtagtcattcaacattcactacataaacacttcctggatacaccaaggtgcaggtccctgcgctagaaaccagagcagtggttcccaaacgtaggtatgcattcaagtcacctggagggcttgttaaaacatagtttaaaattctcaacttcaccccttcgatgggtctaaggtaggccctaagaattttattttctaataagtgcccaggaaatgctgatgctgctggtacaagaaccacactttcagaactgtggagaacagtgctgaaatatgggaaaagccatgaaatttagagtaacattactgcagatttgaactgcagctgtaccacttttcaacaatgagaatataaagaagttactcagattttgtttcagaaataaggatgaaaatgcctgtgtcacagttactaagattaaatgagattatgcttttaaagtactcaatgcctccctgccatgcaagaatcacgcaataaatatcagcaattaccatgcactatattaaaacgtaatacagaaaaccatgtcatcaaaacaagtaagataataaacatatcagacaatgttgatctatatatgaaataaaaatgatatgcgattgagtgtgcacacggcattcattgtatacatatccccaattggtgcatgcaattggccatgcatctggaataaaacaaactagatctccacctcacacaatatttttttcttttaagatggggtctcgctctgtggccaggctggagtgcagtgacacaacctcatctcactgcaacctccacctccagagttcaagtgattctactgcctcagcctcccaagtagctgggactacaggcatgcgacaccacgcccagctaatttttgtatttttagtagagtcagggtttcaccatgttggctgggatgatcttgatctcctgaccttgtgatccgcctgcctcggcctcccaaagtgctgggattacaggcgtgagccaccgcgcccaacccacctcacactattaagtagacaaattccaggagcactaaacatttaaatacatgcattttttaaaacccctaaggatattaaaataattttcagactatatatttgtatagcattgtggtggggtgataaggatcttattacacatgacaggaaacccagaagctataacagaaaaaaacaggtatttctgattatgtttcctaattatatgtttaaataaaccataaaattcgacataaagatatataagaaattttttcaatatgtgatgatagcttgcttgtaatgttaactctaagcaatcactaagcaaaaaaggccaaaaaaaaaaataaaagaaactggaaaaggtatgaaaattcagagaaaaggaagcaaatggcaattaacaaaaagataccaacttaactaaaagaaaaacgcgtcagaacaattagagagaaattttccttagaatcataaaagctttaaaaaagtaacagaccaagcacaatggatcacttgaggccaggagttcgagaccagcctggccaacatggcgaaacgctgtctctactaaaaatacaaaaattagccaggcgtggtggcgggcacttgaaatcccagctactcaagaggctaagacaggagaatagcttgaaccagggaagcagaggttgcaatgagcggagatcacggcattgcactccagcctgggcgacagagcaagactctgtctcaaaaaaaaaagtgacaacatccactgttggaaagcatttaggcaaattgcttttataaattattggttgaagcttgaattgctataatgtcttttgagctatttagtcatatctatttttttatttttttgagatggagtttcactcttgtcgccccggctggagtgcaatggcatgatcttggctcactgcgacctccgcctcccaggttcaagtgattcttctgcctcagcctcccgagtagttgggattacaggcacccaccaccacacccagctaatttttgtatttttggttagaggtgtttttccatgttggccaggctggtctcgaactcctgacctcaggtgatctgcccaccttggccacccaaagtgctgggattacaggcgtgagccaccaggcccggtcagtcatatctagcaatacactcaactgatcccaataatatagttttaaatatataaagcagaaacagaagaaaggacaggtggacaaataacttttccaatgtgagtagtttaccttcctcaacaaaataatctgtgaggagatacataatatatataacatatgattaatatccataacaatacaaattagagaacatattacactcttttcatgtaatagatgtgacatttatgaaaaatgaggaagaactaggccataaagcaattgttcaactgaagcatcacctacagacactaattgaaacataaagtgcacttcttttttttttttttttttttggtgctctgtggcccaggctggagtgcagtggcaagatctgggctcaccgcaagctccgcctcccgggttcacgccattctcctgcctcagcctccagagtagctgggactacaggcgcccgccaccacgcccggctaattttttgtatttttagtagagacggggtttcaccgtgttagcaaggatggtctcgatctcctgacctcatgatccgcccgcctgggtctcccaaagtgctgggattacaggtttgagccaccgcgcccggccataaagtgcacttctaaacagctcatgggtcaaagaaaaacaattactgaaaaaaatttttaaacacttagatttgaacaatacgaaactgctacacatcaaaacttgttaatctttatattacaggctgaaatggaaagaactgaactttcaactcaggtcagaaagcaagctgatcacagtcctcaccgaccaccatagctgaccctacaggccctcagtcactgaccacagactcccgtcactgacccccaaaccccaatcactcatcccaaagagccccatcaatgacccgagaaatccctgtcacagacaaccatcaacggacgtcacagacccccatcaccatgccccgaaaccaccatcactaattccacagacaactcctctattactgacttcacagaatccctaattgcaaccaaccaaaatcgtcacagagacctctcggcattaaaacgtgaaaatagtcctgacgccagcggcgaaatagccttcggggaccacttccacttccggtccgacttctagcacc

SEQ ID NO: 737 - DNA, 126085 bp, Homo sapiens
cttcaattttctcctttcctcaacagttttattgccttttaagaaaatttttgtaaaatataaatacaaaggcagagaatttacttacaaagttaaaacacagatttcaaacataaacacacgattcagaaaattttagttttatgtacatttccaagcaacctcaacatattatgttagttttcaatattttacagggtacagaaaaaaatagctcaaagtcttctttaaataagagcataaaatgtttaaacatataaacaatccggtttgatgcgtgaaaactaatttcacagcttttaaattaggatataaaagtttcatacaattagttgttgtgtgtggatatggtttgaatttatattacacactactggattacatccaatagcatttacctggcccgagcaggtactctgtaaacaaaacaaagttatatcaccaagtgccttccccgaattcgctccctcaaaccaaccacacagttctgaccactctacagtcatggcctgtcatcagagctttgtatgaaattaagtcaaagtgtggagctccttttactcatttttttttctccttaaaaaagaaaagaaacaaatgttccaagtaaaaacaaacgtatcccaaagcatgtgtgcattgaaaagtaaagaaacattataacaacttcataaaaactgacttaaaagtttaaaaggaaaaaaacatgtttctaagtccttctgactggagtaatttctcttatataaagaagagatattttcatatgtaatagtgtcctttctttacagaaatagttgtattatgacacatatgcacaaggattaacactataacacactgtacatggtgggtccagcttgctcaccagtagttgtctgaggccagatcactggggtggagccactctacagaggagcccagcagagtctgaatttcgttcgtgaattccaccagatctaacagctccttactttcagggttgaaggcttccaggtctttggagcaagagaacaagagacttgcagaaacctgccgataaaattctgcctctgcaatggtgacaatttccacgtttggaaaattgcagcgaaatatgcgggaggacattttcaatttcttaaggacatccgaaagcagtagccagtttcgtggcctacaaaacagaaaggaaaatgctttgagtttccagtaaaatgaaaagtgcgcccaactattaatattaactaccaacccaagtggaccagcctctatgtcctttcattctgctcccacccctcatttctcaccatacctactctctgatcaccattttttttttttttttttttttttttggagacggaatctcgctctgtcgcccaggctggagtgcagtggcgcgatctcagctcactgcaagttccacctcccaggttcacgccattctcccgcctcagcctcccgagtagctgggactacaggggcccgccaccatgcccggctactttttagtatttttagtagagatggggtttcaccatgttaaccaggatggtctcaatctcctgacctcgtgatccgcccgccttggcctcccaaagtgctgggattacggatgtgagccaccgtgcccggccatcgccattcctttctaaggtgaggcagagtaactacttctagcagtaggaactctggactcatctgtccatctagggaggaccatctgaataagccccatttctcccctttctgggggtaaagtcctgctcattcagctgtgaccacaactagggtcaagcctatccaagtgccctgctatcaacagtcactgggagagtaagtctgtatccccatttctttgatctcttctctcctcagaccctcactaacagcattataaacacacaaggctgtctctccattcaggcatgtccactcccatccttccattcttttgggagtgacacttttgagaaggaaggtgttacattccttgcatacaacctaccatactttatgatttccatcactgtttgtaatggcatatatgtttatagcttcagggctgaggaggatgttactcatcaagcagctctgtcaacacacagcagagcagtctcttgacaagtacacccaagatgattggtcactggcgaataggggctcaaccatagggggcagaggggattaactaaatctgatgacacaccaatatcctaagtgtcatgtacaatgattgtcctaaccttacacaaggtggtttatcagtgtagtccgtacatctcaaaacatcctacagtggtctgttgcaggcagtcctagggaggacaccttctcaaagtgtttaaggatttaagtatccaaggtgctgacccttccataaagttccagtcacccacttctctggggagtgacttaagccttggtgttagtgatgagggcaggtttataccatgctgtgccccaccccccaccacactgggtgtaaggaagctgatgtgtaccctttctggaaaatatctactgcattgtgtgaggttcgtggacagttaaggaggtcactcacccacccaccctcatctgctcaaagcgcatttctaactcctgtcacctcaagagcagctcagctagttttcaatcacatgacagccatgctcacccctgagccacagatacttggatgttataacacggtaagaggggggtctctgaaaattcaaattcaaacacatcgctataggcatcgtcatcatcatcctggtcttctggtcctggggggttggctaaaacatcatagccactttcatcatctggttctaatggagggcaaataagagaggaaggaatcagtaaactacagcaagatgtccacagttgtcaacaacaacaaggagtttaaataacaagattctttcccaagtgagtcctgcttccagtgcccaccatccactttccctcacccataccagacagaaatggacttgaacttgttcacctcctacggaactagagcaaacaatgcagcttaccacaaacagagctgccatagaagtcccaagtgccactggcgtcatcatcattgcgaccctggaggtcatttaaataatctggagggagagaaaaataaaaaaacaagataaaatctactgctgagaacaaaatgatggcagagccacgtggcattttttcctatacattcatgacaggctggaaggtcatttcctgtcttcctctttctcagcaaaataaagtagcattacacttatgtatctcttttttttttttttttttgacagagtcttgctctgttgcccaggctggagtgcagtggcacaatctcggctcactgcagcctccacccctccacctcccgggttcaagggattctcctgcctcagcctcccaagctgggactagaggcgcccaccaccatgcccagctaatttttgtatttttagtagacacagggttttaccatgttggccaggttggtcttgaactcctgacctttggtgatccacctgcctcggcctcccaaagtgctgggattacaggcgtgagccaactgtgtccggcctacttatgtatctcttctttgatagcctaactaagctgcttcttccaacaagtgagtgtaatttaaggtaaacaagggcaggtcaccagtgagttagtggcattctttggcaggaagtgcctgataaggactttaactgcaggtgcctgacactcatgaaaaccttgtgcttctgctttaggcactttgtaatgcccagggcttaagtaatgggttatctgatgacctaacaccataaacctgtccaaataatttcatgtatggaaggtttgagtcatttttcccagactcaagatgtaaacctatgagccatacctaagttaagaatgcatgtgtggaaaatgggaataactttaggaaatcttttaaaacattagggtgaatagatgacttagcttcactagaacaaagtcaaaccacacaaaagttcaaacactcggctgctctcctaaaagctttacagtttcagcctttgtgatttctgcctagtcaaattccaatcatctattgtatcgagttatcatctaatttttgaataagaccatttcttgaactttgtcatacctgttaagaacttttccataagttcactgtgggtcattttcatgatggttctacctgagtacgtagccaaggtggggtcagcaccataagagagaagtagtcggacaatttccaagtgatcgttctcaacagcatcgtgcagaggcctaggaagagaggcgcaatagaattatgctcatgcaagccacacttgcttataaagcagttgtctcctttaaaagcaacaggcaaagctgggcacatgtgcaccttgggtactgagcctcctaagcacagtatttcatccaggaggtgtgcacagtcaccgccactgcacagatagggaaactgagctacagtgagtggctcaacgtcaagcaatgaatcactgttattttgatgactaaccctttacagggcagatgaagagactatttcaggcctaaatctcaaacccaaatctatcctttttttgcgggggtgggggtgggggtggacagggtctcactccactgtccaggctggagtgcagtggggcggatcatggctcactgcagcctcgatctcctgggctcaagtgatccttctgcctcagcctcctcatagctgggactataggcgcatgccaccacacctggctaattttttctttttgtagggacggggtcttactatgttttccaggctgatcttgaactcctaggctcaagtgatcctcctgcctcggcctccaaaagtgctgggattacaggcaagagagccactgcccagctgcaaaccctatcttaatccaaggcctaagaaggaagtcaagcccaaaatgaaaacattttcaacaaatttaagtagtcatggaccatatgaaggtaacttacaggggataaaagaggtcccatcatcatggaagccaatacaacaagcaactgtcacacattaaaaaaaaaaaaaaaaaaaagccacctctgtttttaaaagaaactagatgcaaagagattagcagagactctcctgaaagcctgatcccaggacctcacacagatcagtgattaacctctggcccagaagccaagggaacggtggggagaagaaacaggcctggtggggtgtgttctcagcaggatacagaggcctcctacctgtgtccatggagctgggggttggggttggcagggagaagatgggtctctgcccaatctgagggaatgctatttgcaaagtgtgaaacaccaaatacatttccgtttggctatttctgtcactgtcaggaaacccccagtgcccagcctcatggcagcatcccactcacacaaccaggaagatgttcaggctgactcagacctgggtctctgaccaataaaccagggtcaaggacagggtgagggccacggctggggatgtgggtggcaatggcaggtcctgctgaaccagcggaggggcagctggcactctgtgtgtactcctgggactttcagctcaaatatattttaaatacagtgacttcatagatggtgatgaagagtccagggtcttaaaaggcaacacccccaattattcatgcaggcctcaacattttcagaagctttggttcacaggaacattataggactgatcaaaattgggagctttacatctacatttgccagaaaggtctgctggattcaattccagagaacccagtggtcagtgtgcttacagtcaccctctgtctttcctcctggaatttcccgtatacactgagaaccaccaccgcacagatagggaagcttggtctcagcagagccaggctgagaacaagacacatcactgacctggttccatcctgggcactacagttgacatcagcgccatattcaaggaggtgtcgcacaatgttgagccagcccctagcacaagcttcatgcagggcgcagtaacctgcgttgtcccgatgatttacatcacaaatcttgttctctaagcagtacaggaccacttcctgtggggaggggagggaagaatgccatcagatcactgcacaatgaccttgtaaggtggacctctctgtagctttcaaagacatacaccctcaggcctgagaacctgagaacctctcgggcgggctgtggatgtcttggtgagggggaaacacatgtgcgaagcgcctgatgacagggacagcatcatttaggggtctgctgcccagctgcctggccctgggcgagttatgctcctaattctccaaagcttcctttcctacctctggaggagagtaacagcgcctaccagaggctgctaagaaactgtaattagagacccacacaagcccttagctcagtgcctggcacagtgagtacagagggatttggttgctaatgtttcaaacaacgcatgaataagtacaaggacatcctcctcactcaatcgattcatccaataggtagtagtggatgacgacacaagtttagataaaagcaaggccaatcaaggcataatgaacaattaaatgagctggagaacgtttctcaacttcacagagaggaggatgcccaggagtttaggctggtcctcacgccccttggaaagacccggagttggagcctgggcggcagtgcctctgttggtatcatactcatcaacaaatgacatcaacgcttccaataaccctaccttctttttgcttcactctccgccccacttggggctgaatcaatatattttcatatttacttaagttaatgacaggaatctaatacaccacataccacaacctacgcatttcaagaactaagtaagacaatccttcccttccccctttgcagaatgtgttccgcatcaacagtttgcatgagaatcactgttattaatctcacttctttggcgtgttaaaacattaaaatgaaccgctcccagtaagcagagcagtaatttagtccatgttttattaccttgattaagaaagttttcaaacacatggaacagtatctgccaccagacaacaggttacactgttttcctagcagtcatggccagcagagagctgtcaggttctgaagactggggggaaagccagaacatgtggggtagcccaacacatgttccacttggcaaggggggagcttgatgggtcacagcaggctctcctttgtgacaactcttaaataactcatctataacctaaaataggcagcatttgagccacccataaacgtgaggtgagttctgaaaattcttttatgccctttctaagacacatcagtcaaaggtgatcactcacttgaacactaactagaatgttctagatgctccccctgtgaacctaaggctgcacgctggtaaccctggccggtaaccctgttgcttcaggacactgcggcagctcccttccaaatcaaggggaggaagagagaaggcatgcccacagatgcgtctcttccttcaggccctcacctgccagaaagcccacaatcctctgagctcccaggccacctgccccgagcactggtatccaggataccgcatgaagctgctgctcttttagcaggccctcactagccagactcgagtggacggctgcaagctaatgagctgtgtacccagccagggagaggccctgtcacgtgactcagggatcagctctaagcgccaccgactgctgtgcacagatcaatctacccggatcccggcagccggcctggtgtcctatcaacccagggtttatttgctctgacaattatggccttcacctggaaaccttcatcactactagggctgatctgagggaacatagaaatgaaagatgtcgaggctgaagggtaagtcaactctgttatcctggaggatggcaggcaagacaacagtaacccaacaaccaggtcagacgttttgccattggccaccgtaacacttctgatgttcccaaatgtgtatgtcatatcccacagtgacctgtgagatctcaggaaggaaaagtggtatgagtctcattcaacactcaaggaagttgaggcccagagaggttaagccccatattcaattaacacaaagtatcagacccataactcaggtcttttggcaacgggtctgctgggaagtttccaaaggcccaatcaagggccctggctagagggctgcaatccagccatgaccggcatcccttgcaccttttctgttggggtcaagcaggctaatgacactctcctagatgggagggtgatgggatcttaaatgggtggcaaccgctgtcaccaacagagagaatgaagaagccagacaagtctgtctacccattacattacttggtttattctccacgctggaaatgggagtgtttgaagggcagcccgcccattcccaaacaaaatcaaactgtttttgttggacaattctctgttaagcagctataagctgaatgacattaaccgcaaaatgtaaccataaaggccataaacccgacattgttaattaattaaatgcctcattaacttttttaaaaacatgatttattcgattcatagaaaacttaaccatcactactaaatgcacacacatgcggttccacattggcatcttagcctaagaacagacaggttcaactgtaactggcctttcaggtggtctattacagatctgaagacagagggtgtttctaaacctcaagaaccagattaacagaaaacaaagcttgagcagcctttttattgcatgtggtatctttttagctaagcagaagacaatgataaagaggggttttgggaaacctctcccaaagctgtgcattcataccgtaccttatcctgttaagcaaactgttcttttattttaaagggtttacactgccacatctgaatggactatcatcctaacattttaatttctgactaaagaaatcccagaaagttggattcaaagttgaaagctttcatctagtaattaaaacattcagcatcaaaactgatgacctgggaaagttctataatgacatttacatttgaaggggaaaagttgtccttccataaacattctcaaggcttcttgcaccaaaggcctggtagcctaagaaagcatggatcagtgttccttagtccaggcctgctataggaaaaccaccagaatggaaactgttccttagagcacccacaagggtctcttgaagctctgggctcagaaaggtgagactggcagaaatgaagccaggatcaaagaccaggccaggagccctaccccgctatggccggcaagtttgctgccctggagccctcccttacctctggtgtttgctggaagcacaagtccattttcccaatcatgcgtaggaatgagtggccctgcctggcacgctgcatctaccctgtcctcataggcgccgctgctctcagcttatgggaaaccaactggctgccacttgggtttaatctgcaagtaactgagctaattttcaaatccttctagagagttccctcaaagataatccagagatatcgataagaaacaagctggtatgaatagacaaagtcacatacaaccaaaaatacctagctagtgcttcaaaggaccatcccacaggtgtgagccagcatcccagttcccacccacacaatcatgccccagggtgggctctgggtcaaagggagactggcagctgggtcaccccatcaggaaaggctcaaggcacagcagactgctgactgcagcatggttaaggtgcatgagcctgggctctggctgaattccgggagcccacagctgagcatggcctggcatggatcctgtcgcccgggtgcttctccacacttcacactcagcctgctgaaccgcattttattttcaccacgactcctagagagctgatgccagcataaaaaaaaatgtctttgcactgtgggctattacatcactatctcaactgacaagtgtgtggtggggagacgcacaggggcagacgtaggttttgaactgtgaaaagcgtgattccaatgggagccagtcctggagaggagccgagtttggggggatggggggagactgggctttggagccaggctgctggattattatctgttcaaatcatgtaacgcctctgggactcagtttcctcatctgaaagcgggaataatattagttactactgcacaaagatgatgaaagggtgaaatgagttactttggatcttaggggctccgtcaacgtaagctatcattgtcatggcccatgctaggaggaggatgagcaggggggctggggagaagcagtgagttgagggaaaagtctcagtccctccctccagagccctcagccctaaggctactgtacccccccactcagaaagagaccttaggtctgccccacccccctccctctgtgacctacacagctacttcctgcctactccccctacacggccacccttccacccgaaacagtacaagcagccccagatagagctaataacttctctcccccttgctaatcagaatccaaaagggctcattaaaattcccctagtcgccaagccctgggttgtgtcagattttatatcagagataagttagcgagactggaggatgccgtagcagcctacctgcctgaacacgaactgaacatcagagaggcctttctttccacaccgcgattgaacaagccaccaaagagacagcagtgagagtggggctaacacaaacatcctgttggagcaccggcccagccccgatgtggagggggctgagctctgctctccatgtccctcccctcgcccaccacagtccgcaggccccgccccccagcctgcagccccagggagcgcccacagggacacacctcatagccaagcctggctgcccgctgcagaagggtctcgccagcgttcttattgacaataagtctccgtgcttccggcggcatagggcgagactgggtggtctcctgaggggaacttgagcatggcagctgtgtggactgggaggctggtagcagttgctgcaagcggtcgaagggctttggctcctgcttggctggtgacagatcatagtccgaactgggctccggccgctttctgaatctccggacagtcacctatcataaaaccaagcagcgcacacggttaagcccgtgtccttctaacagccgctgcttcccctcctcctccccacgtgacaaacctgcgtggagagaggcactttattccttatctttttttgggggtggggggtgcctgtcaaaggagggtttgggggaagggatttcattcttactagtttgaaacttcgctgccacccagaagacatgctcctctaggacaggggagtgacgtgtggtgtgggggaggagtccaggaaaaggaaagctttgtcccctcaagctgggaagcaggcaggcggggatgtgttcgcacaggccccagagggaagccggggtcaagaggtaccttgccatcggcattctccacgtagtattcccctgtcagtggcaatccccgcctggactcctgagggatcaagtgtttggttttgcacagtctcttcccggatggcttctcgctgttgtcggtgtatttctgcagcagggaggcagcctggcaatcctcttcttcgtctgcacacagcacatctgtcttctggttttctttaattttctgctgtttggcaggcggcctggaggctggtgcgcagcttggctgagcctgctttttgccgcctgcactggtggatgaaagactcttcatgggcggagagccggagaacacaggcaagcctaaatacggagggggtgacggggtggcgggcggatgggagacgggagaagaagcgggcgttacacagttgtagccagtgcaggaagaaaagcccattgttaacactgatcactggagcggcttcagtttttaaagatacaccaattatgttttcaaagcattaatattttaattataccacattcaaacggcacctaagttaacccacaaaacgccaagtggcaagttgcttcaaagggcccggaagagaggacagaagctggctcttcctgctttcctgccccctacccactgggtctgggttgctcaggacccagagactggagacagcctgaggctggaatgaaggtgttcagacttccttcctgtgcaaccacgggcaaggacatcaagagagaactccctgcctgccacatcttcgttgaagtcaattgctatggccttctaagatctcctcaaaagccctttcctacagagagtggatgacccaccctccaggagcggggtgaacactcaaggggtggcccccgcataccttgttcattgtcactgggtttaagagactcttccgaccagcttctgttgcctttggcctctgcccttttcctgccaggtttctcttcagtgatgttagtcccctgaggaatggcctcaggctgagtggcctgggtcacttccttcctgctttgccggccaggtttgccatctgctgccgacacctgctgctcccatcgttctctaaggtgcagcaagtggcgttgttttttaggatggagccctgttaattcaatgcacaccttcaggttggtcagctcactataatgtgggtcttctaagtggttagaggaactgtttgtcatttccctctcaggccagtcatctaatggagaaataactacaaattaatcaaaaagccccccgggggggaacaaactgtcttacgcatcactaatggggtgggggagggggggtgtggtcactggtctctgcttttgggaaggggcctaatcatctttggccatctgggttctggctttgggggaggggaggtgtgggcggctccccccgggggctccagggtgggaacctcacgaggcagtgtgggaatggagaggtccgctccactgctgcgcccccacggcttcccctcaccgactctgtctacgggggcagcgcgccgcacatccacatctcctgtccatccactgtggccgcatgcaaaggcccaccccccggcaggcgggcgaagcagacagggctcacctttagagactcgtcggcgtttggctttcagcagagggtcctctggcacctcctccgcagtggtctcagtgtggctgctgtcacctgagactttgcgtttcctgtccacccggagggtggggctgtgaggcatgtccgaggccacctggtctgcgggaggctcgctcacaggctgcctctccacaaagtacttctccacaggaagatctttgtcctctggggcttcaaagggatcacggtgcttgtttccaacactatactcgcctgggggaggggagacaagagggcattaatgaagcccgaaggtcgccatgagaaggcaggatctggggagtgcgtgggaccaccatgcccaaggtaatctgctattgacagctgcttctttggagactggggtcctcacacatggttagcacaaaaccctcagaaacagaactttccagagggagggtacattgaagacgagtggcaagtaaagcagagtgaggtgcatgtcacactcctgactttctccttctcccttcttatggttgggggcaagagggaaccaagaaagatggggcgtcaatgctacgttttttaaagcactatagtcctttcagcagaagatgcaaccaagctggggctgacctaaaaatctttatggaaacatttgctgaggtcattattttgaaataaatggcaggctgataggataaagtgaccaaatatccccaaaatgtcatctatcgaagggataacaccaatattcacctaggccaaccggggagatgaaaatggactggagacaagagtgttgaaagaaagcctaggtccttgatgggcagaagtgaccctcactcctggggggctctgggcctacagtccaggccagagggaggcagggaacccaggcagacccaggctgctgggaagaggggcgtggcaaagccaaaggcaaggtttcctaacacatacacgagttcagagaaaacttcaaaaaactcgatttgctggatgcacagatgtgaaaccaatgggttgggctgttcccatttcctgtccaacacaaagggacccccttggggatgctggccaccccagctgacactcctcttcacaccctctgtcacaggcaagcatcgacagacatctcctcattgttggtgtgtccttcccatgccaggccagcgcttgcaaaaccgctcgttccaggaaccctgtgctcggcctatcacgggccttggggcttttccttgaatcacctcagcccaacatcacttcctatttttgctctagcccaagaaatagctcattaactgctttgctggtcacaatttttctaatacacaatgaatataaatgataactacttaatgaccactgcgaggttaaggtgtcagcccttggcccgctgaaatgatccctctcatcaccagggttatgagtctggtgtcttggtaactctgagctgaggcacacaagtcaatttctagatgaaataagcacacgcctcatccgctgatctcattcttcctctccccaacccacttcaaatattactcccactcctgaccagcaccgctcacccgcttctctcgggggcattgccagcggttcacggcagtcagctgtgggggtgagctttacaggggtgttggctagcctgtgctctcaatggtgcaaggacccattcaccttctcttcaagggtgttctaagggggaacagatggggctgcatctattcttgcaaaggaatggtagaatctccccaaccgttcctcctcatcctcactcacgacagtgcactgtatggacagggatggctgggactgggattcggcacccaagcccccaccatggaataccaccccaggtctctgtaggtacaaccagcaacggatgggcgtccaaaaacatggccaaggtggtgttatgtcacagcagcaacaggagaaaacacacaagctgcccaaaacttacactatgcagaagtggtgaccactgtgctcagcttggcctggggacgcaaagagggtgggctgcgactcgagttgctctgtgtcttaaccactctggcagtaacagcgccactttacagtttggcccccttgagttgtaaagtgggactattactgcaagccacctcccccggtgggcttcataaacacggtgcagcagggcagagggtaaggctggagaaattacttacaaaaggacgctatgatccccagaccagcttgatttttagccctgatatttatgaaagtttaagatgtgaactgattgtcctagttatatactatttgactttctggagccaatcagccgcccctgaaagccctgtgggaggggctgggggtgcaatgtaaaaatgtaaagactgtgttacgaagcgccacatgcaaggttacttttatacttttaaagtgtactcatttcccctccctttaggtaggagagagggtttgagccaagtggtttgaaagcagaggtgactaggtaatgtcacaatgccttcctgggtcaaaatgaggcagcagcttagccagtgtggggccccacccagaacgaactgccctgtcttggcacccttcccagagacacccccccccccccatcaaatccccatcagattaagaatctctcaaccctagtgctttggatttgacttccacagcttccatttgaactccaggtctcacacagccacctgtatttgtaacaatctcaaccaagtctaaggcatctttctcagggagaaagttttccattggagttttgaccttcactgcaaacttcctaatagtgaaatgagtttatatctcacctacctggccttatgcccaaactgccagtatattttgtccacagaaaaccacctagaagacttgtaatcacttatttcacagactggcatcaacaggcagtgactaactggggacctagtctctctgctagggagcacccccattagatatggggaggtcttgccatctgtcttctctggggctccccatctaggaaaagctgcccagtgggggtggggagggctcccctgcacacaccaccttctgctccccattcatggggaagccagcaggctaggataaggggtgcgaaacacacatgcctcctccaagtccccaccattccccgttcagccggacagggcccccttctgcctcctgaatagtccagaactattatcgggagccctccactgctgcatctggggttcactgcaatcatgcctgcccacacgcagtgtagatgcttcttgtccgctctcaagaagatctttccgcaaacgagatctttccgcaaatgaggcctattgtccttccttcaacccctgagcctctcaaggcaaacatcccaattcccctcagtgaaggcccccaaaccttatgctagggtttccctccatgggccagtaataatcccaaagaacacccaccttgactgccgaagatacgtatggcaaacagctatgagggagaggctccaggtcactttcctgtacacttcacttggacctccctcaaatggggctattcttaccagtacccacagaaattactcttgagggcaaaggagatgggtgcatagacagagatgaagggatagataggggtcctaaccatcagggtcctcttccattgcaactacttacagcccttctgtgagtggaatgccatgtgcctttggtcatgagatctaggcagatgtgaacatggctgagtcctacaccgtctaccactttctccttgcatcatggtcctataaggcacagcacatacatcccataatttaccatggctatgccattgcaatacctcctggaagcatcgccatggcaacatttacaagtcaccgtggcaacaaagcaacctcaccactgttataaccacgcccagtaagccctaaacaggatggcagaggactgagatttttgaggactgcccatgacatctactccctctgcaggcaacatcacctctagcagaggccaaccatgttataacttctaccctctccagcagcagaggcattggtagtcatctgtctgcccaaactcaaagtagtttacaaagtacataggggctgctgtcctggaagagaagtttcctgagccaagaagtcccatgaaaccctttcactttcactcaacgctttctccagctcccgctcaggcattgccactgagtgagtcctaggtccacacaagccaagtggctaccaagggagacagacacccaaattcaagaaggaagggctaatatgcacatctaatatgtatcaacaaaagtaaatcaatcaataaaaataataaaactaaaaacaaaaaggaagggcccaacacctccgtgttccctaccccatcttcaaaatgccacttatcattccttaggagtttggggacactcctaactcatttgttcaatttctaaatgaaaaactcagcaacccatactatcactaagagtcaatgaaaatcctaaccacggtgttgtccagttaattcagtttttttaaacaagccctcccaacaagatgcacccacacgcaggcagctgaggccgcacaggcggcacctgccatctcagaagctactggtgctgtaggagtggaggggagaggcttcggggaggcatcctgtaccctctttgtgacccctgcctgccccaaatccccaccccagtttccatatgctcacagcttggctctgggccacagtgacacccatgaagagacgtgatggccgagatagctcagtgaatttgaagccaaacggatccagcgcatgctgtaccctggatgagatggcagtggcagcagcaaggacaacatttcctctaggttcctcctcttgatcaaccacaaacctatggtgccccagctcttccttggccctagtatttaaaaagcagccttcaccttcccccaactcttcttctgctctccctgccatggctcattacctgaggagcactacgtggtgacttatggcttgcagggccctgtcctgggtgctccaagaacacagcctgttggtatgaagcttggagggacttacagaaagggaaagggaggcctttctacatcatgtggggcttgggccctgctccccattggccacaccgagttactcagatgtgaacggagggtctggccatgttactcaaaaaccacagcaagggcaagaaggctggaagctggctaagttcctgtcccttcctccaggcccccagccatctactcagaacaaagagggattcttatgtatggcactccctcttttagaagcaccttccccatcaactcggccttgcccacttctcccaggtccctctgacaaccttcccaagagctggtgttgaggcaactcagagtgggggctgcgagttggcagcaatcatcagggaggaggaaggctttctttgccacttcacccaagagtggcttggacctcccactgccctgtagccactctttgaggaagagtgagcaacttcaggtacattgagtccctgccacttgagtaaggccaccacctattagcagcagaaactactttcttcagcaatgacttacaacaaatcagtcctggtttagcttacccaggatcctggcaggtggccttagtctgctcccagggatgagctggaagtggagggaggggtgtgcgctccgagtatcaagaagcacactctccctgatcacacattcttcccaaactctgtcaggcaccgatgaactgtgttgtgaatgtcaaacctccgacggcccatggtggggagctctcaaacatacccaacacttccaagtgtcctgtgtcaggaggactttgcacctactcctccagttagttcacccagacaccctaattccccttcgcccagtgaggtttctcatgttgcaagcagacctaaagcttcaagcttgcatatttaagaaataaagaggaagacctccacttgctgccaacacatcttagcaccctagaagactcgtgagcaaatcccaaagtcaaccctgttggtggggtgggggacctgctgtaaggaccaaagggagtgtactgaggaagatactagccttctcttcacatcacttgccctccaaaatgcaagctgccctctgtccggtgggaagagccccctcatgcatgccaggctgccttgggattctgtggccaattctcccccaccccccacggtaaatcgtaacgctcatctttatggtgacttcaccatgttcatcctacttcaacaacatctatgcctttggagggagaatataaggactcttcattccacatcagactgtcaccacaggggtggggcaggagatggctgggaagtgtcattccactgctacaaaatataacctgtccctgcacctaatttcctactgccatacctctgctacactgcgttatattagactgttatcaactctagaaccagtgcttctttggaaaaaaagatgtgtcccaggaaactatctttcacagacgcctcgttcctggttgccaccattcataaggacaatcggcccttcattccatgcatggcaaaagcagcccatttctccaagcagatgccaaccggacctgaggccaacacaagcaaactgctcaggtttacttacatctctcactttcgttctgttctgcaatggcctcctccagggtgaccgactttggctttttgtcctgatttcctttcaacctttcccagtcggctgggctgaatttgcacatctcggagtctttggttgctgggtggccaccttctctttctttcatctccaactctgagaagcgcatcattgcacgctagaaagagaacggagatggaaaaaaaaaaaaacaacaccttaccataaaagctatttcatttgccttatcttaaaggaaagtattttcaaagaaaagtgcccaaaaccaaccacagcttatgagatgtaactcagatattttaaagtttaacagataaaacttaagagtatctatatataagtagtcacacattctttattcataaagtcatgtgtatatagatatatatgcgatgtgtatgtatatccacacatacactattgcatacagacagacattctcttttgaaggtaaataaaacaaaacgaaaacacaacgcaaagaaaacaaaacaaaaacacaacagaaaagaaacaaaatacacaatgaataaagacgaccatggcccacaaacttccctttgtatatttggaaatgaaatttaactcaaaaggtttatgtaagattctagtaataaaaatttgaagaactgacctcacagtaagcagcgggtagacataaaatactgtcctcttgtaatccttccatctatgtaattaaaatgggcactcaatggatcatttagataacttcatccatttttataagcataaaccaatttttttcttaacattgcaaaacaatttggctttattcatcttttaattaaaagtaaaatatcttaaggaaattcctatacaacatctatcataattcactagcaagttaaatacatactctatccctttaagcaaccttttttcttttttttttcctttctttttggtgaaaaatttgcatgaatcccacagacatgcggctgctacacatctctaccaggtatcaagtaaggcattctaagcagcacttctaggtatatttgctatcttacaggcagagaaatcaaagcaattgataggtaaacgtcatgcagtctttagatacccttcacaataattaaaacatcggttatcagcaattgagtggagttcccttataatctacagaataacttaaagcatccagacacgcctcagtgctaccactcacgttctcttactggccacattgcatatattcaaattaccacaagcttcattcaccaaatctgcctggtgccctgccctaccatactcccccaatcctgtttacacattaaaaaactgacaactggtaaagtaactgaaattcaggtgggggggctcacctgcaatgcccgttgctcccggctgagctgactggaatctgcatacagttcggtagtgacacatttgaatcggtcacccacgtaacccgctgagttggcgattctctttgccagcttagatggcttcggtttcagaactttgccatcatttgattcagcctcatcagctccatctttggtataggtgggggtcacatccacacttggtggggcactgcccacacaaaatggtttgggatcctcttgggttttaccaaaagttacagcagggccatcgctccccagaggtggctccaggaatggagtcgagactggcaaccctaggttctctttgttggtacctgccagaacactgtccttgcttacggtgaagactggctgtttgaaagtataagtttcgtggaagtcactgatgcgccccaactcctctctcagggcgatgaaatcacggtgctgctgcagggccggctcaactgagggcttggggggctcagcgctctggccaacactctctgctgcaaagctgggtttggacacgtttgtgtcagttttagcatctggttcttctcggagaaggtctacgtagacaagcttgtcgcttttgacaacagtcttcccttgattccagttggggttcggctttaggttcttgtcggtggggacatctggatgtaacttggtgctgctagtttccaaaatctcggaaaaccgattccggagggttgggtcctcgtaacgggctctctcatgggaccgggatctcctctctggtttctcctctttagtaatctctatgggcgtgtgtggtatcaacatgggatgcaccatgcccaaccccagggcatcttggtaggtcacaaactctggacggccggtgggaagcccatagggcagcccaggctttggggcaaggtgcccaggaaacagactgccattgggtaacaaaactgggtgagggtagacaggtcctttgccatgtaaggagaggggacttacagcaatgccctcaggggctgggtaagggaggtaactcctggggtagggaattggtggggacctgaatgcctcatttggagacagaaatatagagcttggtggaaggccgttctcgtttgctttgaaactcggttctgggttgctggctttggcgcccttgctgctggtgctgctactgtgcttggcaggagtggccgggggctggcccacgtgctgaataacggatggtgtggtttctacagagctcctgctggttttggtgccatctgcattggcattgggggcgggtgatgcggaggctgggcggcctgcactcgacactgaccctgaaacgttagtgatgacagcatcggtgccgcccatgcgcgggcatgatgaactccgctgctgtggtatcgcccagtccaatgccttgtttttcagcgacatgcttttgccattgttctcttcgttaggacttggcccgggcaccacccaggatgagggagcagtgctgatgatttcagatctatagatagcacaaccatttcctggaggagatagtgtttctttcggaatctcacttccggagagcactaagccacttccagccctgctgtgaaccaggaccgtgggagccatctttttcatgtggtcagctttggaagcatctacatccaccactttagaagacaagtctagtggcttatctgtgacgtctttggtaacggtctgcttctccaacagaggaggtgagctgccatcttttctgtcttgaaccgctgtcttccgggcatgcccgggcactggctgggcaccttcgcccccttccggagccttgggatacttgccattggagagcctggccgcggggaactcgctgctaactgtcatgtatggctttgacagggcaactgaaggagaggtggagatcctggcatagtgcttgtggaactccgagtaggtgtctgcagcaggctgggtgggaaggtggactcggggtgacggccgaggcgaggggggcaacaggagagctgtgtcccccggcaggccactggtgaccgccttggcagagggaaccctgggctgcttactgttctggatgtgaggataggcgtgggaatcaacaggattcccagggctgacgcccatcttccacgggaggcttttgtctgcgcaatggacgagaggcgggatggctggggaggccgaaggtgtcgagagcctcatgggtgatgccaaggacgatgggatgtggggaccgacgtagtgaggtggcggcaggtagagaaagcgctccccattggtgcagactggagaatacagcggctgggccaagctgtaggactgctgaggtagcaaggccttgtacatgttcagtgaatacttatttggcgagtcgaggaaagggtagatggctggcgtggcaccctccatgtaaggattgacccagggcagccgcagataactagcaccattgatgttgagagggctctgtttgtcgctggcaggcctgtccaagcccagcgcttctgctgtggctacagcacttttttgtattccaggcggtgttttgtatatagcactgaagccatttgggggttttccagagacggcagaagcctccactgtctcgggtgtattcggtttgaactgcatctctggatttctttccgaagaaaacccaaggccacctagagtgcttgtggcagcctcccgacctttctctgagcccagtccacacaagctagaatagacgatgtttcccgggacccgcagcccttcccggatcaggccagtgcggtccatgctcagtgctgccaggccatcgatcctatgggccgtgctcgcatccacctttgcagaagaacaacatgggtgttactgggatactccttcaaggcagcagcacccaaagacactgccaactagttcaacatgccatcagccttaacatccaagcacaaagggttaaagacaggcttccggcggggcgggggtggggggtctgtttccccacccccttatccaaacccctttgctgcctgccttctcacctctcaactagtatcctggaagcagggaaaacattggtccctttggacttgaggcccatatattaattcagtcatctattaagtctgaagattttggccaggcgcggtggctcacgcctgtaatcctaccactttgggaggccaaggcgggcagattgcctgagctcaggagttcaagaccagcctgggcaacatggtgaaaccccatctctactaaaatacaaaaaaattagccaggtgtggcggtgtgcacctgtagtcccagctactcgggagactgaggcaagagaattgcttgaacccgggaggtggaggttgcggtgagccaagactgcgccactgcactccaggccgggcgacacagcgagactctgtctctaaaaaaattaaaattaaaaaataaaaataaaaaagtctgaagatttttaccttctcagcaaaaattctttgctacaactaggacaccaactccaaaactctcagcatcaccctcatggggtacagaattcacactaaccctccctgggcctgtcaggcttgggggtgggtgttcgcttcatttcccctgggtgcaggaaggcatgacttaacagaacaagaaacgatcttcgatgggacaacaggaacagaggactttagcagcctcatttctatatcaatatagaggccatgggtcaaactgtggttgtgtcttttgacttcctctcccttgtgtctgaagtgacagtcctgtgtttcgtattttactggaaaggtaaaccctaaggggctacttggaggctggaaatttatccagctgggagcgctgatgtggcatccagcttatggaagaaaagagagtacacatcccaccagtcactaggggacagggacatgtgtggcgaggcaggaaggcaagactggaagagcttgggtgggggccttgtcctctcgcagaggcctccaactcagccctgctctgaactgccacccctcccccattccccaccctttaagggcatgcaaattaatacgattgattacagatcactgatatgcagatatggcatcaacagaagctattaatctcttaccacgttgtggttcaagggattctcttccctcagttccagtctggcttttgaagcgtcaccatcatttacaaggattttcctatttaaaaagatacaccaacttcatgaaagcattcctcactgaatccatctttcacagatctccccagaacagaccagtttctactaacccaatttttaaaactgtccttaaccctccgcccccaccagctgtcaatggcccatattgaaagtcgcccccaaatggtgattcaacttgaccaggaaaaacaaaggaaacgcaaagctttcatgtgtgaggacatgaatcacaaatatgatgtccccaaggtaggtaagccagaaattaagcacaactacttctccctcgagatttttttctctagaggccaagtaggccaatcggagctcggctgtcccagccaacccttataaactctcctggagggtagacatgaagtggtaacacagccaaataccaaagggggctggaaggctggtcgtgtcatcaaccacttccgtgttacccaggagggtaggctttcaaaactttttccaaaacaaagttagggaccatgtcctacgaaactggtttccatggtgataaaaaagccatatttgactgcctttgtcaaaatgacagggggatacacactagtatcatacaaatgtcagctgttccaggctgaaaaggaagctgcacatctgtgccaggctgctgcggctgccctgggacttgttatcagagagcatcgataaagaaagtgcttggtgccaacttccaaatccccaggataaaaatcgctgacaagcggcagaggaaaagtttcctcattaccccgaagagcagcttcaatcatctactgcttagctgcctccaccccacaactccaaaattactgattaggaagcataacagagctgtctgacgaccaaaagcaggcgccagtggcctctgggaacaggcagcagaggacaatgagagatcctgggcttcaatgaaggaaaacggtggctctctccccatttattactgagcaaactatttgttttaaaagcacatagaatgctgctccacctgggcccacactcctgacatttagagttaaagcagtatatagactgggattaattctccttcataaatatgaaataataaattaaggacgaaagtgcactgaaaggccgctttaggggctaatcttttaaagggcggcaatgcttcactgagccaggttgcctgttaaaactgtaaatcaagagcggcctactaggcgggaagctctttctctcccaccccttttgggcccacggtggctgtgagaagttgaggggggcttcagcatgggcgtgggctccactcaggcccggcccagatgggcgcattcacctgtcttcgctcgccccacacatgcggaccctctcgctgttcatccagctgtgaacgttcccatacaggggggttgctgagagcatgtcgtcttctgggatggcagctttgcttcaagcgtctagtctgttaaaaggaaagaaaaaaaatcccaggaggttcagtaaaggagagccaaacagggcgctagagaaggcctctttctaggtgattcataaaggatgcagatggggaaggcaggctgtgcctgctgtctacagtggtctgggagccaaggacagacacctgactcgaagggacagcggaggggcatgcagcttccctggtaggaggtgctggggctggggaagaagtttaattcgaaacaggtagcctcatccaaggcacagaacacattcagggcacaccacagcacccgcccactccctttcctctgaaagtgtacagtggtcattcattcttgccacttgttaaagaaggtaaagaagacttgattcaacaaggggaggctctgacaataggttcagggatgctgcatcactgggaggcacacaactgatctttcctggggccaaaagggtgcaagaagggtggaaggcaccacagtgaggtgagcggcaggtccagctctcaaactacctgcgtttctagggctgaatttccaaggctgtcgtgtgtgcaacttacagatcaagtgtgaaaaagagtcggtgggctggtgagccgccccaccagagccctggattagattaagcagctaacccgggtggttttgcctggaagctgcagagagaggcggctgagtaattcaatgacgcctgctcactggggacgagaaatcattagcgagcacagaagtcttagcagccctggctgatgggctccaagccgctggcacatggggagccggcagaagccacccattttccacgttccgggagcgggaggttgccaaggcagaggagctcagaccaccacccacccccctttacctcctctgcccaccgcccccacccacatcacattctagtttgctgcatgagtgaagggtcaggacaagctgcattttattaacaggattatcacggcgcgtgatttatcctcgtgcaggattttaattgctctttggaggttgagccgtttcttttgactgcgcttcagcccatatcctgctgttaaatgctgggttaataagtaggggagcctttaatgcctgggaccgatggccctcggcaattccctgctcacaaacacatctcagtgtcccttgtccagaccggccatggcatttttccacgggacccaaacctgggtgtgaaataattggtgtgcagatcatcaggggaacttttttctcctccctcacacacccacccacacagtttccgaaagcccaaatgttccctaagtcgacacatttcctttgttagcaggaaaaaatatgcaaatgcttgcttttacactttagcacacggagcagactgccaggtcggttgggttggaggcaccaggtccggggactcttctgtgagagtgactgagggtgggagttaaggggacacctgggggatggaatcccaaagccggtctgtactttctcatttctttgtcctaactaggtcttttgtccaccagcatcccccatgggcccccatccccatagaacaacgtctgttaaccaaaatccacatgcagcgacacaccacgtacagttagagctcaacaatgaggctggaagagaggtaaagggcccaagaaaaaggcagaaatctgcagaggcatcaggcatgatggggttctggaaagctatttccctaggaagtgtctccagacagcggctcttccagttgactagccacagcgcccccaaaggaccgactcggctgttggggaaggttctataagggttcgtgggcttttcttccatcttgcaaatacacaaatcaagtggggaaggccaccactagggctgggcagaccacaaggcacattcccttgtgcagtggcagtgtcccctctccggcccctgctgccctttctaacaaaaggaagacattctgggtaggataatagagaaggtggaacatcattccccggtgccagtgtgtcccggtcatcgggctgcagcagtgggactgcaccatgccaccccctcactgtgccatgatgaaatacagaaattacatcatgagccaaagggtcactcaaccaaacccccaagaaaaggatgagggaagaagcgtgtgcctaatgaacctcaatcttctggtgtccccattcttaaaaattggcctcccctttaaaaaagctgcctctggccgggcatgatggctcacgcctgtaatcccagaactttgggaggccgaggtgggtggatcacctgaagtcgggagtttgagaccagcctgaccaacaaggagaaaccccgtctctactaaaaatacaaaattagctgggcgtggtggtgcgtgcctgcaatcccagctactcgggaggctgaggcaggagaatcgctggaacctgggaggtggaggttgcggtgagccgagatcgcaccattgcactccagcctgggcaacaagagcaaaactcaaaaaacaaacaaacaaacaaaaaacctgcctcttacccacctcccttaagtagacaccttgtgcaaaggacctcccggcaccttcttgggaaacagaatcattatactgaggcccagccccgaaaaggccagcagctgcttcccttcaaagagcctttcttcagcaaagtccacctggacttagcagaaaggtgactgcggtttacaggcacctgggcctactgggtgctttcaaagcatctccccttctccagggctcctcctttggggctttccatattaatggcgcacagataaatgataccagccaccagaacaaagtgttctcaaatgcacagggtcagatggagggttgaggctagcagagcggttcactgtcgtgtgtgtgtgtgtgtgtgtgtgtgtgtgtgtgtgtgtgtgtgtgtgtgttttgggagggaaggggtggaggatggggctgaacataaaagcaaaaggggggaacacattgttggatcctgctgtggacttacgcacacacgtgcacgcacgcacacgcgcacacacacacgcgcacacacacacacacttataatctttagctgccccatgaactttttgtgaactgtttaaaagtggaggtctgttgaacaaacagcggcgccactgccagccataatttcattgcaacaagctaaagacttttaactcttcgggttcctggccaaagatggagaggagtggaaagggccaatgagcaatggccctggctcacaggaggccctcctcctgggtgacaaagagcagtccaaacctacaaaagcagggacctcctttgcaaaggccatacggctcacaccaagcctctactgaagaacaggggtcaccattacctacagcccaccctggtttctctgtcatgtacaacgaaggggacactggggtaagaaacaaaaagagactgggaggcaaagtatagggacatcaaacttctagaagctgctgttgaaatagctggggacttttttacctctaaggccaagtgcttcgaaactgatgttgctgacccttggcagcggaacactgtggagagggcaaatgacctgatttcaatgacaaacagagcctcagggtgctttgcagctatagatgaagctcgtttgcttttatttttcaatgcccacctccaccccccacttcttccaaatgcaggctatgcttccagaagtgccaagatgtgtgaagtcactcatgaaaagcactttacaagcaccaacctgttccactgtgagctgcgaagctgcaccttggatctggggtttaacccctttttctagtagtggagagaagtgggtaaaggtgctggatagggatggagaggaaagacagctgagaagaggtcagatggggagggtgtgggtctctaaagaacagactgggaactgttccagctgcctgcaggaacacccagggccaagtggagagacctggcttgtgagaagcaggcgtgcacactgcatactgcatggtctccagctcttagcaccaaggaagtggaacacataggagagcttgggtcaccctggacagactctgagtagtcattcgctcttcagccaagggttatgatgagagcacctgagcttggcccggacacgggggagaaggcctgattggcagaaggggggcgtcgagggaccaagatcataagccatcactccaaccttggcatccctgagtagggacacacccaccctctgtgaaaagatgtgagggcagaccacaggtcccaagccttggcccctttccttccccacccccaaccctggccccctcttgcactagggccactttccactgcccccacccttgaggcgccgatcagttaaaagtctgcacattacacttgtcaagtggcactgacaatttggaaagcatggccaccaaactaactctgctcacgcctccctgctgtccacacaggcattgagggtggcccatctcggggtcttttcttgggatctctctcactaggttccccttgcccccaccggcagctatccagcagttaacagccagaagaactggagaggttcgcaagggcttccagctcaggtggccaggcaggcattcccagccagtgtgctggggtcctctggcagaggactcttcaggggaggggtctcgctactgcatggctggttctctgtggagaacatggtcaccacagcctcccggctcccaccctcactcaccgcgtgtctctgggcaggtggctgaacctctccaaccttggtcccctctgtaaatatttggcactgtgttttccaaaggattaagctgcactatggacttgagttttgcctggcaatagctggcgctggccacgtttaaccccgctaaatagtacccgactccaataaacacactgtgtaataagccccagaatcacaacacagtttctttggggcactaccacctcatcctgcgggggaggctgaggcagcaacagagaggggatcagagcagggagggaacttcagcagaactgtgtagattttacagaagcccaaagctcaccacccgccagcccttcctggggttgctccaaacagagactgcgtcacagcagcagcgctgtgctccgggtgtcaaggaagggaggggtgaagaagttcctattttaggatgtgaggggtgggggtggggtgtgtgggagtgggagatgagaagaaaaagctcttccggatgtgcagtgtgggatgggtcctccgggtctgctggagagtaagataccccaaggctgccccccaggtccctgggaggcaaaaccgcaggcttccaggggtgtggtcgagggaggtggctggcccggtcccacccctcccgaccccctcccccgagagagttgggggtgagggaagtgatccagccggcccaggtgctgcctcttggcacactccaagccacagccttagccgtagccagcacgggcgtccccgcccacacctccaagttttgcattagtaagggggagggggaaggggaaactcgccggcccagaccattccagcacccagaaccttcccggcctcctcccggggcgtcggggtctgagcggagagccacctgggctgggagtgaacttggccccggcgaagaagaaagggggaggggcgccccctccccgggctgaggcgcttcagcccggagcgcgatcggtcggcaacaaagggattttctctcccaccacacacacccgtgctgctcggggctcgcccgctcctcctccccgctcctcggcggaggtcccagcgcgcggggccgcaccacggcacacactcacgccctcgcggcgcgcccccgccaggccttccaggaactccagcagcctccccggaggcggcccgaccttcccagttcccgaccctaggtaacccctcggaccctgcggcctggcacgctctccatggtgccccttcccgaggccccgccgcaccttctctccccatcaacgaatctgacgaaaagaaactttgggtgggcgcagggagaatccgagacctcccgggaaacgccgccgagcccacccggggaatgggcacggcagacccctcctcgccatcgttctgggttcccttccgatcatactagagcgctgctcctctggacgcttccccttacaaagatgtgagccaagcgtcgcctactgtaacgtgggaggggtgcgaatctcgggcgttggggtccggggtggaatctgcaggggttgaccctgagggtcgctgccgaacctggattgtccgctacactcccctcctccaggcagagcccatggcccggggtcaggtgcccccaacctctctctcacaggccaacgggggacacttgcccgtctccccggataatctgtccaggccaccccaccggctttttgttcttttcactttccttcatggttttgccacacggggagtcaggaaaccacgtgtgtattcaagagagggcaaatttagaaacaggtgtcccttcacaggaggccacccggcaacagaaacccaagtcaaaagccaggaatccctccttactatcttccctccacgcaaaaagaaaccacttgccccctttgatctagtccctgcagaactgggtccccacttgggaatctacacaacctgggggcaaatccagaataaatgttccacaccatgcctccaaaggctgtgtcaatgcacttttgtttccaccagggctttgtaggagtaaaacacaaacgccgtcgccgccacccccccccaccaccaccaccaccgaagggaacaagctataccgtaaggctaataacaacagctatcattagtatacacaggaagcacaaaggaacttttaatgcataaaagatgtgtaaaatgcaggggtcctgcaatctgcaagcgagtctctcactgattgtgcagagcctgggagtcccagaaaggctgggatgagggtcagagaaggagaggggcacccaccttctttacaaggaacaataggaatcccatgtctgctactcagtcatggaactcagagcacccaaaacaaagccatggaacaactatggtatagatgggggcccacgaatttttgtagctgttcagggcttaattactcctccttgatccatgggactagacacgacaccgccaaggttaaaatgccccgaacagcgctgagcagatgtgagcgagctggcagacgcgcaaatgaggcctgcctcggagcacgataacaagtgactaatacattgcatatcgttgaaagaaaattatttttctctaatttgcatttgcttgggggaaaaaaagccaacgcgagtccctcctcacatgcacaagtctaatcctggaaatacagcccggctgctttaagagagctggaaggagggaaagactgccagtgttttggcgttgcaggcttgtttatctttccgcctttcctccaaggcgaaactcgttttgcaagcaacattcctacagaaaatggcacacgtcataaaaagagaccaatttatagaactggcaccgaagttcatgtctcactccagaagcatctcccagctccccatcggaaacccaactagatgtagaagtccatgttaaaacttagagagtagacttagggaggggaggtgctgagggtgggggggacaggagagaatgaagtagatttgcagatatcctgtaggctgtacacccagagaccaaagtcagccctaaatgatcttccaaaacccaaggaggaccaggcaggtgccagggcttggaaggcttcaaccttgggactcatgggggagaggagtgaatttttacacccagcttgccccaggacggtccagaggcaggtccacattcttggccatcctaagtccacctgcttgggccagccatgaacctccaggactggcctagtgggtaactgccaccaccaactgctctccctcccaccctggcgcctctctgcagggcctggcggggtaccaggaactcaaagaaagcctgttgctgtgggcatctagttgatgaagtcagagtaggtggtgctgtgggcaggcttcaggacggcacctttgcgtgctgcagttgaaggcaaatgtgctcttgaaaacgggaaggcttggaagaaaaggttaagggatgtgggtaatcaaaagccaatctgtcctcccttccccccaaaatacaccccccttagggtactgaacctgcacacttgcatttccaagctggaaacagtgtcgagtgcacagaacacagcacccgcctgtctctaacttgtctgaataacagggccatttcagaggggaacaacggccttcagagcctctgcaatttccagaaagctttcagttaataacacattctttccaacaagcttacttagggctgaaagttattttcacaaatcttaaaaactcagccataaacagctgaggacccagttcaacggatcctggccaaaccccaccaacacggtgacactcacggccccgtgggccttctcccgccacctctgcctcaccacaagttccctaaaccacaacatacaaaccatcctgcaccccaccccaatcctgggaagtcataaagatgtgtgttggggatggagggcgggtgtgccgtggagctttctctcatctggggatgcgctggccagaaactggccgccacctctgcagctcgtccatgggcctgcatagtgcgcgctttgtgtaagtgctgaggaggcgcagcgctgctcgcgcgccaacagctgtcacattatttgcactcgctgtaaacagccttcacattccccccttaccacatagttaaagccagactaacaatccacagttagagatcaaaccaacaacagcagcattgtgtctgcctttgctgccttcacaccaagcccagcagctggcaggtttctccggaacaagggaccccttctccccctacccctccgggatccagccaaggctagccaaggaagcatgcgtttgtcagcgctgtttgttaaagcaaaagagcaccgccatttcgcagagatttccgtgtggctcatcagccctctccgagagtttactccttctggaagctcgaggaagcatcacgagaataaaggttgtggagactcgcagggttggtttccatgctcagcaaagtggggtctggccgggctggggccggggccgggacagggaggtctgcccctctccatgccatgtcacagaggccagacaggtctgtgctttctgcagccctcagcggaatgcctcctgtctttcggaaattgcccaactcactaaatacttactggccgccccactgatcaaaatgtctcctttatgatttttggttaagttgaacatttccataatcgtcattattagtgcaaattacacgcctaatcggtccttaaatagattttaattaaataagcatacaaggctcattttatgacttaagaaaggcattacttttcgttataaactttccaccaggatatagaataacgatagcagacaaatacttattctttgaaaatcaccaataaccgatgggcagagtatcatgaaacataccctgttttaccctctggaatcaaagctgagaccagacatatcacagctgtacaactttcctcctgggatgggagagaggatttcttcctccaaagcactatgtctgtcttccttgtggccagtagaaataaacccccggtgctgctttccctacccatctgatgagatttctctagttgatgtcctctagcaaccactcctcccccacctccatccattttccaccctttcgcctgcttagagtcctggtgcaaagcaggcacgctgtgcttgttaaatgctgtgtaaaatgctgttaataaaataataaatacaaaggatggaggctgctgcttccatgggtgttttgactggaaatgccttggcacttgtcatgtgtttatgggagggcagacaacgctaggatttacatagtttggacatttctgtacttcatttattctttcctaaatgacgtaggcctcgagctatttcaagtttgcatttgtacagaactgttaaatgcctaggagtttctccaattaaaccaagtttaaaatcagacccaaagctggaacatacactcagacttgcccaactccaccttcagcctcggtggctggacaaaacaaacagatcctcgaaaacaatcagtcctcgagctccccaccttcaccccccactccaggagggcccctagggcaaaggttaaggcgtctctagattccaagccccagcccaggctacacactgaggcaatcactgcagtaaggcgcatcttgtccatacactacctttaaaatcgtgcgctaaaatcggggggaaactgctggcctggtaaaacccactgttcacaaaacaatgtcagcaaaggctgtaaggcattctttagagagggaccagggattcgtgcctactgaagctctttcagcacaaaggcttttaggggaagaagggaaaaagagggaggaggagggggagaggaggagagaaagggagggagggctcctgtttcagagcaggcatcccctgagagtcaagaaccaagtgtagcttcaatcaaacactgacttcccctctgggagtcgagtaggaaacctgatcacagtagcttactaccagcctggatccatacaggtctggttttcttctcatgctagtaatttttttaaatacatattgatataaaagaagcaatccctggcagactttattgaaaaccacattgagccctcataacatccggacttaatccctatcaaacaaaccacagcacctctggcctctgcaccaggccaccccctctcacctcttccaaccaggtcttgcccctctaggcaccgtggttcccccctgaaataatgccaggaagccttgccgaagggtacctagatgacggttctgaaatgagttcctaaccatataatgatcccacttgggggtggaggggagaagcaagtcttttcatatggaatcctttaaaaggcagaatgcaaactacggtaacaaagggaaaggggaacccaggaaggtggacctagaataccctcgtaggggagatttaatctgcatccttgggtcccaggacacaggcctagcaagtctcagggggtctcaggggcagcagggaatggaggagcaacctataggaacatgacaagtcattcaaagcaattattcatccttggggcctactatgtgccaagcattctatttagatcctaaaggtggataattattcccagtcttacaaatgaaaaaacttactggggctcaaaggccataaataacttgcccccaaggtcacacagctagtaaaaaatgggccacggtcaaactcagtcctggagttgcggagaggagccaattattggtctaattgtgccatttgaaatcctgattttcacatactgtctcctctgaaaagcttccttaggccttatgtacccaagaacgaggcaaagagtgtttaacacctatgttacttggtctacagtgagccgtgaacccagtttctcctgtatctaagtcatctcctggtccactcaaagtctttcaccatttccccctacatcctacaaatctccctacactgttataccctggtgtaaggccaatgctctcaacaagcctcccctttcccttcctccagtaccccagaatagtcaggggtaaggtgggtcgactcctttcaggtctctgggaaaagtgctgactactggtactaggagctaggcttgccaccccagtttcgccacataaagcaataaatcaaattatctagatagagcaaaagccctttggagggagctcctccatctacctttcctaggatttaaaggaaaaaccccagggaacaaagtagtgtgggagagggaattaagatggaagacgccagcaagatgttctattgggccacccagagtcccccacaaaagcgcaagccgggggataggctatcttgtcctttccccaacgtttctttacagaagcggccggcagcaaacctcagggcccaacatcccctccccaccctatccccaatttccgggtctgccccaggctttcagatgttccgggaactacctacacccgcagagcctgccaaagccacctccggctcggctcgatgggtacaggcaggggtaccggacactcgggcttcccggccctggactggttactcctccagacgctgaagctccggatgtgcgaaatggctccgcagtgcgaccgagtgtgcaggggcctcggcggcgggagggacggaggggagacggcggcgccggggcgctcaccccgctagccagccgagcacgcccccgcaggccggccacccctggctgcaggccagccctctgcaagtggcgttctttctcttttttaaactttccggccttggcgaacgggcagggtttccagtcctccccggcccccacccagttcggggaggggcggggcggggcggggctggccctcctaacccctccggggaggcgattccccccaagtcccgggcaccgctagacggcggccagggcagacgccttgctccaccccaccccacccccgcctactgtggccacctggagagggcggcttcccgaagcgatcgccgtccagccaagcctgggaccgcagcgtccggggaggaactccctacagcgccaacggtcctggcctgcccgcggtgcgctctctccgaaaagtctaatgctccgggaagggggaggggagagagagcaaggcgggaagggggggacgggctgcttttatttattttttaactcttcaaatgcaagaggtttttggtgtccctagcacgactgcgagcgtctggccaggcagaacaatagaaatggaggggggacgccggaaatggtgctggaagacccctataaccctataaacctctcctctccctctaagttcctattagcattgaaagatcctagtgacttcaatgcaaaattgtctttttataacttttttccttaaacacattccccctccccacatgaaatcacaagggcaaagatcgcttcccaagttgtgaccttccgaagctccagggcttctcacctgctctgcccctggcaccctgacctgagtcaatcccatcccccaacagttcccctggtttgcacctagacaataaatttagtttaatttagcttccggtctttaattttagcaggtctcctttttgcatgcaaatcaatatggcaattaccatctaaaagctcgcccagccccgggtcaatgtaaattgatcattgtccgccttccacaaaataacatcgggagtctgtggtgcataatgagattatactggaaactgtcttttagatcacaaattattttttatgctgtcaggatcttctccgagtggacttccccgcttctctaatcatggagagccgagcccgtgggtgccggctgtgggagacacagctctaaaacaatgacggagtgaggacccccgtttctgagaccctcgattgtaaacacatggaggtgagcttgcgccccaaaagggagccttctacagaaatatcgcagaaaggcatcgttaatgaactccacccaacaaaaagtaagatatcccttcctgatgaacacgttgagggcaaccagagaaagccgtcgggcagggctggagaccagtggacgcccccggccaagtgcgcgcgacgaacgcggctcggctaccaccagggcggctggggggagaccatttactcccgccccggcggcttctcctggctctaccacctaggcctcagcagcgcgtccggttttgcaaacagacggaatcccgtcggccataaacactggcaaagaagccggggcgggtcagggccggcccaggcctccccacccagctttgggcgaggcccccaccgggcccgatccagaagatgggctggggcaccgaggcaataaggaggctcctcttgacccgcagcactgctttctcccacccatcggcggcccccggggcacgagtgtgacctcggggcctaacaaagggccttgtgagctcctttcggcctcgggccggagggagaagggtggggcggggcggccgagatggacccaggaagttccccgccccgccgcgcctctccgggtccgccgggcccggtgtcctcgaggaaaccaccggggtggcattgccagggctgcccgcagctccggggaacgtcctgcgggctccaagcctcccgcccagcgcgaccggaccctgccccactccgcccggcgcgggccccacccaagtgcggtcttcccaataaaagctggaattcccggctgggcttagacaaagagggaccgcagcaaatcgacgccgcgggcaagccataccctagccggagtttacgtgcgcgtctggggtcaccgaggcgcctgctaatccacccaacacaggctgtccccgccacggtctcctccagaggaaaaaaaaaaaagaaaagaaagaaagcatacctcccttttattcctcccagaggccgcacttcttcctgttctccttcccagcccactgaggccctgctccaccttagcaaattggaccccagcagtgcaacagccattcctactgaccacaaagtggaaagctacccctcttgtggctacacgatccagccactcaaggtcaggaactcaaaatctcttcagaaaggctcctacctgctcgtcaccaacccgctgcccactccacctcacccctagaagggaaagaaactataaccagagataatcctagttcactgcacaccatccatcctttaggctgctagcgtggccctcagtttccttcaagccaaagacacattatttccctgtgaataagtgtgtgaatgtggttgtgtggcccactcttctgtacccaagtcggtctcactcactcggcaggaaagtcttcgtcaggcattgaggagtgtttgtcattcagcctgtgtatctaagcatggatgtatgcatatgaatgctttttgtgtttccaagtgaccctcttcacacctttaaatgggctattgtctctggaacgcacttacagaaattctgccccagtttccagctcaacaaagtctgggatttttctctcagaatatcgctatacatctctgtatttgcatacccatgtttacattccccttggccagttctttatctcttatgtatctcttgttccatttgggcaacggagcccaagtgtcttgatttgtctcagcacatgtcattcaagcgcacatcttaatctgagcattcgtactacttccattctttttgctttgcctataatgtggctctttcccaggccagaccaatatgggtttgcagtttaaatgtaaacagaggatcccttaagatcacaaactcttaaagaaaggaagaggagggaggaggagactggaatgttagtaatgagttatttatgtatagggtaacccatccgcccatttcaagctgaagaaagaactagataaatgtctgcagaggtgtattaaaattttagaccaatttaatattagccatatatatacacacacaaacgatggatctcacaacacatcagtgtccagctcctctttggaggctgtctccttgcacatatctaactcctcacaagttcctggttaaaagtatgtctatttatatagagacaactcaaagaccgctttgctctcttcagtgcatacctgtacatgctggcggggcatttcaggctcaggtccttggtctgcagcagtcatagtcagaggccccacccgactacagctatgtgcagaccttcccgtccttgaacacccgcatgaattctctttgggaacattgagtctacgtctgtcttccaaactcagtttttaaagtgagggtgttcattgtgtgtgttcacagctccccgactgagaaatacctggtcaaactagatcatctagcagctgcgtttggtttgtggaagaatcgagcccgatgcaccaagatgtgaccgtgcacacataagagaaaggaaaaccctaggcccagactcacagctcctccccactgcgagctactctgcctccaggaatttccactaggctctttgcccccctttccctattacactaccccaccacggcctttaaagggttaagagaaacccccacggccttccctccacccagctcgctgggcccggaggctagctcgctcactcgcagctcacagagtctgctgccatctccgcgcctcccccccctccagtccttcagccgggagggagcctgcatgcctgtctagaccgatctatcaccggcacaccaacaacacccgcgagagcgcggagaccctgcccaggtcccccggcccgcacggttcacggcggacagaacccggggagcgtgacggtgcctgcggggtgggggtagggggcccacaggcactggccgctccgagcgcaccacgggtcctctccagctccggccccccgcgctcccaccagcccggctgccggggcacagtcacagctccgcgcgctgggcagtcctatttttatcttgtctaatcctaaactgggcggggagcacaggcgtcgtgcttagagaacaagagataggcgcgggaggcggggaggagcagccaggcagcgacgcgagcgggagcgagttaaagacacagtggaggcgaccgcgggcaggaagaaagagcgggctgcgcgggcctcgaggcgccgcacgcaacgcgccgccccgcgaagttacactcgcttccccgccgtccctcgctaccggcccctccccacttcccagcggcgctccccgcagcctggacagcgaggccccggcctgtgtgggaggcggaggccaggacggccctgcaaagggctggagagaatcgctaatgagctgtgcagcccattgatccggagaacacttcctaattaactctcagtcacctactggtgacagcgcctcaaaggacagcgctggggccagccgagccccagccgcgacttgccggccgggcgcctgctgcccaaaacccgcgcgctcccctaaacaccccaaggcaattggtgtgcgtggcggtgtatacccgcacactgaaggccagcctcggattaaacctggatggcatattaatcatcgccttccccccccactccgctctacgcgctgaaaccctgcccaaaataaacacgaaaaccaacactgcaaaacccacaccagataacaggtcgagagaggagtgggcagggtcaaggaacgagcgtattccctaagtgtccacgtacaggaatctttgaggctgacaattaaaatgccttccacgcaagcaattctgttggcaaaaccgaacccaacacttcgtaaggattgatttcggcccgcggtgtccgtttccagtgccacaggaagtgtcagatggccagaaatacccaagtctgtctgcactcaccacccaccaccttctggggtgggccatttcctcctagtctttactcccaggccattttaaggatctttctccaaaagactacccctagaaccaaataccacactacccctcctctagcgtcttctcaaaacgaaaaaagggggggaaaacacagctaaaaccccgagctgtctagtctagacgcagcgaggctgtgcgaatacctatttgaagcgcgttggtttctttttaaggtttgtttctaaatacacataaccctcctccttccttcttcgctcttccattccccccacccccaccctccagacgccggcggcgcgcgccctggcgcgcgggcactcacagcctctagctggagatcgcggactttctggaaaagattcattaacagcaaattacgcctcgcccggccacggcctacacgctgccagactcgtccgtctccgggaccccgggaagggcccactcgagcgtgcgagcggcgggaagcccgccgggaccacgcgtgacttcggccgccctactccacacacggtgccccaaggctctctccgtaaacagcaggcgctcgtcaccgccgccgcgagcccccgagttggcggaggctctgcggcgcagccgcccgccggctccgagcgcgggccccgcggcgcctcgccctccccgccttggccgaggatcttgccccggtgcgcaagttcctcttcgcctacagcctccttgccacacgccctccgagtgggaccaacttcctccggccgcagactttcacacgcccatcagggctacccaccagactccccattgcccagcggagggcccaggtctcgcccgcccccgccctccctccacgacgctgcccccgcacaagcacattctacacccacccctgggggctcataacttaaaacctacgctgaacatcggggagggagaggagggggaaagcgggagggggatcgcagattataatcttaaaagaacatttacaaaacaaagcgtctgacctggctggcgggcgggccaagtcggaaccccttgctctgctcgatttcttagtagtttttttttttaatccacgtgattcgtgctttggggcaagccaagaaaaaacgggactcccctcccgagttgcgcggcagcggcggcaggtcgagctcggctcggcccgaggcactcgccacacaccctcgcgcacgcacacgccgacgttccacttggaggaacgaccggcccccggagaggcgagacgaggcggcggtggcggcggctgggggtttttacagttctttcccgagtcgaaaaagaaagcagacggcaacccgctgccctccccttcctgctcgcgagctaacgccgaacccagcttcccagcttccagcccacctcccccccctccgcccgactcgcggcgctcagcggcgaccgcgctcccgcgcacagacacacacaggctgcaaacttccactctgcgaactccctgctctcctcctggcccaccgggaggcgccaggcccccagccgcgccccctccctccctggtgcccacgcggggccgcttaggttggctgcattttaaataacatagctatgaaataaaaacgaaagcgagccaagcagccaaagggaagcgcgaggcaaaagcttcgcggggtacgctgcgggagggggccccgggagagggggccgactgcagccctcagcgcgcccgcccgcccacccgtccgcggtctcccgggggaaaggtgttccgggcactgacctgaaatccccggtgggggagtaggcagggagcctgcgatccggctctttgaagttttcccccaagcggactcgaggcggcgagaaggagcggggggcggttgggtgggtggagagagatatgaggggtggggggggttggcgacgttaacgagcggagaaggagccgggccggagaagcgcggcgagcagcaaagtttgcggtccccggctgcccgcagcccgctcgcggcgccgcgctcactcgactccctcgccgtctgctggcagccggctgccctcggggtcggccccgccgaggggtgggctctgggccgggtgggggcggggcggggcgggctcggggcctccgggcaggtggcgacagccccgtgcgatcctccgggctcccgcagctggactgggcttggccgagctcagcagctcccgcgctgccgccgccgcccgcgctcgggcaggagccccagcgccatgttgacggttcgccgcgagcgcccgctcgggctgggtgtgtgtgagtgtgtgtgagtgttggccaagtcgtccctgcgcggcgacagcgcggcttgggctctccgcccggcggctcgcgggctccccctccgccgccgccgcccgcctagctcccgctctcggtcgcggtctgggctcctgcgcgtctcccccgcagccgccgagctcggcccgcgttcagcgaggagcgcagctctgcctcaccttgccgctgggagcccaggctccgtctgccgccgcacgccgcgatcccaacgcgtcccccctccctggttccctcctcttcctcctccccctccctccgcccgtcctccctcccgcccgccctacctccctccctcccaacagccgcctcccctccccccgcaggcgcagcgctcgggcgacagccgcccgcccgccgccgcctccagctctcgcaagtttgagctccgccagtctccgctcaccctccgctgcggcgcctccgcggcggggtttcgggaggggtgattccccaggaaaggtttgcccgagtttccccggccgtcatcgatgcacggcccggcacgttttggcctctctggatccgaaccccggaccacttgggtggcgccccccctcctcgtcccccggcctcccctccccagctcgggccgagttggctgcgcacgcccgacccgggcgcacgtcctgggcgagccggagaccgacttgggcggcggcggcggcgagggctgccggcagagccagagccgaagggatgggggcggcgggggcggctctcccagccgcgcgccgagactcccctcgctacccagaaggccagtggaggaccgcaattaccataaagcgcctcgcactccgctcagccaaagctgtcaaaccccagcggcagcagccgctgccgccgcctcttgccaccagcgctgcgctctcccggcctcgtcccctccgagacccagcggagcgtggcctgtgtgctcccgtgctcacccccaccccagtttgccccttcctcccagaggagccctttcccatttcggtgttaaaagctacctgaaaacaccaccccaggcaacggtggccgttccgcctgaactccgcgcccgagttccccggacgtttcaattgtgtgggaattgtttggaggtgggggaaggggggagcagcccgtggaggcaccgggaggcgtgtggggggcggtcggcgagcggagatccgcctgtatttctcccggttctcgagcattttcacggtctgtacctctgatggttggaggggctgcccaggcccctcgccccggcgttgggagattatctcccgcgttttattttccttgacagggagcaacttttggcttacaccgttcgccccataaatttccactcggtaacgtcgtgctgatcggtgcttggcggcggcgtacagcctgcgcccgcagcagttcaattcaattgacacgtattgagcttctccagcgcacccggcgcggctctgggcgcggggggagggcgggggcaggcgggagggagggggaagcggagaagcgaggttccggcctccccggagcgcaaagcctcaagggcgagccgagaagccctagttggtgaagctggcgggaaggggtaggagtgggggagggggtattccggactaaccgcgcccagactgcgggcccggacttcgcggccaatggtgaccccattcggctgcccactagggtctttttatactgggaagggggtggggtgtctctttctgcctaaggacaagatggtgcaggctccatgaaacataaatctgaaatggaggtggcttgtaaatccacacggaaagtttttaaaatatcctggagtgtccccatgccaaaaataatcaaaagcatctcaagttgattactaagtcaaggtcaaggccaaaatcagctctagctagcagatattttcccttttaaaaattagactcactactgactgtgggactggtattaggtgcgattttattcattctgttttagttctcagcacatagttataaaaacagcccttctcaaagcagaagtgaaacatctctaccgtttgaaacccgaaacttcggcagaattaaatcttcatgctccagagctgcttataacaactgatgcaaaagacaggcgagcaagtgcccccgcgagcagtgcccagccaggctgggccgcgaacgcttccaggaccagcgcctgcagaatggaatgcacgcttttttcttcctggtctttctgggggtggatatctctgcaagccaacccacacatttttttaatctccggtaacaagcagaaagacacctggactattatgctgtaaaactattttttataaagacattttaggaccagacattaaaagttattagattgaacgcatgcgagttacagacacagctggagaaaaggcctctggttgtgtgttgtggcaacatttctttttgaagcgactccttttattcaaaacaagtcaaaaataaccgggaaggctgaagctgggtatttgtggggaaactctgaacgtggttccaggcgaggaggccgctctgctgctgcaggctggacgggagaactggcctgggccagtgtggagccgtgccaggctcttccggctcggttaggccgaaccgcagaggccctggcccggcgcccagccaccttctatcccctcccctcgtctccccaactctgcccccaggcacaggcttttctcggagttcgaagtcgcatgtaaacgtccagaacttttagaaaatccaggaaccgagctcggggcctgcagcctctcagagtcttacggcctcccggggctgctgacaaagaggcctgtttgtctaactttaaaagtcctagaattcgggaggctgagccaggagaatcgcttgaacccgggaggcggaggttgcggtgagccgagatcgcgccgttgcactccagcctgggcaacaagagcgaaactccgtctcaaaaaaaaaaaaagaaaagaaaaagaaaaaaaaaagtcctagagttaaaatgaacaggggtggtgggggtgctgtaaatgcgaaggggccgaggggagggctgactgggggagaaatttgatgctggagacaaacaggccagtaaattcgcctttgacgtaatttgcaacatcctcccccaccttttctagggatcttgcctccacggtaggctggtaggattaaagggtttctcctccatctcctagggatacatttttcaactccgtgggatttcaaaaatatcttattaagggagtcctaagaggcatgagtggtgggggggattcgtgactcactgggaattaaaatgtgggattttcccgaggcgctataaggcagagggggggaggggagattacacctattggcccggttagttccaattgttctggggaaaacaagcagaaagctgtcgaagggcaatcccatcttgtgtcctcacttaagaaggggctcagggagctggggatgccgcggggcctgcaatgggtgccggcggtttggcccttctcctgccccctcctctcctgccctcccacaagcccttcgggagctgacccgggggtcaggctgctatacccagcactcagcaaggggaggatttcaatgaaaacagaggaggaggagagagtgagcaaaggagtgcatgggaggggaggccgtgcagcccacggagaaataaagaaataggtgccgaaatgagaggtgctgcggatggagcagcgggggctgcccctccgccaccaatctcccttcccatggaagtgtctcctgattataacaaaccactcgacctcaggctaaccaggccctgcaactgggcaatcgagctggcccttctaggagcaggccttgagcctggctgcccttctcaaggcaggttgactctgcaagacccgctagggcctctcccacacacctccagctccaccctggcctaggggaaaggccaggcatcctgtgtttggggggaccctggccttctaaccttgtgtgcaagatttatttataacgtatactaggatccacatcataaagcttataacgtatgtgtaggcttccgatggtcctcctcggaggctgttctcagggcgatgacacttggtactggaacaggtgggactcggatgagtacagataatgtatttttacataatgtgaggtagcctttctttaaaaacacacccacacttatagtcttctggtcactttgtacaagaactctgggcttatccaatggcactttaaaaaacatccgctgccccatcctccaagcacaaggcacagctggcttcccctctgaaactcaaacgaggtaacaaacaggaggcgcatcctcctcccaggatttcactcatctggaaacatctaaaggtagctgcctcccagggcagaagactgctggacttaagggtcgccaggctgaacatgactgttctttcttcttcctagcctttggagggttattgggtgtttggggaaggaaggccctaagggcagcctctccgtggttcctagcaaccatcttggaatttctggtctgggctcgatttgggtcaggccctgagctccccgaacacaggcacgtgtgggtgaactggcatctacactacgggggcccgcagggtggttgggtgtcgaccaaatgggcataatacaggaggcttctgggaggctggccgcctcttgcgctcggcaagggcttaagagccctcgacgccgccgcgctgggccgggtgctcctgcagataaacccggacgccacgtcccgcctcggctgcttatttagcaaggcgccttctgcgcatattttacccggctgggggcagtgagtgggaaccgccgggagagggggcggggaaccaccaactactcgccttcggacccagtgtgccggcctccggccccagccattttgtatccagcttccctcctccactcccaccgggtccctgcgaagacgcaccaccccgaaccccttcgcggtaccactcccgaactggaggggtagagaaggctctgccagcccctcgcctgcagcaggaaggtgggtacggaccagcagaagggaaagcggtgctgatctgtctctaaatacctctgccctcccgcccccaacaaagtcggtcacagaggtgagtggcgcgggatggttgcctcgagaaggtcgcagccaggagcaaagctttggggctcacaacggactgggcattccaaacggtgtaatcttcggcacatttcacccgctcccattccaccttccgaaccactctgctctcggtgctcatcctcctctccatacctgcgttcccagcgcgttagcagccgcgcagcccccggccctgagtgcggggggtggggtgggggggctcagggtggtttgtgtggtgcggcctgacagaaccttctgtgtgcggcggagggaggaggctaatgcataatgcacagcgcctggaagcccggccattagcggcctgtcggtgacacagacaaacgactgagagggaggagatccagctcgctctggagtttaaatagaccagcgtggaggggaaacgccatgatttaaaagtgtgtgtttgcagacactcgcatatattttaatgatttccagcaggctatgtgtcctagccttgcatccccccctccccaaaaggaggatgtgtctagaggagggaggatgaaggcagagtgagaggcctcaacccagacccaccagcagcttttgagagatgaaggaggggagaagttcagaaagcgaggcctggggaagccacacgacccaaggccaagcccagattttgttcttaaaataataatttaaaaaaagagccacccagccttccaccctggactacaccctgtgttgtaccagaaaggcctgggggaaagaataaattctgccacccttgcttcccccgggagcccacatttttgaatcttccttttccactgacactccagagacctccttcctcccggtttaacacactagtgttttttagcaattaaggcgagaagggggtggggataaagataagccaatttttttttccgccatgcaagtgtgagagataagataacgctaagctggggcaaagcggctgcttacaacctccccttagcgattttgatcggtcacttcttatctcgcaaaaatgctcttttcgaaaactggatcaaaaaagaaaaagagaaaaagaaaagaaagaaagattttcatttggaagtgacatttaaaacccacctcccctccactgacaacccaccccccattggcggggctccccaggaaaagtcgcacctcgactgcaggatttcaggctttctcgcggggggcaggattactagtgcaattaggctgaataaaaccagggatgcgtgatgaggatttatcctgtatccaacccaagctcgcggctgggttttccttctcttagttactggtcgatgtttgtgtttcgccatcgcactcagtgccttcaaactaaacaggtagttatacttgggagggtcatataactatgtcaacatgaagtggttgttaatgcgaaataagaagaaactcttctgatatttataggcccctataaagggagagaaaggaaatcacactccctagaacccgaaagctcccagccgaaccggaccctcggggagttttagaaatccttctttccgcacaggaatttcgcgaaggggtttccggaagactttgtcgaggaaggttttggtatcagactccacgacctcagagcgccctgcaaattccccccggcccagtggctagccccagaatgcaaacctcaaggcgggcgccccagaccaagctgacctagcctctgcccacccccagctcacaaccccgaggctcccaccccctgcccccgaccgggtcggcaccgtggcgtccggcacatgccaagtctaccgtctccaagccaggctgcaagatccaaaggttggggcctgccgcggacggattgtccctggggagctgaaaccgcccagcggggaaacccctcctctcgcccttccccgaaaagcttggccgcggtctaagctccgagcaagcgggtatccgctgacagccgggcctcacgtaaggcccacacgcgtcccattagtcagcccgagttcccctcgggcgagccgcctggcgcggccccaaggccgggctcaggcggggagagggtgcggggccgcagcgagctgcgggcggaggtgcgggctccgcggagcccggccaggctcggttccgcgttcctgggcccgcgggtaagctgagtcggcggggcaggccgctccctggctggcgccggggcgccaagctgcgcttcacgtgcccgccatatcagcagcagcggcggcggcggcgaggagggggtgctgggaggcgcgcggccgttcccgcggggtctccggaccccgcctccccgcccctccccgtgggggctgggccgagaccaccctgcggcccccatcccagcgcaagccgaaagcggcgctgccagacgcagagaggctcctggggcgccgttccgagagccgcgcggcggcagcagccaggggagggtgctcctcgcggccgccccgccgccgccgccgcagtcacggggaccggaagccctcgcgccgccccgagcggcctccgctggccccagggctgttccagacgagggctggccgcgcgtcacccctgatccctcctcgccccaggcgaccacccgggccctgcggtatcccggtgtaagccgagaggacccttcctgcggtccgatgagatgtccctgtccctctgctaccaccataagcacgcccccccgcaccgctcgcagctccgcagctgggaccggaggggcgcggagccgccactccggccgggcaggaacacctgctcccaggccctgcagctgggcgcgtgctgctgtgagaggctgcctactgttgtgtgcagagatcgcggaggagaaaatagggctccgaagctcagggccaggagcagccaagcctcggccacccccatctcccacccactgcaggcgacagagcgcgaagccagagggcctgctgggggcccgggtctcctttcgaaggtcgaagggccgccacccctgggatccggcttctggcctgaagaggtcgttcataaaacagatggggcaaaacctgttttgggagccttcccagtgtccgcccccgctctccaaaccagacacactcatctccccctcagccctactctagcctccggcgggggacgggagtaggtcatggcggcaccggtactccacccgcccccctccacgtagggacgtagggtcggctgcggggctcggactttgccactccacctagggaagggccaatggacgctccccgtctcctccgtgtccggaggagatccggcggcggagctgacctgcaaggcttgccctgcctcacccaccccccacctccgtcccaccctccccgactctcctggcccagggcccggcccgggaaggcgttgttttgccagcgggagccgagcgagtgcacagagaaaagcctccctactctaatgagagtgcacacagcgctgcagcgaggaggatgattacccggcgggcggggggcgcgggctcgggccgcgggcggcgtgtgcggcggccccgcgggcccggagtccccgcctgtctggctgctaatcgcacgctttctgctgttacggaggcaggcgggagccggcggccgagcccagcgccgacgactcggcgggtgacacggaaacatggcgcagcgcccctcccccgcccgcgctcccgcctcccgccctccccgcgctcccgcctcccgcctcgcacttcctcccgcccgcgcggcttttgcagttttaatgctctgctttcggcctggcaccattacgctagcagccgcttctccgcggccccgcgcgtctctttcccctttgttttcggggtctatagaaaacgtttgcttttgtcccgagctctcgttaaaccaaacttgtggtggcaacggaaggcggtgcaggcggggaggggtccggggattttggcagtagccggccagagcgtggtggaaacttctctcgctgggttctccgctccctcccactccccctccccaacacagagccgccggcctcccgacgcttctcccttcgcccccgagaggccccagtgctccaggaaggtctgggccacagagactgtgaccaggggtgaagaactcagagtgcgtgtctgtgagccccgaggttttggcactcgatgaccttgctccctgcagccccgacttacctctttccctttggtcattcggggctttgtatcagtcggtgaagaaggggagggaagagaaagtgtttctttcgtgcgtgtggtttttattttaaggatttgttggaatctgtcacccccaactgcacagccccctcccgtataggatctagggcgaaagcggggaaacgtcggatttagggggaaagggtcgggtcagaaacctagccctggaggctggatcgtactctcctggcgggctcagccacacttggtcggcacgcggggcggggcgacccagcagagtgggggacgcaagggccaggtccctcggtccaggagacgccaaacgttccaaccttggagcgagagagcaggaacccccgcccccacccaagcgcgcgcgctccctagctcgacgcgcaagccgtggctctccgcgccagagctgctcaggcggcaattttttaagcctgcaattaagcgaggcgtcgccgtgtcctctgctagtgtcggtcctgtcagtcgcacatggccttggtgctccggtccgaggccccgcgattagtcacaggctcgcttcgctccttccctaatccgcctctgcaggcagcctggggacgcggccgacttggcggcgctggcagggagccactgcccgcggggcgggcctcctgaccagtgccagccccgctgcgcccgagccggcgcgggccctggggtgcgggtttggcgcccctcccctctcacagccccctggctggggtggcggcgcccctcctcctcccgcccctctcccgggcctgcgagatctatttgtgtggtgtcatttgcataaaaataggacaagtgtttctgtgcgttcatacgcgggaggcgaaatccttattgatgtgtctgtgtggagccttcgattgtcggagcggtttgatttagggtgtttgtgttgccttctacaagaaaggagagaaagtccttctcaactccttcggcggcctgggcccccagaagcatgtccctctgcgcggccggaatggtccaccacttgggccccaagcgcgccggatccacagcgagcaggttgagggccaggcgggaggcccattatgactcataaaatcgggcggcctaatcgccagctgccaacccatttacatgtggagcttcccaatgctcccttcgcccgggcccggcttcctgagggtttgccccgacacagctagagccgccaagtgggagctaatctagtggcctctccttcccgtcggcagcgtggcttcccttccccggcgacccccgctctcttggcctactgcgctgctcgccagcaactcctcagcttggacaaatagctgggagggcgccggccgcgcggagccagtaaatcaatcattaactcccaagcgaggcctggaccaggggagggagcggcggccagagccgagtccgcgaggcgagcgcaaagcctccaccggggttaggagccacccacgcgccaacgaaccgggtgcgtgaaggcgggtcccgccatggcctcccgggcccctccagaagcctccgcccgccgggcctttcaagcccgcaccttgcctggccaggcaggtcgcgttacagcgctgcccctgggagagcttgaacattaacgagtcgcctcgggcctcagcggcctgctctccacaggagagcgtcccgcgcttgggcaagctcctcggatccggccgggctcctcctggctcaggcttgctaaaccaaactgatcgcaccctgtatcgaccaatctccctgcggcaccctcttccctcagcccacggtggagccggcacgcagggggttaaaagccccggttcgctctggctcctcggctgcgaggagaaaacgctgatcaaagtgcttaaggggaaggtaacacatgcacattcggtcccgggtcgaaggaggccgactggagacggctcccgagccacccgcctcgacccgcttcccacactcccgggaacgcggcggcggcggcggccctggcccgcacgattcgctcggcggagcgctgcgctgctgggctgggagggcggcggggaggaggagagacgagggggcgggaggcgaacccgggctgcgcgccaagaggcccggagccgcagattagtcaccgctcggctctgcgctcccgggtgcgcccgggaaccgggagggcaggcgtcggccccgctcagccgggctccccggtcctcggcgcgggtgcccccacccccacccccgcgcgctcctggcgcggctggctcgactctcggggacccgcgcagccgagatccacttgtcaggtcaagggcaggacagaaactctgcaagcggagtcttgcttgcgaacaggaaatttctccttgatgaggtgctgcccctcccccacgccgggcttcaaaacaaaactccagagcgggcggccaggtacccagcctcgctcgccatggccggcgacctccgctcctcggccccggccccgggcggcggagccaagccaacagagccggcggacggactcggcgccggccccgcggagggcgccaggctgccaccctccggggcccggacggggtcggcgggggtgcggagccccggagcccccgcgcctccccaggttctacagccaccgagcggttttgcggagctgcccgaggccgccgggtcagcggctccccggagggcgtggggggcggggaggccgcgcggcgccgccgactcggcgaatcccgctgcgggagcccgggagggctgcgagctcggcctggcaaagttcctgtggaaactccatgttttgaaactcctgcggcgtcgcagaaggagggggagaggggagcgcgggaagcgcgcgggggcggtctgcacccgcctctccccgccggggagtgggttccgcggccccccgggcctcatgggaaagctggagggcggggacggccgggtccccgggcccgttcttttgtgtgttctctctctcttccacactctaagagaaatttataaacccgtttcatttaatgaattcacccgggagaggaaggctgcctttttagggaccatgatgttcagggtaatttcgtatttgacacatgtaaatacttagtactctcaggtaaggtcaaattatttatcatcttaatttatatttcaataggcctacaatttagaggcgagaaatgcctccttatgaatcattatggtctattaggggaagtaatgtataaacagcactatttgggagggaatcacttatgttgacatttaaatagctcttcaatagttaaaaaaaagacatttgagtgtctttgattaaatatacaatttacaagaccatcagcatagccatcaggaatataaattcttcttggaatttttatttatttccaatttttgaaaccttccagggcatgcgtgtcattgaatccctatgggggaaaaaaatcttaacatttcaggcaaaatattctcctctcccctagcttcctgtcttatcaggaactcagggaacttctggaactctgagcacacttcaccagcagggaccacagtgggaagtttgtagatcctgtacctctaagacaatcaaccattttcttttcttttcttttttttcttttttcctttttcttttttttttttttttttttttttttttttttttttttttttttttttttttttttttttgagacggagtctcactcttgtcgcccaggctggagtgcaatggcatgatcttggctcactgcaacctccgcctcccgggttcaagtgattctcctgcctcagcctcccaagtagctggaattacaggctcccgccactacacccagctaatgtttttgtatttctagtagagacggggtttcaccatgttggtcaggctggtctcaaactcctgacctcaggtgatccaccagccacggcctcccaaagtgctgggattacaggcgtgagccaccacgcccggccgagaatcaaccactttctaacaatattgcagccaatttgtgaaacagcacagcttccctgctggagttgaaccttccagaaggccagtgtctgtccatccatcctgatgttcccgcagcacccaacataggatctcacactgttttaagtcatcgtttcatacctgctaaaatatcaccttcttagaggcttttccttgctgcctccaccctcaccccccataccctttcttgaaaggccccttgttatacttctttgcttgaagcatcacccatctttataatgccccttcttaacctcgcatctcctttgctggttccctatttatctgtttccctgtacacctggacttcttgaaagaggtgtctccatccatgtggaatttctgcaggcttacctcatgttcactctaaaaatcagctagtcatgaagttattttaagacactggaataagtgcagctttgtttataacagcataggattataaacaacctaaagagtcagcagtgacattgatggcacatgcatacaatggaatattctgtagctgttaaaataataaagaagatctgctctgtgtattgatatggaaagacccccaaggtctacagttaaggaaaaaaaaataaggtacagagcagtgtgtaccatctgctacagtttgtgtaaaaacaaaataggggggaatatagacacatatttgtgtgtgcattaaagatttccaacactgcaggggagtgcccccttcccccccagtttctctgtagatatgcatgtcctctggtctactttcagaaatgggaacacactgcacaatctgttctgtacctcacctatgaaacttatcaatatatcttacttttctagcaacacatggagacaggccttgtcaatttccaggctggtggaatttcactgtatagacacatggtcatttatctcactcctcaacccctccatcctccctggccattctgcagaaagtgctcaagatcactggttacttccttgttgccaggagtgggggccggggtgggggggcggcgttgtttttcagtccttgccttccttggcctcccagaagcatttaccacaccatgaccactgctcccttgagctgcttgctcacagggttttcatcctagctgagaaccgctttcaatttctttgtgggcttttctatgctctaccagttgccttgggcctggatcctccccttcctccccaccagtctcatccaggtttatggctttaaataccacctacttattgatgacttacattttttttttctagttccaaatccccatatcaaacttcaaacttggtatctcaactttgcatctacgctcagcttaataacaatagcaagcatttacatcacgcctgttaggttgaagctctcttcaaagtgctttctataaattaactattaatccttacaactgccctataaggtaggcagagttattatgtacattttttccagatgaggaaactatcagagaagttactgaacattcctagaaaatggtggtgctaggattcaaatccaggcagtcctatcttcagagtccatggtcctaatcactttgccacactgcctcgttggcatgtgtctcgaactcctgacctcaagtaatccacccgcctctgcctcctaaagtgctgggattacaagtgtagcaccgcgcccagccacaactgaattctaaaaagaggaattaatttacaaatatttgggggcatttaataaatgccaggccttgtagcgggtgctagggaaacagtggtgagcaggacaaatgtctcttagatagagaagagcttttcctttagaacctgctctttgctttaactcccttccccatcacagaaaatggctcacccactcaggtgcttaaagcagaatcctagggggccatttttgacccattttcattcatctccccctcaccttcctccagtccactggcaaagctaacccattctacttccaaatagtctatctagtaagcctacttcttcccattttcctacatccacctgaggccaggccaccatcttgggcctggattattatacaggatgattattctagcaatctctgtgctgccacttttgctatcctccagtccacccgcaacgtggcagctagaaagatcttatttatttatttatttatttatttatttatttattttgagacaggatcaagacctcatctccacttaaaaaaaaagagtagtcaagtgtggtggtgcacgcctgtagtcccagctactcaggaggctgaggtgggaggattgcttaaccctggaaggtccagactgcagtgagccatgattgcaccattgcactccagcctgggtgacagagggagaccatgtctcaaaaaaaaaaaaaaagtgttgaatgtcactaccccactagttcccactgcacttagaacaaaatctaaatgccttaacaaggccacttcattgcttgccagtgtttagctcaccctctgaaggccaaccacacaggcctgctatcagctcctgaataggctctgcgggttggtccctgggaggtcacctccctcagcaagaccgtatcgtccataatggtacagtgtatcatcaccaggtgctaagcttgcatcagtgtgcagcgatgtacatatatccataatgttctcagaattttgtttctggctgtatgtgcccagtgcctagcatggtgctcaccacatattgatgaaaaaaaaatctgataaacaataaatgaagtattgcatgcctaatactttttttttctttctttctttcttttttttttgagatagagtctcactctgttacccaggctggaatgcagcagcacgatctcagctcactgcaatctctgccacccgggttcaagtgattctgctgccttggtctcctgagtagctgggattacaggtgtgtgccaccaagcctggctactttttgtgtttttagtagagacagggtttcaccatgttggccaggctggtctcgaactcctgacctcaggtgatctgcccacctcagcctcccaaagtgcgtgagccactgtagccagccacttaatacatttttgctaactgaatcggtattctatatcctggctagagaagaaaccaggttcaagagaacaagacagttgtggagagggtgctataggaaagggggtacctggactggtggggagtggctctgtagttctggtgaggattggggcagaagaaattaggaaagtgaagcataaggctgggggagacactgtcttttggggaggcccgtgggagtatgggacacctgtgtacaggtctctgtcggctggaggagccaagtgacctggtgtgcatgctggtggggaggccttgggagtcctgtccttaactaagtcctgcagaatatcatccccaggagatgagaaagccaaaaggaagacaaaacccaaaccagagccttcttagagtactttgcctattgccaatcatttggtccttaacttagtggcagaagattgagactgtctttctccttgagaccctaagaaaccagaagtgtaggttcttctcacagctgaccctgggcaattggagttctctgaattccatgccatttgacctctaacagtaactgtgtccctgcgctgtttttgatagcaaagcaagtcttttaacaatgaataattcctatgtgataaaaatagctactgtttattaaggacctttgttcatttcagttactttatcaggtacttttccaagttatctcactcacaccccaaaataaccctatggcttaggtattaccattcactttttttttttttttttttttgagttggagtctcactgtgtcgcccaggctggagtgcagtggtgagatctcggctcactgcacgctccacctcccgggttcatgccattctcctgcctcagcctctcatgtagctgggactacagtcacctgccaccacgcccgactaattttttgtatttttagtagagacggggtttcattgtgttagccaggatggtctcaatctcttgaccttgtgatctgcccacctcggcctcccaaagtgctgggattacaggcgtgagccactgcgccaaaacacatggctaatctaggagagtgtggctacggggattctacctgactccaaacctaggctctttcccatagggtatattgtttgtctgtcatgcatatgcactgtttccccaaacctttaactatttctgggaccagatcctacatagcttctgcaattgcatccttctgggcccatcctggcaactcgccaactgcagtaagtatcataaaaggagtttctttctttctgggatcagcaggcctcagctcatctgttgtgttcaccatgggaacctaagaattgatcatctgaatgaagagttgccttccttccaggtaagccttgaaaaagtgtggggccggcctgggctcggtggctcacgcctgtaatcccagcactttgggaggtggaagtaggcggatcgcttgaggtcaggagttcaagaccagcctagccaacatggcgtaaacctcgcctctactaaaaataaaaaaattagctgggtgtggtggtgcacgcctgtgatcccagctattcaggaggctgaagcacaagaatcgcttgaacccaggaggcggaaactctagtgagccgagatcgcaccactgcactccagcctgggtgacagagtgtgactgtgtctcaaaaaaaaaaaaaaaagtgtggggccaagatgttcaagggaaggacttcctccccagaacaaatagattctgtttgaaaaatacctgtacctccaccaatactaaattatggctcaatgtctggcgagattataagctaccttgccctttcatattcctgggcaacacttttccccgttttgagcttccataaagactactcttgtccttaccatgggaaaaggtagttcacgaagggataacatgggaagaactcatcacacagctcttctgaagcagaagagctcttgggatttgaggaaaagagagtcactaatgttcttcagctcctagaagaacaatagctagaatttattaagggctttctatctgccaggcacagttctaaacattttatacacattaataatctcatgtcatatagaaaactgtcctatatggctgggcgcggtggctcacgcctgtaatcccagtgctttgggaggccgaggcgggtggatcacgaggtcaggagatcgagaccatcctggctaacaccgtgaaaccccgtctctactaaaaatacaaaaaattagccatgtgtggtggtgggcgcctgtagtcccagctactcgggaggctgaggcagcagaatggtgtgaaaccaggaggcagagcttgcagtgagctgagatagcgccactgcactccagcctgggcaacggtgcaagactctgtctcaaaaaaaaaaaactgtcctataataaaggtactattattattcccatttcagatggggaaactgaggcttagaggataattaatttgcctgcttgcctggaagctcactgcccattcccaaagcccagacttattcatgccgtcacagcccctgccatcacggtgcaacactagcaactaaatttcggactttccaggcacctgtggtcagcttcattactctgccaattgcacaagttcatgctaattgggtgctttatttggatctgaaggcagtggccttactgcatcctggcatgcaaatgatgtcccctgaggacacgatgggcaatgaatttgtcctgcaggtccctgtgagaggccttttctcttctgtagcttcctaagcagaagctatggatgatccacagacagaaggtggtcatctctaacctgtcctgtgacaaagcatgctggtcagccagtggatgcccccatcggttccatgccagtggctgcaccgggacccctgcttgcaggcacagggaacccggaggagagaagatcagtttccaagataatttaggttcagtctttcttcaaaccagccattgtcctctgctctagatctgacaccgatgattaatgcgcctcgtatttgagtatttcttcttttcggcttcttccttgctttgggttttattttccagctgctgccagagtttctcctcagaagagagtaaatacagactggagcattgcccttggtgttgccctgaaagcgtcccaggtgtcagatcgcactgggccattcctggagtaggtgatgttactgtttagagttcagtgctaacccaccacctccaccaatcgagacctaagccgttaattattctgaaaataccaaaaataaagattgcagggaaggcaattaataggatcatacggtctattcctcatttgtaattacatattattatttttctccctactttgttccaataatgatttaaggctgcttccaaagatacacaaaacccagcaaagataaatagaagaagtggaatatgaattataatgtcatgcctgctcacaacatctctgccccattccacataatagaagtgaattcataacgcctttcaaaaatgaggtaattcagctattttggtggcaacactaggctctttgtaaagtgaaagggtggtacacgatcatggaaaaaccatggaggggacactcgatcccctttctaatgcttgctttcttggtgtgtgaccttgggcaagtcgctcaccctctctggacttcagcttctgaaactctcaaatgtctctgccaatccctgaggcttcctcctctttctgacgtccaagggcaccatcaagaaggcagaggccagtactactgccctctggcatgaggcttcctagaactactattcgagagatagtttcccaggaagtatactatgctcgcactctttctctctctctctctctctctccaccccccccaccccttttcctccctccctatctgtcttctctctaacacaccacaggcacagagaagtctttctggatgactgagataatagaactgaaattgtctcctcccccaaggcaaggaccccccctttcaggaaagtgactttaagggtagcactgaggggatctttttgggaggcggggagtcacaacccttctgacctttctgtcctcccctcaggtgtgagctttcactttctttcctcttcttgcagttcaagacattcttttatttattttatttatttttttctgagacagagttttgctcttatcccccaggctgttgtgcagtggcgcgatctcagctcactgcaacctccgcctcccaggttcaagtgactctcctgcctcagcctcctgagtagctgggattacaggcgcccaccgccgcacctggctaatttttttttgtatttttagtagagatggggttttgccatgttatccaggctggtctcgaactcctgacctcaggtgatccacccgtctcggcctcccaaagtgctggaattataggtgtgagccactgtgcccagcccaagacattcttacaacctggccgactctagatccagtcttatcttcccttcaccccctcttaaccgcatcttccacttttgtatccaggcagcatctaacacaatgcttagcatgtcatttgcttaaaacaccaatgctgtcctctgccccacacaaagtctccactgaccccctagttcctctactgagtattccacaggctacaggggcctcctgagactgggccctgatcccttgcctcaggtgggaggctgcttgggagactctgtttttgttgttgttgagacggaggctcgctctgttgcccaggctagagtgcagtagtgcgatcttggctcactgcaatctctgcctcctgggttgaagccattctcctgcctcagcctcccgagtagctgggattacaggcatgcgccaccacgcccagctaatttttgtatttttagtagagacagggttttgccatgttggccaggctggtctcaaactcctcagctcaggtgatctgcccaccttggcctcccgaagtgctgggattacaggcatgagccatcacccttggcctgagactctgttttttaagatgcaagcacacacaacaccttgcaaatgaaaagaagccagcctcaaaagaatatgcacaataggattccatttacatctagtttgggtgttgtttttttttttttttttggtggtggtgccggtggggggtggacagggtctcactctgtcacctaggctaaagtgcagtggcgctttgcctatgtcaagttttaaagtgggcaaaggttttaatctgagttgttataagtcaggatgggccaggtgcagtggcttgctcctgtaatcccagcactttaggaggcagaggtgggtggatcgcttgagcccaggagttcaagccctgcctgggcaacatggtgaaaccccatctctacacaaactacaaaaataagctgggtgtggtgggcgtgctgtagtctcagctactcaggaggctgaggccgcagtgagctgtgatcacagcactgcactccagcctgggtgacagagtgagactctgtctcattaaaaaaaagaagaggagtcaagatggagttatccttggagatggggagcacagtgggactccttgggggctgggaacactgcaggttgatctggaagctggttacatgggtgtgttaaaattcatcaagctgtactctcaggatttgtacacttttctgtctgtgtgctgtacttccagaaaataaaaaatagaaactaaaaaaaaataataaaccagggaggaatcagttttaaaactgcaatcacactctgggcagatgacctgatagcaggagtgtggggttgctctgagccaagttggggggttgggggagggcagtgtgctgcttctagagacagcaaggaagcaaattttgttaataaaatcacgtgaatagaagcaaacttactgctccacagttggggcggggggaggagcggggtgagagtgatgcgccaggcagatgtgccgtattggaggcttggcagcacttcatcatggcagccctaggcatggcccaggcttccagagtgaaagcgtggagttggcagcattaacgggttgcctaggcccccaccctgtcttcctcaccttctctgcaggaacttccactccagcctaaattgggttttccgctatgcccggagcagacacagcctttccccattgtggcccatgcatgttccctgcaggaatgccccttctctcttcctccccttaaaactgcttcttctccctggtccccaccaaccacctggttatacattccagaaacctgagaatcacccttgacctctccaatcccttcactccccaaaccgacccttcaccaaatccgttttcttttctctgcgcagttttaggagtccatccatttcccccacatccagcgccctgcactgcctagcacagcttctcacctacgccatggcaatggcctcctcactgggccccctcctctggctcctacccctctgcagtccatggcccccacagcagccaccagccacaaccacacccgcaaataaccactgctgctgggtgccaggtgctgctccaggctcccgacacaccccaggaaacaaaacaaatacctgtcctcggggtacttgtattccagaaggagagagatgggcgataagcaataaaggtaagaggtcacaaaattaccatggatggtggacagtgatgtatgccatggaaagaaaagtgggagcaggaaagaagcacctggaaggcagggtgtggggagaaggatttgcaggattaaggtgctcaggggaggtctcttgggaaagtgagatgtgagcaaagactcaacggagccgggggagcaagccaagatttctgaggtgagagttttgcaggcagaggcaaagccagtgcaaaggccctgtggtaggagactgcctgctgtgtttaaggaacaaccaggattctagggtggccagattgcaaaagaggaagaatgatcagacaggtaaaaggggggcgggggttgatcctgcagccagagcgagggtgctccagtggctttcactattgagataaagatggaagccctcagccaccctactgggccctgcccctcagaccttggctctgggcttctgtttccagccccttcccacatccagccgttgccaccgggagctggcttagatttgcgatccctccacccgcttcacttagtcattcacaactctgttcaaacagcacttcctccaagataccttccccaaacagtcatccagaccagtttagtggctcagcctcaccctctcaaaccaccctgcccttcctctacgccacaggcctccccagtgcacagccatctagcgttaaggctataattacttcatttggttcattgcaaatttggcagttgtttactctgtgccaagcactgtcctgggtgccagggcaccgtggagaacaggactgacaaggtccttatcctatgggagatggaccataaacagagcaaataaggtaactttagatgatgacatgtgccacacagaagatgaaacagagcagtgtggctgagagtagtgggagggaaggcagtgttagccaggatggcttgggaggcctctttgaaaaattgagctgagaaggaaccagctgcatgagtatgggggaaagagagtttcaggtagccgagcaacaagtgcacaggccctgaaggaggaccaaccttggaccacctgaggaagagaaggacagcccacatggctggagcagaatgggctctctctctccagctggaaacggtgctgcacacgattccagatcctctctggtctctttgtcatcgcatccatcccttgggcttgctgaccgttgaagctcatggcattcattgaatgaaggtgtagccatctcatttctgcccaaacttcgatcctgctttctccatgaactcttcccagccacttccagccctccaagaacagtctctcctctatacaaaaacctcagagccctcacttgagatctggggctggtctacttggggccggacacccctggaaatgctgtgaaaatggtggccctcgtgcacatgtccactttgccaggggtacatgcatcagagtcccagagggcctcagacacccaaaatgttgacgaaacaggactcccaaacccctcactctgcagatgaggaaactgagggctagagggtagaatgtgtaccctgggcctacctgactttctgtcaggctgccagctgccaggccacaagaactaccccatctggctgtgggaagccagcctggggtcccttgttggcacttggtgtctcggagactgttcccttctgcatggttgtccttgttttgatctgttaacgcacagtaagtaccccatggtaggtcaatgtcttcccttctcagattattccttgagggcacgatcaggtggttggttttctttaatgttattttactccttactttgtgtctgcacaattcctgctgagggactccacaagtactggctgcccagtcggctccttcttcccatgccccaaggaccatggaagccgccactcggggcgttaactggcttgtggtcaggcctgtgactggatattcttagcagccttcggtcacccatcccgaaaatttaaactccccggtcactggggcttagatctctccccgccaagggagagatgttttctataatattttcaggcagtcagctcagtacagagccgagtgtgcttttgccatcaaaggcttaagctttgggggcaaggccgagcatcacactgtcgctacccaccactgccccgggcctgcctgacgagcgggactgtttggaactgcttagcatgatggaagcttttggccacatcagagccgttatcacatctgacctcgttcctgggccctggggcagctcggaggcctgggagtctcgggcacttactggccttcctgtagagatgtccactgtgggtcaaatggcaacttaaaaacaggcatggggattagagatctccatttgggccatttccttaacctgctaggtgaattccccttctaaatgcaactgtttctctcactttcaaggagataccatattcggcttgccatcaagctctgtgtgcagtggcagggagtgagaacaaggattgagaaggggtcttagggaccctccaacagagcaatatggaggggagggtggtgtatagtcagtaggggtacagcagtcacttaagcacactttttttttttgagacagtttcactcttgtcacccagactggagtgcaatggtgcggcctcggctcactgcaacctccgcctcccgggttcaagcgattctcctgcctcagcctcccgagtagctgggattacaggcatgcatcaccatgcccggctaagttttttgtatttttagtagagacggggtttcaccatattgtccaggctgatatggaactcctgaccttgtgatccgcccgcctcggcctcccaaagtgctgggattacaggtgtgagccaccgcgcccggccttctttttttcttccacactttctgatttctcttggggtggctacatctgcagctgtgtttttcctccatttatctggctctggaagtgcaagagcacagactgggaggagacgtgggctaggggaagagaaggtttcctggttgtgtgtgtgtgtgtgtgtgtgtgtgcacgcgcgcacgcataagagggttcagaggaagcagaaatgtttcctctctcccagcactaccattccaccaatccatagcaagcaaaactcaggctgaatgttcaaaccccatgcttttaaggatgccacatggtgagaaagggccaccatgtaatgaatcctgggaaaaggccagggcccttgggagcgggagaatgagcaccagagaagctgataggagaaaccttcagaatccccactggcctctttgcaactttgggaattgagagaactcaggggaatatggtgaactacggacttaagcggaccataaagattttgaactattggtcaggcagggtggctcatgcctataatcccagtgctttgggaggctgaagcaggaggatcgcttgaggtcaagagttcacaaccagcctgggaaacatagcaagaccccatctctatatacatttttttttttctttgagacagcatctcactctgtcacccaggctggagtgcagtggcacgatcttggctcactacaaccttcacctcctgggctcaagcaatcctcccgcctcagcctcccaagtagctgagactacaggcatgcatcaccatgcctggctaattttcttattttttgtagagacgggattttgtcatgttgtctgaaactcctgggctcgagtgatccgcccacatcggcttcccaaagtgctgggattacacacgtgagccacggcacctagcccttacaattttttaaaaaggttttaaaatcaattctattccacaaacacttctttttgagaggggggtctcactctgtcacccaggctggaattcagtggcgagatcatggcccactgcagacttgacctcccgggctcaaccaatcctcccacctcagtctcccgagtcgctgggactacaggcacacaccaccaccacctggctaattttttggtattttttgtattttctcaaattcctgggttcaagtgatccacctgcttcagcctcccaaagtgctaggattacagggccactgtgactggcccacaaacccttctgaaacaccccttacatatatgtacagagctatgaaaataagtaagacatacccttaagggaggccgccctgggaaagacattctaggcatcttgtggggagtgttgggtcagacagaggatggaggggtgtgtgtggcgtcgggggggcgggttggggaggagggcataaaagcacacgtggccagcctgctttgtcctgttctggaaggccatccagtctgctcaagggcagctgaacaagtgggaagagaggtggcaaaggcagatgaggtggtccctgcagcctgctatgtgccaggaagtgatgcattggggcagcagctccagcagctgcctggagaaggtggttgattatgggagaaattgactgtggagtctcactctgtcacccaggctggagtgcagtggcgagatctcagctcaagtcaacctttgtctcctggattcaagtgattctcccgcctcagcctccctagtagctgggactacaggtgcacaccaccacgcctggctaatttttgtatttttactagagacggggtttcaccatgttggccaggctggtcttgaactcttgacctcaagtgatccatctgcctcgacctcccaaagtgctgtgattacaggcatgagccaccacatctggacctcttcagtctcttctaatcactacatttttcctccctcacgcccaaccaagtgagtgagccaccatggaaatgtatcatccagcatcccagcttcaactcctccacctgaagccccaaacattgtgagcagagacaatccatccctgctgtactttatctgaattcctgacccacagaaatcaagagatagaatacattgttattgttggtttatgccactacatttttgggcaacttgttatgcagcattagataactaatatgggggtgggtgagttccctcagagctgtcacagctgagtgtgttcacagaagttaatggcaagcctagagggcacatgtctcacagcctccaggcagacagaagaagtcactaaagaatcatctgggagtcggccaggcgcggtggctcacgcctgtaatcccagcactttgggaggccgaggcgggcggatcacgaggtcgagagattgagaccatcctggccaacatggtgaaaccccgtctctactaaaaaaaaaaatacaaaaattagctgggcgtggtggtgcgtgcctgtagtcccagctactcgggaggctgaggcaggagaatcgcttgaacctgggaggcggaggttgcagtgagccaagatcgtgccactgcactccagcctggcgacagagcgagactccgtctcaaaaaaaaaaaaaaaaaagaatcatctggggctgggtggtggctcacacctgtaatcccagcagtttgggaggccaaggtgggcggatcacctgaggtcgggagatcgagaccagcctggctaacagagtgaaaccccacttctactaaaaatacaaaaaattagctgggtatggtggtgcatgcctgtaatcccagctacttgggtgcctaaggcaggagaatcgtttgaacctgggaggcagaggttgcagtgagccgagatcgtgccattgcactccagctcgggcaacaaggcaaaattccgtcaaaaaaaaaaaaaaagaaaagaaaagaaaaaaaaccacgaaaacaacaacaaaaaagaatcatctggctgggcacagtggctcgcactttgggaggccaaggtgggcagatggcttgagcccaagagtttgagaccagcctggtcaacatggcgaaaccctgtctctactgaaaatacaaaaattagccgggtatggtggcgtgcgcctgtggtcccagctacccaggaggctgagatgggaggattgcttgagcctgagaggtggaggttgcagcgagctgagatggcaccactgcactccagcctgtctcaaagaaaaagaaaaaaaaaaaaaagaggaggttaggacacacacacacacacacattgggaagaacatgtgaagacacaacaaagaaggtggccatcttcaagccaaggagagagatctcagaaggaaccaaccctgctgacaacttgttcttggacttgcagcctccagaacagtaagacaatatatttcagttgtttgagtcacccagtgtatgttactttgttatggcagccccagcagactaatctagggtggaatctccatctcttcctcgaggatctgagttggcatcatgacttgctctgaccaatagaatgcaccagaagtgacactgtgtgacttctgaggagaagccttaagagactttgtagcttcctgcttcaccctctcaggcagttctgaggctgccacgtaaggaagccagtctcacatacttgaggatgtgaggccacagggagaagagtgacagttcactgcagctgacagctggcaccaactgccacactgttcatgaggccatcttggatctccccacagctgttggctagctgactgcagctgcatgagtaaacccagatgtaaccagcagaggaacagcccagccaacttacccaattgtgatagaagaagaaattgttgctttaagctactatggtttagagtgttttgttacatagcaatagcaaactgatatatctcattgaaatatactctagaagagtttccatccaaaagtcttagaagcaagtctgttgactaggcagtggctcacacctgtgatcctagaactttgggaggctgaggcaggataatcacttgagcccaggagttcgacaccagcctgggcaacatagtgagaccctgtcttaaaaaaaaaaaattaaaatctggccaggagtggtggctctcacctgcagtcccagctactgaggaggctgaggtgggaggatcacttaagcccaggaatttgatgctgcagtgagctatgatcatgccactgcgctccagagcaaaaccttgtctcaaaataaataaataaataaataaataaataaataaataaataaataaatttaaaaaaaaaaggcagcaagaatactggggaagaggccgagcgctgtggctcacgcctgtaatcccagcactttgggaggccgaggcggacagatcacgagatcaggagttcaagaccagcctggccaatatggtgaaaccccatctctactaaaaatacaaatattagccgggagtggtggcatgcacctgtagtcccagctacttgggtgcctgaggcaggagaatctcttgaacccggaaggaggaagttgtagtgagctgagatcacaccaccgaactccagcctgggcaacagagtgagactccttctaaaaaacaaacaaaaaaacaaaaaagtatattgggttagaagccaggtgcagcggctcacagctgtaatcccagcactttgggaggccgaggcgggcagatcatttgagctcaggagtttgagaccagcctggccaacatggcaaaaccccgtctctacaaaaaatacaaaaattagctcggcttggtggcacacacctgtgatcccagcgacttgggacgctgaggctggagaatcgcttgaacccggaaagcagaggttgcagtgagcccagatcacgccaccgcactctagcctgggcaacagagtgagaccctgtctccaaaaaaaagaatattggggaaaaactccaatggcatctgtgcttactgattccaattctagggcacagcatagatgtaactcaggaaataaaagggagcagggaccaccttgcctgaatcatcaggggaaagaaaggaatacctccttttctttatctgccctccaataataagtggctccctatgcaagtcataccctcagatggctttttgtaaaaaactatgttgcccaggctggtgtcaaactcccagcctcaagcaatcctcccgcctcagcctctggagtagctgggattacaggcgtgcagatgtctattagtcaaatactctctggatacacaggcctagaatcaccatggaaatagctgccatttattaagtacctactatgtacttgttgcatattcaatgcattcccttattcaatcctcatggaagtacggtcaaaatgaggcactagtcacaactaaatgaccctattttgcacatgatgaagctgagactcagagaggttaagcggctctcctgaggtcgcagagctagtgggcatagactcccaaatggacagtctttcctcttagccaaggtgtgatgtttaaggaaggtgacataggagaacggggatctcagcccaagtgagtagaaacaggaaaagttagccgggcatggtggctcacgcctataatcctagcactttgggaggctgaggcgggcagatcacgaggtcaagagatcgagaccatcctggccaaaatggtgaaaccccgtctctactaaaaatacaaaaattagctgggtatgttggcacgtgcctgtagtcccagctactcgggaggctgaggcaggaggatcacttgaactcaggaggcagaggttgcagtgagccaagatcatgtcactgcactccagcctggcgacagtgagactccgtctcaaaaaaaaaaaaagaagaagaggaaaagctggtcacataatgggggggccaggcctcagtggcagggctggggccaggccaggtatataagtagaaggaagaactgtgggcagagcttccaggaaatgtcttagggagaaggggaaacagtccagacggagggagggaggagctgcggggccttagggaggtgggggttggggtatgggcgaaagctgtttcactgtcctttccttgggagcaggagtggtggctctgcctctaagaacagactccttgccgggtgcggtggctcacgcctgtaaacccagcaggcgtgggaggctgaggcaagcggatagcttgaggtccggagttcgagaccagcctggacaacatgacgaaaccccgtctctaccaaaaatacaaaaattagctgggcgtggtggcgcacacctgtagtcctagctacttgggaggctgaggcacgagaattgtatgaaccagtgagccaagatcatgccactgcactccagcctgggcaacagagcgagactccatccaaaaagaaaaaaaagaagaagaacagacttcacccgtgcagcaggcacctcctctaccaccctccgggccttctcctccatgactctgcctcccctgccccagcaactccctatgcacctgccctccttccctgtccctcttcatctaaatcttcaacaggtggagagcagcctgattaagggtgcaccccaattccctccttgtggtcacactatgaggtgggcacttagttactctccttttacaggtgaggaaactgaggcatggagactgaggggagggcagcctgcactatgacctatcctaatgactcaatctgggaggtttcccctggtcttcctggtcctccaagacccgctctgccagggattccggggtgctgactcacacatcactccttcaggcccatggtgtgagttcgtcaatgagatcatggagacgtgtgaccatttttagcccttggctaggtgtggggcacatagaaggagccccatcatgtgtcgcatcgctgtgcagctccaagcctacccctgtctgctctcagcaaggcagctgctgcatgtgaggcttggtggtaatgagggaagcatgtcggtggggaggttcaggagccccagaaggaaaagaagaggaccagagagagcaggttcctcggagtgctaaacacaggcccaactgcctttttcaggaataagggtgtgggccagaggggcaaacgaccccctccacaaatgccagtgaattgcagcaggcacataatggctcctccctcttgtgtcctgccttccaagggtaccctatttggcaaatcctacccactctggcagcccctggaacccagccaccctcttaatgcccctcatcctgaggcatctgtcatgcaagccaccccccaccttccctggggagctggcttgctggccccagtggtctccatgtgacctttcctcagctcctccactgtctccagacctgaggtgaagaaagcaaggtcagagaaggggcccactcatgaccgtgagacagaagacccacgccaaccaaagctgctctctttctctccagctgcccctcaggccaccattgcaacagatgaccctcctgggccccaaaccaggttgtctgacctgaaaacactcagtactcagccaggtgttcccattcggagcccagtgagcttgcacttgagatcaggcacatgggtaaggctgatatgggggtgacagtgaaccacagatcttgcagtcccaacctcctgagagagctgagctggtcagaatgagaaggtgctcactgcaccctgcatttactatccaaaaggactagaaatgactagaaactgagaaaaacaggccaggcgcagtggctcacgcctgcaatcccagcactttgtaaggccgaggcaggcagatcacctgaggtcgggggttcgagaccagcatggagaaatcccatctctactaaaaatacaaaattagccaggcgtggtggcacatgcctgtaattgaagctactcaggaggctgaggcaggagaatcgcttgaacccaggaggcagaggttgcagtgagccaagatcgcgccattgcactctagcctcggcaacaagagcgaaactctgtcagtaaaagagaagagaagagaagaggagacaagactgagaaaaacggtccctatggcccagtagacatgaacaactgcaagcgactggagacctggcacctggcactggctttaccctgttagcctccaggcctcaaattagaaggaggaggggaactcatgcttgtccagcacttcagcaagatcatctcactgaatcctcataacaaccccatgagataccgtggtggttttaaacacgcccgctagttattcgacactcttcccaccaagaggtgtggtctctgtctctacttctagaagtctgggtgggcttgtgactgctttcaacacaacagaagtgacactctgagacttgtaagacaaaggcagaagaagccatgcagcttgctcctggctctttttggggcacttgctctgagagaagtcagtaagaagtctactgccatggcagagactcacaacataggtgccacagtcaacagcccagcagagctcccagccaatagccagcatcaactgattgctacaggagtgtgccatctcggatatccttccgatggctgcagcccctgttgatgtgtgactgcaaccgaatgagatatcccaagtgagaagtacccagctgagtccgttccagaattcctaacccacagaattgtgaacaaaatcaaagagttggggttttttttgtttgtttttgagacagtatcactctgtcacccaggctgaagtgcagtggtgggatctcagctcaccacagcctcgacctccagagctcaaggaatcctctcaccctaatttttgtatttttgtagagacagggtctccccatgttgcccaggctggtctccaactcctaggctcaattgacctacccgcttcggcctcccaaagtgctgggattacaggcatgagccaccaaacccggccaaagagttgttttaagtggcaaagttctggggtaatttgttgcatggcactagtcacaaaacagatccgtggtgttcccacttgaaactgaggtgcagaggggctgaataacttgcccatggtcacacacctggtaagtggcagaactgagactcaaacctggtctctcagaatccaaatcatagccccttctcacggtgcccccctaacattttctcacttccaagaagagaacattcttttcagactcgactagtttccaaacctggctgtgcgtcagagtcagcagtggcgtgttaaagatagagatttccaggccccaccccaggcctagtgagtcagtattttcaggcgtggggccaggactctgaattctgaactggcaccccaggtgaccctgaagcagttagtgcgtgaaccggacagtgaaacccactgctcagccaggttattacagaaaactggaggggaccagcaaggttttcttcaaaatatagcagtttcagaaaatccctcatgatctgagctcatctgcttcaatttcttttttttctttttttcttttttttttttttttgagatggagtctcgctctgtcgcccagactggagtgcagtggcatgatctcagctcactgcaacctccgccacctgggttcaagtgattctgctgcctcagcctcctgagtggctgggattacaggcacatgccaccacacctggctcatttttgtatttttagtagagacagggtttcaccatgttggtcaggctggtctcgaactcctgacctcgtgatccaccctcctcggcctcccgaagtgctgggattacaggcgtgagccaccgcccccggccatctacttcaatttcaactttttttttttttttttctttttggagacggagtctcgctctgtcgcccaggctggagtgcagtggcgctacctcggctcactgcaagctccgcctcccgggttcatgccattctcttgcctcagcctgccgcatagctgggactacaggcgacggccaccacgcccggctaatttttttgtatttttagtagagacggggtttcactgtactagccaggatggtctcaatctcctgacctcgtgctctgcccgcctcggcctcccaaagtgctgggattacaggcgtgagccaccgcgcccggcctcaatttcaaccttcttggccctaacatctggggagtcttttctactcccacaccactaagagacagaaattgatgggaggctatccaaccagtaagtacactcatgtgtattaacaccttgctaggctctgtggtccctgtgctctaagaacttacaactgaagcgaggagataaggcgtaaagtcatttcagagcaaccaaatgataagttttgtggctgtgacaataagcacaaaggcatctgggagaattagactgaaatgtaaccccctagaaatttgggaggggctccgcagaggaggtggggcctggagctgggagtcagggtgagcagggggatcactccaggcagggggctcaggggctgaggctccctcccagggcagaacaagcaggagggcatgaatgggtagagggactcactgggctgccccaggggtgtgctctgtggcagctgtggaaccagaggagaggggaagacgaggaccagatcagagaggggtcaggggacttgaagtctgatccagatttttattttctcagtttccaaaagctactgtcatttacagatcaaggacatggtcaggcgtggtggctcacacttgtaatcccagtactttgggaggctgaggcgggaggatggcttgagcccaggagttcaagaccagcctgagcaacataatgagaccttgtctctactaaaaataaaaaattggctgggtgtagtggcgcacacctgtggtcccagcttcttgggaggctgaggtgggaggatcacttgagcccaggaggttgaggctgcagtgagccatgatcacaccactgcattccagcctgggtgacagaatgagaccctgtctcaaaaaccaaacaccaaaaaataaaaaaggcagtcccccttccaagtccaggctaggattagttacagaagatggatcaactcacacacctttggagccaggagccagaattctcccaaataagagactgaatccccatggggctccaccataaaacatatctgccccagtgccccagtctctttgcttacaagatgtaaaccttgatgctgctaccttgaatttttagacagtggattcctttgattagaaccactctgggcaacggtgatgagattccattaaccatcggaatcaattgaaccaagagctttccttcctaaagggaagggctaggttccagtacttggctgactgcagagccctggaggaattcattgaaaggaggcccaaaattagaaatcatcactttctgcagagacacttaggaatcccccccacattattcaaggacagcaagagaaaggtgggcagaactggggggaaaaggagctgcaaggaagaacgcgaatctttggccagctcatataccttcatacaacagatgaaggtgtgtcctgcacagcctgcgagactggctaaaagtctagcttttagtcacacctcctggatcctatgccacatctccaagacatgcttagaggtaagcaaggaaacttgctcggtctggggtctcctctgagctttcccacctgtacctttcctgcaagggaaacccctgtaggaagaaaggtctccattccatcatggcttttttcttttccttcttttctttttttttttttgagaaaagagtctcattctttcgcccaggctgaagtgtagtgacacaatactcggctcactgcaacctccactcccggattcaagtgattctcgtacctcagcctcccgagtacctgggattacaggcgtgtaccaccatacctggctaacttttgtatttttagtagagacagggtttcaccatgttggccaggccagtctcgaactcctgacctcaggtaatctgcctgcctcggcctccgaaagtactgggattacaggtgtgagccaccgcgcccggcccttcatggcctttttgtctctcagcattgggatggccggtggcccatcttcccaggtttcctgagattggcggcaatgacccagaagcctctggtgacatcataaaccatctcggggagggtaatgtaattattgcatggatttatttaaatttaatctaaaactgaaggtttcaacaagggtcgttttatcatttgatatatgtgtttgtatatataaatgtcacagctagagatacatagttttggtttgaaacacctgtttcagattgcattactcttcccagtgcttcacctccccctgtgtccacaccttttagaggtagagcatgcctcttcatcccaccgatgtcaggccacatgacttcttctggccaatagatgtaggcagaagtaacagtgtgcaaattttgagtcccggacttaagagtcattgcatttgcactctaccctcttgcacttttgccattgtcatgagaagaacatgtcccaggtagcccacttgtccgtagaagatgagggacacgtggagcagctttagatccaatccacacttggagtcaagccctgttgagcacattctagaccagtgaaccacaggtgacccactgacatgtatgtaggaaataagtgcttactgatgttttgaggtggtttgtgatacaacagtgttgtgacaagagcttattgatatatcgcctgagcacgttactcggtcaacccaaggctcatactgcacaacctaccatctaaaagaacactcgttctacctgctgtagatagaaataactaactacataaaagaacattccatctctctgtagcctcacacccttcttaattcttccgagtatttattacaacctgcaatattatatatttttattgctcatgtactttttctctccccagtaaaatgtagttttatgatgtccaagatattgtttttgttcctgctataaatgtccaaagctttggtaggcgtatggtgggtgttaaataattatgtgcaaaatagatgtctatggtcttttttctccttggttaatatgcctcttacctaatttacgttcctgtgtgcagctcaatgactttgcactaagcaaagttgaggaagaaaaaaacattttgtagaacaaaatatgcaaacaggagacctcccaattttgtccctgatgaagaatgagttcttcttccccaaagagccagtctccatggttggggcccttagaaaccacagcagacctccagaactgtggcaaaccagcaggtggctttgccagtgccatccaatataaccaagacgcagctaaatttctggataccgtatcaggggctgtcctcaaccataggaggtttctctgtgtgtcacttcactggggggaacttcaaagggacttatgtggcttccaagagctgtcagaatgtttgactctctggcattgtgccggcatcacacgttaattaaattatatggcagatacacctcaatgtcaaagtcagatattatagccgtcaaagcctaacattaggtgcagtattttatagcacagagtatacctttaaacaaattcctggccgggcacggtgactcacgcctgtaatcccagcactttgggaggccaaggcaggtagatcacctgaggttgggagttcgagaccagcctggccaacatggtgaaaccccgtctctactaaaaaaatacaaaaattgtcacgtgtggtggcacacacctgtaatcccagctacttgggaggctgaggctggagaatcacttgaacccaggaggcggaggttgcagtgagccgatatggagctattgcactgcagcctagataatagagtgagactccatctcaaaaataaaataaaataaaataaaataaaataaaatataaaataaaataaacaaattcctttatctttccccagtcctctcttgcctctggctcttaagacatctaccattctacacttcctatgtgaagaaaattccagacaactttgtctgttggggggccccaagactctctggcttgccagacagtggaggtttctggggttgcacctacttgctctctctaacccttgactttctgatctcaggcttttgtgagcctaggcttcaccctgagagagaagatcttaccggtctgtgggtaaaacaaatgctagctctttcttcaaagatggttctattagcagggcagcaactagccaggctataaaagggaagtggacggggggcgactttccctccaaatatctttttttttttttaagacagagtttcactcttattgcccaggctagagtgcaatggcgctatcttggctcaccacaacctccgccttccgggttcaagtgattctcctgcctcagcctcccgagtagctgggattacaggcatgcgccatcatgcccggctaattttgtatttttagtagagacggggtttctccatgttggtcaggctggtctcgaactcccgacctcaggtgatccacccgccttggcctcccaaagtgctgggattacaggcgtgagtcaccactcccggcctcaaatatctttttaataagcacagctagaaactctccatgagtggaaactggtcacaagaagcccctgctacttatgtgctgagcgtaggcaatcctctcaggcgagggacgactacgaagccacattcccggttttcttgggtctctctcatggttaccaaggaaaactcggaggccatcaactcggccaaatgacttacatgcaatcaccaaagcaaagttaataccaagtgtgtttaagtctcaagtgtccctaacacctattaagcactttctagatgccaggcactattttattatttatttatttatttattttgagacggaatcttgctctgtcacccaggcaggagtgtagtggcacgatctcggctcattgcaacctccgcctcccgggttcaagcgattctcctgcctcagcctcccgagtagctggggttacaggcacccaccaccacgcctgcctaatttttgtatttttagtagagacggggtttcgccatgttggtcaggctgctgttgaactccttacctcaggtgatctgctcgccttggcctcccaaagtgctaggattacaggcgtgagacaccgtgtctggcccaggcactattttacatgctttatgtccatcaactaatcctcccaacatcattaaatatattgtatcactaccctccatttcacagatgggggaagtaaggtggcgagagtaactgcctcaggtcacacagctggtcaagttgtagagccaggttttgaacccagacagtctggctcccccatactaactacgacatagtcttcgctatttaatcctgcaagctttaggaaatgcccactatgcacgaggcacactaataaggtgctgggggctgggaggagggggatgaacaagcaggcaacatgtctatgagggaaaagtactcctaagtaacagtttaagataaagttaaactaattcagacctttgaaggggttttgaattctttccaagggtaggcgtgttgaataaatataatgcttttgaaaacctgccttcatatatgggtgttcattgtactgctctttcaagttttctgtgggtttgggatttttttcaaaataaaatttaaaatatatatatatatataatatatatacatatatatatatatatatataatatatatacatatatatatatatatatataatatatatacatatatatatatatatatatatatatatatatatatatatatttttttttttttttaagcatcagccttaataggccaggcgcagtggctgacgcctataatcccagcactttgggaggccaaggtgggtggatcacgaggtcaggagatagagaccatcctagctaacacggtgaaaccctgtctctactaaaaatacaaaaaattagcccagcgtcgtggcacacgcctgtaatcccagctactcggaaggctgaggcaggagaatcgcttgaaccaggtaggcagagattgcggtgagccaagatcgtgccactgcgctccagcctgggtgacagagcgagactgtctcaaaaaaaaaaaaaaaatcagccttaatagactatcttgggaagagtaagcaataaactgggagcactggttgccttcagagaggcaaactgagtgactgagaaatgcgggtgggagaggcaccaaacatccttttatagccttagaattttctgccaagtgcaggtgttacccataacatctgccatgaacttgatgtcacctgggcggaccctttggagagaaagcacggaattcccagctcccaagtcccattcagcaggtcagctgctgggagtatgagggagtctttagtttcccagctttatgtgtaaagtgggcagaaacacaccatcagacctttggcttaaaaaatatatatatacctaagcggggtgcagtggctcacggctgtaatcccagcactttgggaggccgaggcgggaggatcacttgagcccaggagttcgagaccagcctgggcaacatggtgagacccagtctctacaaaaaaaaaaaaaagaaaaatgatccagctgtggtggcacatgcctgtagtcccacctactcgggaggctgaggcaggagaagcacttgagcctgggaggtcgaggatgcagtgagctgtgatcacctcactgcactacagcctcagcaagagatagatggagaccccatttaaaacaaacaaacaaacaaacaaaaaaaccaaaaaactatgcctgaggagtaataccagggattgctctttctcctggttttagtgtaagcacaatgaagttttcagctccatggggcttatctctcttggggagactttatgttctctaaggaggggcctgggtcttgttaaccgggggtttccccgagccaccccaacagccacaagcacagtgcaggacagacaagagaggcttgaacgaatgctagttgaatcactgactatgctgtgttcaccatccacgaaggaccatgtggtccaatatccttcctattcgtatgtgtgggtaactcttggagcatggatgccacacttatgacaagtgagcagtgattctcagcacagaatgtgatatttttctgttgcacaaagttaaacagtgaccgagtgtccacaattgcccaacatggcctgaagctgccagccaaggaattgggtcacccctggttcactctgaggggctgggggatccccgtcttgacccattggcaacccactcactcttgggaagctctgggtgaagggattttggaagccattccctggctctggaactagcaacccacaactagaagggggagggggtggtctgagagggctgccaaggggcagcagggcttcctggggcttgggcttgctctggggtgtgcccaggtttttggggggcgacggggcctgagcagtgggctgaagagggcacgctgccagctctggttggcccagggccagtaagtctgactgaacttgagccagccctgttggcccacagactctggaagctgaactgctccagcgctccttggcctctttgttttcacttccccacagctctctcttagtgtttaggaatgtgctttgaaggttccagcgtgtttcgcctctgcttagggaaaccaagagcagaggctgggcccaggccagatggcttgaggaagggcacctgtgatcacactgagagcgccccaaggggcaggtggaatgcatggggcacttaagctagcccccttctctgctgggagactccgtgtgcagtgctaaaccttggagattctcaggtttgttttgttaagggaggcagtattcccttaccagctcccccagagagcctacatttgtccaggagcttttggggataagctgtgctcttctgcttgttcagggcaagagagagagctgtagcgtgtgcttttctagctagaaaagttgcctccttcgttggcattagaataagtttcctggcctgcctagggcaacaaagtcaggccctccaaggaaggggaagtgaagatggcctctctcgcactcccaccactgggaggacaatcttacaggcgcaggtgcttagccaggtagggtttggctcagggaggccatagaggggtccattgctacaggttgccctctggcctcgatgcccacctgtaaactgctatcttcaagagtggaacccagagtggttggcttcctcctcccattccccagccccttcacccactgtctttcatggcctttgtcaccaggcacatataaaggggagagtcttccctgctcagtcctttgagggctcatagtgctggtagccccctttgatgccagcatagtgctttgcacacagcaagtgcttaataaatgccaaatgactaaaataccaggcctcttcagtgaccaagagcactctggatctttctctaaccagcagtcactttcctcctctggctgttttctgaagctgggagctctgggttctggtctcttttgccacaaacatgtcaccctgagctagtgttttcaccctctcaactgatttcctccactgggttaaacagagctcaattaaagccctggtggctcttgtatgacatctgcatacattcttgtttgccggctgtcattttagcttcaggttgggtcacttcgatcctgcctgggcccaggtgctagtagggtctttagccttcagctgaaggttctcccctgctcctccaccatctgtttggctttacaacacacacctagtccttggactcttgacacatctgttcctttctgtccccacggccatttatacagctccagctcctgtgcgtgagggggccgtggcacatgagcaataactccgatgccacaagggcacctgagtcatttttctgcagccaacactgtctggagctacagcagacctccctcctgctctgtggtgacataggccctgttcaggtatgtgtgggctatggatttttttcccgatttccatttctccttgatttcagcacccaagtgaacatgcactccaaggctctgctgagggtaaacagaaagcaccatcgcaggggtccttcctcctctctctcggaagattcactttctcttcctaggtaatgactgctttttcctcccagcttcctctcagcctacgtatatttagtgcacgttgccctggatagagtttaattaggcaccaatgcacccaggggcaaaaaccaaggacccctctcgggttgagcaaatggggccagcctcccctggctggtaaatgacgagctgagctgccggcaggtagaggaggttgtccattctcagctaatgatcgccttaggcgccaagtgatggaaaatccagaaggactggcgagctgcagggggcagccagggacaattgtatggaccagtttaacatggcttccggagggatggcagcaggaatgctgtgtgtctgtgtgtgtgtgtgtgtgtctgtgtgtgtttcctggtctcctttctctcccctccctgccgcctttccctctctcttgctttcgattttctcttctgtttctagcccacacgagttgaaattagaaaggtctttgaattcatttatttgttttaataaaagcagcatttttaagcagcatatttgtagcaattgattgttaaactaaacaccaagccaactaaatgtgttagggggaaatgaaaagtcagtttacaagaaacataattaacacgtcctttgacttctcctaagcctttgtctggctagggacaagacagaggaaccataatcaactttaataaaacgaaagatggtatcaaggccaaaggggaacaaaaaactttggagtaggaaacaaaagccaaagaggggattcttaagttataacaaatatgttaaaaaacaaatcttttggccaggcgtggtggctcacgccggtaatcccagcactttgggaggccgaggcgggtggatcacgaggtcaggagtttgagaccagcctggccaatgtggtgaaaccccgtctctactaaaaatacaaaaaattagccgggcctggtggcgcgtgcctggtaatcccagctactcgggaggctgacacaggagaatcgcttgaacccaggaggcagaggttgcagtgagtcgagatcgggccattgcactccagcctgggcaaaagagcaagactccgtcctgagaaacaacaacaaatcttttgtttcctaatttttggtcatcagccattttctccttaccaataggaaggctccggtttgaactctacctgttcatggggacagatgctgagacctggaggggaagagggaaggtggtacaaggaacctgcaggagactgcagtatcaggtggcagtatcaggaggctgataaatccaggctaatggaaattactattgcacaacaccagagtcttcacgtggcctgactttcaataaactgttcccctcctcactccttggagaaagtgaaataagacattagactttcagtaatctcatatggtgatgatcaatcgaaacctggagaagaaggccaatttatagaaattgtatctgcttcactgggtggctggaaccagggagctgaaaagaaaacggtgctcgcctttgatgtgtgaagttgccccaaaatgacaaacgccaaaaaacactggctatacatgtggggtattcaaagggagagggtactcaggagaggcctttgttaggtggatcattgcggggacctgaccaaagacacatgcacatgttcaggccacataaaagcgatttatttttcttatcttttggctattttaagttggagtttccatctttcttatttgttttatcaccaatgaagtttatttactgaattaacttttaacggaccctccactttgttcttcagagttggcttccacgacttgcgcctgtttagccaggattcctcttgcctttgtgaccgccccccctccccgccaaatcccaatcctggaggtgaacggctcagtctctgttaactccttgcctgctggtgttttttctctgtagctactaatcacctccttttgatcactgccaagttctcaggttgaaggaaggagaaaggacctcttgaccactctggctggctttccacatgagcctgaaaatgtcgacaaatttgaaacatctgccgagctgctttggtctgattgctaaaatatgccgacctcaacccccctccccccgccccttttaatctgtttcatattcacaaattaagcatttagtctgggtaataaatcaaggcggtttacgaggctcacacgagacaaacaagcgagaagggcgcaacacaagcccctggaagaggactgcacggagctgccaggagtcgggagctcccagcgctcgaacgcggagagcagcctggcgcgtcctgacacgccgccagcacccacactttggcaggtcccagagccggcggggcgcaggcgaacagctccggactgggcccacacccctggaaccttccgcgcgaacccgcggcgcccggcccgccccagctctgggcaactcagcccctccgccccgctagggagtggccgctggcaaaggggacaacctcacccgacacacaccctgtggtgggcccattaagtctctcccagccaagccgagaaggctgaatccccctcccccacctctaccatccggcagggcttggccttaaagatcccaggcccacactcaccagaaaggcaaaagagtccccgttcaggtccacgtgtgacctccactaagcctggaggctaccccctccccgccccaaactctccgtgctgcctcctcccaggtttcggtcccagcagccacaaagctactttcagattcagataggggtgggggtctcctggagagcggatcaaggtttaagagcggctggggagggtagcaaaggcacaaacagggtccaggccccctctgcagaaaccccggcccaggcttttgcgaccacccaaactcagggggctccaatctgtgcgtttcccgccctcccctgtgcagcagcgagaagcggacccggattaggggtctgggaccattcgcaacccacgagcttgggagaccccggtggggagggtggctccggggtcacctcgaccgggcctctgttgcccggctatgctcaagttccctgtcgactggcgttctcgatgctatcgtgggacgcggcggcggagaggcggagggcgggaaatcgggaagcctgaacatgcagcccaccccggacctaaggggaagcgtaggaacaattccccaccctgcaacacagtacacgtcgcccttcctcttcccctagcacacattccgactgcgaaagccattactgccggcgcgcgagagactttttaaatatttacagcccgctctccgcacggtagcctgatccatctcgtgggcgcggaggcggggcgcggggctccgctcccgcggaggcgcggagccggggctggggagcccggtgcctccccccacggccctgaggtcctccctgcgcccccactctgtttaacccccaggtggggagaggaccccgagactgcacacagcgcgcccggggccctgccggggcctgagcgggcgggggacagtgtccgggaggagggagggccgagaggctgatttaaaggttctcaccgggaagcgagcgaggcacagacctgagagccgccgcgcggtgaaatccgaggagctctcttggcgaggaggggctgtcagaggccatttatctctcgccagagtggaggctcagctcccacaccgcccgcgagtaacaatggcagcgatcagcagctctgcacgcgcttcagtgcatgaatggattgcggaagatgcctgcgtccgctccgctcaggaggctctaggagcgccccctccccgcccgccgcgcccgcccccgtggcctccctaggccctgcgggcgcctcggggttcgcaagctgggccctgcggcgcgatcactctcacccagaacccccgccgccgttcccagggccttggcacctcgccaccgagtgtcattgggggctgaaatttgacacaagccttcctggcctccccgacgcagacaccgctgtcagccccctcctttcttcgcgcccctagcccctggcggcaagtttactttcaaggagttggaccgtgtttccgccgcaaaggccggcggcgtgcgggcccgggaggagggggcgggctcggaacgtttccttcacctgctcggccgcctggggtgtttgtaggtccccgctggcccccagccctagcgtccatacgcggcgctccccagcttttggcggctaatccaccgagagtccctgcgatccgcacatgcacgtgcactctggataccctcgtcccagcccacatcagcggcaaaatcatgtacccaaattctctttcttggcggcttacagtcttgaaagttgggagagcgccacagacctcgaagtctgccgcagaaatgttccccgtcaactctgcaaagtaggtctcattaaaacaaaacaaaacaaaaaaaccctccagtttcggcctagggctgagagaagcgggaaacgcaagtgaaggataccccaatccctcgagtttgttttggtggagctaaaccagaaacccggggatatttctgtttgggggaccgccaagcccgggatgcgtctgcctaaggcgaggtggggagaaggagagcgcaagaagtggacactcgcagcgatccaaaggcaaagccaagtaccccgcgggaagaggccgagctgacccaggttgcaggaagaccgccacatgtgcgcaaagacgcactcggagaggcagagcgcgacccgccgacctaggagactggcgaggacaggcgagaagctgacagcaagacaaagcgggagtagagagccagggaggctcggtcgaagacccgaaaacgaaggcagcagcagccgcccgagtcccgaagcggaggcgtgcgcagccaggcccagcctggcatagccccattctcacgcctaaggacgcggacacagactcttggcatgacttcctgccagagctggtctctgtagggcttgggcctacagttggctgaggccttcccagcagacagtggggtccccaggggaggtcttcaagaatccgggcccctctggtttccgccccctccttgagcccaggacaaaggtagcgggtttgaggagctcggactgttctcagggcgtctacaaggccatcagagagctggtgcctccactctcagggcctcgggcaactttttatctgacttggcggcgctggagggctgccactttccaccgcatttccatttggccttcgcaattgcaataccctgaaggcactgcccacaccctagccttccagcaatcgggattcaagctggacttcccataaccagcaacagtgtaacgtgaagacactcctagactcaggtttccctcaacccttctcccgcttgtccgcacacggggcggatcaacgccccccacccacggccccacccccgcgggctccgcaacccagggccgcagctaccgagtgtgcttctcctccctcccgaggctgttggctttaaacacacttgctgcactcacccccaccacacactcagtcgttctcacccttcctttctccctgctgggcctcctccaaaccggattgcctagcctgaatgcagagtccaggcagagcaggaagcctgagagatcaagcagaggtggccgaggaaacagaagagagggcccttcatgggggaggaggcccatgtctgagaaagaaggcagccaggagacacagcctgcaggagagagggagtataaagggaaagccagcactaatccctcagcctgcctacgtggggcctgacaatttacaaaagccttttccccgaatattatctcatgtgccgcggcagcctcaccaccagcgctgtgagggaagtaggacagatagcatcacccccattggcaaaggagggaaatggggcccagcgggttgagagaggtctgtgctaaggtcacagcgcgaagagtggtggaagaggcccgaggcctggggtttcctgccccaaagttaactttcctgttccatcgttgtgtatgtgtttctgggtgagcatctgcatggaggggaaggactgccggacaggaatgcacagtccagttagggaagtccaggaaggaagaacacagccccacacctcttcctctgcccgggtctcacacaacagcccctgctctttccacaacagcctggagccggccccccaccagcctgcctggggggagctgttagtgcctggctgtgccttcagtagtgcggatttcagagatctcgtatcctctgctctgctccgctccgctcagctctcttctcagcctgtcatccccacccccagcctcggctgcaggatgccttgcgtccaactgtggtttccgggcaataaaacaactattaaagtctcaggcacggctggtgatttgcatcacatcctcttgtgcatggattcaatgtttaatacacaatattgaatacggatattaaaaatcaatagctggggacccctggggaggcggcacagtgcgatcctgcttcgggaacacaaccagctcttctaaaaagacaggaacggcaagttcagccaagctgagcccagcgccaggggaagtgaggagtagtggatgcatctcagcttcctgatatgcttaactgcgccattcccaggtcaagctaaagggaagccaaaggaatggtgtgcccctaggctctactagctttgagatgggagggtggggaggtacggtttgtttccaagcagggtaccagccaggtgcgcggagttgctttttttccttgttatttgcacttaggtttggttcgagtctgagtcttacatgcaggctctcaactcttcccaccatgatggctccttcctgggcctcatgacatccatcaccataggccccatggggagctcttggcataagctttcagagagatggaacaggaatcccaatggctccgaatatgctttgcacagtaaaagaaatgtgaatgcatgataccaggctctgagctgcaatcttctgaggcactctgagccttcagaacagaaatcctcaggccgtgtgacccgcctaaaggcctggtgatggctgagtggtgacagaggaaaggggacgagaaggagactgggacatcgaagcattcctgctccagagccagaatccagattgtccgttaaacagccaggagaagagcaagctcccaggatgcataattatcttttcaggcctgaagaggaacatgtattactctcttctttatcaaaacatagaaatataccttaccctaaacagaaacaaggttctcacagactgatggggtaggagtgaaggagaataaacatctttgagaggattcagtttttttccactacggaaagggaagagaaactgacagtgggaaacacacttaggttatctgattggaaaggcctgggggattttagatgccaaaaactgtgtgaacttgacctagtgaaatgtcatcttagacaccaaattataataataattttatggattcatttttatcatagtttaaatcaataaggattgagttggaaatcttgctctagttataaatagatggagagaacacctcaggaaaactccaaagtagtaatttgggtaaaagttagaagcggaggaaagaggtggaaaatgacagttaatgagcctgtggcctccactctttgttacctaacagttgtcagagaaccatcaaagggagggaacaggcgcccttctcagaaccatcacaggaaaagcagacattctctggctgctgcagatccccccggtggtggttcctacacccagcctcctgggagtttgcctatgtgtatttatgtgtttccgggctggggagtgtagctactttcacaagattgggccctgagcctgtgaaacccactagcgaaagttctaccacgaggaaaagccattctaaggcaatgctggagaccaggaactgctctgccatcatcaacaatatcttcatgattcctgcactagcaaactgcttcacatcttcccacctcaaccatggggccgagctctgggcctcttacagatccatacaggcgggaccttttgcagctagcacagatgtgtggttaaggcatgagacagctggccaaggggaaaggaggctaaggctggggatggctgggaaggaccaaggcccaggagggcctcctggtacaagcatagaactgacccagcatgggggagttgtacctccagaacccactaagggtggcacttcccccctggacccaccaggtactccaaaccaagaggaaaagcatccttgtggcatgtgggtggattaggcccaaggcgcaggtgagctctgctgcagaaggaacctacacaccaagtcccaaatgcccaagtgctgacagggattggggcaagcaggagggaggggggatctttctgcctcccatcacctcacccttctgtaatgttttcctggaatgaacagaagtcgccagcagagttgttcctggagcccctccctccgggactgtcactacctcctggtgtaagacagggaggaccatggccttctgccgggaggatcctctggctagtacccgagccttggattctggcacgaagcctcacagttccgataaggctttacctcccttcccacgtctcgaagaaaaacaccccctggaactgctggggtgaactcggagcctgaggccagggtcagcggggggacgggtccccaccaccaccaagttgccggcagaggtaacagctgtggaagggggaggggagcgacaggcagccacgactgaacggttgcgatctagaaaattcaacaagaggccgcagcggtggcggcggcggcggctccaattagctgagccaactggggaggcagagagcgagacggcggccccgccgatcgtgtcccgggcgagcaggcaggcgggggcgcggggcctcgagctgccccggcggccctcgctcggcccctcccgtgggttctcggagcgcgcctggtgtttacacactgtcctttcgacgtgagatcaagtttcaggccgcgctggaggcgccaggggccggccacaggcccaggagaggggaagaggtggagcgggatctaaggcagcgctgcgccgacgagaaggcctggcgctcgtgggcacagctagtgcagcggtccccacggggtggggtggagagaagttcactgggcacggtgggtaggggttggtggggttgcaggggggtatccggagagagaaacacctccaagtcactagagtatttgtctttcgctcactcgggccggggaatttagtcctgcaaggggacaggcggcggcggggatatgctcagaacccaggcgcttcgacagccctgagcgccccttgtgcgctcttcacccctccccaccccgtccctttgatatactaccggatctaggccattgttacggggaggggtatgtgggccgaaggaactcggggttggagacctggagcttcccagcgcgccctggccctggcgctgcggaggcctcgggtggagtgctggagggctcgccgctgcgcatctcctctgagctggcagccagcgggtgccccacgctgtcaagcggcggcgggtgagcttccagcagcacaggcacactgtaaacagccgcgtgcacgccctccccgcccgggctgggaacctcacccaaacaccacgccgctttctctccggctaccgggcgaggcttttgtggccaagcctaggggaagggggtccccaccccacccccaggccacccgggccccggagccagcgttctgaatctgcaggagtgcggggtgctgcggggaggggagggagtcagcgcctgccccctcctcactgaatgtctgctttgttccggaaaacaagggaagcattaggcggctgcccccggggaaacacaaaacttctttttgaatctcgggaaaggcggttgactgcattaaggagctcccgagacagaatgaggaagggaaaagccgagagggcgggaggagacagggagacttccgcgggaggccgatggtcaaagtggggggtgaaaccgctcagggtgaccgggctggagacccaggaacccgattcggcgcgaaggtgccgcgcgagttccagcgagcagcctgcccggccaagtggcgcctgcccagccgtcggccgtgccagcttcctgccctgcccaggaccgcggagcagtcggggacgccgccgcaggctggcccggaatcgcaggacagcggcggggggagggggtagccaggccgcaagtaaactcgcactagagctttctgcacacctccgccctagagagggggcccggacccccggtctgtgaggcgtcggctttggccttccaaccttggggtgcgcgaggaagcaaagacccagggggcacccccaccctcgcccaaggcccgagggtgggggacagctgaaatgtctttggtcttgtttgatgaccgcttggcggatctgctcccatccgggttctgccgttccgagagtgccgggtcagtgatacccaggccggtctgagcaggcatgtggatgagcaaaagcaaatctgtcgctcctccgaccgccacccctcacttaacctttcctgcatccaaggaaggggagggcacccagactctgccccaccccccgcggggcgctccctctgcctcggaagctgagactaagagcgagggttttccccctttcccctgggctcgctgggtttctaacttcctctaaacctccctcctcgctccgaaaagccccgaggagaggagctgagaggaagcacgccgctagtgtgcaaaatgaagaccatgtgtgaggacggcggcatcagagtgcagccgcgggggttagggggtggcaaaggcccccgcgcggccggaggctcggggccgcagcagccagtgcctctgctctgcgttggggactcggagccgcagcgagaggcagtggagaggcagggctggcctcgtggcgggaggcgaggagggggtgcgagggctgccgcgccgtggggggcagggggcggggacgcagccccggcttcctgggccgcagctgcgaccgagggcgcaagagcagatcgtgctctgcggcggtggcggctcgggcccgccgctctagcagctgagaatcaacaaagggaggcggcgggggaggggcgccaccgagcgttcgctggctgctctggaataataaaaaataattaataatgataataagagaaaaatcccccggctttcatggctctgggtttccgtgtggctgcagcgggaagcgcgctgtccttgaggcggcctctctcgcctggcctgcccgcccctccccctcctcgccccctcccctccccaggaaccgggaagagaaaggtctgcagctgacaaatattatccattctccccatcgatcgcggagtgtacagatgtgagcgcttgatgtgcccgcggagcggcggatcctccctgctcgctcgctctcgcccaggctccgctcgccgtccccctcctccccctttgttctcctcccctttccctctctttaaatagatttcagggcgctgcctgttggagagcagctggcgatctctcccgagagagggagcgagcgaagcccgaggtgccctgtcaccagcctcccctcccccacctcggcttttctctacgtcccccccaccccacctttctccagtttccaaaatagaaaacaccgggaacacccacgtccactgcaccgcgagcccctgggagcctttggacccctcgtgctgttccttgtgtctgtgtctgtgcagaggaagggcagtgcagggaggggacccagggccgcggcagaagagccaagggtccggatctttccctggcagcagcagggacgcagcgtgggtcacgctaacagggtacagtttacccattagggaaagtcggcggagacggccctgttattcctcttttgcagatggcagattaatccggcagcacccggcctcaaagggaccggctgctcggcaaagggttaacccgtcggccggtaatcgtggacacgcgcgcacacacacacacgcacgcgcgcgcgcgtcctctccgcctgcccgagcgcccgccgcggcccgcagtgcgcccggggctgggggagtagctgcgggaggggagggggtcgggggaggggcggggcgggcttaaccaggccgctcgactgagccggggccacctcgccgtctgtcacttaaatgattgtcctccgctccgctcagtgcggtcagtacgggctgttaacaggcagttgcaatcagtttccgaaaggtcagccaaggtcctccggctctcgcagacggaaggcattacgaaaccgcttttgtatctgcaggcactttagaaaaagaggcgagaaggggcgcaccgcagtgccgcggctgctgcgaccgggggagagggtcgggggctgcggagcagaggagtccgcacccccgcggccagggtcaggcggcgtggatatcacccgcggagtgacccagggcctccgggtttcggtggggaagcaggaagggggtggggagcaggcggcaagggaaggaggagtgggaggaagtgggagaggcgtcctggctcctctcctcacccagccaacagcccacacccggacccagacgggagcgggcggccttggacgcgaggagaccccactcggactctcaggccctcctggcgcctggaagtagggagggggtgtgggggggggaaagaccctcgccgagcgagcgagtcccagcgcggtgtctgaagacgctgctgccgccgccgctagaagtcgtccatcagcaaccagtccaacctgccagtgataatgtgcgatcaacaccaaatcacccccgccaggcgcgatccatcatcgcagcgcgccgcgggcccgcgtgaggctgactcgcggctggggtggggagggggggcgcgcggagcaggaggcggtcgcccagcacacccggactctccgcgcacctcgctgcccctcctggaggcctgcacccaggcgctcataactctccaagttccccagctacagagcgaaaacccagtggctccgagttctgggcacagctcacttaggaatccgcgcgtcctccgcgccctgctgtcgtggtcacaccctgcaaagccattccagcctcggagctgccctgcccatcccctccccctcctccgagaaaccgtggctggcaggaaattaatatttaatatcgtgaaattgattaaagggctggaagccggcgatgggttggggggaagggtagggactcctagcgtaattaaagatctgagagtcgtggtcgttccttgtcggccctggccgcacgtggcctttgtgaagccgaggcggggtcggactgggctgagcctggcgagccggggtcaggagcccgtgcagcttaggctctggcccgcgcggccgggttttttcggggcgggggtagggctggggcggcacagcagcggcaggggatgaggaggtgaccttagggcacccggggctgcgcgcagagccactcttcccctgcccgcctgcaccgtgggccactggagcccgagggtcgggtgctacaactgctgtcttgcttgtacagcacagaagcgcctttactgaccaggtggcctcgagggcgcaccgcctaccccccaggccccctttcagcagcctcactctgggccccgcttcgaggcgcctccccaacccctgacaggagtcttctgagccccccacgcagcccttcgggaggggagtcaggttcacctttccccctgcaacttggaaatcctagggcttaggcgccccggggccccccgccggttctctcctgtccaggccccagcctggtacgctcacgcctggggcagcttaactcgttcagctgcgctgcagatggggcctgctgctcgaagccgctgtctccagggagtcgtcaccgaaccagctcggccagccgcctgtcgtgccgtttaaggttaccgcgcttcccgcgaggggcatcgggactggaccgggcaggaggtgggtgcagctgaggctccctggccacccgagctaacgctaggagaggaattcggtgtgcaaaaggtcagcggtaacccattggccctggctacagtttagaagtcgaatggttggcttggtggtggggtgaccccagctcacggaggcctggctccaaagggctgatgtgaactttttcttgtatctgattttttagtgaagcactctgaaaagtaccaagtgtgcagaggggagaaaacacaaaacacatcaagctgcgtccttggccctaatcaggggagcaggaaggccctccagactccaggccctccagactccaggcccgctgtggggaaggtcaggaccacagaggattaggcccagtcttgggtttattgctgtacttgaacaaagtgccgggggctgcctaaactggagcaagagagaggtaattaagagggcctgcagaaggaagtaaaggctggtgtggctgctgcccagggtaggtggaggaagtgttttccataagaataacaagccggtgcaaatgttatgcagaaagactatttcaccaaaacaaaaccaaaaagttcacattctgcctctcaagctgagctgataaacaacatgcaaactttggttggaaccttgaaccagtgggaggtgtcaacccagtttacaaagggtaatggggaaccgtttctgggtacttctctgtttctaccattgtgattctacctgcattagctgctccctttgggggcccttctgacctcccaacctgagcccagcgggagatcactcagaatgcaccgcattcatcaatgccatttctggtaaattggacctcaggttttggagtgtcctaggaggcaggcagcctacactgcgcgcataccgatgtcacagcaaatgtgaggaaccgcacatattctgtagcctttactgcctttactagagaataccgtggatttcacaaccagaagtagcagattttccaagacattcctgatttcaagtgctttgagccctgtgtttttacggggcatgaagccctacctgcggttactaatgtcgaattgcgcaccagaggtgtcccagggctggaagaaatggcttgggtgtggggctggcacccagtggtccccgctggtcccctgtccaccatgtctagccaggcggccatcctcctggccgtcccgatcccagccggggcccgtccaggtagggctccgggcagggggcctgtcaggacgaagtggcaggactggccctcggggtccccgtgggtaaaggaggagcggcttcgcgccctgggacagcgcgcgccccggctgacacggggctgtcgccgcttctcccccggacgcgggcggctgcgcaccggccgccatcttggcccggctgcgcaggcggcgctgcccccggcggtaggaccgcggagccgcaggctgggccggggctgccgcgcgggcgttcccgggctgccggggggcgctccctcccgaggcccccctccccgctgcgggccacgctgacccaggtcggggacgatggggcggccgtccctggtgaaagcgtggcctgtagtgtcgcccctcctcgaaacgctggagcggattttaatcctgagaaacgacctctggttcccggactcccgcgatggtcaacgtgttatcgcttctcccgcgcaccccagaactctgtccccagaggcaacctgccgaggcagctgggggtggggggcgaggcctacccaccgttcacagggcgctgttgaggccagagaggatttgagagttaccacggtttagggctcctgattggagaacactggaactttatttgtccactttttgaatttaacatgcatttatggagcgcttgctaagggcgaggcgctgtgttaggacctagggggatccaaaagtacagaagtgaatttttaaaagacacctttggccccctcaagtaatttacaatctagttggaaaggcagacttgtaaatgactgaacacaaataaaaggcaccgtgaggtgaacgtaaataaagggcatgaatcttgcagtaaatggcctgggtaaaggccaattattttaaaaataatctttatttctaaaaatgtagaatcagttcgggggggaggggagggtaaagatttactaatactgaatatttccacggttcccggggctaacagtcattacttctgaaaagttgttgtttaggaaaaatgatgaaagtttatttcaaccaagcaaaatatcaaatatcagaaactctggattaatttctcagctcttgacattagctgggtgggacagacacaatttcccaccaaaacacaataccccatttgaaatcagtaaaaactcccaccgcatttcataaaagtgttttttttgtttgttttttgttttttgagacagagtctcgctctgtcgtccaggttggagtgcactggcgcgatctccgctcactgcaagctctggctcccaggttcacgccattttcctgcctcggcctcccgagtagctgggactacaggcgcctgccaacgcgcccggctaattttttttttgtatttttagtagagacggggtttcaccgtgttagccaggatggtctcgatctcctgacctcgtgatccacccgcctcggcctcccaaattgctgggattacaggcgtgagccaccgcgcccggccaaaagttttagaaaataaaactaaatggaagattggaaactttttgaaaaagttttcagatttaaagaaaatagggattaaaaaaagaaacacaaagcaaaaaaagatcagcccatttgcagatggtcttcaagatttggacatgcagaaaattgtcctcagattaattgtacagaggttggaaagtatgggaaaagtagtcataggtcaaagaaaattaggcaaatataaaaatgaggcaattattaactccaggaaaaaaaaatcttacaagaaaggaactgcaatcactgaagctcatttggctcagcaatgaatgatatatatgtggttacaaagtaaacactggatatgaatttagtaaggcattgtgctctagtgctatggtaagaatggagaagggaaagtatggtacagagatctgaaatccccctccaccatcagatggttgacatggattacttttttttttttttgagacggagtctggctctgtcgcccaggctggagtgctggagcgcagtggcgcgatctcggctcactgcaagctccgcctcccggattcacgccattctcctgcctcagcctctcgagtagctgggactacaggcgcccgccactacacccggctaattttgtgtattttttttttagtagagacagggtttcactgtgttagccaggatggtctccatctcctgacctcgtgatccacccgcctcggcctcccagagtgctgggattacaggcatgagccaccacgcccggccggattactttttcttttttttctttgagatgtagtctcactctgtcacccaggctgggctggagtgcagcggcgcgacagagcgagaccctgtctcaaaaaaaaaaaaaaaaaatcagtcaatcaataaaaagaaggctcccaaagacctcctcaaccagcccattactgacactagaaaagttcctttttggagttgtttaattttgattggaatttctttcttcagatgatcctctactttttttttttttttttttttttagatggtgtctcgctctctcgcccaggctggagtgcagtggcacaatctcggcttactgcaacctccacctcccaggttcaaacaattctcctgcctcagcctcctcagtagctgggactacaggcacactccgccacgcccggctaatttttttttttttttttgtattttagtagagacggggtttcaccatgttgcccaggctggtcgcgaactcctgagctcaggcaatctgcccacctcggcctcctaaagtgttgggattacaggcgtgagtcaccgaactcggccttttttattttttttttttaatttttatttatttacatattttttgagacagggtctgtctctgttgcccaggtcgaagtgcagtggtgcgatctgggctcactgcagccttgacctctggctctcgggctggagcgattctcccacctcagcctccagagtagctgggactacaggttcatgccaccatgcccggctaatttttgtttttttgttttttggggtttttttttgttttttgggtttttttgagacgtcgtctcactctgtcgcccaggctggagtgaagtggcgcgatcttggctcactgcaacctccgcctgccaggttcaagcgattctcctgcctcagcctcctgagtagctgggattagcgccaccatgcccggctaatttttgtatttttagtagagaaggggtttcaccacgttggtcaggctagtctcaaacccctgacctcgtgatccgcccgcctcggcctcccaaagtgctgggattacaggtgtgagccagaaaccaggccgattctcccctttttttttttttttttttttttgagactgagtctcgctctgtagcccaggctggagagtgcagtggtgcaatctgggctcactgcaagctccgcctcctgggttcacgccattctcctgccccagcctcccgggtagctgggactacaggcgcccgccatcacgcccagctaattttttgtatttttagtagagatggggtttcaccgtgttagcctggatggtctggatctcctgacctcgtgatccgcccgcctcggcctcccaaagtgctgggattacaggcatgagccaccgcgcctagccctgttagggtcttgcactcaaacacctacatcaagtacataacggtctgcagtgaacaatatgccttaaaatcttcatattcataaaccaaagaaactccctctgcccaagaaacaaatcccatcttgctggctaaacaagacacataagtagggtgacactcctgtccttctcccacccacactccaaataaggcctaggagggacccaataacttacgaaccagtgcctgcagatgagaggtaacaaaacaaagagagtgtatataggcctaccgcgccaacatgctgggtcaacactggcttggtccagtcttaggctgatccagtgtgctcccaagaaacccttttgacctctatctgtcctgtgtcaccttctcttttcttctggatcagagacataatctctttctcctttgccctgagaacagagctgccagtagcctattctgtgttttggctggggacctttgtgcagtacacaaactgtacaatgtaatacagtgaccctgcctgagaagccagcttatttcaagggccatcccctgaatgtcgcttagttctgacccacctgctgaatctgggtttctttgtttgggtctcaggataggagttggccctgcagacccaaaatcacctcaagggaggctagggtgaaccagatacatcctgggaagccgtggtgaggtcaggaaaggggcaggtgtggcagagttcacccaggtgtattacactaattcggggctccaatctgcactgaggtctaaaatctgaacgtcatgcctccaaagtcttactgaaaatgaaatcttcaggaggggagaggaaagcaggccagagggtacacatgccttttggattttcaaaaatgggaaaatgattagattttggatttagggaagatgtgtcatgttaagggagccatagaaaataataactgccaattcccaagcaaaacaaaatcatgttttccaccacgtttctatctgtgtctcctagtcgaacccacaataaactagcagatcaaatagcagatcaaaggcagaggcaaatacaattatgcccgtgaaacctctagcatgaaattagaagtcaaactctccattcaggggttagagacaaggataatgggaacctggggccctagagatgtacccaggccctttcagtcacaacactatccatgctggatatttaaaaccacacctcagggagggcacaaatagtaagtattaattgtttttccatacacactacaggaaatgcattgactacattcctagctttgtaccatataaagatagctgtatactggtggtagagggggcggtgacttataaggcaatagtgaaaataatgttgttgggagcgatgaagggttactagatcttccccaagacagtaggctaaggatggcggcagatagaatgctaatcttttacctgcttccctttcaatgcagaagagcctaaaacccatctgatcccaccactcagttctccctcagtccttcccacattggacaagatcatagagacagctgtcttgatatattttctatttttcctaaaatccatatttgctttataggctctatttcttttaccctggcctaattttagctctctgagtccccctgcccccatataatttatgaggcctcttgagggtagaaacccctattacaatgtagactagtctgtttagagctactgctaattaagcttagctctcaaaggtgcctggtatggcttcccctaccaccttcccacccccacccccaccccaccatggccacaagttctttgacactcctcccaagtggaagtaggatctctgtcccttccccttgaatctggatgggtttgtgaccacaatcgcaaccaatgaatatagacttcaagggtggattagaaaaggtgatgcagcgggccaggcacggtggctcacgcctgtaatcccagcactttgggaggccgaggcaggcagatcacctgaggtcaggagtttgagaacagcctgaccaacatgctaaaaccccgtctctactaagaatacaaaaattagccgagcatggtggtgcatgcctgtaattccagctactcaggaggttgaggcaggagaatctcttgaacctggaaggcggaggttgcggtgagccgagatggtgccactgcactccagcctgggcgacagagcaagactccatctcagaaaaaaaaaaaaaaaaggtgatgcagcttcagccttatttactgcaatgctggttttctggagccctgagctgccgatttgtaacttaaagtcctattaccctcaaggcaccatactgtgaggaagcccatgccacatagagagccctgtgctcatgctatgggacacagctgaggtcccagccaacagccagacataaagtaaagacccctccggatgcttccagcctccagctgttgagtccaccaaattctggacccacagattccaggagcagaattaaattgcttctgagctcccttgtagctgacatgctataggggaagagatcaatttcataacttattgctaaatccatggaagaaggtgaactgggttaaaaacaaaagtgtgacaggcaggaaattttttttaaggaaatttctgatcataacccaaatcccccacctttgataacgcagtgtcttattctttctgaaatccctgtaggacagtgacctgtgtcttcctcaaatctgatctcacattttccctagaggatctgggtaaaggaccctaactattgtcccctcctgacctacattggctgcacaagggagccagttccctaggcaggaagggagaggggcaaagcatttccaccaggctggttttgctctcccttctcttctcttctctcttgtttttcttgcctctcctggagggtgctcatctcagggatagggagggatgaattatgcaagaagtgttagcttacttcattttcttcccaattcccctacaaatcccacaccttttcattctgaccccgactaccagacttgtgtcacacaccaaatgccatgagcttccattcacaaagctaggaatgtgcagcagtgcagctggcctctgtcccccaccatttcctccttctctgagccaggcactcacaggcccctgatgcccaggcggcccatggaccctgaccctcaggctgccctcctggggaagtgccaagctcagggagatgggaggaggggctgaaagacatctggaatgtgatggaccgaggaggggaatggggagagcccaggtcttacccccactctcaaacaagcagagcagccagggaacaggcaaaaatgataaagcagcttgcaatggggagaaaaccaggccacattgtgtggggtggggtgggggatgagaggtggggagctactgagcagaccagaaggaatagcaaagagacgcaggcaaccccgcttcccctccccgccctgccaaatgccagaggatgaacccgccaaaaataaaatacagccatgattactggagcagaggtcaaagctgaaggggcagttctcctcttgaccacagaaagccagcaccaactgggattatctgccagccactcatctccagcagcctggtccgcagtgcacaactaggccccagccacaaccagccctgtgcaggagagtccaagggtctaggacctgccccttccccagagcctgagaccaaggctggcttggcttcccaagttcacagctttggagctgcttgccctgttggacagtgcagtggggtcctgtggctccaattcacacagtttagaaacaattccttcttctgatccaaatcccaggccagagagacctgtgcctagctagggtgtaacacaaaccttcctacttacaattcaaacaatatcagtccaaatcctctcttcactccttcaagagcaagggcatgagattatctatctatctatctatctatctagttttgctttgtttgagagagtctcactctgtcacttagtggcacaatctcagctcactgcagccttgacctcctgggctcaagtgatcctcccacctctgcctcccgagtagctaggattacaggcctgagccaccacacccagctagggcacagtatttattaaaaactttattatcatcttcctggtgcttcacctgcaactacttcatcggatctttctccaattttttgatgtaggcattctcatacccattttgtagataaggaaactgaggctcagataggctacacaaccactgggggcagagctcccatcttaagcccgtatgcatcttgatccagagttttccatcgtagcttgtgatctcccatcttgattacttattttgtgccaggtcccgggccgggcctgcaaaggtgaataagacagtccctccccttagggagttcacagtttagtaagggagacagactgcaacacagtgggacagcagctctgacctctgaattcgggttggtggaagtaccatgggagtctttgtgaacatctccatcatcactgccccttcaccccggctctatttcctagcccctctggttccttctcataggctgctccttcttgtccttccttaagacagacactagctgctggcttccctcccatgcctttctttcctcctgttaatgaggtctgaacccacacacctggcaggaatcttggcaccctacctgcttggagaggttgccttagttgagtaaacttccttggcttctggggccccaggggagaggctagaccctgactgcagccccaggctggctcaggtggaaagtgggcacaggggccccaacgctgagcaggctggtaggccctcaaaaggcttttattgaagcctgttaaagggctttgggcttcctctgatgaaaggcgcttaagtgcatctggttatgattacaggggaggagaaagccaggcggtctctggggggttggaccagtcatctggctctgccttcctcagggcagagctggctgctggtgaggccaggaggccaggtgtgggggcaggcaggaagcaggaccagtacaaaactctccaactctctgaggctcctgaccccagcctctgactttgtcaggctggactaccagaaacagcatcggggctcagaagtgccaggctcctttgagaaaatcaagttcagagtggctgctgaccacccctgactcacagctcttcactgatctccacctccctccatctccaaaatatcctcccaagaacccctgaccctccatctaccttctccactgctcttctccctcggaggaagttaaaataggcttttgccacaagggtttctgacagtgataaaaactaaggaaatgcaaactttcaaaagttaaaaaacctcaacgtttgctttctctttttcaactagccaggtattgtttcccataaaacagacatcgttaaggctgtttcacgtcactgtaactgacaaccatgccgaattaagggaagagattaatatgaacgtaacgtggctgccctggaacgtcatcgggcagtcccaagccactctgtgcccggcgcctgtccctgcgcggaactccacgtgtgcacaaaatgctctggggaggggaggatcggatgggttaaacacagtccgcggttctagaaacgaaaatacatttccttattcccgccctgatttaatcctgctgcgtgttattattgtcaagtctcttcgcaccactgtttctaaaaagaaaacccgtgggtctgcgcggccctcagccgcctgctcggcttttattgtgcacgcagcctggtctgcgtggatccagcacgtcgtgaccgcctcgcaggcgcgcacggacaccctcggattggcatttctataagagctgggcgcattgtctctgcggcgacacacacacacccacacagataataaagggccacggactcctgaccaaccctcctcgcaacccataattagagatgacctttgcgaaaggcaattaaaatatggtaatgatcgatgggctcgcctgtttccaaaaaggaaaatacacaggtgttggcttcaggaggctccacctggccgggccgcgaggcctcctacagctcatgaatgaactctttctcctgggaagcttcgattccccgctacctacgctagcgctggctcctctcctccctttcccctcccccaccagagctctggcagccaggagcttgctggcggcggcggggctttgtcatcggaacgcacacacagacacgcacacgcgcgcacccggccaccacgggaccgcggcagccgcgtccttcctcgctgcgcttccttccctgccccctcttttaaagagctcctccagaccctttcttttcttccgtcctttatgtgtgcggtccttttgcatcaaggagctcaggaagcattttaggggggccttccgcggagcgccggacagctcctgggaggcagaactcaggaccctacacgcgcggagaggacgcggggacagccgggctttgttttgtctcttgcctctgccgggagggcggagaagcctcggccgagctggggcccactggcgaattggcggcggcaaacacccccctcctagcctaagtggaacctgaaactccggacttggtccgggtggggcacaaagctacgtggagggtctcccagtccacaagtggctctccccacacagacaaatgtgcagtgtcattatggtggctcctgttgctcgaggcctcgggggtgctccggcggtgcgcgcacacctcacctccacaaggcacggagggcgagaggggggccaaggggctggggctccccggggggctgcctggaggagacgccacatcgggccttcccgcacccccggctgccttcctggaccgcgagcacggagccagggcggcctctcgcctttcattacggggcctacgaaagcagcagcccaggcaaatatgtagctattaaaattaatcgccccgcgttgtcagctgaacataatgcaaattatttatgggctgtctgcgcaatatttatcatcgtgcaggctccaggcgcttcgtgcctcctggcctcccccgcccgcccgccctggccggcgcagggcgaagctgcgcgcaggctgcagcggcctgggggctctgggaacccgagtggggttccaagggcgaggccgtgcgtcaggccgtcttccaggccgagggcctcactttagtttctgccattcagtacacatttatcggaggcctattacgtgcaaaattaggaggtccgcgaaatcggggtgaaaaccaatttggagaaatctaaaccaaacagatgagctcgggctcgaggggcgatgcagacagaggctcctcagctgcacaagagaattttctctggctcaagtcggtccttcaacctgggaaacccatgtttgctaaagctggattcgctctaggagaaacagggagcatctgatgtgctcaacagattcgagtacaacgctatcgactggaacaggaattcggtgtccttcgagcctcaaaacttgtttgctgatcgcagataacagattaactgttaattgtcgaaatcggccaaccatttagtttatcactgttgggggccccttggtattcgctgcactttttatatgtaaaaacagtcttggtacctcctaaacggcttttgtgtggcttttgtttctctttcaaatacggtgttttaaaaaacagcagcaacacgccaccccaccccctcttcaaccaagccttctggtttaaaaaaaaacaaaaacaaaaaccaggaggagaaataatctataggacaatcccccccctactggtcggagctggcgttggggctttttacgcagatcgagtcgcccagggctgcggaggtaaacaggctttctgcaccgctgctaaatgaatcacgagggggaagaaccgagactgctgggcgagggaggcctcgggatctgggccgggagccagggcggggacggcgctgcacggggggcaatgaggtggagacgggaccagggttaaccctggtccaaggccccaaggccagggaagggagagtaaggccggtgggcggtccagccggaggcccctactcgctatctgcgaggcagggtgaacgcgcagcctgggcctccatccccagcgcgcctgggcaccacctggggccggtcacgctgcctgagcccatctgcgaggaaggaggtcacgaggcaccccctcccacagagttttaacaactccaggccttcaagacgcagtagcaggcctgggtcttctgatgttcatttaaagcaaaatgatcgcctttcttcactgtccccaccccagacgccaacaacaccttgcacctagcagaccaagcctgagtcaagacgtccttcggtcctggggctgggggaatggctaccaacgggcatctcttctgcagactaacagaaggggatatagccaggaagctactataaatttatattcttcttccggttttgttttggttttggtttttttttttttgagacggagtttcgctcttttgcccaggctggagtgaagtggcacgatctcggctcactgcaacctctgcctaccgggttcaagcaattctgcctcagcctccccagtagctgggattacaggcgcccgccaccttgcccggctaattttttgtatttttactagagacggggtttcgccatgttggccaggctggtctcgaactcctgacctcacgtgatccacccatctcgcctcccaaagtgctaggattacaagcgtgagccaccgcgcccagccttcttaaaatgtgatttgacccaatttaaagcctccctttcttccccattaacctccagtttttgacagattttcttagaacattccaaagattctctcattacttcagaaacttatctcgaaatgatgtaaaaggaggttcaaaatattaggttgcttttgggttccctttatctcgaacattgttgcgtagatttgagaaagggctgatttctactttgttttctaatcagcaagtcactggtttttctacctaagagagactgaacattaaccacagtgaagcagaagggttgagccgcatttacaaagtgccttcacattttggtcctcagaaacccatccgagggggacagagtaggtgttactgttctgattttacacatgaagagactggccactcgcccccacaaatttctggaagctagtcttcctcactgaactggagccagaagccatgtgaagccagcctgctcctgcctacaccctccttcctccaggtcaatgtcatttagaatatattgcatccttttcttggatctgtctgctaggacccgggccaccctcctgctggaggcaaccccgacagcccatattttaagcagctcttttcacagcctgcaaacctcacggattgtctcttacaactgtctgtttactcacttccctccacccagtcaattccgactccaggcccgggaggacaattttaaagtgtttctgcagacagaccctctggccgcgccggaagtgttttatggacctgtgagccgagttaatcccaggaggcgcggctggattagtcccgggtatgggtgggggattcatgtgtttaggtttaatccccatggggggggggcgtaaggagaatgggggtcgggtggcttcagcaatgtgtgccccctccccattaaactccgagatttgcgctagagcggatggaaaccgaggcacgcagccctcgaccccggccaggcgtggagtaggggagcagggggtgccccgcgtgggcgcaccctaagaaaccagtgcggacatggcgagcgagaccagagcgcagttgtgtgtggtttttccccaggtttttattcttccagccctgtggaaaggaggagagccgcaacccggagagggagccggaaagaaacacttaatcaccggcgtctcgctgctcgtcacgcgaagatggcagcggctcccctgggtttcaaggttccgggaaaggcgtgtgttctgccttaaggcgcgcgggctgatgcgctctctccctcggctcggcggccggctccggctcacagagcctctctcaacgccggcaagtgcagccgggccgcccagcccccaggccagcctggccccctctgggcctggggttggcgagggcagctgggcgtctgcgctgcccagcccagccgcggatccatggggtttcgcgagctgaaagtaaaggcttgagggagtggggacacccacaccgacccgcggcacgcaggggagtcaagctgcggccaatgcaagacgagcagggtagactactactagcggtggccggaggctcagccaccttcgcgggagaggggatttaccgccaccctcatccacgcgcaggccccaccgcccggtcctctcctctgatccccgggccattgcgaaacacggagcgaacaggtcctcgccagcagccgtcatttcccgggaagatgggaacccacaagcctgactgtgcttcctaaggatactagcgtgcgcgcagaccttggggggaaagagggcagcgcggtctccccgacccggactcttccctggcgcagcacacaaccgccacgggcttccgaagcgcccgagcggggaggaggaaggaaaagcggaggcccgggaggcgggctgcgcgcttggaagccgtgtgtgtttatgtgtctgcgcgcgcgccctggccggacgggtgttgaggggagagtgatcgtgagcaacccggaaccagcagtcccaacctggactgacgaactgggctctccagtcctgggccgtggggctccatgcctcgggctggcgggacaagcggcggggagcccggagcttcggagccgccgccgggcatctagccagctccgcgggagaagcccgggggcgcgtcgggagccaggggactggtgtgaactagccgcccccgcaggcggacgtttagctccggcacccgggagcactgacactgggcgataaggagttcctcggcaatcggctgtccccagtccccagtcacctccggcggacgtgaccgccggatgctatgcagctaggtgggccaggggggcctttgcattgccttccctgaccccttccttgccgcggaggagccacagtaagatgcctctgtacgactctccagaactttcttttgcaaaataaaggccaaatgttgggccttctagtctcttcatattttcctttggaaggttggggtccaggcagtcctctcgaaacaacccccaaacagatcactttcattacaaaacgctagagaggcaacacagccctatttctctctctggtcaatccaggccctatctctccctctggtcaatccaggccctattatcccaagctgtgcggctttgggcaaaccgcttaacagttcgaaacctcggagtcctcatctgtaaaataagaccaatactattatctacctcgtagggttgttctgaggataacatgcctccatacataaggtgcttagaacgctgcctccagtacaatgctacgtgtgtttgttactatgatctggcactccctttggatgggtagggagtacaaagttccgggttaaagttcctggaagtttacatggagccagtggtcttggcagggtggaaagggcactattgtatggccactgaaaagtgaaggccaaatgccctcaaactgtctaggtctccactagaccgtcccataaaggcttgtgtgtgtgtggtggtggataggagggagagtcctttttaatggtgctcatttagactggattaatagcaagttccgtcagggctcaggcaccattacccactctctccctgcagccctggggaagagcgctggtttccaggacctccagcctactcttccaggacaccttttttgatggctgaaggccacctctttaaatcagttctcggaggagttggccaaaagccatgtcctctgggatgtactttggtctaacactggtgcagggctggcgtatggcaggccttgtccctgggccgctggcgggccacattttactggtgcacagatgcaaataccacttctgtagacagaatcggtcagacttctaatttcaaaaggcttcccattacctttgaaatggcgactctggcaaaaaggggaggagttgcggcaaataagagcctagggaggcctcggcctcccctgcttggcctctccagggtcacccataattcattaggtgaggctgccttttccttttcaaacacaacgcaaatggcctttgccttaagtggctaccggcgtttgcctaatcactgaaatgtgctggcagtgcgctctagctctcagtagatccttatcggaactgtgcgtgccaagctgccagccccgagaaagacaaagaacacgggcgcctccaggtttgcttctgaggcctcagggtcacctctggggcttccccttcacagcctccggcccctacaagacgctcccagccagcctccggaacaaacccgcagccctaaatcagaattccagttctcgagcgccacccggagagttcacatttcccctcctccgaggccgcgtggtgcgcaagaaagagcccgagggcggcggcagcacacgtctgggcagccccctccccgtacccagcagcgtgtacgcaggaaaagaaaaagccaagagaaaaacgtggactgtaaaagccaaaacgcagaaccatctactactaactaccgacaaccccaggcgggagtttgcaaggagtaagcaaccctctaatagaaactacaactaaaataattcctctcttcgcgttctattaaggtcctggaaggtggaacgcaaaggggaccctgtcttcttaggacacagactggctgcgccgatagtgctcagccccgcacctcctgagcatacatttaatgttaggcaaagagcaagtttcctatctaccgtttgaccacagtttctcacagtatttctaattgattcaacgtgtattagattgaaacaaaaatgatcttggttggaatatacacgggcaacctgtatttagatggggtaagttcctgcagctatctgaccacatttgtctggtccctctgagaatccacgttttctagcccgagaaggggcaggcggccctcatggcgcctccttcggcggtttcctggcgaagcgcccatcctccccaagcaccaggaacggaggccgtccatattaatactcgcgggcagcctgttctgacctatactgtcattttttccatcggtcgggatcgggctgggggtggggtggggcgggggctctcctccgaggggctcagcacggatcgttgggttttccccggcgaacttaacacggaggcaaaaggggcagatggaaaccaggccccggctggccccgcgcgcgtaagcgcggcactcagcagctcgacgcaaagccagggctggattttcgcggcccgggcccggcggccgcccagcgcccgcgcgatcctctctccttcgggttgagcaaacgtggtcgcctaattccgcccgggagacagcagctgtgcggcgagagggggagaaaaaatatcgcaacttttccaacagaaagtgtgtgcgcacacgagaggtgaaggcccaccccgattctgtgcacgtatcgacacagcatctaatcagtgtcactgccaggaatacgcttccgcggcgggcgacaccgccgccctcgccaacctgcaggagggaggggggatgcaaatggcgtctcgcgtcgtcctagactccgcgcagcacccgctaccgcgactccaagcagacgttgcagcaaactggggtgcagcgtctggggacgcgaacgcgcaggcggcccgagcggtcgcagggaagaggaactagcaccactccccgctacgagaccgttccccgcccccacctccggaagagccgcccttactcgactggggtgaggggcgggaaactttgcaagaagactgttccgcgccttccccgcgtggcacctcagaagaacgtgggtgggtttcccgtccgaggccagaccacgctaccctacttttccaggtttcggacctgaacctcgtggactacgggagggagagtacatttcgggccactgcggggggcggagggacaccaaagacaggcgtcttcaagggttctggcagatggccaagtttgtgtcctttccctcccacgctagagtagcgcacgccactttggggaagcgtgagaccgttcaccaccggccacgaggccaccaatgtcttccaggtggggccgatggtttgtctgcagcactcccttccgccttgcggtcctcgcctggctcccacagtcctggggagcccccagagctagcccgcgtcttccctcgcccgctcttccgggggaaagggaggctgtttgtgtggtgtgtagccccgctccggcttgcacccccgcgagccacctcgcagccctccccggcctcggcctcacggatcccctcccggagtagccccgcgggcccccccgccatgcgtaatggggcgcccctgggacgcaggcggggatggcggttccggtcgttccgggatttgcgtgcaagaagaaaacaaggccggcgactacaagagcggcgactccattcttggggttcagacgccctcgcagcctccgcgtcggttccgctctcgccccgggagcccgcttccgtgtccctgcccccgccccccaacgattcctcgtccggcccgtgccgcaccacgcggagctccgcgcgccctggctcccacaccggtccctccataactcgcgctcctccctcgctccgggctcggggagccgctcgctcccagcgcccagagtcagccggttccaccttcggctgcgagagccgccgccccgcgccacccccgcccggcccggcccttgtcccagcccggctcccccgccagctgcgccgccaccgccgcacgtgacccgcccccgtcgcggcttccgctgagctgcctgttccggggcacaaacaatttttgctctgacgcggggtctctcgggggccctggcgtcctctactccctgctccccaccccaccccaccccctaccttccgggtaggagaactcaaaacaactcgctgaccttcgggccgaccagctccgtcttccactgactccagcattccgttcaaacccagcagccacggcttctaagatttcactccgctctgggctgggggggagggggcgagttctccgggagggggtgtctcagatcgaaagagccacttcacgctctttctcctcctccgaggtgagtttttagactatttggaggccttggggaaacgcgagcagccgcgtgcaaaggagcccccccgccttctccccgcacatgcagccttgtctagtgtgacccgatttccagggtcagcagcagagggcctggccagcttcggaaatacc

SEQ ID NO: 738 - DNA, 126085 bp, Homo sapiens; identical to SEQ ID NO: 737

SEQ ID NO: 739 - DNA, 210253 bp, Homo sapiens
tcctcccgtgtaagtgatgctaagaagcacaaactgcattttgaatctaagtccctgtattttctgtgaaggagctgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaagtaagcctttcccactttgggcatttttcctggtttatttctggcttattatatttcttacaaataatggataatgttgcatgttctataaaatacaatgctaaaaaaggaagtttttatttgttttttttttaagtgtcctgtgttaaagaaatcagtgataccagtcaatgtgaacagtcagttttaagattctatgatttccaataggtattcaggtacagaaattttgtttttaacctttgtagtagtgagctggagaatgaaatggtcacatagactagaagatattttgttgtgtttacgcttttacaaaatagatttggcccttactaattgatatcctttaaaaggaagttattcataacctgtatttcattttattcccacatactatatatttatcttcacttttaaataactctgtgttgcaacatttgctctcataattaaggggatagtctcaatgtttcccagaggataatggttcaaagtgtttctttcaccagagaaatgggcttttactgttatgtgtttctgttttataaatgaagatattattttccacaaacttccccaaatagaagcaagagcaatgtttctgagataatcttgtcggttctatagcaggatggaaaatcagaggagaccaaattgccccagctgtgtgtttatgaagcacagtagctattcaacacgtttaaaacgaagacagggagagtgtgtgcttgtcaaaggggccatgtgatttgtgtctgttgaatctgaatatcaataaggcaaagcgtagagcagctgccgttgaacaagacaacttggcattagcacacagtgttggataatctgggtcaccttctgtggctgcaccagtgagattgttacttgtacggtttacagttgaacatatattagagactgagtgaagaaataagtaaatgctgtgggtaggtagctgatggcacatatagaaaaaccaagtcaaactttaaacaaatgatcagtataatacttgactgcaacgcacactcacaaaagattttttttcatatatatttactaaagagttgttatttaaatagttatttaccctccttgaaacttaatgtgggccccaggcaatgaggaatgaggaagagaagtgctgtgtttagttgtgcaggtaggagaagaaagggagaaaaagaaataagtcataaaatgaatgtgaagtgagtttatggtgcattttatggcaaacagctttgtcattcaatgtaatatatatggaaattcctggagtttgctgcagtttgttttaaaggaaatgaatgtatgatatctttaattaaaagtatagtaactatgaattgataaatatatatcatttgtttttgctctctttgagtaagtgattttattgatagattctaaatactttgtaattattttatttgttctccagcatagtatttttattcgtttaaaaaagtacatttgaagtctcattttcttcgatttttaagcaggtagacttttgtctgtgttgatatatttattggcaagatataatcatattgctttcccaatcaaaacacgtagtttagaccttgttagctgagtttttttcccacctgactttaaaacaatctagcatcagccttcctttctacccttattacctagtattcttgacacaaattctgtgttccagacaagtgaataacataatatctagcagtaaaaattgctaacattgtgttaagcattttctatatcatatatgtcatttacttcttgcaacaaccctataagatagatactatcatagtaattcacattttatagaagatgaaacaaagattcaagtcactataccagtgtacctcaaactttgaggcacctcagggagctggaatgcctggttaaaatgtgcagcctctcaagtctagccccaggtacttagtagatcctaggaaactataatttaattagctcttcatttcaaatacaggtaaccagaagctctgagctatacaataaatctttattaagaacctactacataatgatgctaggaatcatcagaatagttaaatataaacatatctctctcttcaatgagattatttaggagaaaagataaacactatgagctttataactgttgtcactcttatatacataataaccctgtcaagtagaatttattattaattccattttgcagctgaagaaactgaggcacatagaggtttattaatttgtccaaggccatactactagtgaatggtagatctggaatgtgaacctggagatctggctctggagtgtgggctcttagcttgcatgtagttattcccatgaagtgataatgcataaggactttaagtgataatgcttaagcagactttattatgttctgcttggaacataatagcaaacaaagaaatgtccattatccaggtatggtggctcaagcctgtagtcccagcactttgagaggctgaaatgagttcacttaagcctagttcaagaccagcctgggcaacataacaagacctcatttctacacacaaaaatataaaaaattaatggggcatcgtggtatgtgcctgtagtctcagctactcaggaggctgaggtgggaggatcgcttgagactggaaggtcgagactgctgtgagccatgatcctgccactgcactccagcctggtaaaaagggctacaccctgtctcaagaaataaaaagaaagggagaaagaaatttcagttattaatatcatattaattgaaggaatcaatgattctttcttcgaactttgaaatatgttcccttaaatttaagagaaaataatcacctccagctccatactgtattttgtatctaaagttctaccttgctcagctaccaggggaacgctgtttatgttttgatcaacctttatgtccttccagttgaggacatgtgacatgaggaatattagagcagagttcaggaagtgacattccctttctgttcctgagcaggtagacattctcctaacttggagttgcaatgaatttgtcctgattgtttttatacctgttccttgattttgcaaaactggttctaatgtgtgggaccaattaaattttaataattcaagaagagctattattttttgcttctgatgtattaaaagagaaacttattagagtgagactctcctgtgatccattattcagagactgttttaaataataacagtactttataataaactctttttgggaccttgatgtatgaatctgttctgaagggttttaaagaaacaaccataccatgaattagaaaagtaatgtctatctctctagtcctttataaatttgggggtaaacaatattttcaatgtaaatgccacatcgagattaatttaaaagtaactgttttaatctacgtttaaagtatgatcacaacatgtaaaaaaaatgtggtttgacaaaactactttagagttaccagaacaatgttaaagagtttggggtagcatccagtcttccaaaaaccattagcaattattaagtaattgatttgaatggcattattttaaaaagtactttctaaagtactaaaagaatgaagaacaaatagagattaaataagaaataattgaatttgcttaatatgtcagagaaggctgatgttattcattagggagtaatcacatactcttaaaattctacatgtgtagaaacattgaaaactttgatcgttactgtgcaagttaatatccttgcagtggcattttgtaaagtgcctacctaattattagtgtgagaaaaaggtatctttttgcttcctcataaatgaaataatctcatcagtttacagtaaaatcatcactactccatgaaagttacccagggtttcctacattacatagcagagttaactgtggcttcttttattagatacttctcttagcaaaattttctggagaattgcatgcttttttttcatcattggtgattttcaaaaattatcattcatggtctcacaataacaaatactggaattcaagtggacaagaaaagttagagtgagtgtttaagcaaaccgtgctacatctatataatggaatattactcagtaataaaaagaaatgaactatcaagtcacaaaagcacatggagggagcttaaataaatattgctgtgtgaaagaagctcgtccagaaaggctacatattgtatgattccaattttatagcatcctgtaaaagacaaaattatagagacatggaatgatcagtggctgccagagaatcaagggtgtagagaagaggcacaggggacttttagaatagtaattattctgcataatactttaatggtgcatttgtcaaaatgtacagaattttacagtacaaagagtcaatctaattgcatgcaaatttataaaatcatttaggaaatcaaggaaatcccaggaagtaattcagactctgactcaacaatctaactgcattacaaatgtatgagataatctcacagaaggggttggggaaaaactgttcacctaagtagtttatgtacatttccttagatattacctgacatgctttccctgttctagtatcccatccaagatatcacagtacattttgctgtcttgtattttgaggttcctcttggctgtgacagttcctcaggctttccttgtttttgatgaccttgaaggttttgagttctggccaggtattttatagattctcccaatattggagttagttttgtgttttcctcatggtgaaactggagttatgggctattggaatgaagaccacaaaggcaaagggttatcctcattacatcatatctataatattatcaatgatttatacaatcaacatgatatgtgactgctgatattgaccttactcacctgggaggtggtgttatcaggtttccctgataactataaagttatgtcttttattcttctccatactgtactcttagaaaaggaagtcactgtgtgtaacccacacttaagaagtttggagttatgatctctctcctggagggaaaaatttacataaattattcgaaattcttctgcataggagatctggctcttctctttcatttatttatttattcaattgtttattcatatcagtatgaatctattgacatttattttatactctgggttataagtcaatactattttattttgttactcaaattattccatctttggcctgtgggagttcttttcagttggctcctattttcttttcacgtactccccatcaatgtggggtgctttttaaaaaaggattttcttcctttatggctctacaatccctttcagactgatcttgtgtatttcctgacccaatcctagcataaatcaccatttctccaaggagctctgtttccttttattagagaatggtaaccaaaaccaagatctggatgtgaggtgtgcttgttgctgctggggtgtcaggtcttttaggcaatctcagctgaaagagcacagaaatatgtctgtgtactagtccgtgtatatacatgtttctatagatatctctatatgtaaatctgtgtctgtctgtattaagctaaatatgagttcatattgatgcctctaactccatttccacatggatcattctagctgtctccccttgcttatctgtaaatttcaacagtgagaaacctgatttccactatctgccatttattcacttgtttaaattcagtatacatatatagcggtattggactgttaacccatactcctatgggaaacaactttaactgtttaggtacagtacttatagctgtttcattttgtttttagtttttcagaatccacttgtttccaaaactacttaggtgaacagttctcccccaaccccttctgtgagattatttcatacatttgtaatgcagttagattgttgtgtcaaagtctgaattacttcatgggatttctttgatgtcctaaatgattttataaatttgcatgcaattggattgactctttgtactgtaaaattctgtacattttgacaaatgcaccattaaagtattatgcagaataattactattctaaaagtcccctgtgcctcttctctacacccttgattctctggaagccactgatcattctatgtctctatagttttgtcttttataggatgctataaaattggaatcatacaatatgtagcctttctggacgagcttctttcacacagcaatatttatttaagcttcctccatgtgcttttgtgacttgatagttcatttctttttattactgaaaaatattccattatatagatgtagcacggtttgcttaaacactcacctactgaaggacaactttgttactttcagtttggggctattagttcctagggctactgtaacaaagtactacaaactgggtggcttaaagcaacataaatgtattctctcatagctctggaggctagaagtctgaaatcaaaggtaagaagccccttgcttccactgagactccacttggaatccttacctgccttttcctggcttctagtggtgtcattcagtcccgggtgtttcttagcttgcaactgcatcactccagtctctgctactatcacatgatattctcactttatctgtctacctctcttctattcttcttataaggacgtcagtcatattggagtagattcaccctaatgaccccatgttaacttgattacatctgcaaaaaccctatttacaaataagggcacattcacaggtactgagggttaggactctgacataccttggggacacaattcaacctataacatctactatgaataaaactctgatatatgatttaaaaaacacttggttaataccacttttattgggtaaaattggtttacaattgattttttaaacatagtaagtgcttggtaaatatttgtggagtaaatagttgttatgtttcaagagacattatatcgatatccttgtattaacatgtggtagaagaaagattatgctaaacaatgtgcccatattgttctcttattttccccctctttacactgtccctaccttttacatattcagcctttcactttgaattaagtgttcagaaatttcctcctatgtaaatttgccctatgaaattaacttagagtctgatcaatatgtaaaatagcactagaattaggtgtaaacatgcctccatatttcctcgggacaaatagtttagctgtcttccatatgtgaatgttcaattttttaacctactttttttcacaaactgcattcattacttggggcaccaaaagattactttcctttattattgattcaaaacagtgattgcaagttattttactgtgcatgtgttatttgttgtgcttattaataaaatgtcatcttttattttatgtacatatttttgacttaacaataaacagtaaaatttctgaaaggaagaaggtactcagtcatctagtattagatcctattggttgctatggttagcaccctttatcagtcatctagtgtccttcctagtttaataaaaagtagtgattccttcaaagtttcgttgcaacatgctaagtagattgtcctatatttcctagtttttatcttcagaaaagttttattaaaagcaaaaccaaaggcagtgtacttttaataataacactatgggattcagtcatgctgtatcccatactgctgtatcccatactgctgtatcccgtacatgtaggaattagcatgactatttggagttgaatggtttgacgggaccaaaaattttactggttttagaggcaaccaatgtaaagttagttgtccctagccttaagataggataattaataaatattaaaatttactatttattccataatttttttatttacttatttatccaataagtatttattgagggccgtaaatctatatatctgacactgttctaggctccaagggtacagtagtgaatagaagagaccacaatccttgatattgtgaaatttacactttagtggggtaagagagacaaaaaccaaataaataagtaaattatgtaattgtgagctggcaaaaagtgctatagaagaaagcaaaagatgagtaacagagagcagctggaccatgaggatatcacagtgaataatattttgataaagaaaatagcaagtgcaaagaccctgaagcaggagcgtgcctatagtgtttgagatactgtaagttgtccaacataactgaagtggattgagtaaaacagggcaaattaggaaaggtgtcaggggttttacaataagtatctctcattcttgcaatcatactacatagtagctattaagaccattaggacaccttaagcaaatgacagcctagggtacatactaaaaacacagctacaaggggatacaactgagatttaaaacaagtttgtcagattctaaacctcccacaagctcacaccagcttatttattccaaaagataaacattgaggaatttaaaaggccagttattaaagcgttggtggcttaaaatcagccacggtggaagtaatttcatcacagaatttggcaaacactacaaatcagtgtttgggaagatttatttttttaaaaaaagttagtcctaaataataaaagttttcattctacctttaaaattttttcagggtaaaatgtttatagtttcaaccactatcccattcttgtgactaaaatctgccaaagcaggaatggctgatatgtaacctagattaaccgcattgtgtagtctttttggttctccacgtaattgtcctgataattcccagatggatgactcttttctctacattcagaattcttggaacctttaaatacttattttactttctgcaaattagtgagagcagagtgctaatgaggctgagtttacggttcaatctcaacacaattcagtttgctttgcacagagaccagctctgtacaacaagcaattatgtctagtcagatggtctcaaatttgtagtttttaatacaaggagagaaaatgaaattaactcaacaaattaagcaacaccattgaaataatcagttgcgggtttgcagcaataactttttcacataggtgatgcattattattattgtgtttctgtctataattttcattatctattcttttaatatagctgaagaataaatatttatattcagcattaatttttatatgagttgtgtcagtaaatacagattctggctctggcccacaattagttgtgtatctataaatgcatcatttaaactttctaggtctccaatttctcacttgtaaaatgagggggttatattatctaattaccacgttttttcaaggcctacattttatgatttcatgattattctaggtaatcgaatcatagacattgatgagcagagtgtttttagtgaccagtcactctacatgatccagcttccactaggttatattgcaacaaaaaacaaacccaacatcttagtgttaaaacaacaaggtgtatatcttgttcccaccacgtactgtgtgcaagttggctgcagctctgcctcgtttgtattcttcattgctatagtgaatgtttgtcccctctccccaaatgaacatatgtatattgaagccctaatctccaaagtggcggttttagggggtggggcctttggtaggggattaggtcactagggtggaggcctcacacatgggattagtgcccttgtaaaagagacctccaagaaattccttactccttccaccatgtgaggacatatggagaagatggccctctacctatgaaccagaagttggccctggacagaccccatatctactggtgctttgacctaggactttccagtctccaaaacaagaacaacaacaaaaattctcttgtttataaagccacttagtctatgatagtttgttttggcagcctaaacagattaagacattcattttaggacacaatctgcaggggcattcccttttagagaacactgttttaatggcagagggaaaaaggtaatggaggaagcatacaatagctcttaaaagcttcagctcagctttgacatacctcggtttggctcacatttcattaacaaaagcaggtcatgtggctaagcttgacatcaatggactaaagtccatattcaggcataaaatatttggaacaaataatgttttctactccatcttttttcctctttccaacttccagggatcaatttataaacaaatttctttaaataaccattaaaataaatattagaaatttaaaagacttgacaaaactattatttcagcaactatatattaagcagttaaaatgagcaaggtccactgttctccaggcacgtacactgtagtggggtgggcatatgtgtaaaggctgtccagacatttttgcctaagaaaatcatcacactttttaaaataatgtcagaagtctgtgcatggatctggctactattttcacatgtagatagaggtagaaattttattccgaaaaataaaactagtcttgtgtatgaagaaatgttttctgaaagaaaatataatcaagcttgcttcgaaattattagccctaatgaaagtagttatattttgaggttacggtcaactcagatttggcaaacagcatatacagtttgtagattaggaattcctatttctctttaacctcatttcacttatcattagcacctataccagaggttgggtaaggaaagagaggaaaaatgaaatgtaaaattttacattttatatatcaatgcctgaaaattacatcaaacacaatattgcaaggagctacttaatactttcacagactaggagccttaaaagaagcctttacagcctactcattatagtattgactgtatttctacaatttctcctaaagtaatcttaaaataattaaagcattactttctgtaattataaactcaaataattatagatgtaaatataaattgctttctcttcactaacctcattatatcaaatttttttttgtttgttttctggctttttttttttttttaacaacccctctatggagcaactgaaatcaggaaatgtatgtgttgtttaactctttctactcagctgcttcagttagcaggctagctatatgaactacttgaagttcagaatagccatagaactaaggcaaagtttgcataaacgtagttttttctgtaggctggtaaatagcaattgtgtccatgtagagggactcaatgtcaatagtgaaagcagcccactaccccctacccttttattctcatattccttgtttttggagataatacatctctaaagcctttttttttttttaaattagaggagtctatgattcatgttttccttgcctaccagatacaaccaacctctgttacccaatttctctatgtcagacattaggctgaatgtttttacatagtttatctcatttaattgaaaccttgtgatgaagattttattattcccattttgcagagatatctaaggcttggagtgcacaagtaaagccactaaattgttgatttagatacttaaattattttttaatatgagtagttttcacacaaccatatcacacggtcagaatttggaaataccagcgtcaccattcataagaccatggacaatttaaaacttttggtccttctgaattaaacagtcttctatagatacagcatggaaactctgcaaacagacttttggctttatgaagggaagcattaatgtaaatataattgttaatcgtaaatcagaaaaacataagggagagagatgcagtgaaaagatcgtcaatcaagcttgtaagtaggttccacctgtgaataataatctattgctcaaaccataagaaatacaggtattaaagataatttatcatgtattcatcaccagctacatgtgctacaagtataattttaaatatcaacatactgtatgccctcaaagggaatttgttgtgtgactgatgatagaatttcagagagccaagagctttgggaataaactggttttaaaaaatccagatatcataccaaacatgtattctatcaagtacatttctttaaggtattttttaaaactctaataggcagtaatgcgtactggaattgcctaggttacagattgtcacaaaaatatgttttattaattcttagggtcagttgtagtccttgccatcaatataactattttttaaaagaaggatagtttttattatgtcctttttctagtagatatttcactgttaattgttcatggctggtaaactcatatttatgaagactcaaacatttatttaactcaatatgcttttgtttcttcctgacatgtatgtaatcatattttataaagtacattggtcagtgagattgtatgtatgacatcggattaaaaaatttaatatgtaaaataaacacatcgggggcggtcattaaatgatgggtttctgtgctacaactcctgatgctatgatttcactgttcctgtgtaggaccaaaaaatcaatttaaaaaataagtcttagtaattgtgatgcatgtcatttacagactaggttttaagagacactaatccataagttaacaaagtgaaagttggtcgattattgattcttaaagtgtggcaaagactgatgtgagggaacaggcaagaaacaaccaagggcacagtgcatttgggacttaatagaaaaatgaagcagtggggagcgatgtgagatgagggtgtaggggcagtgtctgcataattaaaggctttaaatgctataatgaattatcttatactagagttttcttgtagtcagaggttcccaaatgttttcacactgtggcctgtagagagaggataatatctgtgcaccatacttgctcatgtagtcaggactgttgacaaccagaggtgatcacttggtggcttttgcagctctggcaccctttagcctactcttcacgtgttgggaagtgccatgaaggggggttgaaagccactgaaggactttaaataggaaccctggcatgctcagacttggccagaatgagaagggaataaagaagggaaagcaaggctgtagttagagagacctagcatgaaatgatggagacctcaaacagcgtggtcctggtaaggaagaagcagagtgggcttagatacttcaggggaacattaacttattgtttaatgagaaatgggtgagagcaaaagggaggatagcgaagaatgatttccaggcccctagtttatgtatcttaaataatggtatgactttatctaaaatagtaatgcacggaaaatataggatgaattgttacaatttaaatctctttattttgaaatattggagggactttcaggtgaaaatatccagcaggcagttggatatatccctccaaagttcaaaggggagacccagttagaagataaagagtataataaaaaaaattatagactatataaaacttgcgatataaaatattaacttgctgcttgggttaattacatttttataaataaaatataagctattcataaaaatgaaaaaaaaaagaaaatcaagtctctgaaatttctactgaggtaagaaatcataatcattccttttaaaaataatttattcctttaaaaaataactatgtcacataattgaatttaaaatgtatttgttagttgttttttaaataaaatttcagaataataataaaaaaagaagataaagagttgggtccttacttacaaattcagtaactatcatcaagtccatcctctggactacttattagaataagaagagagaacacaaaaaatctagagcgaagttctataaaataattttacactatggattcaaggcttaaatatgagtgttcctactcattggtccagtaactcttctaggagaaatagttgaaaatgagagcaaaaaatagcatgtgaaggaagccgtatgttatgtataatagtgaaaaattagaaataaccttaatgttattaaccaaatttgcacgtttatactaataaaatgtttgaaacataaattgtgttgctttgggatcaaagaaataaacacagtccagtaatcaaaagtaaattaaagcaatttaaatatttcctgcagtctcttaagaaacgcacacatatacacacatatacaattagaatataaggcacagagaaatattatttctccattttatgttctcaatgtcttgtaaaactattatttctcaattgttatgttctcaatgtctctcactacttcctaaggtctaacctctgaaaaaggttggacctttctcttgaaattctcataggttcttttcttctctcagaaataaatctctactctttcttatataagtcccctctcctgggttcccaaattttgtttatttctttctggttgtcttgattctgcatcacaaaagcccaggaataaagctagtgaaggtacattttttaatataggtgtatggaagatgagcaatcagagccaaaggtacaccagtgggcaaggaagggggaaagaatctcaacacttagtcaaaaggtcatttttgttttccaaaaaggttaagcaaaaataaaaaaaataaaaataaacacatcaggatgtcaaatcttatgtaatctacaatatgcaatttgtggtgtaaaaaatatgcttggaaaaaacaaagaaaaattctggagggaaacattttagaatttttttttctttttttttcctatgttttttggggggaacagatggtatttggttacatgagtaagttctttagtggtgattgtgagattttggtgcacccatcacctcagcagtatacactgaacccaatgtgtagtctgttatcccgcatccccctcccgccctttcctgccgagtccccaaagtccgttgtatcattcttatgcctttgcgtcctcatagcttagctcccacttatgagtgagaacatatgatgtttggttttccattcctgagttacttcacttagaataatgttctctaattccacccaagttgctgcaaatgccattaattcattcctttttatggctgagtagtattccatcatgtatctatctatctagatggatagatatatatcgatataccacagtttctttataccacagtttctagaaatttaatagcaattatcactggacattgaaattacaagggattgcaatatttttctttaattttgttataggttctacattttctgtaagtaggccaaaaatcttcaataaacataaaacagattattatttatattaaaataaattttattttaaaaataatttagttattcaaacaataaattttaagtcacagagctactaacagaagtagctatatatagacagaagtattaagtaaatatttgctatttttaaatactgaaaagttatattagaaaaataccagtttcaaaaatattcaagaaacgaaagatagtttatttcaattataagctatgtgggtttgaatcattttacttaaattctatgttttctcatctgcctaatgggaataattattttaaactgcataggagtgttgtgaggattaaatgaaaaatgaatgtgtgacactctatgacgtcttaacttgatttgatttatagtcagacttgagattcacaatagacttcatcaagcaccaattttacttgtcttgaagaaaatgcacaggaccagtgtcatagcatgcacaatgacaacacagcagaggtctcctgattctcagacacagctttggatgtcccagtcattctgcaccctgggtgtgtgtggccacaaggaataaagctgattgaatacaacttcagctcgggaaaatcatcagctctgagatcctcccttcagtttttatatcaagccatgtgtttgtgactgagtagtcacatctaatcaggtttatgtgattagccctatttcttcagggcagctccatttcattagttcccaattactcgttaaacaaccttgacaatgagttacacatgcttagtcatttccatggaactctcatttatcttgcatcaatataggtaaatatctaactattcctcagttgctgctgcaaatcagaggtctagtcttcagccatttccagagaggaggccaaagaaacagctgttagtcctttttcggtatataaaatgctcaggatagtgcctgacacgtagtaagcaaacaaaaacttcacagaatcattgaatttgttttttcaaaattgacaaataaagtgcatattctgatattgtaatttaaaaaaataatagaacaaaggaatccactgcttggttgtaatatcttttcttcattgataattttcaaaatgattgttgctaaaatcatatgcctctgtcaaattcctttcacgtcaaataaaattaaatcctatgatgtccttgaaatcatgttgtgttacaggtcagtggttatcatagatgactttaaatattcattacaggaatattgagggatgatggcaagtcatggtcttgagagtcgttgctgaaataggctattggagtgtgagttggtcattaaactgtgaaggatcattcatgtcaacatgaaagtccccttgattaggaagttacctagttggtaactgggaatattggttgaaggaagtgaaagtgtagtgaaaagagaagtttgtccaagagcacggcttataagagggttatgcaagaagatggtagctaaactattttttataataaataaccatgaatttgggggtcagagagtgaaaatagagagatgatggggacagaaataagggataagagaatagatgaggcaacttgttagaaggccttgccctttagagaaaaatagccagtaaaatactcctctcagtgggatgtacaacagactagttagaagaatgtcaaattctcatttttaacacatcagtgttactacttataaagcctctctgccttgccagatcttcagttcgattttattacttttatagcttagggagtagaatggtagcaaatattacaactgggctatgaacagatataacatgtcccacattggcctctctgttgaagccaatgtgatagaaacaactcttcttgaggcatcgcagtccagacgtttgatgtggtgactgacagcaaagtgaggcttaacctgtggtgtggtgaagcattctgtgcagcagtggagcacaggtggatgactcaggagactaagctccttctcccatatttaccaaggaaggccatgccaggggaaacacacatgctgagtaaataatgaaagagaatcaactggatagagttgaaacattctcaataaatattaatttttaacaattactagttaatttatttagttattctttgaatttgagcagaatctctttctctcctttttttaattccttgggcttgtgtgtgctctcaagacttagaatgtgaggtcacaacgtttcctgtgatacagacttgaaagagtataggcctttctctgtactcattgtagctcagtactattcctagcttcttagccccttcatggctttttaaaggaaggaaaagctaattattggtgctccaggactgggcaaagccgagaaaaaagagatttttcttttccttcatgtggcatcagtttgattgcttgttttctagaaaatagagagaaggttacctatcaaagggcacagtcttttcccaatagcaatcgtaacaacctcatttattgagaaccgaatacttagaattgtatacaaactctgaatcgtataaaactcctgcaatgtacctgttatctatactttaaaatagcgcacaattattctcatggaagttaagtgatttgacaagttggcaaagtaagtgacagagctagaacagaattaaaacttcttgttattcccactaaaccacctataggtcttgataaccatagaccttagaaaactaaacatttactaattgtttatttgtaatttatcttcccaatactaatgtaacagatttcaactttctgtccaaattaccctaattactaaaaggcctatacacctgtaatgaaacatgaattttgaaatacatttgcacagaatataataaagttttcttagagttaaacttcagtactattgtaggcgcttagtgtctgaagaccactggctgccttggatgacctctaaatgcaccctccagctctgtgatttaatgaagaaatcactgacatagttcccatgttttgcattataatttcataaaatttttgtttatatctgtaatttaatgcaaagccatatggttatcagaaataatggatatttaatttgattatttaagcatttgacttattttgtttcattcaagggaaaaagaaaaactattttgaattctattaattttctgcttcatagagaattagacatttatgaaaaaagttcataacagaagttctcaaagtaaagttaggttgatagattcatttaatgcacaattcttatacacttataaaatttcaaaaattcatatttgtatcatatattcataggtcacaggagaggtaaaatgagtacgtggaatatggcctgaatatataggagctaattagaaaataaagtaatatgctatattttagaaatgagaaaagcagaacttggtaataaagggcttagtttgataaaccatgagttgagaaccaaaagtggttctggcccttggaactgcaaaatagtttcacctactgtaaccaggctaatatattgctcctggtagcctgctgccactccaaaattttctcctcagagtttgtcatttttgtgaattcaagctcttcagaatgtttcaattacaaaaggacaattttacattaacccatcaacatagacttactttcagtttcctaacttaaagtagggacttgaaagaaaaagatctaaaataggtcaacggtagagagtttgtgggggattgtaagcatgtgaaattgatgatggtggtctctgtaacgggatccctgatggatcccacagcagcatggaggctctgacttcttgcaagggagagaggcgctagggaaagaagatgttagagacagtaacaaagcaaaatttcctcatgtgcagtttatccaaggatggctcacaaatagaattattctactcatgaaggaaaaagaaatacaactagccaaatgatccacctggaattatttcctccttagctacacaaacaggtaaaaacaaatccatacattacattttacaattatattctgaagaggtgtccacttctgagcaagatggagtaggtgggactggattcaccctccagcctgaagcaataaaaaaagcaacctggcaacacatatgaaacaatggtttccgagacatcagctatcagagaatgaagagtagtcatccctaagaaatggaaaacaaacaaggtgagccctattgcttgaacttactaccatgagagagtttccgggcaacagcacagggagagggattcatagagagccgagtgtttgaggagacccagacagatgaaattcatgagacggagtacctgaggggagagctgcacagagacagaccagagatctgcagaagctccttttagtattcagctgagtttatatcagcacatgcatgtaaggaaagttcccaagacctgggaaagaataaagctgaaatgattagagataataatgcccagcactcacagagggccaagaattgtacctgtgcccagtagccagactgaataacttcatgatttatgaaacatttggtaggatattgcttcggtagttacaaatattctcctccagattcgatacggtcttgtgctgcttaacaaatcttaaaagcaagacttaaaagaaccaaactgtttctaaaaaactgcattgcagaacacagctcaagaaggcatgcatagaaacaggaaaataagacccaaatgaggagaaaaataaatcaatcaaaacagatcataaattgatccagatgttagaattaccagataagggcaccaaaacagttattacaactgtattccagatgttcaaaaagttaagtagaattatgagatatgagaaagattcaaatcaaacttatagagaaagaatctacaaggtataagacgaaaagtacgttggaagagatgaatgacaaattagacgttgaagggaaggttagtgatttgaagacatagcaatggaaatgatccaaaattaaacataaagagaaaaaaggattagaaaacaaaacaaagcaaagcaaacgaaacacccacaaaactgtgacaactttacaaagtctaagatatgcaaaattggactccctgaaaaagagagtgagaataaaaagttttgaagaaataatgcccaaacttctctaaaaaggatgaaaactatgaatacataggttaaaaaaaaaaaaaaacttgaatttccagccaacagcatgtggagagtgatccatgtagagcctaatgtttgaggagacccggacagatgaaattctcgggacagagtacctgagaggagagctgcaacgggacagaccagagacagaccaaaaaaacaaaagcaaaacaaaacaaaacaaaaaacaaatcccaagtacaagaaacacacacacaaaaccatacccattttctttcttaattatatctcttacttttctctcattctgtcaataagcaggaaatgttttcctgaaatataattatcttctctaattcttgaataatattttgtttttgaaaatattttgtctgtcttttttcttctatggaaaattgtgctctcatttcactctaattttggttcctctgcaggtgctccctattttctttctggtttcttaatgcattttctttatcttcagtgtattgtgatgtgccttggttggggatttatatttactgtatctttattttttcaaatgttatttatgattcttaagactttttgagcttcttgaatgtgaagtttcacaaacctcgtgggtttggggaaaatttgaaccatttatcactttgaatatggtctcttcgccattctctctgttctgtctcagtattcctattagatgaatatcagaaccttttcttctatcattgttgtctattaatcttactaacatattttcctttcatctatttcttttcagctatgtctaatatgctctaatttgttgatttagttttaaatgtcagtgcctacattttccttttcaacagatctgtttgccttttaaaatggacctattcttttttatataatgtgctttatttttcatattacaatttaaaattttataaagatatatatcttacatagttatatatcttctctaaagttatatatcttatgtagatgattatatatctgtagctatttaagtatatagttgttatatatagttatttttatctagttatataaaagttatatttgtcagtctatcttaagggttggggatctaatctatctatggtttctgctaacttgttccttgtttgtttttcttatgacttataattttttattttgagtctttcttcaagaggtttttaaaaacatttgttgtatttatcctatgagtaccttttggaactgcatcctggtcatatccctgtagaacattttttgctgtgcttttgcaaagtagccaaggataccactggctcaaaatcagttttttatgttccctttcgtgtgtgtgtgtgtgtgtgtgtgtgtgtgtgtgtgtgtgtttgaagagaagtggatctcagatcatatgggtactgtaaatgggatagatgcagagtctcagggttttgatttcctggaggtaggatgtgaaaggacaggaagtcattagcttcattgttgctcaccacatccctgacagtaggaagattattttttaggccttctttttccctgaacagctcagtttcacatccccccagctcctttccatgaccattaaaaaccaaactcttgatgcaagggatccgttttttcttcttctctcccctctatcagccaacaggacagacacagtatgaacgtccattgagtgtcatgctgattttcagctctttcatcccctgtgttacctggtgatctccctttccttcacttacatatttaaataatatttgttgtatttgattcattatttctgattatttgtaatgggaggattttaagtttatgtacatttgccctctcactaaaaatagaagttaattatccattcactaaaataaagatatctgtgttaaaatgacatgctttttgtccatgcttttgcaggacaatttccatgcttttgcaggaaattgtgtttcttgtgcctggctctctggtactaaatgtatttttaattgtaatgagctctaatcaagaaagaatttttctttaaaataaatggctttcaaaatgagaaatgaaactaaaatatactgtggacattaatcttctcgattttatacttatatgacaatctcacagactagttcaacgtttgtaaacttgcatttgaataggtaataagtactaaaaataataacttcaagagctaggatgatgacattttaaaacttaattagtaatatttaaatttccatgcaagataattcatttcttggacaatatagtctttaaaaacttcatttaaataaagatgttaataatgaaaatacttaaatatataagtgagtggacatgtgtcttttatcccattctaacgaattgatttttactttattcaacactgtgggataataaacatacggcactttgcaagtattttattttagcttttaattacattgggaaatttaatatttcagtatttccttaattttctaagattagttggttacatgttttatcaaattaatgtttgtgattactgcgaaaatcttatactcaaagtagcttcaaattactgttcatgataaaatttcatttgattgacttttatctcaattcaataatcaaaaattcatgacactgttggattttagttcatgctgttatctttctacagtaaaagcaaaattagttagagattttatatttatttcaagatgtcacatatatttgtcttttcagtttccagagtccttagcatgcatagtgcttaatagagcacattcctggacagcctgttattattcattgaaattttagattgcatatataattataatgcattatatgtacatacatgtgtacatacaacattgcaagtttcattccataatgctctttgctttcccatctatattctccaggaaggcttgcatttaagttaagatctaagtttacaaagacacaacttaccagaatctctgggacacatttaaagcagtgtgtagagggaaatatatagcactaaatgcccacaagagaaagcaggaaagatctaaaattgacaccctaacatcacaattaaaacaactagagaagcaagagcaaacacattcaaaagctagcagaaggcaagaaataactaagatcagagcagaactgaaggagatagtgacacaaaaaaccctttaaaaaatcaatgaatccaggagctgattttttgaaaagatcaacaaaattgatagaccgctagcaagactaataaagaagaaaagagagaaaaatcaaatggacgcaataaaaaatgataaaggggatatcaccaccaatcccacagaagtacaaactaccgtcagagaatactataaacacctctatgcaaataaactagaaaatctagaagaaatggataaattcctatacagcatcccaagactaagccaggaagttgaatccctgaatagaccaataacaggctctgaaattgaggcaataattaatagcctaccacccaaaataagtccaggactagacagattcacagccgaattctaccagaggtacaaggaggagctggtaccattccttatgaagatattcaaatcaatagaaaaagagggaatcctccctaactcattttatgaggccagcatcatcctgatacaaaagcctggcacagacacaacaaaaaaaagagaattttagaccaatatccctgatgaacatcgatgagaaaatcctcaataaaatactggcaaaccgaatccagcagcacatcaaaaagcttatccaccatgatcaagtgggcttcatccctgggatacaaggctggttcagcatacaaatatcaataaatgtaatccagcatataaacagaaccaaagacaaaaaccacttgattatctcaatagatacagaaaaggcctttgacaaaattcaacagcacttcatgctaaaaaaactctcaataaactaggtattgatgggacatatctcaaaaaataagatctgtttatgacaaacccacagccaatatcatactgaatgggcaaaaactggaagcattccctttcaaaactgacacaagacagagatgccctctctcaccactccttttcaatatagtgttggaagttctggctagggcaatcaggcaggagaaagaaataaatggtattcgatcaggaaaagaggaagtcaaattgtccctgtttgcagatgatatgattgtatatttagaaaaccccatcgtctcagtgcaaaatctccttaagctgataagaaacttcagcaaattctcaggatgcaaaatcaatgtgcaaaaatcacaagcattcttatacaccaataacagacaaacagagagccaaatcatgagtgaactcccattcacaattgcttcaaagagaataaaatacccaggaaaccaacttacaaaggacgtgaaggacctcttcaaggagaactacaaaccactgctcaacaaaataaaagaggacaaaaacaaatgaaagaacattccatgctcatggataggaagaatcaatatcgtgaaaatggccatactgcctaaggtaatttatagattcaatgccatccccatcaagctaccaatgactttcttcacagaactggaaaaaactactttaaagttcatatggaaccagaaaagagcccgcgtcgccaagtcaatcctaagccaaaagaacaaagctgaaggcatcatactacctgacttcagactatactacaagcctacagtaaccaaaacagcatggtactggttccaaaacagagatatagaccaatggaacagaacagagccctcagaaataataccacacatctacaaccatctgatctttgacaaacctggcaaaaacaagcaatggggaaaggattccctatttcacaaatggtgctggaaaaactggctagccatatgtagaaagctgaaactggatcccttccttacaccttatacaaaaattaattcaagatggattaaagactttaatgttagacctaagaccataaaaaccctagaagaaaacttaggcaataccattcaggacataggcatgggcaaggacttgatgtctaaaacaccaaaagcaatggcaacaaaagccaaaattgacaaatgggatctaattcaactgaagagcttctgcacagcaaaagaaactaccatcagggtgaaaaggcaacctaaagaatgggagaaaatttttgcaatctgcacatctgacaaagggctaatttccagaatctacaaagaactcaaacaaatttacaagaaaaaatcaaacaaccccatcaaaaagtgggcaaaggacatgaacagacagttctcaaaagaagacatttctgcagccaacagacacacgaaaaaaaatattcatcatcactggccatcagagaaatgcaaatcaaaaccataatgagataccatctcacaccagttagaatggcgatcatcaggaaataacaggtgctggagaggatgtggagaaataggaacacttacactgttggtgggactataaactaattcaaccgttgtggaagacagtgtggaaattcctcaaggatctagaactagaaataccatttgacccagccatcccattactgagtatatacccaatggattataaatcatgctgctataaagacacatgcacacatacgtttattgcggcactattcacaatagcaaagacttggaaccaacccaaatgtccatcaatgatagacaggattaagaaaatgtggcacatatacaccatggaatactatgcagccataaaaaaggttgaattcatgtcctttgtagggacatggatgaagctggaaactatcattctcagcaaactgtcgcaaggacaaaaaaccaaacaccgcatgttctcactcataggcgggaattgaacaatgagaacacttggacacaggaaggggaacatcacacaccagagcctgtcgtggggtagagggagaggggagggatagcattaggagatatacctaatgtaaatgacgagttaatgggtgcagcacaccaagatagcacatgtatacatatgtagcaaacctgcacgttgtgcacatgtaccctagaacttagagtataataataaaagaaaagacctaagtttgttttacttgagtgtttgggaggcaagtattttttttcataaatgatatgtaagaactctaaattctcataaaatcataaacatttttcaacctcttggcaggctatagaattgttaatcctttttcaatggtctttaaatgttgtcatgttgccttctagcttgtagctggcccaaggcctgagtgagggtggtgctggattgtgtcgtcagggtactaaacacctgagtcctaaggatcaaagctgaaaaccaaagtagtgtgtcaaaacccaagaggcaggcaagagcaagggtcagaagcaaaataaggacaactgagagcaatgtgggatatccagcaggttagagcaattgaacttgaagaagtaacttggggctttgtcttgtaggatatagattccgcaagtaaaaaatttttgagccaaagaaagagaggaaccagacactcaagaacttcacagtatcactgagttgtgtgtctcatcatggtatattttgtagtttatatttcactgataatggaatgacacaactcaagcctttgtgtctgcagcacttcagcatttaatagctgaaatatatttgagcagctttattttggtcaccctcctttcttccacccacatgattaagatttgttaatggagatatttgtcagactgtacaagattgtgaattagatcttctctgaagtgcgacatatggctgaggatctaatcttatttctgcctgagaccttgtgtacctaggatgatcctaataaagtattatgtcttcataaagacaaaagccaggcttactgtgaaacacagcatcacatagctggaagagagctactttggtctctactattagatctaagaaagatagcatcttaactcttctaagatttaaaaaaaaatttaagacaaagtaaggcataatccttcattaatagattttatagacagaagactataaaaatatgagcactagacttgagaacctgagttctagaactgtctaaactacaaaatacaaattgtttaaatctctcttggactatttttctatctgcaaaatggagacacaaataatgttcatagtatattaacaagaaacactttttcatcacaggtaaaatcaggggctctagagccagactgcaggccttgaattctatctccactacttaccagatgttttgcctcagaaaattacctttgcaagcctcactttcttcatctataagatggaaataataatggtacttacactattttatgaagcttaattgacatcatcatggtaaatgatttaaaaagtgccaaactgtacctggaatatagtaaacagtacatttaaatttctacttgtgttatccaactagatcactgaatttccttcatattttcttgtatcaaaactgtcttgctacagatccagaagtcagttgtatctccaggtaagaagagagtgatagacttcagaactaaagtgaagtgatttatcattgagatcccatttatccgatattggaactccaggcttttaggaactgatctgtctggtaaccaagttgatatggtttggctgtgtccccacccaaatatcatcttgaattgtagctccgataattcccacatgttgtcggaggggcctggtgggagataattgaatcatagaggcagttcccccatactgttctcatggtagtgaataagtctcacaagatctgatggtttcataagggggaacccctttcacttggtcctcatttctctcttgccagccaccatgtaagacgtcccttttgccttctgccatgattgtgaggcctccccaggcatgggaaattgtgagtccattaaacctctttttctttataaattacccagtctcagttatgtctttaccagcagcatgaaaacggactaatacacaagtctcctccttgattgacttcctctctttattctctagtcctattaggtgagtttgttcttattatcttgttcttgctatattgggcttttctaatcctgagctctagttttcctatgactgggccactgaatcttgtggcatgggtcatctgaaacgccatcaactgcttgccataatctcaattctgtcccgtgtttgcaccttgtccaacactcctgatatccatccccttctaatgattttcttcatgttgattatctgctcctaattgttcctttctagacttgaaaaatattaaattgtgctattatacatatattagttgtctttgggagttagagtccacaagattttttggttaattgaatgtgttaggaaaagatgaggaaggatccacgatgaacctgaggattctggcttgatcaattgtatggccagtacttccatcaactttctagctgaggtatggagtatggcaggaggaaaagtactgcatgggagtgcaggatgaaagatgaccagtagcgttgctatgtttgcaagttgagttagaatggagatgtcagatagtgtgatagccttcatgctgaggaaagagggatgtgctagagattacaacttgggggatatcaatctatacgtagcaagtagagatctgatgattgaggatcacccaggtgagagtccacagggaaaagggaagagggcccctaaggtccagtcattttaaatgacaactgagaaaagagaattcacaaaggagcctatagaacttagaggggaaaagaaaaaagtcagaaaagtatgaagctataaaaaagaatagcttttaagagatagagagataagataattcaaatatcaagacttcaagtaagaaaatgactccaaatgtgttattactggggaccctggccagtaggttcatggggtggtgaggacagtagccagatggcagttggctgtgcactgagtggaaactgagtgagaatagatggtgaacatagacaactgttctgagaagtctggctgtaaagaggggaaggcagatactacaggagccatagggaaataaaggagagataaagagggttatgttatgtactttgcttcttttcttttgttctatttttagcaaaaatgtgaacatgcttacatacttacagagaaaagagaaattgcagatggaaaataaagagaggcaagaccctacagggaagtaaaagaatcttattctgagcacgctgaaattttatccttggataaagagacaaaacctagtagcctggttaataggaggaaaacaggaatagatgtatatggatgtagataagtctatatcactggtacagggaaattaaagaaggtacctctaacaggttctatttactctgcaagtaaattgcagacgatgaaaaagtggggtaagaggattaaatgcttcaggcgagaggaacctttaagtagtagttttctccacaaattttggaggttaataattttcagtgttttggacaaaatgaacaagttgattctaaaattgaggagaataacaaagaataaaactggctaaaacactcctgaggaagaataatgacttggagggaatatgtcctaccagataatatagcaagaattattataatgctataacaattttaaaaggatgacattggctcaaggggtaaatatataaaacaaagactcagaaacggccatatataagtggaaaattatacataagagaaatggtattgccatcattgggaacagaacaaatggcattaaaatttttttgcccaattatttattgatattgaaaacatagagttgatcttcttctcatttatacataaaaactaattccaaataaattaattacatgggaaaagcaaaaactttatactttacaaaagcaaaagaatatttcattacctcaatgtaggaatacatttatttaagacaaaagtggtaattatgaaaaaattaaggataaattcaattacattaaattaactataatagtcaaaaatactgtaagtaatgtagaaaaaaaatcaacaaactgggagaaggaatttgcatggcatacagtcaacaagataatgatgatcttagtatgtaaagcactccttcaaatcaatgagaaagtgacaatggaccaattaataaaatggaaatgagacatgaagaactatttcacagaagaggaagcacgaatggtcaaaaacataagaaaatgcagtccatctcactagttatcagggaaatgcaagttcagatcacagataaatgccattttgcatctagattggtaaaaatgattacatcttacaaagccaacctgacagacatgtggaacaacaagtaagagtgactcttacatagaactaatgcatgtatccattggcataagctctggaaagcaatttgaagttattttataaatttgaccataaatttactctaaattgactaagtaattccactcctacacacacactaaaggaaaaatcttcaatgtgtatgtgcaatcgtgtacaaatcaaaatatgtaaaaaaagttcatacagcaaaaaacttgaaaaataaaagtatttttgccttgacaagaaaaggaaaaaaaaaactgtagtatatttatataacaggttgttagagaatattgaaaatgaatgaactactgttatgtgcaactacatgcataaattgttaaaacctaagttgaaccaaaaaaggcaggactccatagaccatgatgtgctatacagacgtgcctcattttattgtacttcacagtaatgtgcttcacagatactgcattttttttcacaaattgaaagtttgtggcaactcagcatcaagcaatagcatgtgctcagtttgtgtctcggtgtcacattctgataatttttgcaatatctcaaactttttcagtattttgttacatgtgttagggtaatctgtgatcaatgatctttgatgttcctattgtaattgtttttgggcaccacaaaccatgcccatatggcaaccaacttaattgataaatgttcagtatgtctgactgcttcactgataggctgttcctctgtttctctccctattctcaggcctccatattccctgagactaaacaatattgaaattaggccaattaataacgctttcaatgttcaagtgaaagtaagggtcacccaactatcactttaaatcaaaatctagaactgattaagcttatggaggaaggcatattgactaagataggctgaaactaatcctgttgtgccaaacagccaagatgtcaatgcagaggaaaagttcttgaagaaggttaaaattgctactccagttcacacacaaatggtaaaaaagtgaaagagcctttttgctgagatggtgaaagtttgagtggtctggatagaagatcaaaccagccacaacatttccttaagccaaagcctaacccggagcaaagcccctactctcctcaattctatgaaggctgagagaaataaggaagctgcagaagaaaagttggaagctagcagaggttggttcataaggtttaagggaagaagccatctccataacataagagtgcaaggtgaagtagcaggtgctaatgtaaaggtgcagcaagttattcttaagatctagctaagataattgattaaagtggctacactgaaaagcacattttcagtgtaggcaaaacaacctcctgttggaagaaaatgccatctaggactttcatagctagaaagaagttgatgcctggcttcacagtttcaaaggacaggctgactctcttgttaggggctaatgcagctgatgactttaactgaaactagtgttcatttatcattcagaaaattctaggccccttacaaatggtgctaaatctactatgtctgtgctccataaatggaacaataaagcctggatgacagcacatctgtttacagtatggtttactgaatattgtaagcccactgttgacagctaatgctcaggaaaaaaaaaaaagatttatttcaaaacattactgctcattgacaatgcccctagtcacccaagatctctgatggagatgggcaaggatgtgaatgtttttatccagcccatctatgaatcagggagtaatttcagctttcaagtcttttttttttttttaagaccgagtatcactctatcacccaggctggagtgcagtggcgcgacctcggctcactgcaacctctgcctgctgggttcaaatgattctcttgcctcagcctcctgagtagctgggattacaggcatgtgccaccatacccggctaatttttgtatttttagtagagacggggtttcaccatgttggccaggatggtctcaaactcttgacctcaggtgatccacctgcctcaacctcccaaagttctgggattacaggtgtgagttaccacacccggcttcaagtctcattatttaagaaatacattttataaggtgaacactccgtagatagtgattcctttggcgattctgggaaaaatccattgcaaaccatctgggaaggattcatcattctaggtgccattcagaacatttgtaggtgcctcattaatgcagtaggtagcatggtagtctcataatctgaagaaacattcatgattcatgggaggaggtcaaaatagcaacattaacaagagttggaagaaattgattccaacccttatggatgactttgaggggttcaacacctcaatggaggaagtaactgcggatgtggtggaaatagcaggagaagtagaattagaagtggacctgaagatgtgactgaatagctgccatctcatgatcaaagttgaatggatgcaaagttgcttcttatggatgaaaaaaaaaagaattttgtgaaatgaaatctactcctggtgaacactgtcgaaatagcaacaaagattttagaatattacataaacataactcataaaacagcaatgaggtttgagaggattgactccaattttgaaagaagttctattgtggttaaaatattatcaaaaagcacagcatgttacaaagaaatctttcatgaaaggaagagtcaatagaagcaacaaattttattattgttttgttttaagaaattgccacagccatctcagccttcagcaaccatcaccctgatcagtcagcagctgtcaacatggaggcaagaccctccaccagcaaaaagattatgacttgctaaaggctgagatgatcgttagcattttttagcaatacaggtttttaaaattaaggtatgcacattgtttttgcaggcataatgcaatggtacacttaatagactacagtatagtgtaagtataacttttatatgcactaggaaaccaaaaatattgtgtgtctcatttcattttgatatttgctttattacagtagtctggaactgaacctacaatatctctgaggtatgcctatatttgtaaatcttagggataaataaaaagtaagcaatataaagacctaaaaaaggctaatatacacaagatggggccaaaaaatggaaggcaaagcctgcaatggtgagctaaatgttaggagtgaagtctgagtctgttcaactgtctctgatagagtaattgacaaaataaagaatagaaaattcagaataaagttggccaaagaataatatttatgccataaagtcgatgaaagaatataagacaagatctcatggcaaaatgtgggggaatattaactagggacacaagagcccctttaggtcagcttgggctaaaatctgctagtgttagaaaacacatcaaattaaaatcagaaaaaacaaacacatttgtgaaactaaatactcctgtatgcaactgaagggaagtaagaaggtatgtcaagttctctttaatagttccagatactttcccaaggcaccacaaatcacacatatttcctgaatgtctcatctttaatgaagctgcactaagtagaagcattttgtgtgtcatcaacttggtttccagccattctacttttccattatcagttatttgctaaaataagacccaggctcaaattaagaggccaattattcttttatttatttatttatttatttattattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaatatgtggtgtttggttttttgtatgaaaagaagatcttgttcatttttcctgtttctttttactctgaagtaaaggagatattactagtagcagtagaatataaaaataacaaataattgtaccatcagatgactgtatctagcttttgacattgtttaatattatctaccatctagctttactctccccaacaagtctattaagtgtcaagtcatctcaaagtcaaatatcatgaaattcagaccctgaaaaaaaaataagcgacttgtcctagctagattgatgatagaatcaaaactaacattcagatcttttgactcatgctttccttgaatcaatctaaataagccactttagatttcacatgtctagtttgcctttatctaatagctaaacttatttttattctaacattaaaagagaatattatgcatttggaaaaaatgctgttgaaaacatacattgaagctgagagtgttggtgtgtgcctgtagttccagctacttgggaggctgaggcaggagtgtagcatgagcccaggagttcgaggttgtaatgaactatgatcatgccattgcatgccaccctaggtgacagagagagacgccatctcttaaaaaaataaaaacataatattttaaattagacattgtgttttggaaaaatggaagagttatactctaaagatctttcaacaaatcttcagtatgcctttactaaatggagaagctatgtattgatatgtggtaatactattggtggatcagaaagtattaggtaattctaggtcattatgaataccaactgaaacagttcttccccaaaatcttcatagcacatctctcaaaaatggaatataatatactctttaataagattattgtctaattttttaacataagttaaatgcaattagatatttgattttctaatggttacattttaaaatatattgattttgattttgaataacattaaatgtttttccacatctagggaggacacatctatgactagcagtggcatgtgctcaggaaaggtaaatgtatgtcctggttcaggtgtattctcacttaacctctatgattttcatattcttcatctaaagttagaggagtttatttagatgcctctgtggtagatactatgggttgacttgctcagccttcatcccaccctccacctatgtggttttctatattgtagattctggaaggctaaaactacatttctcactttccttgcagtagggttctacacataaattaggtttcaccaattaaaaacacttggaaggcagaagtgaagtggaaatcattttcctcttttggctacatctacaggcttgcacagttatgatgacatgaggatcttggcaacagcattccattgtccactctccagctacctaagtgtcaagaggcagttttgacaaaggcagtgccaatcctacccattcaccagtgttcattcacttgctttgtgaatgttcagggaccatggcaatggtggcagtgacacagaggcagtcctaatccttggatcatagctatgaccttgtgttttgtattcgacaattccagcttcagcctgagagttctgtagtgttctgttagtcattactggaaggccctgcagagcctattctttcagccattccagggatgccttttgcatcttattctcaatactaaatttatttctacttaaaatacttagagttggtttttatgtcctgctctgaaacctgatatctaagtttgctgtgtgctctaatgttcttaggttactggggaacttggtgtgttttctaaaacatagtctccaatatttatggtaatttcttaaataatttaagtttctttctatgtagagtctatttgtaatgtaattttattactatcctataattatccttgttggtgttgagtacatgggagtcaagtgtataaacatatttgttaatgaatcaacagcttatattttcaggaattaggatagctattaggtgctattaaaatagagtatacatatatgttccaaaaaattttatgtactgatacaatgaattagaatgtctgaagtagatataagagtgtataattaactgtattttctaaaaggattttttgtatgaatatgaaaaaatattatttatatatacatatatatagagagagaagagaaataattatgcggatgactgctaataatctgtgatttttttatgagcgtccttttacagcattcatcttgggttaaccattacaacacctgaataactatttgatatttgccgtcacctccttaacgtcttgataatcaatattaactgcacatgaacactttacattcttcttgagctaaaactattcaaataccttcaatccttgtgaatattttcccaaattgcaaggagttcttgcaattcctctattctttatattttaaagaatgtaatacagaaagatctacataatataggtgataaattactcactttggaaactgatatttgagatctaattgaaaaaaaaaaaaacaaaaagcaagaactgagcaagcctgcaacattatcagtctcaattctgggaatatctttgttactgaattgtaaggagtgcaaccaaggatggatgataggtggggaaaaggaagtatagtgttcagtcctaatattggtaaagagtgcctggaaacgaacagcaccaaggaatgtaagcagaggaataggtcagatccaggaaaggaagcagggtagggcacatacaagaacatgtttcagaggaagcagctggccagcagctgctgaacactccagaaacagagagattcaaattgctatatagcaagctgtaaagtccaaaatgtaggagaatgggtgggtcccaggtggtctgagggaaattgaatggtcaaagaagaaaagtcgtgaaaacagtccagccaataataaaaaggataaattaggataaaacaaagataagatatctgaagtatcaggaatgagtatctttttgatattgaaggcagatatcctgtcctaaattttgggttttctattatactttggaaggaagaacttatcctacagtaaacagtccaggctgagcagaaaactgaaagtactacgctgagatggaatatatactcagaggcaaaaagcctgtcatatccattgggtggcaagcttaggattgtagtggagtgttatgtggagcagtcaggctctgggaagataattttgtgctgagagcaagacttaggcacagaaacctcaagggacaaggatcaaagaagagagaaaaattggtcctttgctgaaaattcacttgcaccaaaaagaaaatcacacagaaaggcatgaagtaaacatccaaagtcaagtagagaggggtctctgtctgtgctttcttgccatctacagtcattttcacagcagacaaaagcccacaggtgctcatttctgaagcagggcaaatgcaattagctattacaactcaatagaatgatctgtattctagtcacatcatgttgttagttgtgtttcttagcagcacactgaaaaaaggagtcgatttgtgtggcctgaccatttttccctcttatagtaaaaacaaatgttatgtctgaaaatttagatatttttacctttattttatttgttctattcaaagatattttgaatataagtggtacctgtaggcaaaaatcaactaacatttattaagcacctttttgcttgcattttacatataatagtttatgcagaactatatagttttcacagaacttagtaagttctcatagaactgatagtaaaacttcagactaagaatcagtattgcagagttcaagcttcagatgtatttctaagcagctaaaaccttgagcaaattacttccccagtcattggtttttacaactgcaaatgaggatgttaaaagctgttttacagcttgtttggacaggattaaaggggtttacatatgaaattctgttaagtttaatgaatatttattaacaaaataatgtttgccaaacagcatgcaaaggcttttgggatgatacaaaggaaataagctgtggttttggccattgaggtctgagtctaaagagggagactgaaatatacactttaaaattagagaaaatgcaggaactgtgagagtacagagaagttcagtatgaaagtaactaaaataatagccacatccaatcactcttgatgttcaatgagttattttctctttttgtttaaattatttctaatcaaaaggcaaggaacagaaatgtccattatcactgacaggtagatgatttacagttgtgaatgatgagttactcattaatgtattagtactggaggtattacgatgcagtaggtcagagccccaaggctcacagcaggctcttgtccattgtaacttaactatataacttggaaacattccagatcctctctctccctggtccttccacttactagctacgtgaccttgaacaagttacttaaactctcttttcgagctaccatttaacccagcaatctcattactgggtatatatacctcaaagagaataaatcagtctaccaaagagacacatgcacttgtatgttcattgcttcactattcacaatagtaaatacatggaatcaatccaagtaccattaatggcaaataggataaataaaatgggtatatatataccatggaatactacacagccattaaaaatgaaatcacgttatttgcagcaacatggatggagctggaggccgtaatcctaagcaaatgaatgtggaaatagaaaataaaatactgtattttctcacttataagtaggagctaaacgttaagcacacatggacataaatatgggaataatagacactgtggactacttggaggggggcatgggctaaaagctacctattgggtactatactcactatgtaggtgatgggatccttactccagtcctcagcatcacggaatattcccatgtaacaaacctgcacatgtactccctgtatctaaactaaaagttaaaaaacaaaacctctctgttctaatttatcatctacaaaataggagtaatgataggttgtacattgtaagattattatgaagattaaatgagctaatctatataaaaatttttaaaaagtgctagtaaacagtttggacttaataaatgttatctatattcatgaatgtcatttttactataatgatggtgatgatgctttggcatatctttttgtaaaatagagaataaaaagatttatctattagttgtatgatgaggattaaaatttaaaatgtctggtttaataggtccttaataaatatgaactattatgataatagtgattactactaaaaatcattccctatatatgtttagcatttcacaatataataaatgcttttatgtaaacaaataaataaaaaatataaatttataaacatataaaaatgtgtgtgtatatataggatttacagtatctacatatatgtatatatgtgggtatatatatgtgggtatatatacatatatgtgggtatatacatatatgtatatatgtgggtatatatgcatgtatatatgcaggtatatataaatatacagtatatatgtatatacacaaacgtgtatatgtatatatttatgttacatgtatatactgtaaatcatatatacacatatacacacacacaatgacacacatatatttatatatttatactcacatatattcatcagtgtgagtatatatatttatataaataattcacaattgcacaagagatgaacaggccagattgttctattcctatgtattattcacatttcatagtttgttcattagactactgtggtcttctacagaagatctttgaatttgaatgtcttactacgtctttgctgacacacacacacacacatacacacagtttctggttggtatgtggactaacataacaccttctgtttaattaattctgcattcttttctcctttcgtttcttccattgctttcctacttccataagtataacactggaatccacatatttagagaaatttacggccaggcgctgtggctcacgcctgtaatcccagcactttgggaggccgaggcgggcggatcaggaggtcaggagatcgagaccttcctggctaacacggtgaaaacctgtctctactaaaaatacaaaaaattagctgggcgtggtggcaggcgcctgtagtcccagctatgcgggaggctgaggcaggagaatggcatgaacccgggaggcagagcttgcagtgagccaagatcgtgtcactgcactccagcctgataacagagcaagactacatctcaaaataaataaataaataaataaataaataaataaataaataaatttacttatgtactgtagttgttcaagatgaaggttacacacagagaactgggtatgttatttatgagcatatttgcattcatgtagcatcttaaatgtagttggcaaccctcttctagcacaatggacacctgctggactaacaatatgtttatacaaggaaagtgaaaaatatctacgtttgcacactggctgatgaaatgaaaatagtttaaaccagtgatttttgtgtatagctttcttttaacttttttatttgggctgagaaccatgtgtgcaatggtatgatgtttataaacatttgaatgataaatttctctatgcacagagttacccaacagtgtaggtttacaagaagacactacattattgaaaacaaagtaattaaattttcgaggtcaaagttcaaggaggatcctgcccttgagactctctttccctcctcaaggagaatgagaagcctcactgggttggcaattttcggaatagaaaaatataaaaaaaaccctgacatcttccaggcctaggaacacatcgtcttttgtcttcgccctcaccaaacctatgcagaatgttgtggcacctaaatccccgtttctgggctggagactcagcattatctcttgtcaggaagttgtcagatccctgcatctgcagaccacagataatagggaaaaggaacgtcaaggtaagatctgtgtaattaattagcttgttgagcaaacagttgaaagggaaatgaatttattaatttttgaaatgtatttttaccagattaagagaagctttagagttctatcaaaaaacttccagatcaatcaacaagtgatacatatctatatctatatagatatagatatagaaaattcagtgaataaaaaagaagttacatactaataaatatattagcatattctatctggttcacctgataaccatatttgcatagtcatattagttcaataatgacttttgtttttaatagaaattaaaattacatagggcagtttaggggagtaggaaatatcatatgcttctctttgcattatgtttgttaatatcccattggccaaagcagtcatgtagccaaacctgacatccacagggtagagaaatatattctcccatggagatgaagacactaatgaatattttgatgaacaataatctcacctatgacacctgccattcatctgacatagaaatttccgatgaattaaaaatctaaacttaaaaagctaagctaacttttaaattttaatggttttatactgacacaatttcagacttctaaagttgttgcttgcagcattagtcacagtagccaagacatggaaataacttaaatgttccttgctggattcatacagaaaatatgatatacatatgcaatgggatattattcaaccatcaaaaagaatgaaattctgccatctgtgacaacatggatgaaccttgagggcattatgctaggcgaaataagtcagaaagagaaatgcaaatactatatgatctcatttctatgtggaattttaaaagtcaaacccatggaacatagaatagaatggtgattaccagagcctgcagggtgaggacatttgagagatgttgatcgaggaaacaaacgttccgttgtaagatgaataacccctggaaatctaatgtgcaagaataattttgctttccaagattatacaaaatatttcttgtatttcattaaaaattcatagtttttaactcttgttgcaactactttatttttttccggatttattgatgtacaattgacagataatattgtacacatttaagatgaacactatgatgcttagatatatgtatatattgtgaaatgattaccacaatcaagttagttaacacatgcatcacctcatatagttagtgtgtgtgtgtgtgtgtgtgtgtgtgtgtgtgtgtgtgtgtgtgtgttgagaagatttaagatctactctctctggaaatttcaagtatataatacactattaatattatttatatcttttaatgggaaattccccaattaccagtgcttatctgtttcttatagatttgtaggagctctttatctgttaaatatgctggattcttttgctcatcttttaaattttgagtgatatatctttctttgtacagaaacttaaatttcatatagccaagtgtaagtaaaacctaaggcttttctcatagtttctgctattcttttctgtaagtcgtaagtaaattatcacatcatagattttcccataaacaacataacttaggcatgttgctccagatttgatgagatgaaaaaatttttaatgtccctgaaaaaatatgtgtatataatcaatatacaaataaaccttagcaaggaaagataactacatagtaactgtttattagttgctattcactgaaacaaaagaaatcatagaaactgaatgaatatgcaacctctgtcagtcataaaacattgttaacaggctgggtgcggtggctcatgcctgtaatcccagcaatttaggaggccgagatggatgaatcacctgaggtcaggagttagagataagcctggccaacatggtgaaacccagtctctactaaaaatacaaaaaaacaaaacaaacaaacaaaaaagctgggcgtggtggcaggcacttgtaatccgagccatcaggaggctgaggcaggagaactgcctgaacccaggatggggaggttgcagtgagtcgagatggcaccactgcactccagcctgagggacaagagtgaaactccgtctcaaaacaaacaaacaaacaaacacccaaaaataaaaacaatctgttaagatagaaaaaatataatatggctacaaaataatgacaattatctattcaaataaaataaaagagagcacttttatattgtgttttttacacatagcaacatttaatattattcttgtatttttcattatctgtaatatatcaactgcattaatccctttccacaatattttatccagttaaatttttttacacatagcaacatttaatattattcttgtatttttcattctctgtaatatatcaagtgcattaatccctttcaacagtattttatccagttaagtttttttattttttaaattgacacatcattgtttgtattagtccattctcacactgctataaagaactacctgagactgggtaacttatgaaggaaagaggtttgattgactcacagttcttcaggcttaacaagaaacatgactgggaggcctcaggaaacctacaatcatggccaaaggtgaaggggaaccaagaactttcttcacgtggcagcaggggaaagagaatgtgtggtggaggggaagtgccacacacttttaaaccatcagattttgtgagcactcactcactatcacaagaacatcatgggggaaatctgctcccatgatccaatcacctgccaccaggtccttcccccaacactgggaattacaattcaacataagatttgggtggggacacagagccaaaccatactgttgtacacattttttgggtgaatgtgatattttgatacatgtatacaatctgtaatgatcaaattaggccaattgagatatacatcacctgaaacatttatctcttctttgtgttgggaacattacaattctttctcttctagctatctaaaaatatgcagtaaattatggttaattataatatcccttatttactatcaagtactagaatgtattccttttatcaaattgcgtttttgtacccattgaccaacttctctttatacctctttgcttcctttccctttccagcatctggtaaccatcagtctacctccatgatatccacttttttcactcccatgtataagtgagaacatgtgatatttgtctttctgtgcctggcttctttcacttaacataatgacctccagttccattcatgttgccgcaaatgacaggatttcattctttttgtggtatatatactacacttaaaaatccattcatctgttgatggacacaggttgattccatatctcgcctattgtgaacagtgcttcaataaacgtgggagtgcaaatatctcaagtctttaatctattttgagttagtatttgtaggtctggttaaattttaaaagggtaacagattcattaactagcacagttaaaaccagtttaaaaacgcctggctaagatttgctaaaaacctgactaagatttgctaaggttcttggatcgacatcttccaccaaatttgggaaatatttggccattattaattcagaatatttttcctccctgttctttttctcctctccctctggtactgcaattatatgggaacctacttggaattatcccacagatcactgcagctctctgcagttttttgaaatattttttctttccattcttcagattatgtaatttctgttaatcgtcttcagatatgtgaatccttccttctctggttccaatgtactgttcagcccatcaagattattcttcatttcagatattttacttttcaattctgaaattctcattgggtccttcttatagttttcatttctctgcaaagttttctcattgtttactcatattcattcttttatttaagtccttgaaaaatattaagttcttgcaagctaatttcaacagttatgtcatttcaatatttatacttttttcttgattataggttagatctaataatttttattgtatattggacattcagacgataattaaaggggttcctgattatgttaacttcctttaaaagatttggaattttgttctggcaggcagctaaaatatgttttttccctgtaaatcttgattttattctttgaatgcttttattttgtttttgaatgtatggcatctttctttctgtataatgtggtctctactcctaaagaaaggcctttctggtttctcaatgcttgagatgtttagtgtcatgtctctccctactggctgagctggaactccaactctctaatttctgacagttttgtttatctctcaatctctcagcagatgatatctgctaggcccctcagagacccatgatgattaatgagtcttttgagcccatcctctgagtggctctttcttctctggtgctctggcctataaactctaattgcttctgctgcctatgactctgacctcatcctcttcagctcagaaacattgctgctcatctcattgtattccttctgtctgcccacagcacaaaagccattccaaatccaaatcccaggagatcactggtgtatttatgtgtgtttcacatctagcaaaaatcatagttctgcactaacagtgctcagttcccaaaaatagaaacctcatttatttcctacctttttttttagttgtttacatcaggagggcgagtcttgtactagctaccctgtcattccatcacaatggccaaactagtttggtttcacaaaaggcatcaaatatttcctgtgtgtctttgtgttaagcactattttacacatatgaactatttattatctcatcataacaaatttcggaaaagcttggggttgacggtaaatgctatgtcaacacagatcagccaaagacacagtttcagacactttctttctctcagctccaaagctgtgcctgcataaaactaaaataaacagatggaaagcaaaacatgctgaggggtacaaaaatccacatgtgtggagaaaagtaccagaaacaacatctaatttttccattcatatagactctctaagagtgaaattatacttcatgaatataaatatccaaacaaagacaaccagctgaagcaaagtagtgtttgcatcaacttccacatatttgtttagactttcccaaataatgtgcttaattaaaaataaccttcaggtgcaatgagttgagttgttcagtttattcaaagtaacttgctcttatttgagtgactagatgcatttttatttttgttttgggtgaattcagtatcctgaaaatggccaacacttatttgaataatttaaattatttcttttcaaataaaatgtttaagatataacaattgcttcttacactaacattctaaaaggataatcttagaggtgaactgaggtcaattgccatgtataaagcttattctgacttcatatttttgaagattagccttttatttacaacaatttttctactcaatgcatcattgctacaggttttggtttaagaagtaaccctagatatatcttaagatcttcactaggggacaggggttttaaacatcattgccatcatcattcttgcatcatatcctcatcacatgagctttggttcaaaaatcagattttaaacgatttcaaagtcagacttttttttttttgagacggagtctcactctttcgcccaggccggactgccgtggcatgatcttggctcactgcaagctccgcctcccgggttcacaccattctcctgcctcagcctcctaagtagctgggactacaggcgcccgccaccgagcccggctgattttttgtatttttagtagatacggggtttcaccgtgttagccaagatggtctcatctcctgacctcgtgatccgcccgcctcggcctcccaaagtgctgggattacaggcgtgagccaccgcgcccgtcccagatttttatatgtgtctgttggaatataagaaccaaagcaccataaactccagctataaaatttgcttgttattaatacacaaagaaagtgaatattaagagacgaagtctgagccaagaaaataaaaaaagtaattatttttggtttaatttatacatgccatttttgcacaaaatagtgccaaaatttaatgtcacattcaaactttaaaattcattgaagcaaactctctctgtttagagatgccatgatattacatggagaacaccccaatgacttcaccaaaaaaccattaaaattaataaacaagttcagtaaagtttcaagatataaaatcaacatacaaaaatcagtgatgtttctatacaccaatagtgaattgtctgaaaagaaagcaagaaagcaatttcacttacaatggctacaaaaaaaaaaaacaaaaaaaaacccagaatgcctagtaataaatttaaccaaggaggtgaaagatctctgcaatgaaaaccaaaaaacattgaggagagaaactgaagaagacacatatatctcatgttcatggatcagaagaaataatattgttaaaatgtccgtacaatgtacacctctgcacctgcagattcagtgcaatctctatcaaaatagcaatgacaggtggggcacggtggctcacgcctgtaatcccagcactttgggaggccaaggtgggtgaatcacccgaggtcaagagttcaagaccagcctgaccaacatggtgaaaccccatctctactaaaaatacaaaaattagcttggtgtggtggcacatgcctgtaatcccagctactggggaggctgaggcaggacaatcacttgaactcgggaagcggaggttgcagtgaaccgagatcacgcctttgcactccagcctgggtgacagagtgagactctgcctcaaaaaaacaaaaaacaaaacaaaacaaacaaacaacaaaaaaccaatgacaatcttcccaaaatgagaaaaaaaaaatcttaaaatttgtgtgcaaccacagaaggccccaaattacccaagcaatcttgagcaaaaataacacggttggatacatcacatgacctgacttcaaaatataccaaaaggctagagtaaccaaaacagcatggtaaatggaataaaaatagacacatagactaatgaactgaatagagggcccagaaataaatccctgcatctacggcccactaatttttgacaatggtgccaagtatagacaatggggaaaggacagccttttcaataaatggtactgggtaaactgcatatgcacatgcagaacaatgaaactagactcctatctctcaccatatacaaaaatcaactcaaaattgattaaagacttaaacataagacctgaaatgaaactactaacagaaaacataggggaaaagctctgtgacattggcctaggtaaggattttttttttttgtaaaaaacctcaaaagtctgagcaacaaaaacaaatatagacaaataggattacatcaaactaaaaagcttctgcatagcaaagggaacaatcaatagagcaaagaggcaacctatagaatgggagaaaatatttgaaaactctacatctaataaggggttaatatccaaaatatataagaaactcaacaccaacaacaaaagtaaacccatcaaaaaatgagcgaaagacttgagtagatatttctcaaaagaagatatacaaatggccaacagataaatgaaaaagaagatgttcaacatcagaaatcatcagggaaaggcaaatcaagatgacagaaattttcacctcattccaattagaatgactactgtcaaaaaatcagaagataacaagtgttggtgaggatgtggagaaaagagaaattttacactctgctggtgggaatataaatgagtacagccattttggaaaatattaatagtttagagtttcctcaaaaaataaaaatagaactactgtatgatccagcaatcccactactgtgtatacatccaaaggaaatgaaataggtacttcgaagagatatctgcactcctatgtttattgtagtaccattcacaataaccaaaatatggaatcaacctcaatgctcatcaatttttaaatggatttaaaaagtactatcacaagggaatgttattcagtcataaaacaataaaatactgtcatttccaggaacatggatgaacctggatgacattatgttaagtaaaataagtcaggcttgggaagacagtgcatgatctcactcacatgtggaatctaaaaagttgttcttgtggaagtagacagtggaacagtagttgccacaagatagggaggttagggaacaagtggggataggagagattggccaatgggtgcaaagttatagttacacaggaggataagttctggtgttctgttgaatagcaggatgactagagttaacaacaatgtattatatgttccaaagagaagtttttgaactcattacaagcaaatgataaatgttatcagaaattgactttttaaatatgagactataataggacctgataatatcttctaataaatgaatataggaaaatcaccttgatttacactaaaaaagacaatattaaacaaaggtatattattgggaaattctctaaaatgctcaatgatggctttaaaaatagaagtttggggggctgaggtgggcaaatcatgaggtcaggagtttgagaccagcctggccaacatagtgaaaccctgtctctactaaaaaaaaaaaaaaaaaaattagccggacgtggtggcgggtgcctgtagtcccagctacttgggaggctgaggcaggagaattgcctgaacctgggaggtagaggttgcaatgagctgagatcatgccactacactacactgcagcctgggtgacagagtgagactccatctcaaaaaaaaaaaaaaaaaaaaaaaaaagaaagaacggagaatattttttaaatattctcctatttgaaaatagaatttcttaatacttttgagttcaaacaatggaagtaaagagatttggtcaccaatttaaaaactagtttgtctgtgtaattacaatttcttttctctctgagtgtaaacaaaatatttaggatcagtttattgcttgtaatgtgtcatcatttctctctttctttttttttctcacccatttaatttgtttactcttttttcccctgtgtttccagcaacataggaggatttagaaacaaaactgtcttgggcagagggagatgatggcaaatggatgaaaaactggcttcttgtttttggtggttactatagcaataatcatgatgggagatttttagccgcaagtggtttctataacaacatgatagggtgctttagaaatagacctgaggtaaacagattctttaagggcctcttaaccccttttatcccacaaaattagcatcctcttggaggatgaatattagttggcttatttgatgaaacgcttaaaatcttgcttttgttttgtaaagattaaatggttaattattctataaagacctggccttagccaatcagctcttaggctccttcacttcaggaaataattgatagcatccctactttatttctgcacagcaaattcaaatagccttaaagatatgcatttcatagtattcaccaaaaattggaaaaccataaatagtcctcgtgagaaagtgtgttcactctgacatagatcactcaagggctcttgctttactaatacttcatatacactatgatttcacctattgggctccctgacaggtggagcttttcctactctaactaatggagtctgaatactcatcctttattaggctattcagtgtgtgccagaatagacctggtccctattgagttataattcactaggtattacatggggaagtttagtaattttttgaatttattaaattttagtatcataaaaactgacatagaaaaaagcaaaggcctccatttcatacataagcatccttcaggagcccttataagtgaaagatcaaggggaatttatgacaggaatgtggtacaggagtagatggtggtaggcaggaaataatttttcaagagaaagaaagatggaaggcttaaatttagttaagtagttaaacagaggaagatggggatcaagtttggttgactttaatagtgagttattgattatctactctatgttgtacactataggtatatacaatgttgaatagtatatgggatttattttaaaaactaaattatcatatcaagtaaagcactcttattaaactattaattaaattaattgatttgaagtggccatatatttacaagaatgatttcatttatgttatgatgtctcatgcattttctacagtagagccatccttatacttttattcttttctattcagttaagctgccaattcaaaacatcagatattctctttcaaatctcagaaggatgtcagcaaccatgcatctccttctctctgatttcaaacagtacaagctattcccatttccctggtgttttgtgctcagcaatgaagcctcggaattcattacgtaatcacttgccatagccttctggggtggagtttgccaaatggatccctgggagatcaagacccattctccatgtgtgccatagggctatgcacatgagctgaggcatgtctgtattcaccaaggccctgctcagaacagcatgtgccagaatacactgggcaaggagccattcataaattcttgaaaaatcttatccagaccaaaggcacaatggcattgtagttgttgtgctcattgccatggggcttttagctgaataaaaagaaaataaaaaatatattcatgatgacttccaagttatccagtaaccacagtaacctaggttttccccaaatttggtccacaactttgagtcacctgacagaaacaaatcattctgtctttgttcaagcatagtgagccatagagtgagtgaaacaaatttccctgggataaaaaccaatgaatcagcaaagcaaacaatcatcatatatttattttactattagaaggtggtattcaaaatgtcatcaaaaccaaatacatacctcatacatacaggcatactgaaaagcatatattatagttcctgaacttaaagagtttgtttgctaattgtaaggacaagtcttcatatatggcatgaagaacactttaggttgcatatagataagtgttcaattgtatcttaacaataataaattctgtggctgctcaggccaggagctcaaggggtatgtaaaaatatgaggaggattaatgggaaaagtacactttgcattggacttctaacaatttgaatatacatcacagttaaactctcagaaagtattctgagatatttttattcatggctactataagaagaatgtcataaagaagataatttaaattctggaggaataatgtcttactcataaccacacattatttttctagactttagttctctgtacaaaaatgcgagaaaactgttgagagttgcactatccaacacagtagccattaatcacatatggcttttgagcacttgaaatgtgactaaaattaagtgtgctagaagtgtaaaatacactaaggatttcaaaggcttaatgttaaaaagtgtaaatatttcattaatagtttttacactggccaggtacggtggctcatgcctgtaatcccagcacattggggggccgaggtagacagatcacttgaaaccaggagttcgagacaagccccatctctactaaaaatagaaaaaattagctgggcatggtggcacatccctggaatcccagctactcaggaggctgaggcatgagaataccttgaacccaggaggcagaggttgcagtgagccaagatcgcaccactgcactccagcctgggtgacagagtgagactctgtctcaaataataataataataataataataatttttataccaattacatatttaaatataatgctttatctatatttggttaaatatttaaaattaatttgcctgtttgtttttcgttgttaacatggttacagaagacttaacattccatatgtagctcacattatacttccattagacagcactggtataggtgcttgctatttaagtgtagtatgtggaccaacagcatcagtattacttaggagcttaccataaatgccaagtctgaggccccactcctcctgactctgcaaggttaacaagatcctcagcagttcatatgaacattaatgtttagaaaatgctgatctagataatgttttagatgtttctttttatgactctgtcttccttttcatttggatttttttcaaataaatattttacagtctgggcatcctgacctagcacatattagatgcataaacttggggaagttatctgacattcctgaaactcaattccatatttataaaatggatgtaatacctccaatcccataatttttctataggggttaaatgaaacacaagaattatgaaaggaaccaataaattggagaaatttttataatatcaaaaataatattgaaaaattagattattctaattattttcattcttatattgattgccaatactattttgatgtacagtggaatgaactagagttcgaagggctgttttcatttattttacaaatgtcacttttttaacattaattgtgtataataaaacttagcacactgataagtctctagtagagatattaaaacttttggatcttcttttagaacaaaagtgttgtgtagctaaattttcctgcaccatcattatataattgacattgaaattatatctgttcgttgatcgattctgcaaaacatggctttatggagcgggaaaaaactttttcgtctttgttcagaacacttttagctttactgtgagaatttcaatttgctagaggcaaataaactagtaaaatatgtctattccatagtaaaaggggtcattcaaaagcctgtccttattaaaatatacattgattataataaggtcagtgatttcaggcctgattagctttaaataaatgtaatgtcaaaggaatataattagttcctcattaaaatttttcatgattgacagtgagtaaaaatgaccttcacaacttgcatcatttagtcatgttctaaggatgacaaagggcagggcatcttctatgaggtaaatgtgtatgattgcagcctgaggcacatgcacttggtcccttaccctacctaaccctaacgcccaagacctgatccaagccagaccctgtgcttaggtgtgtaggctgtgtaaaggaggacccagaagctttgattctcatggggatgctttgagagaaaaagaaacctttgaaccggcaggacctgatttcatctgtgatgatgctgatgatcagaaattatatataaaagcaaatagcaacgtgcctatcagatataggggatttaaaatatgttgacagaaaactttctcagtgaggccactgaccttctaaagaggagctaatagtagaatagggatattaagatacaggtgatgtcaatgaattttggccaaaaccaatcttcttacctggagtaagaaagtcgtgtttcaaggagtttgcatgagtattaattgtggttgatgatgatgggaacctgccctgattattaggtatgattctcagagaatgtgtgctggtgctaagcttgcatttctcagaacccccaaaactctctttgcaatattatatagtttcattttcttgaacttattcatttgttaaatatgcatttactaagcaccaactatgtacatggcactctgctagtcaatagacaaataataagatatatgtactttggaccctgcattgaaagaaaaagcaaataatgttttttaaaaaactactttatgcttgattgttataaggaactttatgtgtattatctcttttattcctaataataataagaacaaggatgattgataatgctcactctgtgccaagccctgttaggcattttatgttcattaatttaaccctttataacaactctatgagataggtgccatttttacaaaaatggaaactgaggcagagcgatgttatcttgataaaactcatagacttagtaagtggcagagccaggatttaaacccaggcaccaaacttcatgcgcttatccactatatatatggctccacatcattttctttagtaatcaggacactgaggctcagtgaaaatgttttttcttaaagtcacagagatggtaaatactagaaccaaaatttaaatctctgtctaccataaaaatgtcctcttctcactatattaaattggcctcaatttagtatttaagacaacgtgtacagtaggaatacaaaggaaaaatggtcttaaaggagcccatctacttcttattttaactgctccatgtggattctatcacgcagtacatcaaagtaagtgatttaaccaatcatttgttctgcttgattttatcaaaagaggtcaaagtaagaatttcacagcaaggcttaaatgggaattcaggtttccttgctcactcattcattattcaacaaatttctattgactgccttaccatgtgcaagccattttggctatgtcctgattaaagatgtgcccctcctgcaccgcctccctccccaccccaatcctggaactaaatttcattctctgcagaaagccaggctaaagagaattcagcaaaccactttattctcataaattggcattcttagacctggaaattttgagttctatctccagtagcattgtttataccttctatttcattctgattacatttcattagcaaaacatagcaaatgtttataaaatcgtcagtcttctaggtgaaacgatgtaagacaccattcatttgattttttggaaatatcaaattttatgttcacaattcctctattctactctgattatttaggtaaaattaggttaaatatagataactatagaattaaaatttaaaaaactgtgcctttacacgtttggaaaattactcaattttttttcaaataacgccaaccatatatattgaaaataacattattccataccacaggtgacatattcttttcctatccctagcagcgacttccccaagtccctgcttgtctcaacagtttgaggaaaaaaaacaccagaaatatacatgttccagaacaatgaataaattcccaaataactttatatacattagtgaggatacaatgaggagtgtttatctagctaaatatgaggcatattaaaaattgctactttaacccagatatgagcaataataggagttttatctacgcctccttcctttccttctgctgacaaaggatacatttaattcttgacgttaatatcagttaaaatgagatctagagacagatataattagagagctagggagagaattaagttagtaaatcttaagaaaagactgagtatactgatgataagaggatatttaaatagaattttgaaaaagatcaaggatcaataattatacatttaaatatacatatatgtatgcatatacatatgcatagttttacataaagaaactattaaggtaagagctatggctttgacagttaatactcaagaaatatttactgagcacttggtataaataaatagatatggagcacaatacaaagatacagcagatgctctgaacaattaagtccttatcacaactcaaattccatagctagcattttgctgagccaagaatttaaatggtacttaaaatttatagaggccggggactgtggctcaagcctgtaatcctagcactttgggaggcctggatggctgaggcgggcagattgcctgagctcaggagttcgagaccaccctggcggcaacatggtgaaacccccatctctactaaaatacaaaaaattaaccaggcatggtggtgggcttctgtcatcccagctctttgggaggctgaggcaggagaatcacttgagcctgggagatggaggttgcagtgagctgagatcatgctactgtactccagcctgggcgacagagcaagactctgtctcaaaataataataataataataaataatttaaaaatgtataatcagatgttaaatattttcttgcaaaaaacaagggagctggggaacagaacctttttaattcaatttcataattatttttgtccgatcctgaccattcccaggtaatttacaggaagggcatagttggcaccttgaattagtccattgttaggctttctatgtaagggtactcgtgtttttttgtttgtttattttgtttcattctctttcttaaaataaaattccttcagtgaaaattattagtgacttgtacctttttaattatttttattgctatgttttgtacttgttcagtaaattttctattaagaactcaaaactatttctcaacatcttataaaggtaagagctagcatttaccaaacacttacgatgtgtctgcaaagcatttaaatttagtgacttaattctcacacaccaaaaaaaaaaaaaaaaaaaaaaaaaaaaaaaaaaaaaaaaacagaaaccaaggctgggagaggcagagcaggcctggtacccatctgttgccccttcccactgtattatcctgactcgctggtaaatctcctatgattgctaaatagaaaagtcaatgaaaagattgataataaaaaccactgaatacaactttcagattcttgattgatgattttaaattagagaattacctgtttcatagaaaagtgcaatagaactatcaaggacaaaggaataaatactacttacaatagagaaattaacatgttcttccctgaaagtcttgcaccttgcactgtttcattgctctaaataaacatactcggcctcataatgaaacaaaattaccaatatggctattttccaagtcaatttaattattagaaaatacatacacacagatgcatacacacacacacaagaaatatatttactgttatttgggtcttcatcttccttaaaactggtcaaatttgtttttacttctcagcagacaaaaaaactttattttagcactagaaatacttaatgcaaatatagaaataattgcttatagtaactatataaaatcttttcttttctcttgtgcagaggttttcaaattgctggtctcaaaccctagctccttggaggtgtctctaggggaggcaggagactggtctgactgggctccaagggaccttccctgcttcgacctgagcagatctgctttccaattgtgtacattgggattcctcatgacattttccttgaaggaattctgctgctcttaaaaagaaaaaagaaaggaaaagagggaaaacaaaaagtctgaaactcacagtggtagaatttcttaaaacagccagtagatggcaaactttactgcaaggaaacaattttgcagcctatataatttggtctgaaaatagcaattaaactctacatccagtaaaatttgctatcctgtatataagtcttctgttaaatcaggaaacaaaattctctatggtactttctctgggaactaaatttcaattataatttaaaatatcctataacttctttctgtgtccatttaagtcttgctctgaaggtattatcactatgaaaattattgcattgttcactgaaagtacatacaatgtgctaggtatagtaatgtagatgacgtagttttttcattaggatgaacccaactatgtattttattaatgagtttggttgaggcagcacaaaggtcacaaagaaagatttttaactttgtcctcatttataaatttaatcttgttactttttatttccttgtagattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtaagtgtgatcatatctgaatcacagatggtgtagttagctctttctaagtggcagaagcagaggtgacattttatttttcacacaatcatttatgaaaatggccaagttcttgacaggaatcaatcactagatagaaactccctaaactgctgaaaatccactgaatgcactgaattctaagtggttgcctgctgtcactgttgctgttttaaatggagctctacatgatttaaaactggattcagtctagaatgaatgaggtccaagagaaactcaagggcagttcaggtttcctcatcagtgcatgttcctttcattccagttcaagcctgctttctaatccccaaagcctggcactgcaaccttctgggaaggcagtttggaagttgatgggtttctagtgctgacttgagtattatcaacagatcagtggtagtaaagctgatggagcatggtatatcagataaaccacgatttttattaagaaaaaaagcctgttcttgttttacgtcttagagcaaacaattgtacctcatatttatctatctattctttacaatgtttctgttgatagaattttattttaataataaagtaacaagttgacaactcatcattaccaagttacatgctattcagcctcttcacactcagtatttatcctccctatccttttgaatcactgttactgttttaggtcaattcttcacgatggccacatttcttgctttgctttattctttggcttttccatttacttgtaagggggtaacttacctagcctatgctttctcacatgcattcattctaacttctgctcaccactttcttacagttcctgactcatatctctaagacaccacacacattttaataccatgttctcccttagcacttgccgtttttgtaccttcctgaaagccttcctgaggctttcagcttttaaacttgccttcttctcccaacactttcacacttagttctttattttgtcattctttttccaagtgttaagcaatatatctatttggaaaatatttctcttcaaaatttgcaccagaaccctccagcatcattttacttttaaacattctaaaactatatattttataaaatagacacattcctagttgctctaaaatgaaatttttcccctctccctcctcctttacatacaaccagtcttcagaatctgctgttttgacatctaagatatgttccaaattgagctcatccattcttttccttggttaggtttatttcaactcttgtgtgtactactacacaacctcccagacgttctacttatagcttctaccttctcgaagttgttctgaacactgcctttgaaataacttttctaaaatagacctatgccgtagttctgaagagccttgagagcttcccactacacagagaataattttagcctctccctgaaagcacttcacaatttgggcccatgacagtggccatgtcctcacacattccaccgaagccttctatttcctctaataaatcttcttcatttcttatacaagtcatttctttccccctggaatgtccttcctcacttcacaatgtctactctgaagttctgctatactttttaagacctagttcaaatatcacccaacacaagaagtgtttccaggttcctttccagctggaataataattccacactgctgcagtaattatattcattatgtttgtactagttgacacctgtattaaagaatcccctataattctttcctattttacatatatctatgtttttgcacccccccccaaatgttagtttctaaaggacagagtattgttttatatttattctttaattcatcaatactttctgagtttctattagatgtcagttagtggattaagaagaggagtcctcggccaggcgcggtggctcacgcctgtaatcccagcactttgggaggccgaggcgggaggatcacgaggtcaggagatcgagactactgtgaaatcccgtctctactaaaaatacaaaaaattagccaggtgtggtggcgggcgcctgtagtcgcagctactcatgaacccgggaggcagagcttgcagtgagccgagatcgcgccactgcactccagcctgggcaacacagccagtctccgtctcaaaaaaaaaaagaggagccctcttcctccaagagcctgactcagtatttgtgagtaatggctgcttaatcaactgttactaaattgttctaagttttacaattcttccatatatttctgggcacccttccccatcctgaaactcaggtaaatgaatattaaataagaattcactttttgtattattttatgtatactctatgatgctaaaatgcttatgtcaaatggaaaattattttatcaagtgacttaattgtcaatactatctaaaagttataggaaatattttaaaagcttataaaacaatagttgtatgaaaagctccttgtttgtatgccatactgaggtgtctctttctttggtggagttatggcaggtgaatttcaatattttttaaatttttgaataaaaataagaaatttttgtggggctggcttggaagtgctttgtttacaatggtcacatttaaaaatcaatacagttcattaagatagtgtcttccattttctgcttctatctcaatattgtgaatggtgattaaaaggaatagatataaaatcaaattaatgtttcattcatttcaactatagtattgtgtaatagtcttatatttgtaaaaaaaacacagcttgcaaaactatattttacaatgtatgttttttaaatatcttaattaaattggattttaatgaatcctttcagtcgtctaaatttaggcataaaagatggaaagggtggccaggtgtggtggctcacgcctgtaatcccagcactttcggaggctgaggccggcagatcacgaggtcaggagatggataccacactggccaacatggtgaaaccacatctctactaaaaatacaagtcccagctactgggaggctgaggcaggagaattgcttgaattggggaggcagaggttgcagtgagctgagattgtgccattgcactccagcctgagcgacagggtgagaccctgtctcaaaaaaacaaaaaacaaaaaacaaaacaaacaaaaaaaacagctagaaagagtatattctaaatgtgaaatgtagtcaaattccatcataaggcacttcaccttacaatgaattcatttatactgtaggttgtatcacatccctgtagggtccaatgggaatgagtccccttttctcactataacacttaggtccacaatgaggatgctttccttgtcaatccctgatataatagtgttgttccctatttgactatattcttcccttgttttctatgaaatcagctacatgttattatttcaccttttcaagtgacatatataaaactttcttgaaaacagaatttaaacaagagactcataaggcagataaaaatcgggtctattattagctggttaggcttgttcgggtaaaaaaaaaaatgcagtcataggcttgctcaccaatctcctacacaagtagaatggcctgtgttctagtagctcatgggtgtttctcagccctgactactcattagcaattacccagggagctctgaaacagaggtgctcagactctacttccagagggtcaaatttaattgatgagtctaatgtatagccagggctggcggccaaatattaagttcatgtgagctttatttggaaatttttcttgcaccataccatcatttagacacacagggaagtgtgtttatttcattgctatcccatgaccaccagtgtttgtggcagcccaggccaactaacgagaaccccaaagaaggtctgtagaaccaagggaaaagccaaagttgagaaggaaagaaaaaagaccatcagcaatcagcatggatgtgctggagtgctctgcctcaacttagacctcctgatgaatcctggaaactgtattacaatgacctagctgctgtgcaccacatccaaatttagagtgatcataaagaactcctcttacagaaaaaaacctgtgttcctctgagcagcaaagtaagaaaaggtaataaattttaaaaggcagagaggtagaaggggaaaaagagctgtagcacatagagagggttcacactgcgtgaattctcctctgtgcactccattatgcttcatgggcagtgattcatgaactacagaaatggtctcagagagagccactgaagaggctggtgagaatctgctgtgcataagcaaaaactccaattgaagctgaaagtaagtggatgcaaacttttttaatgaaaagaatattagctctaagcatgtgactgcttttagttcaatttcatgcaatgaatcatttcataattgaggccttctttaaaattagccagattgattaatgtacatttttctcattcagatgcctgcagtatgagaaaaatagggctgtaagagggcagagaaaggccagttcaatgtatgttgaaacaaatcaatgtagaaaaatatcttattcctctattacaaaatagatctttggtataaaagtaatcttttgggaaataagaaaatgcactatattcaatgtacttttcaactatatgatgaatttccttgcagaaataaaaatgtacaaaaattcatcatatagtgaaggaaatgtatttgtacttacagagtagttagaagactagttagttcatggagactagttaggaggccattgtgataacccaggtataaggttttaggacctggcctgggagagtggccatgggcatgaaaggaaagagaaagtataatgtctctagaaacaagactcacttaacatttatcaaggtcagagtattttcaaacttattgtatccaaggaaaacttgaaaactctgatatgaaacaaatgcattaaaagtttaactggcattgtcaacttaataagcttacaatgtagatcaatgggtctcaagtgttggcatgcatcagactcacctatacagcttatcaataaaatactgttttcagttcaacagatctgaggtgggggtccaagaatatgcatttaaaacaagttcccatgtgatgctgatgctgttagtttggggactacactttgagaaccactgacatagacagttatgtggatttccatgtgacatccttgactgttatttcacaaagtccatgaggcaaggaaacacaaatcaataaaagcaggcttttatataaagcacttattgctagtaacagttctaggtacttgatgatatgatttgagtgattgcctcctccaatactcatgtgttggagacataatcaccaatgcaatagtattgggaggtgggaactaagaggaggtatttaggccatgaggatggaaccttcaggaatggattaataccataataaaaagggctttttggagtgggttcacccccttccactcttatgccatgtgaggaacaatgttcctatcctctggaggatgcagccttcatggcaccatcttggatgtggggatttaccagacaccaagcccactggaaccttggtcttgaacttttaaacatccggagctaagagaaataaatttctgttctttataaattacccagtcctatatattctgttataccagcaccagatggactataagacacatgatatggattttttaaatatttgtcgaattcattagatcattaatttattcaacacatatatattgagtacctcaatgaattgggcattgttctatgttctgaaaatgaaagcgtaaagagaagtgatgacaaagtctcttacattctgcaaggaagagatagatgtctataaaacaagtaatagatatactgtatatagtaggttagagggtaataactgcatggagaaaagtaaaacaaaataatggtattagggattaactttaggtagaatgatcaagaaagtcttcactgagaaggtgacatgtgaataaagttctaaagaggagaggatgggaaccaaggaaatgtcttgtggaatagcattccaggcagaggaacagcagatgcaaaggccctgaggtaaagagtccttgcaatgtttgaggagcagcaataaagttagtgtgactggagtgaaggaggaaggagataggtcagagcaataatgaggtcagactgtttgggaccttgtaggccattgtaaggactttggcttttactttaagtgagatgggatgttattggagagttctgagcagagaactgaaatgatttgacttacattttaacaaggtcactctgcttattatgttgaagatacactgcagggggcgataagcatggaattcaagtgtctaagggaggttaatacaatagtccaagaaaatccactccttgtgggagagaagagtgaaagagacctatcaagttttttgtttctttttgttttaattttttttttcagatggagtctctctctgttgcccaggctggagtgcagtggtgcaatctcggctcgctgcaacctccacctcccaggttcaagcaattctcctgcctcagcctccttagtagctgggagtacaggagcgtgccaccacgcccagctaattttttgcatttttagtagagatggcatttcaccatgttagccagggtggcctcgatctccggagcctgtgatccgccgcctaggcctcccagagtggtgggattacaggcatgagccacctcgcccggcccctatcaagttttaacagtaactttctcccctccctgttccacccttaacatttaagatggaaattaacaaagaaggatcatggatcatgcaaacaaaatgaaagcatgcctttctctctctgccctctattgccctctgatggcaatgtctagattattcagaacaaatctgtcctttagaatattctaacaagaatgcagtctttcttagtagcttctgtccaccatattgccatgcagtgtctttcacgtacacaactgcaacatattttacctccctgggttacatgatggttactcatttaaagtgtcctatcagcacttcttttacttttaatgataattcctgttcctcttgggccttctccaatagtcctcatccatgctgatgcataagtctaagaggtatgatgtaactgacactgccattacagtggcacatatcaaagacataattcgaatttcagtcgttgtggaggtttgaatctgggcttggtgttctatcttttctaaatatattttgatcaactaaatcactttgaaggcatctgtggcaaataatatagataatttaatggtcatgggaaataatttgaggaaaataaaatatgttattaaatataagcttatttcatgagaaataatattattatatcaaagaaaaatggttgtttttatatgcgcttaattatgaaattgataatgttttatggtgtcttataaagaaaattaaacacttgttcaggcttttgctcagaactagagtcatttgaagtagtttttatgaataaatgaagtttccaggttttgacaaatgtttgttgaatgagtgcacaaaataacaaatattcactcagcaaatacttatatttgcaatgcactgggcattgtgcggacttcggagatgtaaaagtgactaagataaaatgtattcctgacaaaatgctcacaaattattctgggatcaggaatgtaaacaacaattaccatctgtctataaacatcatgctgtggaagaacaaagaaagaagctggtaatgttggttggagtcaggaaatgttcctaggaaaaaaaatggcctatgagtagagcaaaaatgcatccctttcagaatgtaaaactgaaacttgtatcttcctcctacatttactattattatttgaacaataacatgttgaatatcaagggagaaggactgcagagatattttggaaaggtgttgctatgatctgaaaagtttggtccttccaaaatgtatatgttgaaatgctgtccaaggcgatgaaaaggtgaggcttttgggaggtaatttggtcattgcggggaagctctcataaataggctatgtgcccttataaaagaggtccaagagagatccctcaccccttctaccatgtgaggacatagaaagaaattataatctatgagccagaacgacagctttctctctgacatgtgactgctatttctcctagtgcctacctagttatcagcagggtgtgtgtgccagtccgaatgcaaaggggatgagccaaaaaatatatagtaatataaagaacggatgtggtggaaagacaaatttggaagtagaagacagggattccaggctcagcctagatgttctctagtggtttggtactgataaataacaattatgaacttccatttcctcattcaaagattggcatggtaatacaacctaacttttagggtcatgatgagaatgaaatggattaacaaaagtttttccatagactatttaggctatgaaagagttaattgccaatatttctgtctcttaaaacattgctactaatgaatacctatggtatctaaacaatgtttgcctttgttttttacaggtatcattttcttatatttgaattgcattcaagtaatcttatacctgattacttgaaagtattattttttgaatactgttagaacccaactcaggaatagattaactgaagttcggtcaaaatctctctgccacacttataaatttaaagtgtaatattttaatatgtgtaggcaagaattcaacttctaaaatggccatatcataaaataaagaactaagaaattactactattttaacaatttcatatatttaggaatagtaattatcctaatgaagagaaacataagaaagtaatttgctatgattaaaacataattatggaagtacgaaaatatataatgtttaatactgatgtatttaacataaaatgagaatgttgtaatttttctataatctttcaaaaaaacataaaattaaagcataaaccattcataaaagtagtgtatttttcaaacatagcatcttggagtctctgaaatgggttactccagcttttaaaatttgatatatattttgctattttcataattcttttaaaaagtgtgggtgtatatatatgtataaaatatagaaagtgtagggggaaagtcattcgtttaacttgggaaaataatatattactatcttgtaaattttatgatatttatgatgcaagtgaagtgggagaaatggcatacagatggatttagagaaaaatggctggagaagaggaatgaagaatgagctcacagaattagaagaaactgttctccaaacagacaactgtaatcattagatacaaggaagtaggagaatttcctcccaatgccccactcctagggctgacaaagagaagacattctttctcttcctagaattagtttcagcctccatgatattctgggaagatggttttgaaactgtcaagaacattcttaaactttcactgatggtaaaatggtaccaaagaggacacaatgtgaaaaggattaagaaaacctgaaaaaaatgtttaatatggaaaccacaggttattacagttttgtctagcagtaaagcaaaacttgtagaaacaaaaaggattataatagtcacaataacaaaataataaaatataatcaaatagttaaataaaataatgacaaagcattaataatatttataaagacaaattttctgtatcatcagatttaatacatcatcagtcttacatacatttcagatatcattaagaaagaaaaattatttggttaagttgtaacaagaggctaaggcactgctgattgtaaagtgcatctcggttctagagagttaaaaatgtgagggagtaaaaaaggagtcagaattgacaaaattcggcagtccttcagagatagaatcctgggcttgtaaaatctgctttaagtgaatgattcaaaaagagaattttgttatttttggtgtccttaggaaaggtgtgtctaaattcacaagccagaaatctcattggctaaaacgccaaagatgttcccactgaaaataataattatccacgtttaatctcttacaacatcttgctaaacattgttatgcttatgttattaatcagagcaggaagtcatccagcctctccttattgctttaggatgttaaacagattgactataatatctaggaggagaacttactgtaaatctatcactataatgaaaaccgaatgctacagttccacattgctctgatacttgtgtcaccgacttgcactgataactgttgtacttgatatacataaaaagccccaaaatagcatacataattattattcaaaagaaaaatattatgcatagaggcctgttaggcatcacatacattgaatggaatttgaaatttaagatgatagtctgaagccagactacaattatttccaaagcgtggactctgcagataatgagaaaggcattcagaatggtttatcaacaccttgctgcgtgcatggtgtgctccctgcccactgtaaagaatgatgaagacagcgtcaaagtcaagacctgttccatcctgataggatataatgtccattatcttgtggcacggaatcttaacatggatctctaaatgccgaaagatgccaattggagtgcaaagtctctaaatactgatcacaagtttggggcacaatcattctgaaaccataataggttttaaacatttgccaaagccacaaatttgacttttgggcttttgatttatggcttgtggaagcactgagaagctctgtttggcatacagtttgccttcctgtagaggtggttgattattccatagctgtgacttgattattcatgcattcaacatttattgagcactttttaaatattcaagaatatgtgctaaatgccacagatattggtgttaaaggtcaaaggccctgacctcaaggagctcacaattttgtagataaaatagaaaaataagcaattgaggacaatatatatagacatttatattaaggggaattttgagagcacagtgaagcagcattagaggcaaatataagtaactatagtttccagaatcatgggatacacaaactggatatttgggaactaactggagctagcctggggaaggagggagtgaggagtggggcattacaagtaagggaaatacctatatgcagcctggagtcttgagatacagtggagctgtgaggccactgctgtgggtggcaccagtagaatctacatcttttagaagcttctactgcattacaaggcaattatgctttatttcagagacagggagatagagaggggatgatgtcaaaaatttaagcagacgagggtacaattatatttgtactttatagtgatcacatttctatagaaatgtagagagtgattgcgaaaagagaagtcaataatagtgagagcagatgagacatgatgagggttgaattaaggtcacagcaataaggatggcaccttagatccatttctaagagagagatgatgagatctgatgactaattaggacacggggaatagtggcaaataagatgataactcctagaactatggcttggatgacctggatgataataccattcactgagaggagagttttggcagggatgggggtggcgcaaatcagcacaggtggggagatgaaggttatcattatttggaattgtggaatgatgcctgtattagtccattttcactctgctaataaagacataccctagactgggtgatttatttaggaaaaaggtttaattaactcacagttccacatggctggggaggtctcgcaatcatggcaggaggtaaggaggaacaagttgcgtcttacatggatggcagcaggcaaagagagagcttgtgcagggaaactccccctaataaaaccatcagatcttgtgagacttattcactatcacaagaacagcacaggaaagacctgcccccatgattcaattacctcccacagggtccatcccataacacctgggaattcaagatgggatttggatggggacacagccaatgcctgtgagataactcaatgccattgagatctcaatgcctgtgagataactgaagaagacattctagacggtatcaggaggatgatctgggccagacgcagtggctcatgcctgtaatcccagcactttgggaggctgaggcaggcggatcacttgaggtcaggagtttgagaccagcctgaccaacatggtgaaaccccatctctacaaaaaatacaaaaattagccaagcatgatggcatgcgcctgtagtctcagctacttggaaggctgaggcatgagaattgcttaaacctgggaggcagaggttgcagcgagccaagaaagcaccactggtggcaaagtgagatgagtgagactccatctcagaaaaaaaaaagaaaagggtgatctggtctggaggtacagaatgctaatgtatatctacattcgcttatgtgaaaacgtcacagggaaaaatctttctgacttctgtgagaatgatcacctgtttctctacctatagtctcttctcaactacgaatagataaaccaaacattttttttcccaatgcacctttaatcccatggcttttgctgaaacttggcatttattcaatgaaaccactttccacacaatcctctttgaagagtccttatctccatgattcattcttaaggccaagagggaaggttggctttcttgctgaaaccactgttcccatgagtccactagtgggacatttaacttcagttttaaaaggatggcttccttgggtggacaagggggaaaaagcattccagacagagatcagtgtatacaaaaactttgagtggtagaggtatatggtaggtttgaggaaaagcaaacagtctggtatgacatatgactagcatgtagaatgatgacagaattttaataggagccattggaattgtatggaccatgcttttggaattctgtgagcttcttattctcagtcaccttcatctttattccactgcagccatacattgatccaatttcaagttagaccctggcgtcattcaaacctgctttacaacagaaattgtcaccacatcctgaggcttctcatttcctttctactattgaatttttagcagaacctctgtcgcctggcctttccatacccatactctctctcactccttctctatcttgacatctccccaacaatcatggacttaatgagaagcatctcaagaatgtgtctgtcattgctctctaaacattcttgtttttgaccttcaactttccagtagtggaaagccccattttctaccttcttctcgtctagctgtaaagctattaatccacttcaaatatttattacctaattttagctatatatttgctattgctttgtggctttttctacattaattgttgatttttttaaatggtatttgacacgctggctgctccaaatttttccagtctctatattttatactcccagtaatgtcatttatatttattgataagtgaatttaaggttattctaaattctcttttagagttgtctttgcttccagtcacttttcaaacattttttattctacctaccctgaagaattaagggtggaatgcaggaaatgacaaacacactatagtaatacctaccattgatgtagcatttactgtatccaacctcgttgttagtagtgatagagcagagctcagtcctggatggtctgtcaaaaaaatttatgttctttccactcttccatgaccttagttatgccaagtaaaatagccatggaaaatctcattcacagactgcagtagaaatagctaagcctcaaagagcaagccacttacctagaaacaagtgctattgcaaaaatttccattttcaccgacataaatttagagttttttattttttaaaaaacaatcaaatttaatatgctagcttctcttttaagttggttatttgttgaatctagtaacagttgtaaataatagatggtgttagaatatcctgctgcattttctgtagagaaaaatgggcacaaatcaattgaactactactgacttctgagttttttgaaagtcttttaataccattttaatatataatttattatttggggttagaaacaaagaaataaagatggataagtatagatattcttccttttgtgtcttttaaaacctgtatgcaaatgcaattattgcatatcaaatactattttggcacttaataaaatagtttgttatttaaatactactacaacttgtataaatcataaacttattttgcttagcaaataatacctactaattttggggggataagtacagtttttttttaacataacattaccttaaaatgaagtgttaatagcttctaatgatgccattaattacattgtcaccagtttttgtatttaagggtagtattttacaaaaagaaaaattaagataaaaatgtctatgcaaaatgagcacttagatcaataattgcacattatatttgtacaatagattttttgtggaaaaaagtgttttttctctagcaaatacttagtatgtatcaggtactgctataagtacttttgaacacatttaattagactaagagtcctatgagataattaccactatcgtctttttcacatgaggaagctgaaacatggaaaggctgagaagcttgcccaaggtcatacagctaataagtggctgtgccaggatcccgacccaactgtctggctttggagtctgagctcttacccactgttctctctgctcctttactaaattaagtgtttaaaaataatggaaaaacatcgaccagccacttttaggcttccaacaaaagtgcagttaacaataaactttgttctaaaaatgacttatttgttttcacggactaaacaccacaagctgttgtatgcaataattctttgtaacagctgctctgccttgtgcaacttcccacaagcacaccaaaagttaatatcaattacaattaagggggaaagttattttgggtaacagaacatttgacaagtgctctggtaaacaaagcattgtcaaattgctaaattatgaacactttgctaaaactttttctgttttttctgtgctgacttttttaaaaggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacaggtacattttctctggcgttgggtgattggcttagaactccctgaccatgaactattttaccactctgttgaatttagagctctcacgttctcggcttaaaatttggggtgtaactttatactttaactgatgaaaacattcagatttcactaaaaagggtattcttggagaccatctgtctcaagagggaagattttacaagtcattcttgtaatagtttagaactgcttatcctatggaaaatggccaatttttcaattccatgaaataaagctgttgtagataggaaaggtgcaaaaacagagctagagattattatatatgtgtacataagtttgtatctatatgtcaaggatataaatcagatgacagcaataaatccttttaaagtgttatataaaccatgttggaaaaggcagtgatatttaattacttatatcttgaattaatttccatgtgttcagggaattgggtgaatatttttgagaaagcataatggcgagaaatagccatgtgattctgcttcaaattgaagtctatcattggctttcaggcaaaatagaacagcaataaattacatctcaatatgatgaatataataaatgtgtgtaacagtaattgagctcatataaaacatttttaaaagaactttctaatacttatttaagccacgacactgaagaactttctaatctttatttaagccacgatgctgagttaccaaatacataacaatttttaacaagattagcacttaaaattatcgtttgattcttcgacagctcagtggaaggcaagataagtatttatgtttccatattacaataaggagtctaaagtttagggaaatgagaagacgcccgcaagttcacacaattaattctttgcaaaaggaagaccagaatggttttcctttatttagtaaataagacataatttatgccaaatctaatttcaaagtgaatcagagtcaaaaggagagcaataaaaggcacatatgcttcaaaaatttgcaaaaataatgacttttttttttttttttttttttttgagatggagtcttgctgtgtcacccaggctggagtgcagtggtgtgatcttggttcaccgcaacctccgccttccggttcaagcaattctcctgcctcagtctcctgagtagctggtattacatatgcccaccaccatgcctggctaattttgctatttttagtagagatagggtttcaccatgttggcgaggctggtctcgaactcctgaccgcaggtgatctacctgcctctgcctcctgaagtgttgcgattacaggtgtgagccactgcacctggctctcaaattttaatagaacaatgtggttgtacattctttttaaaatataacttttaattacattccatgtcttgcctttgacttttagttgtaccccaataatgctctaggggcataaatctacattcctggagacaggtaactggccaacacagagacagacaggtcacaatggaagtttccacacaaggcctcctagaggaaaaggaggcttacccttccatacttcactgtttccagaaagcatcaggacagaaacgacacaactttttgattccaatggaaatgtaaacaaggctgaaactttgctatcttttattctcctcacttgaatatgccatgaataatttccctattgtaccattatctcttattgcctaaatgttgagatgatagtcataagatcaatccaatataacctgactttatgttcccacaaaaatttaaaatgtttgctatgagatacattggaaaatcagaactgaaaaaaaaaaaaagaacttcttgcataccaaaggaattatgcaaatggagcttctaattccgtgaggtccactagtcagccagccaagccctttggcaacagggtttttgtcgctaatgttttacctatactagatttttagtaggtattttttaattgaacaaatggaatactgaatagatttctaacaacacatatgaagattacagtcacttacaatatttggtttggtgataaaaacacacacagccatagcgaagaggactctacctgccttataaattcatagatattcttttcccaagaccctcattttgcctaagctgagtgtgcaggtacattttttacaatactaaatccttgaggagaccccgacctaaattaaaagtctcctcttaataaaatcaacaactttcttcattagatttgtattttggggctatttgataattccagtcattccgttaataattagaaatagtaaggcctaaatattcttgcaatctaaaaataagagaacatcgtaagtcacaattcatttaataaaggcttttcctgagtttttcataatttatggtttcacttttcatatggaaccttattaatgggctctctgtataacagagtgccatgatggtataaatcattctctaccaccttaaaaaatattaacaattttattaagtgctatttagtagcaacatatttagtacttcagatatgtggaatactgtgtctattctttatatgcatacttaattgtcacaataaccttgtaatataggtactatattcaatttatgaatgaagaaactgaactaaatagtcatggtttgcatgaccctgtactttaaattttttaaagttaataagacattaatatggaaataaatcatgcattcagtcctgtatagataattccccagagtttttgaggtagtaagatgatgccatgggtcttgggttgatagacagttgaagaaacagtataaagatatctgatctcaatatgactaagagttgacatgaaaatttcatttactttccagatatagctgtaactgcacgggtagtggattcacagggacacactgtgagaccttgatgcctctttgttggtcaaaaccttgtcacaataatgctacatgtgaggacagtgttgacaattacacttgtcactgctggcctggtgagtgacaaaataccttccaccaattatttttcatttgtttagaatacacatatcgcttatagcaaatgaaatgaaaaattattgttgttaaatgttttaaatcaatttcttctagctaatattgtttagttttattcttcagtgctcacacatatttactgctatactaaatgttgtctgaagtaggttaccaagctgcccaatgatcataaccctctagaggaatagaagggaaaaatcaatggaaagatgaaattcagcatgatcttcatggagaaaaattcactggaagatgctcttttcttccaagatgttctcttatatggcaggaatatatagaaatccatgaaataatgttaaactattagaaacttgtattctcttaggcatttgtaaagagttatatttgttaatataataaaaagttaattatctataaaccataattaaagtttacatatagaggataattagacgagtatagaggtgatacaagaatcaatagaaaacagtatgtaacatttgtgttacattacaggccataggcaaatattgatgctaattttgcaaaacaaactgcctgacatacagctttgcattgcataacaacattttggtcaatgacggaccacatatacaaccgtggtcctgtaagattacaatagagctgaacaattcctactgcctagtgatgtcatggctgtcttaacattgtagtatcactcactatccatgggattgtggtggtccctcaggaagtattccaaaagaacgcattgttgtcataggagatgacagcttcatgtgtgttattgttgctgaagacatttcagtgggacaagatgtggaggtagaagacagtgatattgataatcctgactccatgtaggcctagactatggtgtgtgcttggttcttaatttttaataaaaggtttaaaagcttaaaaaattcaaaatagaataagatgtaaagaaattatttattgtttatttatttatttttattttttgaaacggagtctctctctgtcgcccaggctggaatgcagtggtgtgatctccgctcactataagctccgcctcccgggttcacaccattttcctgcctcagcctcccgagtagctggtactacaggtgcctgccaccatgcccggctaattttttgtatttttagtagagacggggtttcactgtgttagccaggatgggctcaatctcctaaccttgtgatccgcccgcctcagcctcccaaagtgctgggattacaggcataagccactgcgcctggcccataaagaaattattttatacagctgtacatgtgtttgtgatttaagctaagcattatttaagagccaaaaggtttaaaaatttgaaaaatttataaagtaaaaaagttctagtacactaaggttagtttttaagacagaaaattttctaataaacctagagtagcctaagcatacagtatttataaaatctacagtagtatacaataatgttgtaggctttcacattcattcattactcattgactctcaagagcaacttccagacctccaagctctattcatgttagtaccctacacaggtgtaccacttaaaaaaatcttttatactgtgtttttattgtaccttttgtatgtttaagtatgtttagatacacaaataccattgtgtttcaattgcctacagtattcagtacagtaacatgctgtacaggtttgtagcctagcagcaatagactataccctatagcctaggtatgtagtcagctataacatttaggtctgtataagtacactctatgattttcacaccatgatgaaattgtgtaatgacttacttctcagaacaaatgtttgtctttaagtgatgcatgactcttttttaaaatctaattctcattaggattttttgataaaaataaaagacacagcatctcctatctcctcttgctttatttactgggaaaaaatgataaacttatgattactcaaggcctagttatataagcttactgatcatctgtctctctctccccactaactttattgtctaagaaaatgataatcttgtgggtggaaaggaaacctggagactagtcaatctaatcagtagtagcttctggttgaaagatatcctattgcctaagagacatttaacatctttggttaaatacattttataggaaaaataaatgaaaatataaaatgaagtttggaatgctgtggcttggaaatctatatatgttatgtcttcccacttgcagataataaatgaggaatatttgctaacctttggtcatcaacttgacttaaaactgaaaatttggctgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaacctgaaaattttccaaactatgtagtttcatgttcttgtcaccaaccaacactcatgaaagatctctgtccagaagcagagggcggagtggatggtttaggagtaggatatgtttcctgtttattaactgagtgaactcgggtgagtttcctcttcatctctaagttcctcatctgcaaaagagggataaaaatactttacttgtagtattattatgaaaagtaaaattgtaaaaatagagccttgcacatattaagcactcaaaaaagggcaactatgtagcaaattctataccatgaggtggaaattatgtaggagggcgagagtttgtaatggagtcaggcagttaagaacatctacctcaagaaacccaattagtacatgttccattcattcatggattcaagcatttaagccacatggatttcagtggctaatacaatagggatctgggaatataaaaggtatcgtcccttcctccaaggagcctaaattctagtagcgagacatatgtcaaaacgtatatagtacaatttttggtacaataagaggctatactaaattctgtaaaaatgaatagagaagaagtgcagggatagcttgatcaaagaggcaccattttagataagctaaagatgactaagttccataaatgtattcactagctgtgtgactttggacaaattactgctctgagcctcagtttcctcatttataatatccacaggatggagctgtttcagagataaatccagtaatgtatataaaactcctggcttatcctggaccacagtaagcactaagtaaaagttaaataaatatcaaaattaggaagttgtgtagtccattacttatttaataaatgaagaacggaaggagaagaggaaagaaagaagcaagaaaggtggcaggcacccatagaaaagagcatgtctggctgggcgccttggctcacacctgtaatgccagcactttgggagaccaaagcaagcagatcacttgaggtcaggagtttgagaccagcctggccaacatggtgaaaccccatctctactaaaaatacaaaaaaaaaaaaaaaaaaaaaaattagccgggtgtggtgttgcatgcctgtagtcccagctactcaggaggctgaggcaggagaatcacttgaacctgggaggcggaggttgcagtgagccgagatcgcgccactgcactccagcctgtactccagggcgagagggtgagacttggcaaaaaaaaaaaaaaaaaaaaaaggagaagaaaagaaaagagaaaaaaagaaaagagcatgtccaattgtggaactttgaatgattgcaaaaatactggactgtgtagggctggaggtagaaacattgaactggggagcaggactaaagccagatcacaaaactccatatctgccctgccaactacggggcagagaaataacaaaatttgctttgttaatttcaaaagagttccctggcttcatggcagatgatcaaagaaaataacactaaaggcagggaaatctagtgagtagattcctaggtagtttgaagagatgagcctgtttgctagaacgaagacaacagtggttaaggttggggcgaggggtagtcctgagagtcacataggagctggaaatgatgtggggagtgagaaaagggcacaggtttaggacagttctgcctctgggtttctgccttgggttactgcatggatggtaattttgcctagatagaacatcctgaatacccttgtaacctatcttgctgttgtatacaaagataaaagttaacactacaaactactctatatctaagaaaaggagaccatttcttcagctcatgacttcactgccacagaacacaatggcaagaatccactgatgtaattgcctagggtcctcatttcagaagtaattaataattacaagaagtgtcagtcaccttaaatgcttactttcaaagatttcctgatgcccagatgtgattggaattgttaacaaacataatataagaaccccagggatgtgactcagtatcatgttgtttatttgttcagagttttacagaaaaatttgttaaaactattgaatacagtcttgactgaaggagtctatttatatacatggttaaagaaagcagcaaataaaatccccacagggcctcagtgttggggacaggactggcaagactataaatcagaatcttcctaatgttcacgattggaatgagataatgcatgagccagaaaagcaaaaaaaggatttatgatgattctaaattactccctaacctggcttatgtgtgtctcgagtcttagaatgagaagaaaattgaaaatagtccagcctttcttcaataagtccattgtggcacaacaaataccagttaataaaaacttattgtaaaaactattatttaatgtatttgaagaaccttaagtatgaaataataatattcaaaaggtagacattcaagtttaagagactctgaatgatctttgttgcggggggtcactacaaaggattgttgggtcttgatctgacatgttattttactttcctttttttttttttttttaactttttgactctaagtttcttcttcagattgttgagaaaggccccaagggtctttttgtaaaaaatatattacactgttgagctgcagaatttatgttgtggttatgatttaacatatgatctcatttaggtgtttattaaaactaatacaaaatgagcaaacacattacaatctcattatttgcttattaatagtcaattccctggtttatgtgctaaactaggattataatctaaattgttattttcaatctttgagtagtactagtgattgaaggtctactgcttacatattgctcagtcctggactggtaaataaaatgaacacagtctctgttttgtgaagcacacagcctgctgagggaggaaaccatatacacaaatcaatatatatttaaaattacaatgagagcaatgaaagaaaagaattgggtggcatgagagaaaataaggggatcttatttatatctgcccatgatggaaagttattctgagaaagcaatacaagataaagtctgaaaattgagtaagagttagccaagaaaacacttgaaggagagttttctagaagagagaaaaacatcacgaaggctgtgggaatgcagggagtttttacagttatgttaaggatgttgaattcctttctatgtgaaaggggaagttgttgaatgattttaaagtaaacacatactatgatttagtttacaagttttataattctcaactgtaaattgtttccaaaacatttctcagcagagttaaatgatattgcaaagggccttaggcgactgtgaagttgaattgtgtttctttaaaaatatgaggtggctcacgcctgtaatcctagcactttgggaggccgaggcgcgtggatcacctaaggtcaggagctcgagactagactggccaacatggtgaaacttcgtctctactaaacatgcaaaaattagccgggcatggtggcacacgcctgtaatcccagctacttgggaggctgaggcaggagaatcacttgaacccagcagatggaggctgcagtcagccaagatcacaccaatgccctgcaccctgggctacagagtgagactccgtctcaaaaatatataaataaaaaaaaaaaaaaaaaaaaaaactttatacatttcttttaccacgttacaaaacacttgatattatcctattgaccatcagtgttatatgtgcatcctactaaatttacattttggggcgagcagtatacatagtatataaatactcttacaaatcaatatggaaaacaacctaatgaaaaaaacaggaaaaaatatgaaatggtaaaaaaaaaaaaaaacacccccaaaatgttcagctcaatattaactggggaaaacgtaaaccaaagtaacagtgagatactatattttatccaaccagctggtaaaatttatatatttggtgatagcaaaggttggcaaacgttttgagccacattcacaatcatccactgctggtaatgtgcaaatggtacaactagagatgtttggcagcttttattaaaattaaaaatgtacattacttatgacccacaaattccatctctaggcataaactgtagggttaaactcaaaacgcttacacagacagccatgtataattgtgtccgaaattggtgggttgttggtctgattgactcttcaagaatgaagccacagaccctcgcagtgagtgttacagttcttaaagatggggtgtccgcagtctgttctttctgatgttcggacgtgttcagagtttcttctttctggtgggttcgtggtcttactggcttcaagagtgaagccgcagacctttgcagtgagtgttacaactcttaagatggcacgtctggccgcgtctggagagttgtttattcctcctggagggttcgtggtcttgttggtctcaggagtgaagctgcagaccttcatggtgagtgctacagctcataaagtcagtgtggacccaaacagtgggcaacagcaagagttatttcaacaagcaaaagcacaaagcctccacagtgtacaacatgacctcagcacgttgccactgctggctccagcagcctgcttttattcccttatctgccccccgcccccccaccccccccccccgcccacccccccccccccgcccacccacccacatcctgctgattggtccattttacagcgagccaattggtctgttttacagagagctgattggtccattttgacagagcactgattggtgcattttcaaacctcgagctagacacagagtgctgattggtgtatttacaatcccttagccataaagattctccaagtcccactagattagctagatacagagtgcctattgttgcatccacaaaccttgagctagacacagggtgctgattgatgtgtttacaaaccttaagctagacacagagtgctggttggtgtatttacaatcccttagctagacataaatattcttcaagtccccaccagattagctagatacagagtgcccattgggcatccacaaaccttgagctagacacagggtgctgattggtgcatccacaatcccttagctagacataatccgtactagactcaggagcccagctagcttcagctagtggatcccacgcaggggccgcaggtggagctgcccgccagtcccgcgcagtgcgctggcactcctcagcccttgggcggttgatgggacccggcgccgcggagcagggggtggtgctcatcctggaagctggggctgctcaggagccctgggggattgcggggggctcaggcatggcgggctgcaggttccgagccctgtcctgaggggaggcagctgaggcctggcgagaattccagagcagcactggtgtgctggcactgctgggggctcctgcgtaccctccacagctgctggcccgggtgctaagcccctcaatgccgtgggcagcggcgcccaccggccgctctgagttttgggccggcaagcccacgcccacccagaactcacgcagccccgcaagcgcccgtgcagcctcggttcccacacacatctgtccctccacacctccccgcaggctgagggagccgactccattctcggccagcccatagaggggctcccacaatgcaacggtgggctgaagggctcctcaagcgtggccagagtgggtgcccaggcccaggaggcgcccagagcgagcgagggctgcgagggctgccagcacactgtcacctctcataatgatattaattgcaacatcacaatagcaaaaatgtacataaaacaaaggttaaactgtaagacaatggttaaggcatggcacatctatattctgaaatacttggcagtagttataaattgtgagttagatctatattactaacatggctagactgtgcaagggagtgaataaagcaagttgctaaagaatgcagataatacagttccagttatgttaaaacagtcacatacactaaaactgtatgtatttcttacagttgctcgtatttataaaagcaaagaaaaagttcaagtagagaactttcattgatatttaatgttttaattatctataaagtgacaaatcatgttttactgttcttattcctggtcctaataaaataatccagctaagtccatgcaaatttaaaacaacctcttattctgtttcattgaatgctatgaaataaggatttacctttactttgagttttaagagaatttagtttggttttgtggatatttgctgacttttcagctattgaaatatttttaaatacaaattcacaaatgagtatttgaaaaattggaggctttcattaaaatgttcaggttaaatccaggttatcctgacatctaattttatttcaagtcttattaatcaaatttttctttaaaattttttggtcaaaattatttaagtgattttactgatactagtacttgtttccactaagcctcctcttaccagattccccttaccagctccttgagggcaggcacatcaacttgctaaatcaatgccagtatagcagtcaacctccttttaggcaaatgctctataattcaacacctttgacttagcagcttctctgaattttcatcatgcaggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggtgaggccaaggagatgggatatgacttgactttctggtattttatggcagaccatggctttaaccaaatggtgtattagcaggaagagctgtactgtgtaaactctgctgctgtggtgcaaagggtcccccttgtgggcatgaaaagtatcttgtttcacatttcagaattcctcaaatcacgagagaaatattaaagagggataaaggaggaatgaaagggatgacatttttatatgctatactgggaactggagtgcatctcaagttctttacgttacacacagaaaatgttgaaatttttatgctatcaaatttgataatgatgttaaattttatgttattcaaatttgctagaaaagttattgtacttatatttacactgggaaaaatgacctagtctcaagtaatcttcctcaacgattctgtagctaaagtcattccacatatcaaatttaaattactctttttttttcacaacttgcttacctaaaacccagaggaaatttgcatgtatgttatccaatgaacagttttgtattgtctgctttctgttctgaaaattttcagaattattgaggcattccccaattcattaatggctagcaatttacctacaattgcattgatatcactgagaaaaccaattacaatctagatctctatcatatttctttctcaatagattaagtgatgcctctggaaaatatatcagttgttgttgaggatttctgagaaaagtaaatgagaaataagaaaagaagggggtgtctatttacacttaggattctctttcaatgtttcagttttgaaatttaatggtctttgatttgtggcagtgtttgctgcaaggtcgataaaaaaaatgtttatttccttattcactgacctttcaaggagaacatacagtaaaaaaattccccaggtgtcaatatcaggaaagtggtattttccctgaacaacttctatcatgcatgctttccaccctagtttaaaaaatgcatccaaataaatcttgatgtgactcaactgattaaatgcatgaaataaatcttgtaatatataatatttcccaattatgtaagctgctagaaataaatatgagatctgcaaacatacaggtctttctgaaatatatttgtgtatttacctcacctctggggatatttaaatttcctgtttctgtttcttactattgcctcttttcaaaaatttgtttctaaattatttgattttggtctagtgtatgcattttcgtcagctactttatatttttcttggaataaggtgaaggcattataaattattttttaaatattggttttagggtcataaaggggtgattctgtgaaagtcaaaggacattgctaatattacctcatcaaataaaaggaaatgggtgaccccttgaatctgcagatctaaaaggagagacagtagaatgttccagaaaagtgttgggcttgatttctgaagagctgccaggaatgactatatgagttaagatgtcctgactgccccaaatctctgtggcttaatgcaatggtttatgttttactcatgtgaattccaaaactgggttcccatcatcagttgtcctacaaatggcaattcagggtcacaggctcctctatgtttttcccccgcttcaaaatgttacttccaaatttgctgtgctcttatgaagcaagctactggagaaggaaagaaaatggagtgtgacacctgcagattttatgggccaaccactacaagtaatgaatatctcttttacccacatattactggtcaaatgtaatcatgtaactacatttaattgcagaaaagacgagaaaatctagtctttctgtgtacctaaaataaagagaaaataagttttgcaaacagataaccaatttgacacaatagctagaactggtacactggggatacgaacctagatcttctgattctaagtttatcctcctgcctactatgtcacatatttttatgtctacacgtttttctatattttgtttttaaataactttttaaatgataatagtatatttatgtgcagttttaagaaatacagggaggcccatgtatgctttacctaattttcccaatagtaccatgttgcaaaactatagttcagctatcagacttgcatattgacattgacaaagtccacatccagaacaattatcatcacaaggatgccacctctctccttccctgcctcctcatcccttatccctggcaaatactaatctgttctgcacttgtataattttgtcattccaagaatgttatataaatggaatcatgcaatatgtaaagttttagaataagagtttttttttttttccactcagcatcattctttggagatttattgaggttgtgtgtatcaatagtttgttccttttcattgctaagtaaaattcgatggtatgtatatatcaaagattttttaaccattcagccattgaagggcatctagattgtttcagttttcggctattaattcataacagccgctgaataaagctgctagaaacattgttgtacaggcttttgtgtgaatataaatattcacttctctaaggtaaatgcccaggagtaaaattgctggttcctatgatagtttcaggtttagttttctaagaaactgtcaaactgttttccagtgtgtctgtaccattttgcattcccaccagcaatgtacgagtgatccaatttctttgcattctcaccagcatttaatgttatcactgttttttttaatagtcatgttgataggtatgcagtgatatatcactgtggttttaatttgcatttacctaatgcctagtgatgttgaacatcttatatgtgcttgtttgacatctgtttgtcttttgcaggaaaatgtcaccccatgttttttgcctatttcctagttgagttgtttttatttttttaactgttgagtaattttccacatacagaccctgggcgttttttgtgaggttatacctaagtatttcattttcttttgagggatagtaaatagtattctgtttttaattcagtttctacatattcattattagtgttgggaaaggcagtattgtgcatgtggcctttgaaacccctactcagccacataagaatgggccttgggcctagaacacttccttcccaagagataaagcgtcctcgcagaccatgctggagttatcaccttgtgtgggaatatctttccctgtttcagactcaatatgtactccctcgttctgcttaaacatatgtatcatatggcacctagccagccccactgctgtaactttcttctgcggggagggcaaaaggttcttctgctgcagcatgaaatggttgcatgctgccaactgccccgcatctgctgaaaggaggccctgctgtttatggggactgcttatggggtcaccacatagctgaccttgctctgtctcttctctatgtgagtaaagcattgttccatctagtacttgactgtgttgtgttttccttggtaactccaatactaaaatgcagtggccaaacgtgtccagacttttactcctggtaataagcaacagatgccacttgccaaagagctagaacataaaaatatgattgtttcttggttgttgattgtgtatagtgagactttgtttaactcacctatgagatctaggaattttctttttgtagattccagggcattgtctgcatggacaactatgccatctgcaaagaggactggtgttatttcttcctttacaatatacatgctgtttattttactgtgttgagtacgagttgtgagagcagacgtcttgcttcattcaccattttagagggaaagcattcagtcttttaccattagctatgaatttttatcgatgctctttttcaagttgaagtagttcctctctactcctaacttgctaagagtttttaatcataaatgggtattgcatttggtcagatgcattttctgcaattgatttatcatgtaagtttcttatttagcctattgatgtggtagattgctctggttcattttcaaatattgaaccagacttgcacatctgaaataaatcccacttggtgtattttttttcagtttgctaatattttatgacttttttgcttctaagttcatgaaagttattggtctatagttttctttctctctctttttttttttgtactgtctttgtctggttttaagatcaaggtagtattgacctcataaaataagttggaaaatgtttcttaattttctattttctggaagagagtatgtaaaattgatgttaattattctttaaatatgtagtagacatattcagggaaatcagctgatcctggagattccattttctggatcttttgaattgcaaatttaatttcagtattgttatgagactatcaagaatacttattttcggcaatttgtggatttcaagggattggtcctttttttttctaaaaattgtgtattttgctgtcgttggatggagtatttctatatatgtcaattagatcatgttggatgattgtagtgatcggatcttctatattgctgatttttctgttgaacttctgagcataatgttgctcataatattgccttattactcttttaatggctacagaatctgtaatgatttctctgttttattcctaattttgactatttatatcttttctccccttttatgtccacctttttacaggtttatcaattttactgattttttttaaaaaaatagcttttggtttcatttattttctctgttttcctatttgcaattttattgatttctgttcttttttatatccttatttctgtttgctttgggtttattttctgttttttaaatttatttttatttttctagcttcttgaggtaggaagttttattactgatttaagaccttttcttttttctaatatataagcattataaatttaactctcaatagtgcttcagtagctgcatcccacatattttgatatgccatacttccatcttaatactgttctgtgtatttttaaaattcctttttgacatcctttttgacctatggatgatttagaaataagaattgaattgtttaatttctgtttagaaatttttctcttgtctttctgttattgattttcagtttgatgccattatgattagagaacacattctgtataatttcaaataattcaaattatttcaaatttgttggggtttgttttttggcacaggatacaatctatcttggtaaatgttccatggttgcctgaataaaaattaaaaaacaacatgtgttctgctattgtttagaggcgatttctatatatgtcaattaaatcccattgactgatggtgttgttcacattttgtatatccttactgatacagaatagcactgtctagcagtccattacttgtttagaggagaggtgttaaagtccccacctataattatggatttgtctctttcttctttcagttctatcaatttttcttcacgtattttgaggctctgttgtttgatatatacacatttagggtcattatgtcttcctggtgtgctgatccttttatcattaggcaatgattttttttctcatattcttttcttgctttgaaatctagttcatttgatattgttatagccattcctgcctttaaaaaaattatatttacacagcatatatttttccacccttatatttccaacccacttatgtcattaaatttgaaatgattttcttgtaaacagtatatcaaacagcaaattgttgggtcatgcttttttaattcatcttgccaatttctgccttttaattgatgtatttagaccatttatgtttaagtaattattaatattgtagggcttagctctatgattttattatgtgttttctgtttgattcctttctttctctttacttcctatgaattagttgactatttttgggatttcatcttgatttctgtatagtgtttttaaatatattactctgtgtaattttcatagtgattgctctgggtatgactgatcacagcctattggtttcagtattttaccacttcaagtgaagtataggaatttcacttctatttaggttttttttttttgccttcttcactttaaaatatccttgttttgaggatcagatggtgttataatttttattttaatcattacatataatttagaaaactcatgaaaagaaggatactccattgtgtttacttatgtgtctattctccattgtttgtcctccccaccttaggcctcaagagtctttctttttttttttaaatcattttatttaggtttacagagctttctttagccattctatgagggtaggtatgctagtgacaatttcttttggttttcctttgagaatgtgtttattgcacattcattcctgataagtagttttattcaatgtggaattcatggttgacagttcttttctcatggaacttgaaaaattctacacaacttttttttctgcaccccatggtttcaaatgagaaatctgctatcattgtaaagtggtgctgggtgcagggtttgggggaaggaaggccggctcggcaggaaggcaggtttgcaggcttttgctcccttttccaaagaccaacaaagagaactttcccaactcccaacccaagcccttttggaactgtgtgtggttgttggcatcctgtggtgcctccttgccatccctgccctttccatgcctggcaacgggtctttgtggctctgcagaatggagatttaaacccaagttcatggcaaaacatctgaagttcatcaccaggactgtgatggtataggaagggaacgtggaaggtgcatagaggaccctaaacagaatcctcactacggatgggctcactgaggacattaagcttcggcggtattatgagaagccatgcggccggcgacagagggaaagctatgaaaagtgccggcggatctacagtatggaaatggctcacaagatcaacttcttgatgcgaaagaatcaggcagatccgtggcggggctgctgaggcgggcagatccgtgggtgggctgctgaggcttgtggatgggacacccagtatgaaaccctcatccagttttgtctccatctcttttttttatacaatcccatttcctattacagttctgcaataaactcagtaaactcaaaataaactcaatatgtttgcaaaaaagaaaaagaaaagtggcgttgccctataggtaatagattatttctatctaactgctttcagtattttttctttgtctaattttcagcaatttatttgtaatatgacttggtgttaacttatttgggtttatcctatttgagatagtctcaccttttaaaatcagtagatttatgtcttttggcaaatttgggggcttgtcagccaatttttctttgcatattctttcagatccttttttatttttccccacttctgggactctaatcatacaaatattgggtcttttgctatgcttccagaggtttctgaggctctgtttttatttttgtttcagtctattttctgccttttgctcagaatgagcaaattcttttgatctgtactcaagttcattgattctgttcttttttgtctcccatctagtattgagcccattcagggagttacttcatctattgttttttacaagtctataatttccattttgttcttttaagcaacatatgtttttgctgatacttctgttttttcttcatctcaggagaatttgtaattgctttttaaatcatttttatgctggttgttttaaaattcttgttagataattccaatatctgatttatctctgggttgacatcatttcattttattttctcattcaagttatggttttactgatccttgtgatgacatgattttgaattgtatgctggacattttagatattaagttaggagactccatgtcttctttgaatttttgaatttagcagacaatcacctttttaggttttaagaacaggtcctggcctacttatgtggactgtgggtccaatgatcagtttattttctgattctttgctgtgttgttttgacctccttggcttaccttgtgccattgggcctcccaggatctctactgatgatccctgagtggtcagaaggtgtttccttaggtgagaatgttccatgtccttctgagaaatgggagtctttgatttatggagatgaagaggctcctttagtgggtgttgtggtgagcttctccctgtctctgggggtagagagcatttcctaggctgaatacctgttgtggcataatcccctttactgatcccccactcacagggtatctcttgatggaagtggggagtctcacaactgctaaggaaggaaaacacttcacataacaggccattgtggtagcataattccttttgccatggcccccttgcctatgatgcctctggggagggggggagaagggaggctcagcaacagaggaggtaagctctttctctggctgctcttttttcttttcttttctttttttctccttctccttctcctccttctccttctccttcttcttcttcttcttttttttttttttttatcagtagggctttgtttaattctctttgcccattcttccaggctcgccttgtgttgtaggtgggactctcgttcaatctggggaaagaaagagccaacctcggccaccttctcttgtttctgttgctgaccggggatcagcaaacaccaggacggaggcacctccttgtgttatgctggaggttataaaaagccctgatgctttgctgttagtcctggggcgtctaaccagttcaccttcctcttccacctttcagagttctgtttggttgttacatgtagtttttagtcatgcttagtggggagaaacagggagagagaagtctatgctctcttgtccagtctaaaagtccctatgtaacatttgttaaaaacacttgtgttatagtagtataaagaaaaaaaatttttttaatggcttcaggtagaaaagcaagtgttaactttctctttatcttcctgatagtaccaagaagttcaaaatatcatttatttttatcaatgactatatttataattaattattaataaataacttactatttcccttgcctttcttccatcccgaatagttggatattcaactttatttttatttgttatacgtccattttatattctgcagatagaaaacatacagtttacttttttacatgctatgtgtatttatagctctattggttgttagattaaaataaaatttccattatgttgaaaaatgtatttgtgcatagtacatttactgacagctccattcaaaagaacctttccaagtgttaaatacaggtataaactgttctttttttgtattataattaagaatgtatttattactcttcactacttgtgtaattaccttctatattgaaaatatttgcatatgtaacgtaatttttctaactttttataatgtaaaaatgatatataccagagtagaaaattaactgacagtctcagaattatactcagggagttagaaatagagagagcatgagaccatggaagatgacaaatgaaaacaggaactcaaggaggcagagaatcctagtgagaggaatcaagaccccctgaaggaggattaacttttattcaaggtttcttctagaatttccagccggtaaagcaagttaccatggcccagagaaaccaaaagtctcatttggtaaggtaattgagaaaaatctaaagatccatttagatattttaatgactagaattgaaccatgcctctagaggcagtagtggttactattctctaattctccaaaatcatttcaaaaaaaaatttggcaaaatatgctcatatcttgtcataactatttgtgaccatagttgcaacactcaaattaaaatgagaatgggacattgccacttgatttaaatgtctgtgcatttacttaaacctgcacatccacataattttaatggtaagcaaaataaatttataattggagaaggcctgtagttgaataatactattcagtccattccaaagtcagtaaattatctttattttgtatgaccacccttgaccactactagaaggaatgttggctgcttctttgtattctgtttgagctttccagtccggggcactgggctcagttctggggataaaatgatgagagtacatggtctcttcccaagggaaaatgaaagaacaagaggaaaatgatgcgcaaagtgtaagacaatatgataactgtcacagtggagccataaaaaggcaccattagataaatcaataaagaggaacttttgtgctgtttatgccagatagaagttagtggaaattataagaacccaaacagcttgataaattcacattttgaagtacaaatcaacgttactactgaaacttttacaaggatctcatgacctgtgtgcttacccttgaaccatcctgttctaaccagccaagtgaaattggaaacaattgatatgtctttcacgtgaacatttcatttctatttatcaaactatactcatgataatacccttaacaagtttccaaaccatctcatccaagtccaattttcatttctaactttccctcaccaactccaattagcatgtactccaactcagaggaacaccctccctggtctctggaacgctacattgttgcctctgaggctgggattttattctacttcacccatctgctctctgtatggaaagaactgagtgcagcaggggatcctatgaagtcctggcttcaaacctcgggcaaaaatatcgggtttcttaacaataaacaccccgatgagagccacctggcaaagtgactgcacacagggctttcgttctcaagttcatccgcttcaagcacaatgttgctaaaaatgaagcgttcacttttccttaaaagtcaaatcctgtcactttacctaaatccaactaaaatagccatagagggccaagcatatatcattcaaagcttcatatagtcatgaaggaattaggcaatggtacagtcaatatctcctgctggaagagaaattttcaatagaattttttcatttgctgacttcacatttcaggagcattgttcctagaaatgcacttttttttcttacttacaatttcaaatttgagaatataaatcctaggactctcaaacagatatttgatatgcataaataactgtaactctaaaagatgaaactttgcttctatcctcgtttacttcataaaacatcttttcaagattcatctgattcatttacctttgcctttaccatgcatgttaatttctatgaacaaaactattcatagtgtgtataactatttacgcttgtactccttttgattttactatgttagctgcaataactaggacaggtataccacgttatacatacattaatttaaaaaatgatttttgttgattgcttactgcctattatttagaaagatattatagcaaggaggaaaatttaaaggctaatatttggaagaccacatacagaccaaaacagaggcagatatgtttgtagaccctatgacagagatagataactatggcatcaagggccttggctgctgtctcaggttggcattcctctgttgacttgtaatcacacaagtaagggaaaagctctcaaatgaataatcagcagacaggtgccaactcttcaacttaagtatgctgaccaatacgtattagaaaaaatttctgaaactaaagaacaaagccaggaaatccatcattaaagtcttgaggtgctgtcctggcaacttagaagacctgaaaggtagattttcataccagagttctattttgatgagagagatgtgggcctcacccatttaaaagagctttcaggagagtaatgtttcctgagaatagccaaacgtttgttagagtaagaagctgatgaaaatgttcattggggaggttgaggatattgggagttgtcctcacagtagaccatcctgcgagctctcatatgacgtggtctagtgtgtgtttactactcatgaggatgcccatcttgacatcccatgctttttttctaactacccaagatcccaaaatgttttttattaagcatgttaatcattaagtacaatattattgacctacacctgacctaataaatgattaattatagctcttttcccaatgtctactacttagtttgttgagagagtctgtcttctgatattaacacagaagaccctcagaaacacccctctcctcctgcatcccctccccaaccaccatgacacgcacattcacctagagcttcacttcagtcccaagcaacccagttgcgagggcaagaaaaagtatccaaaacctcttcctgagaccaaccaatcctcttcctgaagaattacatatccctttctcaaaagaggttttattatacctgccattggcaaaaaaaactacccccttagtcattacttaggaaacaattaatttctgaagaagctataatcagcattgattacaactttccctaaagtacatcaggaacaataccactatgacttataagtctgcttacttcagtcacccactgaagtcccagcgtcccagttcatcatttctggtctttatcccagaatgctctctacataccctaatttcatgcaattttctaccccattctgaacttctctctgtatgctgaagatttaataagcccaattaccaatatcctcaactttttttctaaatgtttccttcacctgcttgcttaagctcaaatcatgctatattctcagggtaccatttcttctgcaatcttcttgaatggtggttgtcttttattcttcttccaaatctcatgtttgactagtcccaaaggtaagctaaatgtcctcatgtcattgcttcatctaggaaattagtcttccatcctcattcagaattttgtatccagcgaaactgagcctcataaatgaaggaaagacacaatctttttcagacaaacaaacgctgagagatttctccacttccaagccaggactacaagaactgctaaaaagcagctctaaatcttgaaacagaacttcaaaatacaccaaaatagagcattcttaaagcataaatctcacaggacccataaaacaataacacaatgaaaaaaaaccgcaaggtatttatacttttgttgacagaaaatcaacaaagaaacaatggacttaaactatactctaaaacaaatggacttagcagatatttacagaacgttctacccaacaactgcagaatatacattctactcatcagcacatggaacattctccaagatagaccatatgataggccacaaaacaagtctcgagaaattttaaaaagtagaaattgtatcaagtacactctcagaccacagtggaataaaacaaaatcaactccaaaaggaactctcaaaaccatggaaattaaataacctgctcctgaatgatcattggatcaacaatgaaatcaagaaggaaatttaaaaattccttgaactgaatgataatggtgacataacctatcaaaacctctgggatacagcaaaagcaatgttaagaggaaagtttatagcattaaatgcctacatcaaaaacccacctcatgttgaagtacatgtctttgaactgcactgctcactacctcttttggttgcaacattcttcctacctcacggtaccttctcctcagtcactgattaccttaatatcttactcctgtcatcattttgaggatttcagcatccgtgtagacaaccgatacaaaccattatctctgttatttgaaatccttatttccaatgactgtgactgccatgccacacacacttctgcccacttctttggtcataacttaggccttattatcgctgataaccttcctaaaaacatcactttaaatcattctgttttatgaccagaacctccaattattccagttcatatactttagaactttttccgttgagcctagtctgttgtcttaaccactttttttccagtcattgcctcacttaccttctgtctcagctaaggtttcaaggtccagcactataattattcccttgcatataccttcggctcacctgattctttctctcttcattgtacttgcctgacaaaggtacaattatggttaaatcaatcctctaccttctccacacttacaaccaatttgaatgtggttggagaaaaactcacaagccacacactgaactgttgagtgtcactttaaatttatggtgccaaatctcatggggcctttagcactagataaaaatccttctagagctctacttcccaagatgagcctttttaaatcttctatttcttcaaacttccaatacctcctccctcattgttaccctaagttgatcatcaagtctaatttcatcaggaaaatagtatcttcctgccaccaaaagtgttgtcagttctgaggtttgatttttatcctttttacaagctcatacgttatcctgttcctgttttgtgaatgctggcaaaagacataaaactttgtgtcaggaaaaaatgcacaaccagcagcatgagcctcaggtttacatgaattacccttgcacccaactcccacagggttggtactacatgggcccagatgagtactgcacagacagatttttgtcgcaactgatgaacatcaagttggggaattcatcgcttttacggtaagcagtaagaagcctgctccttgtcccagagggagacattacttcattcttcagagatgcttgctgcaaaaccaaccccaagaaatgggcaggtaaagatcagtcagggccttgcattcttaggattcccagtaagaaactgccaggacacacagggcccatgatgagttgcttcttccagcaatccatcccatgaccccacttgttcttggctgaactcgaattttcatatgaatatgccactccatgagccaccctgcttaatgtgactgacagagactgggattaaatctgttcaatttgcctcatgcagcatttaattaaggagactatcaagaggactctaagcaataagatgaagtcaacctgtagtatacatttcaactctactccccagggccctggactcagccaattgtacataagtcccaggggcaccaatcatcatcttaactttagatagccagaaagtagtctaaagccagtcagttatccattgtgacccacgtaagggagcttagattgacatactgatctttgatgtcattaccaataatgacaggggcaataaacgagcaacactaacccccaaaggagagacattcccccacatacaaacatataacacaaagggacagactctagttcagaatttctggttaaaattgatttatacctttgttacattggtttggttaattcagtacaacagaagcatcgcttgcagctcccattgccatttatggcaacacttaagctgcctgagtattaggaaaagcgtatgaatatatgttattaagattgaggttgggcacagtggttcacacctgaaatctcagtgctttgggaggccaaggcaggaggtttgagaccaggttaggcaatataatgagactctgtctctttaaaaaaaaaaaacaaataaaaaaactgaaacaaagttgtgggacctatctctttgtacgcatacaaggctgaggaggaggcagttcaggagcttccattagtggtgtcagctatggtgaagtagtttaggaccagccaagtttgcaagacttttggtgtttttataacacctggacagggatgacaaatcctgtagtgagtttagattgtcaactgcagctgctcctagattcagctagaccatacaattgttttgccagcctgcattgctgaatctaaggaataagaagcctaagtgcctctctcccctgaactgcctggggtttaaagtgatctgtgctcgggtgctagaattgttattctccctccatggccatgaaactagggtgtcccaacccagtagctataactttacctcttctccaatcatctgctcataccaataccttttgtccagagaggtcagacatgaataggaataggtcactttaaaaaatatttactgagattcattcattatatttcccacttagtccagttaggttactataagtaattatactagttggtgaatagtatattcaaccagtgttcattgtctttatgatctaagaccatgttaattcaataaaagaatccaggtagctacatcaagttaagtttgaatctcttagtctcccctttagatgtggctgcccttcaaagtgtgtacaaatcaggctgacatgaggttgtcactaggggaagaaaatacacttcaggttcataaatggtcaaggcataatcatgaattttcaaaataagtttacataatttttctacccatccatcttgatcattacctaggagttggccaacaggagacaaatctttcctgcccatggccatatttaatgctcaaacagccttaataaactgttttaataaaatctgtgggccagaaagaggcaaagaaggtagatacagaaaggagggagagtcagaaatcttcaggattggtttccaaaaagtctattccatatctcaatgatgccagcagccttatcagagaatgataagagtgtggaatgtccattgaatatgtttactactggcccattgctaggtggcctttatgacaaaaatacaccattgtcagattgtagatggtcttgaaaactgaaaataagaatcagattatcaaactgaaatagcagcaaaataatctaaaaatatgtcaatattagcaaggcaccaatggtagtcccaagagagggtcagagatctgacacagccaattttctagaagtgagcagggaaaatgctccttgtaatgtggcctcctttactgcaaaacaatcaggccaatttttggcaggagtctcctttggtatgcagtttctagattagaaacatatagtcctttgctgtagttcgtggtagtggatatgttttctggtaagaggatggatccagataatgatggaagccatctagatagatgctgggtaatccatttgattctagttgttctcattaggggttatagcaacagccaccagaaaaccatactatcccccagttgggagtgcaaggaatggaggatgatggggagattagcctatgggagtggacgtgggaaaaggcttggtcctttctaaggggctggtgaccaagtgccagagctgcttcctatccatgtatatcctgatatctgatgagtgtcagggcccagaggaccccttttttcttgccccccctgcatgccattgtgctctgccctgtcaaagggtagtcaccaagcaagaacagtgccacacctgagtaagctagtaacttgagatctcatataacaatgttatttcttcttaaagaagttgatgttgtggaatagggagggggaggaatcaggggtcatagagggagagagcagctcgacactagtaaacaaggttttacattcaatttcactttcaattcaatttctcttgcttgtggctcaatcaaataaactcatcatcatcaaataaaatcatcatttttttttctaactaaagttctatattgaattgaaatgatgtcattgttgactccatttatttcatctttcagtactccttgactcagctgtcacagatacgttgccttctggctggagccacagggcttgctgccctattgtcataataatgttttttcctcctcccacctagaggagagctagaaacaaccaaggcaccatataaggctgtttgttttaatcccaatctgattgatgggcaggaccttgggggtcttttgcttccctctttcacctaccatttcagtgggagtccagggaactcatcttctacatctgaacccatcccaaaggctcttaacatttttcttccagaaagacatgtctctttcaggatctcatctttgttgccataactgttgggtctgagatttaattttaccctgtttataaaggaatgagttagcctgttactgtttcatggatgctggcagaagacactaaactcttgggtcaaagacaaatgactatattactcacagcacagcagactgcatgagtatcatgtttatgtaggtttcttttgcattcaagtcttacaggggtgatttgctagatggatggtgtacctgcagtggatttgcatcacagctgaggaacaatagcttgataaattatctgttttcatagcaggcagtaagccaatctgttttttgtcccaactttgaacctcatgtttcaaagttgcttgctgcaaaaaccaatcctgagagatggcctgggtagaatggtaaggatcttgcattcttggtacaaccaacaagaattgcagtgatcctcagtgcccatggtatatggactctcccaacacctacctatctatctgtcactcatttacttgccgcctcccaattcctgcctatgtttggactacttttccattacaacattcccacctgaagtttacttatgcatggcaccctgttcattctctatgattcaggatctttagcaattattctttatacatcttgcatcattgattttccactctattctaaatcattctaattggcttgcctatctatcctctggaaaaaaaatgctccttagaatgcatacacctcctcagatatcctcttctgtattccaccctcctctaaagagatgtgtatacttactctctactttttcacttcccggtaacctccccattaaggcagtttttgttacttcggtgaaaacttccctgtcaacaatttccatttgctaatctaaaacttaattttaagtccttatcttaactggcctctagtttacagttgttctctctgacctgctggatataatttctttatttaacatctgcccccttttcttcttgttcactatcattctattgctagcatatcctctattttctagactctaaatgctggagtcccctaggattcaatccttaaacatattttttcaccccttggaaaatctcatgtaatctcttgactttaaattttagatagatgtttacaacatctaaatttttgtctccagccctagctcctctcttgaacttcccttaacttttgtatttagatagctaaaatgattttcaaacataacataacccaggcaaaactttttatttttttatcttcatgaaacccaaaagaaaaaaattaagctaaagcaaacaaacaaaataatcacaaaacaaaacaaaaattcacaaaacgacaaaaacacttcttccccatctcagtaagtggtaacagcatattcacccagttggtcaggccataaattcaaagccgtatttggtttctctctttctttaatatcccacatctgattcctccacacagtttgttggcttctcctttaagctgtgtttcaagcacgatcatacttcccacctctaccatttctactctagaccaagccactgtcatgtctcacctcaactacttcaatagcctaatgttttggtgttcttccattcttgactttctaaatcagttctccacacagctttggtagtaacataatatgcatcagatcatgtgagtcttccattcaaacagtccagtggctcacatgttctcaataaaacttgtactccttaacatattcttggaagcccttgtgtgatctgtccttggttatcctctccaaaatcacctcctgagtcctcactctcttcactgtagctaggctgggggtcttaaagttacttggttaggccaaactcatttctgccttaggggttttacatttatttttccctttacctaaaagactacagatttttgcatggtgattccctcttttaaatctttattcaaagaccacttttccagagaggtctatctaaacctcccacaaaaatgccacctctctctgcaccccaacacatacaaacacatgctctatttccttacccttattaatttcttcatattacttatcactgtgtgatcttacgcacacacacagacacacacacttccattaatttttaatctcccctctctcagtccttactagaattgtccaccatgaaatagactttgaacatcttgactactatagctccaggacctagcacagtgcctagcccataacaggaggcccaaccaatatttcatgaatatcaaaatgctgaaatcaatcagttgaagcttgagagaaatctcaggactctcagttgtaagcattgatcatcaacccacatgtcaggtaaagttttgcccttagcagctaaaaactttaataaaccttttgaagattctttcattctcctaatccggaagtaactagatgagcctcagaattcttgctctaattatagtgtatgccatattttgataaattaagttttccatgccacttgacatatcataatttgaaaaatgtgttctccttatttcagattgatcttccattttcaagagtatctaacaccttatctttaagtttctcagttccattttcttcctatcaagaatctaaggatttatttattcaaaaattcaaagatattatatgagcttacatttttatgagaaaggcttttgttaaaaatgaaacctttttttatgaactctttttttaatggatcatgacaaacctataggggtcattactggaaatgtgattaggatcatttgtgcaatgaagcacttcctagcttaaggcaaatttggcctagctctagcctgctgtatcctcccggcactatctttgagtcaagcgtatgttcttagttaattggcttatggcaaaagtaattttgtcagttagatgtttccgtagagctgcccttgctgagttagtgtcttaagacagagccacaaggttttgttgacatgtaagttttctggttgttttttccatttttacttcctgacatctcccatagtgttttaaaaaagaggaatggtggctagaataaagttatgtatgggcaagccatttttggcacatgcgaaaccatcaattcttcaagtatcaaacaatgatatagatgtcagccaatagcgtaagatttttcaaattcgatcaaacaaaatgtcctgctctccacaatctaatatttcttcagattgaatttagagtttagatcaagatgggattactattacattttcccaggtggctatattgatatcttacagctacagattaatctttctccattttttcctctcttttctcttccttgtttgctcttacctcctctttctctcaattataatggttcttaatgaattcattatgtaaaggattctcatatccaaaactctatgaaccctttccaacaaaagggaactagacctacttttgatgcctctaagatgcagctatataaatttcagacctgtttttcactcctctcatggtagtctgaccccaataaggaagagggtctgaatgaaacatttcataagtgtcacagataatctactgctgaagctgtatatgtttattgcttttttcaaagagtttcttcagaattacccctttcaaaataacagtttactctctactgataaaactgtaatcaagatctggttatcatcttttgttaacattttattgaagtatcacacacagataaaagtgtacacataatatatttatagctcaatacatgtgttataaagagaacatgctcatgtatctagtacccagagcaagagcatggttaaatggatgctactttcttttgaaggagatgactagtgccagtgtagttagtgacagaggcaaaattcagttcaatcatcaaaacattttcagataattaaaactgtctacaaatgagacaggcatccttgcaaagaaaaaagattctatgtgattagagttgtttgtggataggaaagatggaattcttgagtggttggttggactggatgacttccttgggtctttccaaccaaagatgtacgtaaaatcaaactctgaagatcaatgttctaatggtaacatcaaggcaattataaatgtacataataaaatagtattttctaaagatcagtgaaaatgattcttaggagatatttaaaaatcatttttcttttcttttctttcctttttttttgagatggagtctcgctttgtcgcccaggctggaatatagtgccacgatctcagctcactgcaagctttgcctcctgagttcacgccattctcctgtctcagcctcccgagtagctgggactacaggctcccgccaccacgcctggcaaatttttttgtatttttagtggagacagggtttcaccgtgttagccaggatggtctcaatctcctgacctcgtgatccgcccacctcagcctcccaaagtgctgggattacaggcgtgagccaccaagcccggccccggccaaaaaaaaaaaaaaaaaaaaaaaaccatttttctagctcattcaggaagtaaattaaaagaatggtggaatgggctttttgctttccatatcatagactattttaagttaaggatactatcagtgaagtctggatgaaaggatataataagtttcataagatggaagatttatatctaagcttgttccttgcactgggtaagctttggcaaacagtgaaattgttacatctcttcctgctaatgataacataattttatttcagcacaaaggagttacctagataattagtataacaaaatttttataactgttgccctcaaattcaacaactgaattaaggattcatctttgtgcactttttcatgagaaagtttgtttctttcatattctttaatacatgaccatctcactttgtgatttaaatgttttaattactgcagtgatttaatacgtcgaaaaagaggcagataaagaaaaaaatgatcgagattttctacttaacacctcggttctgcagagcccaaggtgattaaattgaaggcagcattcctttagagtcacctatgagacaatagtctggaatattatcaaaagttttggcaaagaaaatcatttttggggtgggaggttaaacagaggatagggcttcaaaatttatctatttatttgagtgagttttagcatcattgacctggccaaactccaacacaattcattatattttgcctgtctcaaatgcccttgaaattctaatgaggccctatatttctcatcttaacctactttcataatattgcttgaagcggccatccagctgtggtcattcacttaagaagaatctagatttatctagcagctaagggtatccagtatctctgatttccccacagaagcaggaaggtcagtgaattcgttccagtgaaaagatttgaacagcttacacaaataggtaagaacatccaaataagataatccaatttctcaagcatttctcatagtgctcttagtaggaaaaatgagagacacaagcaccaagctgggcacttaacttcaatcatagttaaattttgtaaagcccccaaaaggtaaaatgctacaagaaattaaaacaccaggaagctctacaccaagatgctttcctgatcatctgaagccttttttgcctttgaattctcatagttggctcttgtgtgctttgatccatcctgtctgagtgcatctccatgccaaattacacaaagcagccctgcaggactgacaaggcccaggagccagcgcaagtgtgtctggcgcatctctcgttgttgaactgtccttgttggtgaggattttttagcatgcaaagtgtgtccttagaagcagtaggaaaagggaagagattcctcagctcttcatatgttttctttcatgaccccaatatcgtatctgacaaccattcccatttgaattattactcttagatcctgaacaatcattaattaataccatctttgtgagcgttcatttaagcaataccactctagggccttcaataccactctagggccttcagccagcttctattaaatgggttcctcattctggtttactctcattctcctccttttaatattttagcctgttcaggcattatgcattgggagaataagagaatttttcagtgatttaaaggaatatatataatagaaaaataaaaggagactagattattactatacttgaatcattcaaattggcataatcctcacttacttcgtatctcataggtaaattcaaattataataaacatgcagacataatcatcaaacatagaattctcctttcagtggcacagaattggtaattattttctttaagtccttacagtgatatcttacaaagatttcctccgtgaagcattcaggcatcaatttaatctgcatatgtgtaactaaacgtgtttcctcaatgaacacaattacttttgttctttgtagtaaattctctcactataatacacatagtttggtcaaattaagaacctatagaaaatgattaaagacacaagaggttacacatgcagccttcaatttgacagatgacagcataactcattgcaatagtaataatgagtattgttcctatcttaatttaatatgaaaactttccacatccacttaactaacatgaaaaattttagaaatttacacactgattggtgaagtcaactacataccaaccattaagataattgacttccttaaaaatgtaagttctgcactccttattgtgaggaagccaaataatttatgggctttaagcagtaaattcttcccttgcagatgtgtttgatgctttccaaagggtctctcctcctttagactggaagaggtttggctcaggatgtaattttcgaacacataaggtgtgcctagcactgagctgggcagtcccttaggaagcaaagtgaggagaaactgtgatggtgacggggagtagggactgtggattcagaattcttagtgtaacagccaattattaatattatctgtggccctatatttcttcatctacaaaatatagacaataacagtaacctaacttacagggtggctggtaatgggataaatgagttaatatattcaaaatgcctagaacagcacctggtgcaaagaaagttcagtgtaagtatttgccatcattaaatatccccctagagggcaggtacttagggctcatgactgtatttccaataccttatactgctcctggaatagacttgataaccaataaaatgtgataaactagtgatgaaggaatagataaatgaattcagagaaaaactcttcttttgaataatatacagctattttaatttgataattcatccagtaatttatttatttactgataagaaaggaaatctcagaaaatatactataataattattcaaagacagcaagacgtttttcaaagaaacatctgggtttaaatcagtctgctttaagtatcaaatgaatgtgtttattcattatgtccaccagaagctgcaaaatagaaaatatgcccaaagtaaaattgtcatagaaaaaaatcagacacatataggtatccagatgtccaataacaaaaaattctggtcacatattcagcaaagatttattaggagcagactctgtgccaggcactgttgcatgccctgaaaataataagcagacaataatccctgcctttgcacagtttacagtcttgggaaggagagagacaagaaaggtacacacataaaaactcactttcagggcacgttttgcagctctcctaacctcactgacctctcaggatgcagacctgctccaaatcatccattctgcaggaactaaattaaggttcttctaaaacagaagtacaaaattggtaactaccctcaaaaatcataggttaaaattatttgtcctctacttttggtgcagaattctggacttctgttcgagaatcactcaagggcttgaatgggcccaaagttacattttgagaattcttggccctcctgtgctattttctttcaccagttcacccttcatcccacacatatccctggcttgtaggatcttttagtcaaaacacaagatgtctataatagagtttccataggaactcaaactaaaattgttgatattggggaaagctaaaatagggatcatactaacaattctttactcgagattttctaagcttcatctctgaatcatcagataacctcaagcagaatgcaactggacccgctacgctctccattctctgcctcttgcaaatgcctttacatgactatgaataagtgtacctggagctggtcctgaagcaagaattaaggagctgctacatacacgatttctccactttttcaatagaactgctacttaagatactctttgttgaattctcaaatgtcccttatacaaagacccttttcagaaatttcacagttaaaagttgaaagaaatgtcttttgacaacctgatatgcagcttcctcctgttgaacactgtgacgtaaacagactcatgatatttctctttctgtcttggctaccatgaagctcggagtttagtttttcttcctccatgccagtgtttcctgagctttggttttctggaacattttctctcctctttatacatcttcaactctattaaactgctctggtatttttattttgttttactgactaccagtttaattggaactataccatttagtgtaaactaccacaagtcctttgggcaaataaagagaatatataagcaaataaataattatgaacaatggctactgagccttaaaaccagtggaaggttataagagctttttaatagactcaaataagtttaatgcagaagttacaacctgagggccttgggccagattttgctcttggatatggtttattcagcagatgtaataattttaaaagaaaaattagttaccaacatccttaagttagaaaatttccaataaaaacctgaattgcttacctctctactttctgtgccagaccttgttttaatactgaatcttctaaaaaatcctctaaggtatcaccattctcatcatcccaaatctcacaaatgaggaaacaaaggcatggagaagttcaataacttattttacaggctcacacagcttgcaaatggtaaagctggaacctaaacttggaccaccaggctccaaacactcccaggtggtcgtgctattacctggaaagaatgatccaaaggcttggacccacatttccccctgacaacaatggatccactttccaacctggcatcaatagctggaagtgaaaacagcatgtctctttcaacagtcacctggtgtttgcaagcgtttccgtttaagacccttgtcttaattctaagctgagagcatattatcctgagatgggagctgcatcttaaatgtattttcgacatcctgtaggtttagtctttgcttgaagttaattaacattgatgagtcccacaggtctctatagcttcctgtgaagtcctcaacattgacaataaaatggccaaatgagaaccgaaatacatttcactgtagcacagcccataaaagcagttttacctaaattattccccaaagcatttcccacttaattgtttagcatttacggataataaggacatgaatgaccacatttgcatatttatattgctcatttgccctgtgtgccgtagtcagtgctttagaaagatttgtgtgccacctgttctctgtcagttatctcttctctctgttaaagattcttggatagaaaaaagtaaaactaaagctaatctccttcattaaaggtagagagacttttaataaaacgagacttgctctgcacttcagaggataagcagaaacctttgaaggattttctgtctgaggagtttccagggaggaaaggatatgatttagtcagctagtcagctaagctcattaattctggtaacttgtttctgaaaaaagggaattttcctgtgaaatgctgctactgcaaactaccctcccccagctcatatcacaacttctaacccttgagacaaacctgctattgttaattagtcgaattagttgtacaactgtacattatcattttttaaagttgtcttactgattctcaaattgtattttcttaaaaagtagttgagaattgcttttccaaaacaatatatctttaaaagaacaatgtaaatagacaaatgaggcatttcttgaagctgctttttggtattccctttgatattctatcaggaaactatatgtctaatatgtaagaatatatgtctaatatgtaagatattaaattgtggagtgagaagtaggttttcagatttttctcctcctccagagtctttctcctcatacttctcctcctgactcctcagggtgccaagttcaatagtacaagtgatatatacatgtacaatatacaagtaataataacatgttagaatatgtattattgttatactattatatccttgttattattagggttattatgattactattataatcttttggtgacctttaattctggattgcaggggactatagagagttggaggagactactcagaggcattggcaggtatactgaacgcctcaagagctcctagagctgacattcataataatcactttaggtatgaaaatacatagttaacatttaagattctctttttaatgacccaaaaatgatagagaacagttcagagctttaaaaaaagaagttaactacaatcagaagtggttaaaaaacaatctaagggcttgaaattgtaattgagttagattcaattaccttgaaaattatcaaaaaggaactatccatttcccagcaaagttgttgatctttattcttctaaagcaatttgtacaggaataaattctaacattcatatgtctaggggctaaaaccgacatgcggatgttagaatttattcctgtacaaattcccccagtagtggggggtaaaacactacccctgaaatcacatacccctggattgtgttcaccaatgttcaaataccagctcttgccagtttcttgctatgtaaccaagaactggttacgtaattgttctgtgctaataatggatctattaataaaggatcaaacgatatggtaaatatacagctcctagaacaccctggcacatagtaagagctttgcaaatatctgttattattattccacatctttgtatctcttatcatactctttaagatttagaaactgttgagatttttcaaacttgtgaggacccagttaccaatctctcagtcaatttagattgcagaccaaagatggagtctcccttagcagagctaaaagtccctgcatctctgcatgcaaagtagacagcacttccctgaattcatatctgtcccagaactttgatttaaaaaacaacatgatctggaagttgcattaattcatttttccacattttatttctcagaatttaatcacatggtcaaaacggactgcaagaaataatagtctatatcgtcttaatatagccatcacgtgctcctctttaactctggaggttctttatacaatctaagaaggggagaatatacatgggggaaaataagtcatctctattatgttgagtgttattgcattctctctttgaaatattttcagggatatgatattaagctcttttaagaaaatcggagcgaatattttccctgcttttatcctagtaactgtcaattgttaataattttatagttattataaaaagcaattccatagtaatagctatgtttttctatagccatgagtattggctacgacaatttcatttgtttactttctccatccaagttaacagtcttccctgatagaaacatttagatcacaagtagctcgctttctctcactcaacagttgacatcactccattggtccttggcagtagaaccatcatgttcacattcttgttcccaacataatctttttctttttttgagacagtctctctgttgcccaggctggagggcagtggtgtattctgggctcacttcaacctccacctccctggttcaagcaattctcctgcctcagcctccggaaatataatctttaaagcacaaagtctggagtattttggcaaatgtagctcaatgtagctaatgtagctacattatgttaataaagctaatgtagctaatgtagctacattcagcaaatatagctaatcaggaacttaattcttttggacactgtttgtagagaggcatgttttcctctgccatttgtctttggtaattctccctttcttctagatttttgtatatctttttaagtgtgaatttaacagaaagttccctgtgccgctccatagaattctctaaatctctctacatcttttttggagctatatttgattttggcacctggcgtactaaaaatgacttgaccttagatgtattataaataatttaataatgtttccaggaaccttcagttaaaggaaatgaatgattattttatttaattttatccatttattctacaattttttattgggtgcaacaatttttttctaaaaagtttgtttacatgaatacaagagccttctagttattttttaaactgtttttactacaaaaagaatacaagtttattaaaggaaaatttgaaaaatacagaaaggaaaaaaacacaaaagcgtggggaggctatttctattgccaccaaacgaaaataatatatgtaatatattagcagattctcttctgaaattgtatcttcttttttccccaacctcccctcaccaaactgagtattagtatgtatttatataattgaaactgttgtgtaaactcatctctctctctctctatatatatatatatatgcacacacatagtatttaagacatgatcaaattacataaacatcattttaatgtctccataatattcctccttatggatttgctttattatcccctattcttggacatttaggtagaacctactactcgatattatatataacactgcaatgaacatctgaaatgaaaattattttttgatggatttctggaagacaaattactaaggcacaggatatgagctactttaagtttcttaggatcaaataaatggcaaaagcacattttaaaggagataatagtagggcaaatgaattttctcaaaataagccacttaacctaaacaatgtcatcattatatcctaaacattttcgggagactaagaaaaaaaactcaatttcacagcattacaataaagcctgagtttttaagaatgtcaaaaatctcatgtttttctctcttccctattcatcaagtttcctcttcactggtccaatgaaatagagccacagcacttttatttaaatctctatttctcctgcattcccattagtgaggaaatcaatcagcagttaagaaatcaatcagttaaaagaataattaaatagccattccgaaaagaaaagaagtagaagataagatggctatggaagagtttataatctaataatgtagaaatcaatcacacatttaaaaacaaacaaacataaccatgaaattcacccctgaaatgcttcatgagagaattgctacatttctttatttttaaaatgaaattaaatattactcttattaattttctctttatctgtcccagggatggcaactgtccttaaaatttagaaaggacaatggcagcaacaacaaataaaaacctgattttaaaataggcaaaggacttgaattagacatttctccaaagaagacattcaaatgaccaataagcacatgaaaagatgctgaacatgactagttattagaggaatgcaaatcaaaaccacagtgagataccgcttcattcccattaggatggctattatcaaacagaaaagttacaaatatcaagtgttggtgaggatgtggagaaaatggaacccttgtgcattgctgttggcaaggtatcatggtgaaatgctgtggaaaacagcatttgactcctcagaaaattaaacatagttattaccacatgattccacaattctgctggatacacaccttaaagaggggcagcattattcacaatagccaaagataaaagcaactcatgtccatcaatagatgactggctaaacaaaatatgatatatatggtatgaatactatataaatataccatacatatatcatggaatataattcaggcttaaaaagcaaggacattttgacatatgctacaacatagatgaaccttgaggaaatatgttaagtgaaataatccagtaacaaaagacacagattttattattccttttataaagttcctggagtagttaatttcatagagtcagaaattagaatggcgactgccaggggctgaggggaagggaagcgagaatttggtgcttaatgagtagtttttcatttggaaagatgaaaaagttctggagatggatggtggtgacggttacacagcaacgtgaatgtagttaatgccacagaactctatacttaaaatgatgaaatgtcaattttatgttatgtatattttaccacaataaaaaaattggatagggctattggtttcagttcatcaatagttgtttaagtggtctctcagaggtctaggtggcatgtcttcaatctttttatgttagacataggagctgaggcattttgttgcagtttctaaagtcttgaaaacttagttttcagtgccctggcatccaggagccactccaccaaactccctgccaccctgctgcgtgctgaatgaaaatgatgtgagatctgccacagctttgtttttgtctctggtacatcaaatgtgcaactcaaaacaaaaacaactgtgaacttccttttattatggtattattaaaggattggggaggagtggcaggtgggactgagaaggggaacaggagacactgtagaaaggaagtcaaatctttaaaagagataatgttagcttctgcttcctgaaagaagtataggaagaagagcccagagaaggggtgtttgtgtgggggggagggggtggggcgggaaatataccagatataattgtgttcttttattaagtcactacattataaacacatttataaaaatgtgttttaaataacaatagagaagttcaaacatagctataacaattaaatattctgtgctcagaggaggtaaatggatgaatagacagcagacatttttcccatatgccctcgcttagtgccagcagtgggaagggtgcttatatttgaattagagactctgagcaagccaagaaagctgaacaatagctcccaacattctcctgggcagtagaaagatgacaaggtcagaaggcacatttgattgtttttcatatcataggtatgttcagcttttccagggctccaaggtttgacccagcatacagaatagaaagtgaggcagaagttactcggttcccttcattgtgcataacatgataccttgttttgtttacccataaaggtcctctgttgacattttaaaccagagtaaatataatacaaaaaaattttaaagacgtgaatttttttaattgtagctaaaatagcaaatcaaaatatttaaaattttccttcctcatcccatgaaaaagataactctaggagcttctatttgattcttggtgattgatctctttttaggtagagacatttcctgttaaaacttccatttctagcccgaggcccttaagaataggctataataggcattaataaggttatacaaatatactcacttatgcattgtagcttcatatattttgtgacaacattaaaaaaaattctaaggattgctgaaatactttctcaagaaactatttctccaggcaaagagttgcaagcagaaagtttcatggtagacagcacaaaggagtacatgccaattgtaattagaacaagcaggagaattcgcttggagaccagaaacacaattccttttatggcatattagaagcatcccaatcttcctcaatagtggtgttcatcaaacagacaacattctgaaattcccttaagagattgctggagtgaaaataaatttgtttttagtgtgatatcctcaggacagaaaccttataaaatcatttgccttgttggcctgtccacctcctataataaccattgatcccacaggctaatttcaaccaactttgatagaggggcaaagagtctatagctagacagaggctcataaatttcttgtggtttcttctgtttctttcagaagagttgtttaatggtatcattttgaagagtataaaaaagcaaaccaagtttctgctgtgaagttgtcactgtaatggaagatgattacatcagaagaagttcaaatggaaaaaaaatgtttgtagttgccttgtggtttcctgataacaagcaaagcaagcaccatatataacaccacacagtggcaggcatctttacttctgatagttgcatcctggaactttataataaattcgactcttgggttttgcacatccaagtggctgagtttttcttgtttattggagttgaacttaaccagttctcagttctcagaagtgtgctgacataattgaaaggctttcaaagagctgatggtgagttagtgaaggaaaaaataagaattcagaaaaaaatattaagaaggaagcaacagaccctcctacagtaatatacagcagggtgacaactcaagttcaagtctaggatagagtcagtatctgagagggtccaggtctcgatgtggtaggagatctgcttacagaatttgtagctgaaacttggggggcccagtgcaaaaacaggttttattctgaggaatgtattcaagaaactatgagaaattaggaatgaggccagcagagggcttacaaggctggtacagcatctcgtggtgtctaaatcctagggaaaaggggaactcaagcagctgggtagcttctcactacatgcaattagaggtaccagggtggtgctgctagtacctgaaggccttttggtccttactctacacttcctctacacctgaggtcctaagttttcactctggtgacaaggcaaaaaaacaaagatatacatacacacacacatacacacacacacatatatatataatttccttctttaaagtgagaaaagggctcaaaatctgagtctagctaagacctcaaagattgtatggctgaatgagaaaaccaggttaacaggatcataattatagacagctggaataagtcttgtgttgaataggaactgatactataaaggtaactcagataatttgtttccataattttcatctttcaattctttttacttgaacatgctctgagctgtaaagaaataggttacacagcactgggtattcattttccaaactctgctagcaatattgttcaatctcaagaaaagacccaaggaactaaaagggaaaagagaaacaggataaatattttttgatgaaactcctattttataagatgcaaaacataaaactatggggctctaaagcctcacctaagtgaatcaatatgactacagagcttgtaataaaatacaacactaaaaatactatgaatcaaacataaaatatgcaaagttcaccagatcttcagtggactagggaagctgtccttgcaaaggaattaagtattatttgaaatgagaaagtgtaactgaagagttgggaatttcattttctggagctgccacaacagtgcccaagtagggaatcagcttataaatgcaggtagcttgtaaattcggcacttgatgaagtaatatccagggaaaaggtacttaatgttcccaggggaatatatgttgtatgaatgcatatactgtgcaataataacaaaatatatactacataattagactgagtatatattttacaacataaatatagttagggctgttaatcaaattaaacaggacattttaaaacacagttaagaatgcagagaggaaaaaatagattaacatctaaaagcacatgcaaaagaggcacagcaatgaatgcaggaccaaaaagtaccaaaaaatagtattgcatgcacaatgtgttatctttctttctagaagtagtcatggaaactaatataaacaatgacttctgaaagctaggtttgctcctcctaccttaatggcttcagaatctcagcttctactatatagtagatggaaaattctcaagtgaagcccagcaacagcatagcaagagaagggctggctacagtggctcagtagctaatatttccagtgaaatagcgaggctgttttcagtcttcctttacaaatctagatgaatatgccaggcactctcattaatttcttgaaaagtagtcattttttttgaaagataaaacattcagtaagaggtgaaattaatggagaaatattctcactattattttactagaaaaggtataaggatttaaatgatttgaatgaccaaactctctaccaaaaaaagtatcacccaattagttcaaactaatactatagaccatgcttcacccgatgtaatttacatattattccaatcatagcccactataacctctgctttcatcaacaagaatagagtttttataaagattaaggcacatttatctgttcttctgcttttttcaaaactgcttaaatctataaatgtatttcaatatgtatcgagaaaacagaataaagttaagtgaatgtataggaataaaaggtgcttctgttaaattttttacaaaaactacgataatgatcttaagactagttttagaatctccctatatataaatagtgtttagtcatcgtttcttaaactttccacaaaatttatagcggtttgggtggcactatatatagttgaccctagaacaacatgggtttgaactgcatgggtccaactatatgcagattttcttctgcctgtgcccaactatgtgcagattttcttttgcctgtgccatgctggagacaacaagaccaacccttctacttccacttcctctgtagcctacttattgtaaagatgctgaggatgaagacctctatgatgatccactttcacttaatgaataatcagtatattgtctcttccttatgattttcttaataacatgttttcctctgaattactttattttgataatatagtgtataatacatataacatgcaaaatatgtgttaatcatttatgttatcaataaggcttccagtcaactgtaggctattagtagttatgttttgggatagttgcaagttatatgtggattttctactcttcaggggtcggcatcccagcccccatgatgttcaagggtcaactgtataccttttatatctacataccatagatattgtaaaactacctacattcacaatgattaaaataagttataattatgtattaatttatacactcaaattataattaatgcaattatgatacaaatttaaattatataattttaatttatttctttaatttttatagatttattatgttttttgccattccttttcaaggaatcttttctgatttcagttttattaaagtcactttcaacacagggacactatttctgtttaatgacaggattagctgccagtccctatttctccagatgtggagataacatttttattcagcagggagtctaaaccattcacagaaatcccattttataccataagagcaagcatattaggttgcactcaaataagatggggtatctccaagttatttctctattttatgcctcggttagttcctaaggcaactaaataaataaataactctgacttaataggcaatcaaggagcatcgtttgtaccatatggttggcatagtaaccctggggtattgttactgctaccaccttctagagaggaggaaggctgggcctcagaggttaagtaacttgcttgagattacagtttccacattaagctggaatctaaatacagctgctaatggatgtctccagagtacatgcagcagaaaaactaaaagaaattactgttctatctccatcagtgaaaattttatgtaaattagtaaatgttatgtaacccaagattattgagagtgagagttgaatgaaataactttctacaagtttcttctgacctccaagtaatgtacataatatctgaaactatttgaaaccctgatatttaccgtacaaggaagcaaaaaaacaaattattcataagccagaaatgttcccaccttaggtgcatgcttttggcagcctgcttagaagattgcatgatatgcactaaagaaatgtaaaaaattaacagagcagattacctggaaataagtcccaagttggaacatgagataaatactgtataaaagttaggtggtgattcaacatacccctctccctataatttttagtctttaaggaaccccaggtcttctctgtgctccagtgctccctccttatgcccatgactcaacacctactgtgtgccagcacggacctccctggttcattgaatgcaaggttcattcagcatttaaaattcaattaatgtaattcaccatgataaaacaaagaaggaaatctatgtgatcatctccatagatacagaaaaaaatgcatttaacaaaactcaacattcatatgataaaaacgttcagcaaacagaattaaaggaaacttcctcagcctgaaaatgaccatctacaaaaaaacctagagctaacatagtaatggtgaaagactgaatgcttttccccagagatcaagattaacacaaaggtgttcattcttaccacttctattctacattgtattggtgatcctggtcagtgcaacatggtaagaaaaagaaatagcagttacatatattggaaaaaagtaattaaaaccccctctattaacagatgacatgattgtttatacagaaaatttcaaagaatttgccaaaaagagactagaacaaataactttaacatggtcacaggatacaaagtaaatataaaaaattagttgtttttatacgctagcattgaacaatttgaaactgaaatttttaaagtactattaatttttttaaatgaaataattaggtatacatttaacaatagtagcaagattagaatgccaaaaactacaaaacactgataaaagaaattacataagcccaaataaatgagctatatttcacgttcactgattgaaatactcaacgttgctaaaatgttaatttttgcaaatttaatctctgcattcaatgtaatccaaatgaaaatatcaataggatttttttttgtagaaattgataggctgattctaaaatttgtatggaaagccaaaggaaataaaacaataaaaaccaatttggaaaagatgaacaaagttgaaggactcacactatctgacttcaagatctgttatagaagcacagcaatcaagataatgtagagttggcaaaggatagaaataaacacaataaagaatgcagaaataggctcacacacttatgattaattcattttaaacaaaggtgtaaagcgaatctctggagaaaaggaagtcctctcaacaaacaaagctagcacaatgcatgcagccatattgcagggaaatgaacttcaactcaaattttatacaatcaaatgcaaaaactaactccattaaaactcagatttaatataaaacttcgaagagaacacagaaaatatctgggatcttgggctcagcaaagatttttaaaattatacctaaaaaagtacaaatgatataagggaatctgataaattgcacttcaccaaaattaaaagtttcagctctttgaaagacacttaaaaaaataagaagacaaaccacagaatgtgaaaatattgcaaaacatgttttttcttacatattgatattcagaatatttaaagagctctcaaaactcaagaatgtaaacaaaccagtttaaaaatatacaaaaaatttaaataaatacttcatcacataagatagcaaataagcacatgaaaagatactcaatatcaataacatgtccattgaaaccacatgagatatcactatgcaactattaactattttatatacatgtattagtgtatgtgttgagagagagaaggaaggagagagagtaggttatatgtaataatcgacaataccaaatgctggagaggatgtggaataactctgatgctttggtggcagggatgtaaaatggaaaacagttgggcatttttttcttataaaactaaaaatacacttactgtaacacactgagcaatctcactcccaattcatacatattacccatgagaatgaaaacatacttctacccaaaagcctgtacacaaatgattatttcttctttactcataatttcgaaaacctgataagaacccaaatcttcatcagttactgaatggataaacagtcttaccttcttgcaattgaatgctactcagcaataaaaagacccaaaccattaacacatgcaacaacaaagaataatctcaaaatcatttttctaagtgaaagtagcaaggttcaaaaggctatatattgtatgactccattcatattgcatctggaaagggtaaaattctagggacagtgaagagatggagtgttgctgggagctggaattagggcatggtattgaaaacaaagagcattgagaactgttttggaggggaaggaagtgttctacagctcgattgtggtggtagtcgcacagtgtatacctttgtacacctaacatgatgaattataagtgaattacatatcaataaactcaactttaaaaaagtggaagtgacctggacctctgttgcctctgagatgtccatcctaaccccagtttctcactcttcaccctactgtaatccagtttctatctccaccactgcacaaaaaactcattttgttaaggtcagcaaaaacattctgattgcaaaattcatcctcagttcttcttatgacttctcacaacttttagcataatcaataacttctcctttgaaatattttccctttctcttccacaatgctgctctctcctaatcatgcattcttagcgtgatgaaaagttcctcaaccccctaaatattggtgctgcttagattcccatatttagaatacctttctcattttctatttacttatgactcgtttgttttaaagtaaagttgagcattgtaaacaagggcatcacttttgtattttagggtatttacctttgtatcaattggaagataaatttgaaaaaggcaaaactgaaggaaggcgggtaggttgggagatgatatggagaagtgatggatatccaaatagtagggctttggaagataaggatagattaaagagatgtagaagaaagaatcagtagggcttggcaatacattgaacacagctaggacagggaaatagaattgttagatgaatggtcaaatttatggtcaatttatacaatctgaataatggtggagtcattcggcaagtcagcgaacataagaaaaggaagaggtttgggtataaagtgattatttcagcttggaaaataataagtttgataatcctatcaggaagatatttaaagaaatcaatctgtatcccagggaaggagtagaggcactatatatacatatttccatttatatgacattctggaaggggtaaaatcccaaggacaacagagataatagattgccaggagctggggtcaggaaatgattgtgtgtgtgtgtgtgtgtgtgtgtgtgtgtgtgtgtgtgtgtaatatgcagatatagactatatatgtgactatatatatgtataatagttgtctatttctttcagaagtaaagaaggattcaagtctccatgtatttctctatgttattctctccacttgcaatgctcaccttcttcatctgttatttccaattcatcctccatgaaatgattcagatgccatctacttgaggaaatcttccttgattagccccattccctcaagcccacctttatcccctaactccacgctgttagatgcacatttttggacattttaatgtcacatttataacactctaatgaatgtagcatttagggtactttaatgcaactgttgattagtttagttgtcattttcccacaaaagattgtcagctccttgatgtctttcatctgtggaacatgagtgttttttacagtgcctggcttataggaaatagtcaaatagggttgcagcattacactgttggaaagaacatggtgtaagaaatcaagtagatatgagtttgaattttgactctgctagccatagtctgtgtgcttggttaaatcgttcaatctctttgagtttaggtttctataaaatagagattataatgctactttcctcatcaagtttttgtcatgtattagtaaactactgccgcataacaaattttcccaaaactctgcaacttaaaataatgtccatttattatctcacagtttcagtggataatggcttagctgtattctctgcttcagagtctctcacatggctacaatcaaagtgtcctccagggctggggtctcctctgatggctcaacagggaattagtccacttcaaagttcatgtgtgtggtttttggcaggtacaaattccttcagggtggttagactgaggatctcagtttcttggtggcagtgagccttctctaacaatggcagtttgaccacagtcattatgaaacagagtcttctggcaaggtggaagtcaagatcttttgttacataatcactgaagtgatatctcacgacctttgccatattctgttgattagaagcaagttgctagttccagtccagactcaaggggaggggcttatccaaggatgtgaatgcctggacatggggatcattgggagctatagagtcatatagaactctgcctactacatgtgaggaccaagtcaataaaaccaaaagattcactagatgcctaatattatacatggcaagtgctcaaacagctatttatgtccaatggataaatgaactcatccatcaatcaattgttctgcaattaaccggagtaaccactagatggtggtgcatccttcacagcattgtgccataaaagtagggtcagagattttgaatgtaagagctttttttttttttttttttttaaaacagataaggtcttgctctgtcacccaggctggagagcagtggcgcaatcttggctcactgcagcctgcagcctcgacatcctaggctccagcaatcctcccatcttggcctctagagtagcagaaccagaagtaaaagagcatttttttttttttgatgatgatgatgatgatgtaatacacaaagacacattttaaaaacagaaactatacactcctaactaaatctcttttgtatctctggaactcttacaaaacctatcctgcttcttccttccagagtaaattataaaatgtgcaaacaaaataaacagaaactcctctcctcactttgatgtacaaggtttctcactcggatactatccagccctgatttaaggtttctcactcagatactatccagccctgatttaagtttccttttgactcttaaagacttaaaagcttttgtgtttctgttttgaaatatgtctgttatctttttctaaattaaagtaaaacatattcattgtagaaaatttggaaaatatagaaaagaaataaaggaagttaaaaattctaatcgcacacctaaaaatactttagtatatctattctgctttccttcccttcttttcctctctgtttttctctattcttcccttccccaacacacacatacatatacacagagaaattgaaattatattatatatagttttgtatccgaataaattgctacctcacaatatctttaaacttcctttttgtaatacaatttttgagtccttgccttttactgctgtgtttaagcatatatatagctattattataccatttgtagtgccttgctcctaccttctcattttctgttattgtagagtgtgggtttttttaaattggtgttttaaaaataatttttgtattttttgtatattattttgttgatgtttatctccaccagtgttctggaatttccatattttgttttcattaggctacttttaaacttaaaaacattttttaaatgttttaatctattctcctctaattaccaaggtcaaagtgaaatcatattgttttgattgcccactatgtaagacaaagaatttagcatgttttaaataaaatttcatcttttccatgatagcatggtctttgctaacataatcatgagcttgggaacaaattgttgtcatccaattattattttaacattttggaaatttatttttgaagaataaccttgaacaatttgtcgtattttgtgtcttctgttttgcaaaatgatttagccatactttcaaattgaactggttttaatgtttatgaccagttctttaataatctgcccactaatatttgataatgtactattttatgctatttaactaatattcttcccaatgatattataatttttcccttagtcacatgaagtttatctttaagtatttttaggctatgcacttatcataagtagtatctctttctgttatctacaaatttgaatgacagtttctctgtgcacagaatttcagggtctcagtcttttatattcaaaatgttttaactttaattctattattttgatattcttttggcatttatttgtatcttttaaatttgtttatttttatgtcttttaaaatattttaatataaattaatatttttatgttttccttgtatccacagttaatttttattattgtttttcttctttttgttttgttttctttttaacttttattttgggattaggagtacatgtgcaggtttgttatacagttaaactcgtgtcacaggagtttgtcgcacagattattttgtcatgcaggtgctaagcctagtactcaatagttatttagttatttttttctgctcctctccctcaacttaccctccatccccaaggagtcctcagtgtctgttgttcccttctttgcgttcatgagttctcatcatttagctctcacttatatgtgagaacatgcagtatttggttttctgttcctgcattagtttcctaaggacaatggcctcctgctccatccatgttctcacaaaagacattaccttgttcttttttatggctgcatagtattccatggtgtatatgtaccacattttctttatccaatcacagttaattatttcatcattatttagatgtatgtcgtttaaaattaatgttgactaaaagatagtcatccattttaatatgctgtctcctgtcttattcaacaagaaaaataggtcagctgtcttttattgttaatccacttcaaagtattttgatttctctctcagttacatttgaaattttaaggtctaatttctgttctctagtccctttatctctgggatagtttctcagttttgttctcttatcacagatgcagttttaaaatttttattgaagtacaataaacaaaaaattacataaaccaagtatttagcttaatgagttctcatcaactaaacatatctgtataactaattcctagatcatactgctttgattatctgcagtaccagttttccacttttctgcccccaatgtagattttaatagcactattgcaatgctagttttagtttattcttgttattttacactgcatccttttcttctctgtctgtagtccttaatcccatcctgttgtcttttcagttattgttttcatttttgtgtctttttactttatttccacagaaatcaagttttcacacatattgtcatgaaaataatgtagtattctaaaatgttcttgatgttttgttataagccagattttgggttttcttcctttagctctttagcgttatgttccctttcttttgtggagcactaggaatacataatgtatgtatgtatatgtatagatactcaaacacacaacatgtgtctgtccaatcatcatgtattccctcttgctttacctcttcataaaagaacagtggtttctttaataaccttcttttcctagcagccaggtacattagaggaggctgacttcattctcagttccaaagaataatcctctttcctcccacttcttgccattgatccatttagagatgaatatgagtaaaggtttgctgatggcttctcgggaagttctcatttgttctttaggtagagacatcagggggacgtgaatgaggaagcatgtagatagagtgctacttgcaaccatcctataacttcaaaaatgtctttgaggtaaagctgaaactttgaccagtgaagtgaagaagtggtagatatctgagttcttgatctttttgagtcttcaagataaccctgctgatgttttttttttcttggactttctccttatatgagccaataaattttaatatttagggaagcttcatttaggttctctattgcttgctgccagatcatcctaacttacacataactacaatctgatgttgaaaggaattagttttctctttctctctctctccctctctccccctgccccgctcttccccacatctccttagcaagtgcacaaccagacctagtgtttgctaacaaaataaatctgtgagctgtcattagccaggttcactgaccaccttgaggaacagtcaaagctccacctcagatacatagtagaaattgctgttcaagttccggtagttggtaaccatctgttgtaataatactaaactgtactaggatctaaccagtttcacagatacttcaaaccaagcagatatcttctctgtcacttgtaagataaataaaatatagtcctctgttgcttttgccttgttttgttctgcaagttgtcatttctcaaagcatggagaagacagagtataagaatgacaaggaaaatagtattcagactagctctgtaaagcaactgagtgaccatcagctggctctctcattagtgcagacccagggctctgagcctaattgcatattgcaggatatgaaaaccacgtctctgtactttcctaaaagtagtggaacttcggacgcctgtagtcccagctactcgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaaaaaagtagtggaacttgtcagatgacgttagtcaccatttctgttgctactttcttgtttcacactggttttgtttaattcagcacctttggttttatggttaagcattttctccaattcagacagtaagttatcttttcattttatctgttactattgtgttacctctcatctttttcttgtcttcatacacattttaatgggatattgacagtaactgttaaatagatgatgctatagagtggatatgtgcccctgctaaacagcaattattattgttgtttacatgtttcaaacttgtttacattgcttcaatatagctaaacttgtgatagatataactgtaactaatttgtatttgggcactgccagatctaaatttaagttctggcactaccactgtctaattctgtgacttttggcaagtttcataagctgtcaaagtttcaatttattcagcttaattacctcactgtgaggttgtgagaaatgaataatacagtaaaatacttagcaaagtgagctgcacaccatacctacgcaatagcagtagctattgttaataatgtgctcgccctcgccctctccctctccctctccctctccctctccccacggtctccctctccctctctttccacggtctccctctgatgccgagccgaagctggactgtactgctgccatctcggctcactgcaacctccctgcctgattctcctgccttagcctgccgagtgcctgcgattgcaggcgcgcgccgccacgcctgactggttttcttatttttttggtggagacggggtttcgctgtgttggccgggctggtctccagctcctaaccgcgagtgatccgccagcctcggcctcccgaggtgccgggattgcagatggagtctggttcactcagtgctcaatggtgcccaggctggagtgcagtggtgtgatctcggctcgctacaacctccacctcccagccgcctgccttggcctcccaaagtgccgagagtgcagcctctgcccggccgccaccccgtctgggaagtgaggagcgtctctgcctggccgcccatcgtctgggacgtgaggaacccctctgcctggcttgcccagtctggaaagtgaggagcgtctctgcccggccgccatcccatctaggaagtgaggagtgtctctgcccggccgcccatcgtctgagatgtggggagcgcctctgccctgccgccccgtctgggaggtgaggagcgtctctgcccagccgccctgtctgagaagtgaggagaccctccgcctggcaaccgccccatctgagaagtgaggagcccctccgcccggtagctgccccgtctgagaagtgaggagcccctccacctggcagccaccccgtctgggaagtgaggagcgtctccgccccgcagccaccccgtctgggaaggaggtgggggtcagcccccgccaggccagccgtcccgtccgggagggaggtgggggggtcagccccccgcccggccagccgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatggaaaggggagaaaggtggggaaaagattgagaaatcggatggttgccttgtctgtgtagaaagaagtagacatgggagacttttcattttgttctgtactaagaaaaattcttctgccttgggatcttcttgatctgtgaccttacccccaaccctgtgctctctgaaacatgtgctgtgtccactcagggttaaatggattaagggtggtgcaagatgtgctttgttaaacagatgcttgaaggcagcatgctcgttaagagtcatcaccactccttaatctcaagtacccagtgacacagacactgcggagggccgcagggtcctctgcctaggaaaaccagagacctttgttcacttgtttatctgctgaccttccctccactattgtcctgtgaccctgccaaatccccctctgcgagaaacacccaagaatgatcaataaaaaaataaataaataaaaaataatgtgctcaatattctgcatattttaattaaatagctgttagaatttatatttacaaaatgaatggatctctaacataaatttaacatttcaaatatttcttttattaacttaactttaaaattagagggatttttattttttttaaccaaatgacaaattccagacatttagagaaacatattaccctatagttgtatagtgctttatattttgccgaatagagcactttatattttctaaaatatttacatattaattaccttttccagttctcacaacaactaaaggtaggtggtgcaaaggtgcttactcccatttcaccatgaacaaagttaaaactcagagaaactacatggctcctgtaggatcacatatttaactggagccattgctgggacatttgacctccaaacacctcctctctcttccatatttattaaattggcttgccaattaatatatgtaaacctagtaattaagaagctaagtcagcctatgtttgctacaatatgccacaggtaactttttaatcttaagattgtactaagaaagaatgaagtggaaaaatggttaaagcaaagacaaaatatggaggaaaatttcttgttgcatatttaagatattctttttattctatgaaggacataatgaaatctactcagttaataggcagcatatggtataatccaagtatgttagagatttcgggttttggccaaatagaagttttaaagaaatattttggtgaagtagtttctgccttttatcaagaaacctctatcaactaaagttatttcttctaaaagtcactgccattttttaggaacagtttaaatgccaatccaaagccagcttctttgaactgacacatttacatgggtagataaaatttgtgtctctgaaagtgttttatttcctgcgatcagagcttcttagcttttccagatcaaatattcctgtgaaaatttgttgaaattttagaccagttctgaggaagagtgctaacagaattacctggtatgctcataaaaaatgcagctatctgagcccgatcttgattcacagaatcagaatttctagtgatgtgtcctaagattttgcattttaatcacacccactcccactaagggactcttatgatattatattttatagagtcaatactataaattcttcccccagaaaatgcaaaacaacaaatcaaaaaatattacatatattttcaaatgatttacagacctgtcatgtccattcatggatacattagatatctgcaaatgccaggtttacaacctttgcattgaataaagactaaagttgtcttccaatacattaggctctttatgcaggagaaaagactgaatgcatgttcattttgattacagcatttcacacatttcatcaagatatatactttatagcagtactgtattatataataccgtacactaggaagtaaacatagaaagaggtattcacacttataagagttaccatgcagttgaggaaagtaaatcacaaatattaaaaaaaagaatacaatgtactctgtgctgggttccatatggataagctcagatgttcaaggacaaacatgagtgagagttaccaatagaaggcatttcaatatgggtaagtaacaattgggcagaactgtgaaagaaagttgggatttttaaaaaactgaagagaaagtagcagttgagcagaactctgaaagaaagttgggattttgaaaaaacgaaagagagagagaaaactttgaatgtgttttaaattttattctactaaaatatattttaatacaaccatttatgcagtaagcaatgggaaataatgctgggagatgaataaaagccagattgtggagggccttgaatgtcgggccttaccaggtcaataatatacttggcctttgatattttcatggctgtacaaaattaaagtattaataaatttgcaaaaaatgacaaacagcactgctaaagaatgtaaagccagttcttaccatggcagagagaaagccaacatttcttagaacagcaacatccaactccatacaagacaggtttttataattcactttaacttaagtgtttaatcattcacttttgacaagacaagggaaaaaaggaccaagcaagagcagagccctttctgatgatttactgatcaaagccaattaggatagttctggttgaactgggttgagtttctctgaaattacttttcaaagtaaagtcaacaagagtgagcatgtgcagtgctgtactttctacttgttagtccgtaaaataactaaaaatcacttacctatatccactgagcttcaaagtatgacttttgaagtgcaaaatcaagtgaaatgtgaaactgaaatgcaaggctttttgcagctattttgtctttcgtttgaagatctcagaatactttccacacaatagactgaatcaaatcttcctctgggctcagtattttttttatctgagctaccatatggttttgaacaaatatcaggtctggagagtgtgtatatgtatctcttgcatcagaactttagaatagtataatcataaagtagagcaaagaatggatgctgaagaaacaattccatgctatacgctgtacacacacaatcttaatatacaaaataagttaccaacatagtaacaccacatttttctgatattaaggttgacagtgacccacataaaagagcttttggcataacacatttttataattcttgtgggaaaaatgttttttttaatcatttcacatttaaatatttcagaaatatattacacattttcttgcatttctggtttaaaaatgttgcatacaattttgtatcttattgacgacaatgttattatttattgtcctatgctctatagattttgattttgttcctattttcaatatcttcaaggtactatactttttaatattattttatgccagctcatcatattattttttcggagggagcatgttgtagagaacaaatgacttatctcaggagtcaggcagactgagtaccaaccacaagttggcttggtttcatcatctgtgaaatgcaggtagcaatacatgcttcatcattcattagaatgattaaatggccacataaataaagcacttaccacagtgactggcacagatctgagactcaggaagtgttagttctttctctttttttttgagacggagtcgttctgtcgcgcaggctggagtgcagtggcgcaatctcggctcactgcaagctccgcctccaggggttcatgccacacacctgcctcagcctcctcagtagctgggattacaggcgcccgccaccatgcccggctactttttttgtattttttagtagagacggggtttcaccgtgttagccagaatgatctcgatctcctgacctcgtgatccgccctcctcggcctcccaaagtgctggcattacaggcgtgagccactgcgcccggccagtaagtgttagttctatccactcacattcattttctagttctcagctgtcatttcctgctggctgaaaaggtacacaaagttatcccttatccttttcttttgctgattctattccactgcaagctgaaatatttgataatcaagcttgctttaattgtatctaaaatagtaatgaatgatggattaaggcctgaggaaatagttaacaaacttcgccatctccagttttaaacatagacacttttaggacacatcttcgttcttgattatgttctgcatagttgaggtcacgtacagggactgacctccagaaaagtaaaatttaatggtaatcaatacggagaaaaattgtggacatgatgaaatctaactatgtttttaagcaaataaaaatagagttagtgaattatggcaagacaagcaacatttgataagcacctatgacctggaaccacatgctatgaacaattgcctcatttaatccttattagtggccttctaaagaagttactgctcttccctttttacagattttttaaactgtgacaaaattatgaatttatgaaaatgtcaactcttatattcagcatattttccacttataaattctctacttagaaattattcatgcggcatattctttacttaaaattatgatagaatcttaggactgggagaatcactagaggccattgaaatacataacataccttttcttaaatttcgatgataatatccatgctgaatgatgattctctctaaatctgcacagcttcaatgtcaggaaacatactgtctcccaagacagctggttctatgcttgatgagcatcaactgctagaagattctgcacagtgagcataaataaaccatccaaaggcttcttactgttggtactagttttcacagttagaaacaaataaaacataaaattccatgtgttagacctttagctacatgaagacccttctgatatgccctggtatctgcttttctcctggttaaacattcaattttctccaataatttctctaatgacatgatttcaagtaaaatcactatcatattagctttctttattggagtgtccatatcttatcgctgtctcctaaaacaaaaatatttcgagttcaaattgggagttagaaagggattttcatttcctttgccccagatactatcatcggtcatgacagccccaatgtcacataaaatttggaaagtcacatcaccatggatccatatttcaaagataagttgaggtaatacagaataaagtaaaccataggctgctgtacattatgtaagtgttaataataattattagtaaattattatcaattgaaactcataggtcttcacccaataagttgtatctcttctatccagttttgtggtttcttcacctcaagtgaaaagagttaactctttacttcagattatagaaaactgtcttctttagttgacatgagatccctggcttgcctgctttatatctattccattctgtcccaaccaatcctattctatagtttcccccattcctcattcatttttctcctttccttttgtacatcactctgatatattagctatatagactcatttacatgtattcatgtaaattattaaggtttgtgtataagtatatattgtgttaaagttctcattttctttcttccttttttaacttttagtttaagttcaagggtacaagtacagatttttttacataggcaaacttctgtcatggggggctgttgtacagattatttcatcacccagatgttaagcctagtacccattagttatttttcctgatcctctccctcctccaagccctctaaaggtacatctctttgttgtattggagaagaaaacctttttcagcctccccctagcagagcacccctcaagtcctattgaccaggattgggtcacatgcccatgacccagctgtaaaggagtgtgtgaaagaatatatttgacatgtgtattctatacggtggaacacatttctctctgtaaggaacaggcatgggacatgctggggaatgactactagaggtaaccataatttctgcctaaggatggtcattatttttaacaggttcatgttgcctataaattcaataagtatgccttatatatttttattcaagtaatatttatccaagttcacttatgctgtctacaaaaaagttggtgaaactcctttgaatgactagcatgctccaagcatttatagttatctcatttggttcacacaaaaataattgtttcataggctttattatttctactttataagaaatttcagcttaaataaattagctaatttacccaagttctcatagcctagtatcaaagctccgattaatataaaagtcagtgtcatagtctgactccaagtccatgtttattctacttcattattttgattccctgagggctattagaaatgcctctccaagtaggtccattgatcagaaccctgaatatgttccctctccttcttacaccaccttcaccctgtagcccccaatagatacatttcctcctttggtcctcaaggctgttgtctgcttaggcttccccactactataagcttggataaactgtatgcttcaaaaagcaagattatatctatttttcttcactatcatatctcctgcactcacatagtggcagtcaaactaaggccttgataaataagttttaaatatgaatgaataataaatgaatgaatacatgcactattgcaatgtctcttgcatcacacgttttctgccttattactggtttccatcacaacttatctgacctcagttacctggcgattattttttttaacttggcatacactgcccatgataaggcactaatgactatttcatgatacagttactgcccctctcaggtaacattttcacctttactgaggcttctaagagacaaggtctcaacctaaaggaattgctctgattgtgagaattttagggagtatggtagttctaggggcttcatgacctctcagcttatactgcctatgtgaaacctctctaggtcctcaggttcccctttaagaaaatgttaaaaagaaacaaaaaagaatcactttttttgtttgtactctaagtgtatctcaaacacctcacatattcaaattattctcttgtacaaaattaaatgccattggatgtagaaggagtggagcataactggtctttcatagaggctggaatttctctgagagcaccacacaagtaactcttgccacagtctcaattaataaaagcctttactcttttttcttaatttttctttcctttctatcccttgcatagatacttaatagatttgaagttgccattaatttcttaaccactattcaaaaggaaaacaaacaaaagaaaacaaaaacaaaaacagcatttcctttgttgtaaagcaaaataaaatcaggccctaattttccacaacagaagttgtccaaaatacttatctgtgtttagatttcccaaaattcatttcttcataataatactgtcagcgttcagtgttgtgatcataacattcactagtgtgacttaaaaaggggaggcaccatgtgttaagcagggataggatctaagaataacaaatctgcctggtaagcagcacaaatgagtcttacactaagccacactgatccagcttggagggaaatgagtcaaaaccaagtccccatactctctacctgcgagaaagaggtgacattgaagaacaagcccacacttctggatatggtccaaaatgatcagaaactcactctgtcaacctagtaggtgtttggatggatacctcttttttaacagaaagatgtttggagccaggacacatggttttcacattttaatggcaatgctcataggtaactaactctcttcttatatacgctaatttgcaacatgcttagtgtttttaagatgtttatttagcaactattgtttaatgctataacagatattactatcaaatgaaaattcaaacttttgagaaaggaaaagtggatatatttatgcattgagtttttggctttagataatttctactttgatttctatttattaaaatttttaaaatcctaagtcaatcaaaacagatcaagatgaaacttcctcatttgtatatgtctttgtatatatgtctagtatatatatatctagggtaaattatataacttcatattagatatttcattaaccatggcttcagcaaagtgagaattatgacaaaaatcatcttcatatccaatgatattaattctaaatataaagtctacgttccttttatccattaatatgatttattctcaaggaaatatgagatataccaagtggtagaaatttttgctatcatgattatttttgaaatacagtattattatggaatcagatactgaactaaaaaaattttaggaaagtaaaatgaggtgacagtttttaattaattaaattaattgactttaagcaaataacaataagcttcaagtaatccatcccatactataaataattgcacataaataagcaatttgtattcaactaaaatacccaattaagaagactgaatggccccaatggtcccataaatatgtcctaatccttttatcttgattgacaacagatcttgttctttgcccagctcctccaataaccaataggagacatttttatcttttttcccacttttagttttctgggttcatcaaataaatatgttggactttattttacattggacatgtcaatagaattgattttaagtgaagtaaaagcataaatcgctgtttatcattctacttttcatacctaattctgtttgctgttcttcggactattgatcttaatacaggctttctctcctttttttgttctttttaaagtgatggtaaaatttaaaacttgcttttctgtttatatttaaagaaacacataatcaaattattgacattttatgaaagatcaaatgcataaattttagcaatcataagaaaaaaaacagtaggcaatggtatagaaagcatgaccatctgcacttatttgcccacaaaggataaatgagagtgtactgtaaattgtaaagaaataaacatcttatttcaagctctaataagcttatgtgtcaatagttttaatagctgcctagttggtcttcctgtctctactttcttcccacttcattctgttacatatccctgtgaaggtgatctttatgagaaaccatgttggttttctgtccaacaattacgtatgactccccactgccagaaaataaataaatacagctaaaaacctcgtaagttcccagaccttctccactctggctacatttaacctttgtgtgtttatttttctaggtaaattgtacatgccaaccagattgccaaactcattgtcacctctaaatgttaagctttcccatcgatgagtgttttgtttattcacttatttacacacacaaagacctctttttcttttttcttttttttttctttttcttttttcttttctttttttttttttttttttgagacagagtctcactctgtcgcccaggctggagtgcagtggtttgatctcggctcactgcgagctccgcctcccgggttgacgccattctcctgcctcagcctcctgagtagctgggactacaggcgcccaccaccacacctggctaattttttgtatttttaatagagatggggtttcaccgtgttagccaggatggtctcgatctcctgatctcgtgatccgcccacctcggcttcccaaggttctggcattacaagcatgagccactgcgtccgcccacaaggacctctttatcaacttgacctatatttgaaaacctatattaaattctatttctataagaccttcccagccaggcctgaagagatacccttctccagaggctctgcagcagctactgcccaaactattcacttagaatctattgtgtactgtctagtgaaatctcttcagtattgtcttgacttgcactatcatttagtttttcacaaatttgtcttacttttcctttattaaattcattgaggacagggactagttcgaacttcatgttatctgcaatattttatacatgatatgtaatcaatatttattgatttgacttaaatttaatatgaagatttcatatctaaagatgtttcattatctatcattcaaagtatttttcctaaaactttcctaaatatgctctaatgttgcctgagttttattctcatatattatcgacatctgctgggaacatactatgtacaatgcattttcataaatatatattttgtccttccattatattgtaaatacattcaggctaggtctacgtcttctagtttgtagtctgagagtactctgagagtacatcatagagtagctattctataaattgagaaaatggtcaattgaaatttcatctaaggggtcaagatatggttgctgtcaggtaccaaagtgaattatgaaagaaataaaaacacaagatgttaaagtaaatacagataacagactttaggtttttgaaaggtttatacttttttattttttattttattttatttatttattattttgagacagagtctcgctctgttgccccggctggagtgcagtggcacaatctcagctcactgcaacctccgcctcccagattcaagctattctcccacctcagcctcttgagtagctgggattacaggcacacgccaccacgcctggctaatttttgtatctttagtagagacagggtttcaccatattggtcaagctggtctcaaactcctgacctcatgatccacccgcctgggcctccaaagtgctgggattacaggtgtgagccaccgtgcctggccaaaaggtttatacttatgtcagggatgtgtgaaaattcttcagaggcaatttgaaggagtgggtctataaggagatttcgttggagaggcttgctgctgtgttgtgagttgaaccttactcatcaaattgagggctggatgccacattctaaaccagagtgaccatagcttccaggagtgctccagtgtcatctaaagttggtggaagggaaggaacaggaaacttagactagattctccacctgcctgaggaatccaaagatgaaaaagcgtgatgactcttaacccgaggtgtcaggaaagagagagaaagaattgctgctgtgctgtgttggaaagtaaatgtgctcccctcctactgcaggttaagggtacgtgaatcctgtggtctagatggggaacccatggtaggagcattagtaggcagtttgtgtaaaaatagttcttcccaataggcctctgttggaaggtcaaagaatcccactaaaagagttgataaagaaggaagaaggagtaaacgtcagtaaaccaatagcaaaggggttgaggaaggagcaaatatgagccgccagtaaaaagagaggcaacgtctgcctgccttcacagttctctagagtgagtctcagctgcaggaatagagtgggctccaaggaagtcataagtgtcccttataacaaataccaactttaaacacctcccagtctcagaaaccatggagccatattgtatcagtcaagtgaataatttctgtgcccccttccccctttttttgccaccaagttcagtcttctaggggacaaaacacataaatctgaagatggagacaatggaaggatagaaagagggaagaaggcttccaaatcttccttcaagacagcctgaagttagcctagcagacaaagacgattttattctaaattgcattgaaatttttgatcattatatgtgactgaccattcttattgctttgtttttttttttaagagatcgtgacactactatctaatagtgagccgaaaagtcctggggtctgctgaagacttatctagaggcaatgaaacccttccccagttaaatatgtttcaagatagggtaggagaaaaaatcgtgttttgcttttgttatgccatatcagttgttcaatagttttaccctcaatcaaatacttgttattaatttttttgttcttaaaatcctttgaaaatcaagtttaagtaaaatatcttctaatacaaaagtttcaacttttcatattcagttatattaaacttgtattggaacacccctttagaatatactgtagtttacctgtaattcctgtgtcagttttctgtgcttcccaggataattgtataacaaatagattacttccattcagttctattctttctatccatcaaacatttaatcattcatacccttagcactgtacaggtgctgtgggcgtctctaagaaagattataatatgtccacggttttcacagagcttgaaatatttttgaattgacaaagcttgtatgaaagtaatcccagtacagtaaaatataagtacagtagagtccaatcaagtgcctagacgtgtagatcataaatggcagtacatcgtcagattaacatttcatacgtttgtctaaaagtttacacaaaaagatcactttggttttggatcagattaaatgcattatataaatatttaatcactttaggaaggtcatgatgaattcattcattccaaaattaattactaaatggtgaatacaagccaggtactatgctatgttttagacatatattggtgaataaaacaggcattttccttccttcatggaaagcacaacttgatgagattctagactaatatgctgtccaagtaaatttctcatataaaattacgcaatttacaggacactacacatgcccacactttctaaatagtctctctcaatgactacagtactatttgaattttgtcattagagggtaattctttcctactactttttagtattggccaaaacttattgagaacttgttatataccaaacaatgttatgaatatttacatgtcttaactggtttaatctttaaaagagcctcgtgatgtaaatactattattaatcccattcatagatgaggaaacaaatatagaaagtatatgtgacctgctcacaatcaagcagcatagctggggttctgatccaacattatcaatataggaatctttggtttaaatttttaaaaacacacatttgggcatagagttaaatggaaaaataagacatgcatattaataacaaacaataaatgagaatacactaaattattaattaaaaaactgtgtgtcagattggattcttttttttttttttttgagacaagagtctcgctttgttgcccaggctggagagcagtggcatgatcttggctcactgcaatcttcacctcctgagttcaagagattgtcctgcctcagccttcagagtagctgggattacaggcatgcgccaccatgcttggccagtttttgtatttttagtaaagataggatttcaccatgttggccaggctgatctgaaactcctggccttaagcaatccacccagctaggccccctaaagtgctgggattacagttgtgagctaccgagcatggccaggttggatttttaaaacctagttaatttaggccaggtgtggtggctcacacctgtaatcccagcactttgggaggccgaggcgggtggatcacgaggtcaggagatcgagaccatcctggctaatatggtgaaaccccatctctacaaaaaaaaaaaaaaaattaaccaggcgtggtggcgggcgcctgtagtccaagctactcgggaggctgaggcaggagaatggtgtaaacccgggaggcagagcttgcagtgagccaagattgagattgcaccactgccctccagcctgggcgacagagcgagacacgatctcaaaaacgaaaaaaaaaaaacaaacaaaaaaaactagttaatgtagggtctgatgttagaagtgctttggaacttagacttcactctttctacacctcaatttactctgtgaaagagaactaagaatatctgctttgaaaacctcagaaaattgtagtgagcacaaatataataatttgaatgaagatgttggggaaaccataaagtcctacgcatatgtctgttcttattgttactctttgttcatttgaatctccctggaaaagcaacagccacgcttattaaaaggtgttatacgtattcatattactttttttaaatgaattctaataattccctaattagatatattttttgacttggaatcagaaaaaaaaagtagaaagtgaagttaaaataataaacaggaaaggagcttgttatggtatagacatcatgttttacactggcattgcagggaaggaggaaatggggccttccattcaccttagaagtccttcatggtgagagttgtttggactatttatatttctggcaaacttttaggaattatggggaagtataaacaagatataaggcaaaatcactgtttccaagtagaatagagtgaaatctgcagccagggacagaatatacaatgtctgagaaaaaagtctcgaaataaataaattgtatcttacatcagtgccaagagcgatcttttttcttgtttttgtttgtatgatattcagtgctgcatgtatatctgacagtgatagttggaatcaatcacagtatttggcaaattattcctagaggaagaatacaaagcctgccatgactgcatcttttttcttcatgacacaggtggaatatagaattgattttacttttccttattaagtgtttacattttactccattacagtcctaaacctgagctattcatgcacttctgcaagattatacaagtaaattacgtgaaacttctatttttgatgtgaatatatataattttagcccttttttattatttaacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagaggtgagagaaagctgagtgctatggctaggagtgccatgcctcagagcagagcagaaacagcaaaaacagccagactgcttctgcctgctatgaaacataatgaccccacaagacttctgctgctggttgcccactgatgagaaagaaaagaagagggcagtgatgtgcgttaattaattttgagtggattcataggacatcagtttcactcatacagagaagtaaaaaaaataagcagatagctcttttccaaagaggttttcatctttgtgtttgcaaaatgctactgcaattttaccattggtcacatatcagaaatttattgtaaatcttatttgaaagagaaataatcttttgaaaaaaaaaaaccttagacataaaatttgtcagtgccacatactagcatgatatcttgtgcatagtaaattctcggtaaatattcatttccttgctctcctttccatgcaattcacacttgctccacaatcataattaagcatagcgtttttataaaacgccaattttattcaaaggtatcttttccaaggttgccctggagaagacagataatatactaggtgtcttaagaaaaaaaaaaaagaaaaaaaaatgtggaaagtaacaatagtagaacttggtagatgccataaactaattgatctaatttctctagtaaaccacagtttgcaaagtatttcaaaatccttaacttccaacattgttctagagattgctgttgatagtgatcaatatatacctgtttctttttattattattatcatacattgaaaaagtctgagaggtaattgtaacggactgctttgaagttcagctgtaatttaccccaagattttagagtaacttgaagtaggacaacatctggtaagtagtcttctctgctttatatgaagtaaaattaaaaccagtcttagcctatactctattccatgttcaaatgtctaagaattattagaaactactcaagggtttcccccgaccacaatattcattacaaatcacggacctgtttgacaatgaagtatggtatctactagctctacgtaatattttaagtagaatggcaagttgttttgtgattttttttaaggagaaaaagggaaattatgctgaggcaatgttcactttttgaagaaaaatttaattgacctaaggcaatatttttactacatatacaaaataacaaacagatgctgactcattttgactggcttccagatgcagtgacccatgaggttaatactgaccatggtgatgttaactgtcctagtaaatagattcaagagatgccaatccactgggttctggttttctttattttatccaacttggaaaaccatgaacttttcaaaccaagttcctgaattggttacccttcccccacttctcccagtttccttatactccaacattatttgaaactgcttaaccctcaagaaaatatttgacttcaaaagatcactttacagacagagagagttctgtgaaatcttttctttctgaaaattcttggtataaatttaaggaaaattatatttttcatatcacctcttcattataaaattaaaatattctgtattttctgttatcttgaaggaatgtttcctggagagtttattcccactaaaaactgcttttaagtggtaatgagaacatggagtctttctgctactgtacatatacgtgcaagagggaggagacatactaaaaagcacaaaggcaaacttcagcccattcatgacttgcactcatatttggctcaatgttttccaaccatggtatacattttaatgaacaaggagactggatagaggattttggtggctgactaaacacaaaagacatagtgatttccaatgtatcaaggttgatcttttttaaataatctaatttctcaacagaaagagtgctgaaaaggatttaactaagcttaggtcacagaagtgtccataaggttctctcagcatatcttgtgttgactgtttgtaagaacatgcagcattcaagatactactactcagaataaatggcatcacctacctcttgctctctggtgaacatttgacttacaaaagcaatttacatatctcttcttttcagccatatacctagattttgagaattttattctcttagaattatagtttcctagatatagaaaaagattcattctatgactgaatttttaacacaattgtacctgccaaatgtagtggctcaaatctctgctcaaacaccttcacaaatagagagatcactcactccatcttgccaaaaattgcccaaaagttatttccttatattgaaatagaataggatttgcccgtagctttccttcattgaccttgttgcatttctggaacacatgcaaataaaaatctcaacttgcctgctgcttgagaatacttaatatctgaagaaaagtatctcgagccatctaaaccatcacttctattcaggctaaacatcctgtttcttctaatgtttgccatatgacatagttttccgacacttcatcagctgcttgcaggttttggaatatatttgcttctttgtattccttctaagatgtgatgtctgtatgtgctggatgatacagtgacacacagggccataacctcccttattctagataatgtgcttctgtttttcagcttaatacaacattgactttttggcagccacacttcgtgattgcgtcactttgtatcattgtcactcatgatgccacatagtcctgtttctcccactctaatcttataaacgcacatttagatcgaagtggctcttatttattcttgttaaatttcatcttgttgtattccatcaatcattaaagcttgccaaaattgttttttatctgtatgtgttgttcctcttcatgacatgtcaaccacttgtatgagtatcacccttccaaatccacagccaagtcatatgtcttcaggtgtttctaaagtcatgtagcaaatcacacatgctgattagttgcttgtgatttctgagaaataggattgctgaagaatcaggcttctgagaaaaaaaaatactctgcattttggcttttaatccagatccacaaagtgatgctgaaggcatcctgggatgaccagcaggcaccccgctacccctgaggttgagtgattctgggcatatcttcaaacctcaggggcttcaagggccaaattttcttattaagcattttatctcatatgaaagtgctgcagtgtattcagagatgttaacctcttcaaaggggttattttatctaacagtacacttttgaaagctaccggtagttgcctggagcaggtggtctccaaatgcagattcaaaatgcaatgttcctgtattaaatcaagtcagagttctgaaaatatagccttttatgcagaagatcttcaaacacagttgattgtctaagcaagttttactatagttaagctaaactaaaatgtgtcttacctttgcccaaacttcagctgggccatatgatgacatttagacatgctgaaatatgctctttttttctggttagtactgggatataaaatcttgaagacagcaatatcttgaagacagtgatcttgtcaagttatcaatgctttctagactgcaaaatcaatggtcaattctgtccccatcttacttgatttctcaataccagttaacacaattaaacactccctcctcctgaaaaactattttctcactaggcttatgggacaccacactcccttggttctcctcttatcttactggctactcttgcatcatttcctttacctctacttgtctaatgcccaaggacttacttcttggacctctcattttctctatatatactcattctcttggtgatctcatccagtcttgtggctctaaatatctaatatggtttggatgtatgccccctccaaatctcatgttgaaatgtgattcccaatgttgaaggtggggccgatggaaggtggtatatactaacaaatcccacattatcagaacatcctgcctgaacctctatatcaactgcccactagtcacttctgcttggatatccaaaaaggcatctcaaatttaatatggactcccacctcacccaaaaatcttttcctccagttttcttccgtatctctgcaaatagaaagtccatgcttccagttgcttaggcccaaagccttagagatgaacttgctccagaaaattctgttgtatctaccttcaaaatattttgaaaatctgaccacttttgaccactttcacattaccactgatccaagccattatcatttctctcttgagttgctacaataatgtagtataactttgggcttttgctcagatatcactttctcagagttcctccctgattgttctatttaaaattacaattccacccctccaaatcgccctattccctttctctacctgacattttatactaaaggatttctcaccatctgacatattatatagtttgcttccttgtctgtgtctggtgtctttcctccaactagaatgtaagcttgatgaggatgggaagttttcttcctactatgtcacccatattttacaatgtcagtttttatttttatacatctcaagagttttcttgaggtgatgcacatcaatagcattgccacagatgagcatcactaactcctctgaccacaggaaatgcagggtgggtttaatactcagctttgccccaagttctctgtttcctgtgcctttcctactcccaaccaggaccacagaaggaagggtccttctttttccttgttcaactgccttgcttcttatgtgagatgtcatcccaagagaagatttaatcatctaattcttgatttctgttgtcccaatttatgttatttacagactaaaaacctgaagtttagaaaggttatgtaactagcctaaatcacatgttaatagcagacctgggacaaatacattccaggctctaaaaaatttctttacaaagaataattaggtttaatgacatgtttgcttcagcatgcctctaagtagcaaagattatgactccctgcacagtccacttgcagagggttgcatgaagtgcccttgtccaaaaatttcttccaccaggttggagtatagtagtgtctgatataccaccattaaggcccatattttagggcagcaaaggggagattctttagtttatcagtgcagagatctttttggtctgttttgtgatcaatatgcctgaagtgtaaactacaaaccaaaatatagttattttagggttaaagtaaactcagaagtccagaaagaggccaaatcattattctatttaataaacctgtcctgaactttaaaagctatgtatgagtgtgtatgcttgtgtgcatgtgtgtgtgtgaaatgtataattttcgtcttccatcccttctgtcttttgagccttaagatgtttctttttttttctcctcctcctctattttgacattgaagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaaggtaatgattactcatacaaactaggtatatactgtatgctaaacttttactttattaaaaagataacttattaaaaccattctttgtatataaagatgatgttactgacccaccagtatagaataatatttcatctatattgttccaacaagactgtgaaatttacattgagccatagaaatgaggccttgatcttactggtatcaggatctatttaactaaccaaagtaacttcggctataggcttctctcaccctcacagcaatcaaattacttaggtataataatatttcaattcctaaactcctaatggcacaccagaggtttaactgaattaactctttttggatgatattgttaactttattttaaatgcccaactactattgttttgaacttttattaagtcagaaacaacaagagaaatctgagaggtaatttccttctggtagttgaaatcttccgaaatataatttctcaaagcccaagctttactttaaatattctatgtgctcttctaagagctgcttaaatacaagaacttgtcagctctgcatgacctttcaaaggaaaaaaaggaaacgcatttctgtgtgttgagcgtttgttgagctccaactatggccctacactaagcttggttctaaatatacacaaatgaattattgtaacatagttatggaacattttcaatgtactaggcactattttacatggattaatccacttagttctattgaaggactactgtggaaagcaagcattattgttgtcccaatttacattatttacagatgaagtaactgaagtttagaaaggttatgtaactagcctaaatcatatgttaatagtagacccaggacaaacacagttcatgctctaataaatttctttttaaatactttcattttgaatactttttgtgagcaaccttgtgagaactcaaataataatactatgtctctgattcagaggcagaccaatgtgggaagggcactcactgagttgggatccagaggacctaagtaccaagtttcactgtttcgcttctgtgtaggatcttgggcaactggaaacaccttctttttatcatctataaaaccaggagtaagaatcccttcctcaaatgataattagtgcatgtgaaaaagtgcctggtaatttgtaaattacagaggacactgctatacttgaaaaaccctccttgtgctatggatcaattttatatcttttctctctctctgccaccactctgcccttttagaaaggagttggtaatggcagtagtcatttttattctatttagttaacaatggatcttaaaagtttaaaatgtaaagatgcagggaaattagcattttaaaaaaacagatatgtggtttcaccgtcaacatttttctatttagttgccagtgctttttatacctttgatttcttttctgctcagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtaggtagagttcaaacctaccatctcaccagttaagttgcgacatttgagttgttccaagagcaaacacagaaaaagagtatagacaaagccagtttattaaattaatctatggttgtttcccctatgcgagtaggctaatactgactggcctcttgcctcatcctgcccttggtggctgtctggataggaaatggaggtcacagcaacactaaacctagatgcttaatcatttaaaactgatttcctgaaaaagaattaacaaggcaatatttgaatttccttccctcattactgggaacacagaataaatatgtgcatgttacgcattgccatttattaactatgaggcctcaggcaattcatgtgatctccatcatctaaagcttcctcacctgtaaaatagggagaacactttctacttcttcggtttctttgtgatgattctatgaccttatctgtaaataatcaaacatgttaggcactcaattaatgatatctatgagaatttccctcactgtgaaaagttttcctgtccatcttctgtactacaaaaaacaattttccaaatgttagcaatttgaatactatacagtattcacaattttgacatatccacccactaactatactgttatttatattctgtcttctcacctacttcaaataattcacagtccagttaatagccaaccctctaagtttgcactgaattctaatttcttccccttattcaaagattgtgctcctaaaacttttctctcacacaccagtatcaatttttccatcattacaaaaaatttcttttgacacttcctcactcctattcctaccagttaccatcccatttctctgccttaaagaatagggagtaaaaaaccctttaatgtgttgtccgcaatatgcttctgatattctcactccattctctcttttgctccatacagtcaggcccacacaccaccacctccctcctgaactctcttaacccagagattcacaggtcacctttgtcacttcattcaggtttctacacaaacatcctccaacttggctttatttttatttttatctcttattgttccttgatattttgttacatatgcattgatatatttgtctatcatctctttcatcatgagaatataagcttcacaaggcaagaaacttttctatgtggtttcttgctcataaatatttgtaaaataaataaattgatattattttcttcaaatttacttaatattttcacttaactgctgtggacattaagtacattatcagcttactataaaaaaaatacatgctggatgcagtgactgacacctataatcccagcactttaggaggcagaagtgggaggactgcttgagcccaagaatttgagtctgcagtaagctaggatcacaccactgcactatagcctgtgcaacaaaacaagaccctgtctcaaaaaaaaataaaaataaaaataaaaataaaaatactgcactaaaataatggaatggaactagaggatagtttggcttaaggtcagtagcaatgacatactatctagactgggccccgaagtaactgagaaaaagagaaaaatgaatttacttttatgtttctgtacttcaaaatcatattatttaaaagacctgtatgaaatacattacactgtatatacacttggggaagttctctagaaaaacgtatatacttttatgtttcatacttaagaaataggtaccacacatgtatagaaaacatgatgcgttggcataaataaggtaaattggtttttaatggggcactaaattttaaatgatactttttcattctacttctttaattattctaaaataatttcttaattattaattttactgttgatcttttgatagaaatactaaagttgttagtctcagctatgttctacctggtgtccgaattgttttgaatattttcacaggaaaaatgaataggatttctaaaaacagtggcagccccaaaacagtatgcacactgctctgcaatctacacatcaaacagtttaggagctggacaaacatgtgtcagaaggaagtgaagtgaacttttactgctacaacattgccaatagcaaaagactagtaagtccagctctgacacccccagaaagtcccagtagcattttttaagtatagcttatcttagtgtagagagaaaacgtaaataaataggtgtacaataggaattataaatcaattttctaattgacaggtatgaacccagaattcacttttactactctcataattttaattttatgtaatcttatgactctattatattttctttccaactaaaatatattgaaaagattaagtctaatggaacaagatactcttgagagtacagctgataaattgctctgagtttgcctttaggactttaatcatctctgtatcgtaccaagatttaaacatttacaactcaccttaaatacaggtgtgcttattatggtaaagttccccaaagaaaaggtgaagtacaaaagtgattaggtatatcgtggtttttacccagatcagaagacatgatttcagtgtgctcagcagagttagtaaatatatttatatagcattatagaccatagtcttcatttcagagttggagaattttggagattttttattttaacatttacttaaaaacatgtaatgaaacacttgttgctctttttttccctaaattcccaactccaaacctggttgaaacacacacacacacacacacacacacacacacacacacacacacacatagtaaaaaacaataagatcaaaggaattgatttatttaattaagtcaaataatacacttgaatgatacactgaaattttctcctgctgtggtttctaatcattatctcacttttcaggatacaggatggagttattttcatagagtattcatttaattatgtttactgagcacctactatacatcagggacacacaggcttaggcataaggatttagtgataacctagacacagaggatccttggtttcataaagcttatgtcctagtgcagaaagacagtgaaggaacaagtaaacaaataaacgtaattttaagtggtaatgggagctatgaagaaaattaagcatagacagtgaatgcagggaggcggtttttttaacttggatagtcagggaaaagcttctcagaggaggtgacatttgagcgatattaacactaagaaaagccaagtataagaagatctggggaaataatattcttggtataagtaacagcaagtataaaaggcctgcgctgggaacaagcttggtgtatcttcaatgaatggcaagaaattgtggctgtggcctgtgaatgaattggaattggagagttaatcaggggccagatcatgtagatgcttttttttttaacatggcaaaattttgtcatgaattttttttttttttgaagagagacggggtcttattatgttgcccaggatagtctcaaactgctgacttcaagctatccaccctcctcagcctcccagatagctgagattatacccacaactggctcagatcatgtacactcttgtggttatgtttagaatttaggatttcttttaaagatgataactaatggagcttgactaaggagtggttgttatattgatctgcagagcagtagaagcagggacactaagaagtaattagtcttaatgaaagatgatggtggttgggtgtagtgcctgataatgtattaatagtgttttcaggtcatttgctactgaaaagtgtgatacaataaaagtagataattggccactgcattgagtaacatggaggtcattcattgtaaccatgaaagtggttttagtgaagtgactgggacaaaagcttgagtggcatatataaaagagaaaaatgaggaataatagagtgagaccatggggatataaaattagtaagttttgctggtaaagaaaatagacaaaaaagcagcaggattgggggatgtcaggatactgtttcgtgtgtatttttattttttaagattaaagcaattacacatatttgtatattgatgggaaacaacaaaatggaaggggaaatgatgatgcaagaaagaaaaagaatgcatagaggaataatatgtttaaaaggtgaaaagcagtaggacccagtttataactggtagagttgaccttggtgggaatacagacaatacgtctattatagcaggatagaatgcagtgtggatccaaataatattaggtttacagatttgatggatatctgaggtagctctgttttttcaagaaaatattaggtgagatcataagctgagacagaattagatattttaagagacagaacaagttgtttgttaatcatcttatagaatggggaaaaaagtttttaatagagaaatgcaataggattgcccaaagtgctctgctcacatatagcatgagagcaattgatatggttgtatatgaaagtacttgggtgtagatacagaatttgcagcttgtcacataattggagttttaccaggtaagtaaatcagtcatttggaatgctacttttaactgcctactcatcagcttaatcagaagccagactccactgttaattttctgggtcaccatagctagatttgtgatttctttttgctcaatttatttatgtgtaaaatgaattatcaatgctttatttgtgggagcaaatgcaaaataaaaattggcatgcattaggatttcactggaaaagaaatgtatagttttggttttgctatcagaccatcccagtttgatattctggctttgttatttattaattacatgaccatgaacaaaattacttaaattctgtgagtctcaacttcttcttccataaaatggggataataataatacctgtattcaaaagtttgatattagaaataatataaaagcaactagcacagtatgtaacatgtatcaaatagtcaatatgcaatgttattaacacaatgatcattactattaataacggtaattaagcaaactatagatttaataaagttattgattattatcaccttctctcattaggtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcaggtgagcataaagtccatatgaagcttggtctttgaagctatactctgcatcactgttcttgtcaaattggaaagctctctcctcaaggtatacatatatactgtgctgaacagggtgacactggtagcttctgtcacaatttggtcatgttcagatgggatctcacttaccaggatattctacaggtcagaaaggtagtgtttaaatcagattttcagcaaaatattttctcagtcatctgtgtgaaaatatgtctcatgaactgtagccccagggtctaacagtttcaaggcctcgggaaacaaatgcatttacaataaatgcaaaagctgaaatgtagtattgttagggaaggcatgacttctattgctaaaataatgccttgagctatttcaggcaggtaaatactctaaaatcccgaaaacagtacattaaagtatacagctgactcttgaacaacgcaggggttagaggtgctgatgtgcagttgaaaatccacatttaacttttaactctcccaaaacataacaactatcagcctggttgaccacaaaccttaacaataacatagtcaattaacacatattttgtatgtcatattctgtcttcttactataaagcaagctagagaaaataaaatgttattaagaaaatcataggaaagaaaaaataaatttactattcattagtggaaattgatcatcaaagatctttatcttgattgtcttcatgttgattaggatgaagaggaagagaaggggttggttttgctgtctcagtggtggcagaggtgaaagaacatccacatataagtgaatccacaccattcaaacatgtgttgttcaagggtcaactgtaatttcaaaacagtggaattataattctcagacaaatataaaataaacatgttttaattattctgtcattaatgaggaaactagtaagatataaaaactaattcaaaggacaatctaaagaatatgtatacgtatatatacaaacaagaatgagtgaatgaatttattaataaatacaaaactgtttaatatcccatagggcaagaaaactagtatttgaagtcatcttcaatactgtgataatcatttgtatggctcactacagataaactaatttgcattttgacgaacaagattttcatattaatattgttttctacaacttacagaattgtaataaggcacagaccactgcaaaagtggataatcctggatagtcctttatgtaaacccagcagtgcattgaaagaatatgcagtgattttttttgcccatttcaaagtatttcacatttttctacaactacaaaagcagtattttagttcttgtaactacctccatttcaagctatataaacagagataagaaagactatttttcttctaagtcacattgcttcagtatttccatgtaagaagttattattgtttttacaacttacaccgctttaaatttactaaataattgagtcattatggggaggtgagagggttattattaacaagtaatacattccagaacttcggcaagaacacctggaatgggttggcagcctgtagacattacactaattcagaggtggtaccttaattgcatgaatctcctagcaaacataacatgtaggcatacctataagaagttgtacatctctccttaacagttactgttctgagcctgtgaaagcaaggcactgttgtaggtgctaagtgttcccaacaggtaacctgcctgtttaaaagcaagaagaattcaggatcaaatttagtatatttcactgtgaattttgataagtaaaataaacacataggccctagtaactacttctccagaatttttttctgcctaattcattaaagtcaagttctgaaagatgaaagccctcaaaaataccttctaatgagattcaggaattgtttattaaaaccaagatgtatacaaagcttcatatttgcattgctaattgacctctttcaaagctggttgacatttttggctcttttgaaaagtctttatgatatccttctttttaaagtagaattgattagctcttgcgggaagagacacacttagcatcatataagctagtctatccacattagctgcagcacacacaacagaacaaaattcaattcattttacacttcctgaatatttattagttatctgataccatgcacatacacagtgggtcaaagggcctaagcaacactattaaactctttaaatatcagtcccttcacattactagattttgtcttacagtgaagttccgcttagcttctaatacttgttccgccttttatgaggattctttaacatgtaaagctttgttgccatatcagagagccacactctgaattcacatgcagttaccatcgtgtgctatatacaaagctcctggacagcatttggcttgcattcttcgaagctatgaattattacatagggagcagcaagtcttggcagggcaactggagttcagctctgaaagccaatagagaaatcacatgagtgcttgggtagtagagtgctgtccttgcttcctggcctttatagagatgcaattttcctatggcctttattgatttattagcaaagcagcagcaaatctagttatagcaagttcttttccaacccaaaatttattgccaccccatggcatagatcttatctcacaaacgaaaactgtgtagaaatggaagatgtatagccatgcttgtcacagaaccctccagcaggagctttttactggagaaagtgattcttgcataatgcagcacaattaagcatttgtagctcctccagcctgagtacttaattagcttggcattgactacatacatgaatttatcagaaaacttttcttgaatgagatgaacaagatgaacagctgtggctcttgcttttatctctctagacagagcagattaccctcaacagtctgtgggaatgagaagacaaatctcacttgctacaatggaggcaactgcacagagttccagactgaattaaaatgtatgtgccggccaggttttactggagaatggtgagtcacattagagccttctggaagagaattctgagctaaagaatgatgggattactcaaagttcattttctcctctaattttttatctcagttcccataggaaaatctatgctgaaatagaggttcagacagaatgaaacaataaaaaagaagaaaaactacagtttaggtcaaaggggagaacattttattagacaaaacttcaaatagggaaaaatgatttttaaaaaatgtataatgtgctatttttctttcttataagtacttctgaattcatgtctcttttttgttgctaactctaatacatgatgcaaatatggttgctgtcgaggtaaaataaattacaactaaaagattgcctcatagaattgcctacaacccaaaagtatatataccttatccatatgagtctacttttcccagagaaactcttcaactgttcttcacctcatacaggaattcttaaaatggagttggtcaatggcttcaggcaatctgtgacctgctgaaaatacaggaaaattagaatatgtatttgagtggctaggggtaagttcaggggtagaaataatgcatactgaatagcttttatcagctgcttaaagggatttatgtccccaaaacagttatgaactggggctctatagaatacagatactatataagcagataattgttaaccttttgttttagcactgtgccatgcaccttacaaataccatctctaattcttatagctctgtaaagaaggtttcatgatttttattttgcatatgtgtaaactgaggctgagaggttgagtgacgtataaagggcctatccacacgtttgctgcagtaaggttgagctgccttcaaagcctctgctcttctatttgatgtgccagcataactgtatgaataaatctttgctcaacacaatttctttttttttaatgagaaaggtgttcttccatctcatgtatcatcgagggtaagataagtgatctctgatcaaacttcctacattgaaaaaattaaataaactgagctcagacatatttgacaaagatattttgactgactcaatatttcccataagcatagttaataaaataatggatatgtgagtgctccctggcaagtgccctttggattaattggaattttctgttttctagctggcctcttttgcatcacaaagacacaggtcttttgccatttttacaaaacagcggggagtctagggtatacctgaatttgacccttttaacgttcattttcatttgcagcctgccttctgtggttggttctttgtggtacaggcattccaagtctatatgtgcatgaaaggagatagccttgagtcacattctgctttctgttgcaccaattttggttctgcaacttattaactgagatcgtttagttgtattccaattccatgtatctttcaaaatattgcaaatattttcttgtcattaattttgagtaatccaactattgtcaagggtgggttgcttcctggttgaacgtcacactttctgcctaatggcacaatgcatggaactcatccaaaaccctggattatttttctctgccactcacacattgtttctatttacaacaaatatctccctgtcttctgatatttattagtttacaaaatttatatttgacatttaaattcagatatatttgaaatatagaaagaaaagaaagcttagagttttccttcttttcccaggagacttttcaactggaaaaacttacatgatgctagatatttctaaaacattgaacctgtgttcagtagattctatgctttcaaagtccttaaccatcattacttaattgactagatgttaatggatttatttttacttttcatgcattaattaacctctaataaaaatgccaatgatgctgataatacatgtgtatctattgttgactgtttagttcaacagagaaataggtgagaaagtgatggagtagttagaggaagacagaaaatagtgggctatctcccatggcctagggaaatgtgacttccatcacatccaaggatattgaaaagctatcctcaaataaattggcttctctcctgccttggttaaaccttcagcttaatagtgtcatcctggcaggttttgaatgatggatggtgtgaacactctggcccacccaagaccgagaatgcttggcaggctcctgagggttgtcaagttttgctcagatctaatcagagaagtctccctccagtccagaagcataagccaaaaaaggaaaacaaaatgtctcagctatgcttggtatccaaagggataaggagctgtttttcttggaagaaatctttgttttcctttataccttgggctggccttgccccactacctcaccccctttcattttgagcctagtgattagtctctgacccatacgtgcaagttttacattttggaaggtgagggaaagaataagggaaaattaaaaattgtttacatacaatttcaacattataagctgcactatagagatcttggagctaagattttatataaattttcaaaagtaaaatagccgccttagttgctgttctatcccaaggtcttagcagagtgtttgtcacatagtatgtgttaaataaatatccactgtgtgactgaatacatgattggtgacttaatccatgaatatacagaaaaacaaattcttgctggaaaattagtttaaaaaaatgacaatatcccaggaagaagaaaacttcaatttacctgagacttgatgtcacttgtcttggaaaatttggcttttgaaagtcattctacctcaacatttcagaaattatgcttggctattggaacacagatttattagcaagtacaatcttctaattattgatttttgcttttgttataaaaaaaggatttccacagaaaataattcaaaatctctcagaataaacctctcctcttcctcctcctcctccttccctccttcttttttttttttttttttttttttggtttctctttggtgggctttttccttagcctgagggctctgatgcatgaggatcctgatagcctgaatgtaggtctgccctgcagactccagatggcaaaatacagcctctctccttgtgcccctaataaactgaacatttatataaggtggcaaccacactaatgctcttgagcattgacactggtgtaggcatggcccacttttctcttggtttctaaatatttgcatctattttctcattctaattaattccgtgtgtatatgtatatatatgtgtacagattatttccattaaaccccaaatgtgttaaagaaattttaagaaacatctccgacattatcaagtatgtataaagtatgtgtggatgggtagataagactgtgctgttccagagagataaggcaaactttttcttcccatttcacaaccaatgtattcaacagggacctgggtttctgctgttctgtttattttgaaggtgtgaaaaggacattgatgagtgtgcctctgatccgtgtgtcaatggaggtctgtgccaggacttactcaacaaattccagtgcctctgtgatgttgcctttgctggcgagcgctgcgaggtggacgtaagcagcctctccttttatgtctctctcttattctggcagaatctttttcagcttctttcttacctcattttgcgtatgaatgacgagccagttgttgagtggggtgaacaggaagattattaacatacatttgaacattcccaaatgaaaaaaaaagccattgaatttcaagaaatgccttgattcattttagatctctggggaagaaaaaggaaataaaaaccatctcaataattaaggtaaattcaaggcttattttaaacatatcagaagcactttgtctgtgtataaaatattttcctattctaactttaaatatgaaaaaagtgttcttaatataactagaaatatctccttattgtgtgtatttagtacaaacatattatcattctcaacacttctatatgtgaatgaccactgcaatttcttcccactccatttctgggtattttcacattttaagttgccctccatcactatgattctattttcatttctgttctttcattcttatctattatttatgacacaaaaattgagaattacaggccaggtgtggtggttcactcctataatcccagcactatgggaggctgaagtgggcggaacacctgaggccaggagtttgagaccagcctagccaacgtggtgaaaacctgtctctactaaaaatacaaaagtaactgggagtggtggcacatgcctgtaatcccagctactcaggagggtgaagcaggagacttgcttgaacccaggaggcggccgttgcaatgagccaagattgtgccactgcactccagcctgggcgacaggtgagattctgtctaaaaaaaaaaaaaaaaaaagagagaattaccgattaaaattactgattatattcatctatgtttttacatgaagctattcaaatgaattgttacgttttctctgatatatgattaaatatataaagagaaatcaggaatttacatcgagtccctaaattgtagaaaaacaattatctagtatcagtactcaaattatacctccctggtataatttctgattccataaaactgtctctctaacaaagttacaaataatcctttctctatttcctttcctgcaatactttcccttttcctaacaaatagaacaatttttctgttgtttctaaatttatgagctccttgacttttctatcaaatggactaatttcagttgcttttcaatgaatatttaataaaaataagcactgtagtttatacataaatttaaaagtatatattgtaaaacttgaattttcttagaagcatggttttctaagatttgcaagtaaatttattttcttaagtatctttcagaaaaaaatatgaaagcatagtatacatcataaccaaaatatatttgacattatgattttttaaaataaatgtatacctgaaataatggatctataaagtatactaagatatgcaaaaattaatatattctttattataaatatttcagagattataaaataataatttaaaaaaactttcttaatgtttttattgtttccaccagtacgttatcatttatgctaaatatctttgtgtagatatacccttccaaagaagacgttatttgtgttcatttaaaggaaaaatagtttgatcctatgaattaattcagaaagcaactaaaataacaatggcctgccaaatgtcattttgtaaatatacgtctatgactttaggagctgtcctggtttgaaaacatgaggacagtttatccattggatgccatctatttagtcccaattaagaaagttgtttttttgtgagaatgaccaaggtaaatttaaatataccattcaaacaaacaaggacaaaataatatccttgttatagagtacatgtagcatatagtatgaagtaatatactacaaaagcaaagaaagtgtattctatcttgcaatagtaatagacaatttttatatagcaaattcatatcctttggagtagtgacaatcatttcaaactgggagcaactaattgtgaagattttccttcttactcatccattttcttcacatccaaggctgaacgtgtgatgctgctgcttcagatgatttgttccaaagttaaattttgtgacaaaagacatggggaaaaccttcccatcaatatttacattcacaagtatttgcaataagcataaaatagattatagccagaccatatgtatagttttcacatttactcccttctagacatacctgtacttatgtacttacaggctgttccaaatgtaatatgttctctaccaaatgtggttaagaaatattcactcacaatttctttctgtgtacaattctgatgcctctgttgtcactgtaattgtcagttgcttttctgttttccaaatgtcttcttgtcataaggtatctgactttaaaaaatgttttcccttttctttttattcttctgtattttccagctgcatgtgtgtgactatggcttttacatatttgcacagaaaaataaaacctttgtttctgtatcttctctttctcatcttctaatggtacttgtacttgtttgccttgactatgtcttgtatgataaaatttccaccagccatgcatacacacacacacacacacacacacacaccacagaagtactggtactgatcttcctgaatcgtgatctctttctgtgaaagtgtcactgtgagtaaacactgtggtatccaagtaaagttgcatgtactctggcaagtaatcctctagttggcattctaaagttgattacaaccctaattgttcttattattggtttacattgtccctgccaaagctagccatagttcaacctggttctaaagaggggctgttttacctaaatgacagaaatttacactaactcctctggaccaagcttctaaaacatagcctatatttacttgaataaaaactaattccattttgctgcgtttttcagatttaacattaaactaaacagggctatgtctctatgtttggccatgcctccttttttgtgtgcgtacgtggcaagtgggtttttatcaccctcccttttgcaaaataggaaaatagagagaataggcaaatttggaaaaatcagtgtttgaggaggagagacaactaagttcaattaacaccactgaggacttactctatgccaggaactgtgataagcctttttaaatactttatcttttcaattatcttttttcaatacaaggtcaaccaaaatctttttatcttccaaattcttcactaaattttcttaaaatatcttttggccatttgtaggtttaaaaatagaaactgttaagctttaattttgcaatattaaaattaaacttcttctgcaaatggtgctgcataaaatttgagtttagtgagttaggcaggaaatcagtgaagaaatctgtttctcaactgccagtattattactaatataaactattttacttctctgcttttgtacttattcaacaaatgtttaatgtatgtctactatttgccatactgtatactaggtcctgggaatagaactatgatttagacacaatgcttgctcaaaataagctgaagttatggtaaggaatgtgggttagactgggtgtggtggctcacacctgtaatcccagcactttgggaagccgaggtgggtggatgacctgcagtcaggagttcaagatcagcctgacaaacatggtgaaaccttgtctatactaaaaatacaaaaattagctgggcatggtggcgcatgcctgtaatcccagccactcaggaggccgaggaaggagaatcactttaacccgggaggtggaggttgcagtgagctgagatcacaccattacactccagcctgggtgacagagtgagactttgtctcaaaaaaaaaaaaatgtgattaaacaaatagtcttaggatgtaactaggatgtaactgagtgccagctgtaagggagcatataagagaggcattttgtccagtcttacaggtgggtatagaaggtcaaggaaagtttcctgaagcctaagctaagacttgagggagttaggctgtggaagaagcaatggcacagtactgtgtgtttcaggcagaaggggctggagaggttgtgcactgtgacagggatatcacagggtggcagtgctgaaagatggggctgtcgaaagaagcaggagtaagcccttatacaccttggcagaggccttggtttttcatcataagagaaatggagaatccttgaagggtttcaaacaagaaaaatgtcatgattatacttgcactttagaaagatcacttgggcttctacatagagaatggcttaaaagaaaggcaagactggacccagaaagacacagctaggaggctgctgcagtgataaagaaagaaggagaatttgcactaccatatatagttgtagagaagatagattttaaaagtttgaagcatgattttttgggagaagctgtgggtctaagggggtgataacttaaatttggtggataatatttttaatatctttgttgattggataaatgaatgaatttaagatctgttggatatctaaatacagttattaatcagtgtgcatattccattctggagttcaagaggcatatcagggtgtatatatttgggatatatattatagatctattgagtgttatattccattctttgtatatgtaatccatttgtattatttatttattgttctgcaacaatattacttcaaacttggcaacttaaaacaacacacatttattatctcacagtttctgtgttcaggagcccaggcatggcttaactaggtcctctgctcagggtctcacaagacagcattcaaggtgtcagccagagatgtggtctcatctgagctgaaccagggagggatccacttccagagtgaactcagtgatcaagttcactgaggctgatggcagaggtagccttcgattcctgaaggcagccctcagctccttgccacttggggctccccaacatggttgcttacttcctcaaagccaaaaaaggagggagagatgccagcaagatggatgttaccattttatataacataattatgcaattgtgtacatataatcgcatacttctcctcacctttgtcatagtctgttggttaagaacaagtcacaggttctatctacactgaaagcgagaggggcacacaaggtgtaaacaccaggaggtggggaccaaccatggggggttcacttaaaagggtgtctgccagctggttgcagtggctcacatctgtaatcccagcattttgggaggcctatgcagtaagatcacttgagtctaggatttccaggccagctaggaagcatggtaaaatcccctttctgacaaaaaaaaagaaaagaaaaaatacaaaaattagtttggcatgtgcctgtagtcccagctactaaggaggctgaggctaggtgggaagatcacctgagcctgggaagtcgaggctgccatgagccatgatggcaccactgcactccagcctgggcaacagagcaagaacctgtctcaaaaaaaaaaaaaaaaaaaaaagtctgtctgccaaaccttctctcacagtatctttttttactgtctgtgctgtattctgcatatattccctattgctatcttccaagcactgatagtccacatataatccactgatagatttttcaattttaaattactttaaaaaattctgacttttttaaatcttacaaatcaatcttttctcctgtttgtgtcctgtttttttttctctataattgctaccttcattttactttcacataattaggaacttatttaatagtgtctttcagactgttgtgttatttcaagctcttggagtgctcaccctcctatttttgtttctggggaattttactcacaacagagtttttcttcatgtggtttgttatttttttatgagcaaaaacaactttaagaggatttttctttttcctggggggtctttgtgtgctgagttgcgtaaatgcccctgactacagtcttagctttagatttttgctaggatgccaggagttccactggtctagtgcctgtttttgtgctcttagtttggggattcccacaacatctggatagtgtaaatttggtctccatatacaatttgggttcaagccctttataaatgtgacacaaactgtctccaacttcatttcttacctgtgctctcacaaactccactctccagccacatgaaactttgcacctccctttgaacttttcacagctgccacagctcttcccttacgtgctgttcctcccacctaacctgtcattcccttcttctctgtttgacatacttttgtccttccagaaatttcagatcttgtatagactcttctaggatcctttccctgattgccccaggaaaagcttactattttattcctgcacttttttgctattttgtacttctttttctagtgcttattatttggtaattatctatgcatgtacacacaaaaacagcatccaataataaactgctcaaggccagaggccatctaacatatctaactcagctctacaaatgtctgtaaaagaatgatcactttacagtaacatggagatcttgagaagaaattatattgcttccttattttaatatttttattttaatgaggataaatgcatagtgtagctagaataaaatttatcatgatacacttatagctaagtgagaaactgcaggctatttaagaatacaaattcatagtggtatttacaacaatgtcaaaagaatagcaactatgtcagtgtgcatttttattttcccttagttgtaacatcatagttatgacagctgctttaaaatccttttcagttaattccaacacctaggtcattttgtgattggtcaccatttattgaatttccttttgtatataagtttcatttttctgtttctttatccagtaattttggattgcatcctggtcattgtagcttatacaatgcagagattatgaatgaattcttttatgtttttcagaaaaatattattattattttattttattttatatttttgagatggagtctcgcactgtcgcccaggctggagtgcagtggcgcaatctcggctcactgcaagctccgcctgccgggttcatgccattctcctgcctcagcctctcaagtaggtgggattacaggcgccggccaccacgcccggctaattttttgtatttttagtagagacgggatttcaccgtgttagccaggatggtctcgatctcctgacctcgtgatccgcccgcctcggcctcccaaagtgctggaattacaagcgtgagccaccacgcctggcccagaaaaatattattttattttggcaggcagtctcttagctgaatcaaacttctagtcctgtagcagtgccctctgtggtgtgtcacagctgcaatctctgctcagttattttgtctttagctgggtgacttggagtgtacgctacatgggcatattacaagggtgaaccagagatttgagcagaaatcattttcagaagttgaggctccacctctgtagctgtctcctttctagaatttttccttcactttctagctgctgtggtgaaccctcttttctctggttcttcaagcctgtaagattgcaaacgtctctcctagttttagttaactggcatggtgctgagcagagactgcactccaaaaaaataaaaatcacatagtgccctccgctctgcttagttcaaattctcatacaggtcgatgcatacttttggttattatctgagtgccctcagattgttgttttttgctattccatctggattttattgctgttatatgccgaagggttactctagtagaagctactttgtccacagaagtggaaactgtaattttaagaaggtaatctgagattgtaatcgcataggtatttggtcccagaacaagatacatggttttccttctgatttctgcactgaccacatcaattcagaagcgcaggttttacttctgggcactacattccggggaaaacattgatgaatgccagggcctagaaaagggcattttagcttattttagcaggtttgttacataggtatattgtgtgatgcgtgatgctgaagtttggcatatgaatgatcctgtcaccaggtagtgagcatagtaacccaacagttagttttttttgtaaacattataaggataaacggatattttgtctagaaagggaagacttaaggaaagcatgaaactgccttcacatatttgaaacgttatcatgagaatggaaaaatagatttgttctatattaatacagaaagcataggccgggcgcggtggctcatgcctgtaatcccagcactttgggaggccgaggtgggcggatcacgaggtcaagagatcgagaccatcctggctaacatggtgaaaccccgtctctactaaaaatacaaaaaaaaaaaaaaaaaaaaaaaaaattagctgggcgtggtggccagcgcctgtagtcccagctacttgggaggctgaggcaggagaatggcgtgaacccggggggcggagcttgcggtgagctgagatcgtgccactgcactccagcctggaagacagcgagactccgtcccaaaaaaaaaaaaaaaaaaaaaaaagaaagcataaataagacaaagggatagaatttattgaaagaagatttcaagtcagcataagaggaagcaagttaacattagaagtactcaataatgtaatgcattgatttgcaccaaacaggactcccatccctggaaacattccaatagaatctgaatgaccgtatttcagaaatagtgtagagaatacttaagcactgattgaaagagagacatggacctgacatttcttaagcatctgtgattagctgattagcacaattcatgcattttctatgtataacatttctcaagattatggcatagattactcatgataacaaaattatgggccaggtggaaaaatgacatttgcgaattttagttgagcaaagtgtagtacacagggctaaataattggccgagatcacctgatactttggagaaagggaggactgggaatgattcatctagatttttcaggtcattaatacgttggaccatgttatagtaaagaaatgtttgagaatgagacatttccctaagaatgtgatatttttaaatgcattgatttattatgctgctttctctgaaactgaacctaacactgtcgattctgccccattcagagcaaggatgggctgggcctggatgtttgccatgtgcttcatatacacttacaggattttctgagcaaacttagaggtctacattgcttcatcctcaatcatttccaaacaagatctgaaacagaatcgaggcatatagccagacaatagcaagagagcaattgggaaagtttgtttaaattgcgcttttcttcttaatgtcatatggtaaaatactaacattagaaaaacattccattataaattgtaggatgtcccttataggaagattaagtgaatgctatttccaccactacatatgccactgaaacattagattgaatcatatgaacttgcaaatatttgacattttgactgataaaaatgacaatttaatacggttaaactgactccataatagatgcctgatatttgcaaggatgcttcttctaaagtttaggttgttaatgcagaagggagaattaaagagttaaaaaggatttcgggaatcatctaatccaacttctttatgtatgagatgaagaatctaaagctcagagagagagagtgctttatttagactctacaagtatcccggtctgtcaacccacagttcaatattcttcctgctgttctaagacgacgaaggaaattccctatcccatttgccagagagattgtgaatgagagtctcagagtactctaggccactgcagagtccctgcatacgtgacctattttaaagctacaaatttataaaacccaatcaacatcagcactgcattcatcaaaatgtagtcttagtctaatgatattaaaagtactttaaagaaatatgatgacgaatatcaattgtcattatataggcctaggatcttagaggatgtaggagacaaggctgagtctggcttgatttcgtgatggaaaaatgaaagcatgtatgagatgaagggaccttacatatcaattttagtaataaatattcacagaaaccttatgggataaatattataatgcccatcttatagacgggggaaataagatttagaagggctagttacctgccccagggccacacaacaaatagggatcagagcaaggtttagaacctgggagtacttacttccaagccacaggtcttcctaggatgcagcactatctttagtaacaaaccctgtaagttgattcctaaataagttacacatatgtagaaatggttcagccactataaaaacctgtatgaagtttccccaaaaaattaaaaatagaactatcatataatttgttaactgtcatatgattcatgattctgagtatatatacaaaataattgaaatcaggatttcaaagacatatctgcattcccatattcatttcagcattattcataatagccaatagatggaaacaggctacatgttcagcgaaggataaatgaataaagaaaataaaaatggaatattattcagccttaaaaagaacaaaattctgacacatgctgcaataggaatgaaccagaagtacattatgctaagtgaaattacccaattatagaaggacaaatattgtttgagttcacttatatgagatatctagaagagtcaaactcctagaagcagagggtagaattatgagtgctaggagctagggggaagtggaaatggggagatgtcattaaataagtatgtgtgtatacttgtgtatatatatatatataattaaattagtatataagtatatatatttatatataataagtatatataattaaattagtataattaaattaatatacataattaaattatatataattaaattatataacatacttatatactaatttagcatacttacaagtatagtagtatactaattataaatatattggtatataaatatatacattaaataactgtgtgtgtatatatatgtgtatatatatgtgtgtgtgtgtatatatatatatatagagagagagacagagagagagagagagagggagagggagagagagagagagagagagacaaggtcttgctctgttgcccaggctagagtccaggggtgtgatcacaactcattgcagcctcaaacttctaggttcaggcaatactccttcctcagcctcctgagtagctgggactacagccatgtgccaccacacctggctaattttcttcttctacttcctcttcttcttattattattattatattattaatatattaataataatatattgttaattattaattattaatatattatcaatattattattaatatatattaatattattaataatatatattattaatattattatattattaatatatattattgatattattatattattaataatatatattattgatattattatattattaataatatatattattgatattattatattattatttgtagagatgaggtctcactcatgttgccgaggctggtctcaagctcccaggctcaagcaatcctcctgccctggcctcccaaagtgctgggattacaggcatgagccactctacccagtggtataaaattttaattatacaagatgaataagttttaaagaacagctgtacaacaattgtgcctacagataataatactgtactgtgcacttgaaatcttgttagcagaatcttatgtaaaatgatcttaccacaattttttaaaaagttacttacttaagacagaatttaaaatacttcaaatggaggaaaaataaataaaataagaaattgttcataaatgttattttgatgcattatcaagcaccaaaattaggtctaatttggttcactaatctcttttcctttcatcttttcatacattattaagatttctgcttcaccaagtataattaatgttcttcatttcttaacgtgaggtcattgctgcaggcttcacggaaatcatgcaacataggtttttcccgtcagaacacattttttcatgtgttctgaatagaatggaaacaggcaacatacagagtggagctcctggattatagatgcaaccaactaaattggttggtttgttaagccatagacaactgtgggaaataactaggttgatgtttgctactgagttgactagctaaccaaatcatgcagcatttttgttagctgtcaaatcaatctcatcatctactaaaatctccctaaaatgatcactgccttggtacgatactggacttacggaaaccggtttttaaaataatgcatttattcattcatccaccatttatcaaaggcctttttcaggcaaagctctgagctaggcatggtaagcaactaaaatatacacaaaaaagtgtgtttgtgctttcaaagaacttaggtaagaaaatcaggtacatagcttcgtacataagagttctctaatttcgtgaatcataaagatatttttaatgtgtctataatgacatatgttggttatgacaaggttggccatattatttcttgtccaatttggagcattttcaaagtgaaagagagcaacactattaataattattctaggacagcagcctaaactgatactgttctgggcaaactaggacatatcctagttattacccacccaggagaatgcattatgttttacttgattctctttaaaatgccattgacatctatcacagatcattcagaaatcaagtctacatgttccaaaccaattaactgacaaaaataactcaaacaataaagttgacagcatcgtgttagttaccaattttcttgaattattttccttattttttgctcaaggagaacttttggcatcagttccatctatgaaaaatagagctgtcaaccaaaccgaaaactgccagtatgcacccagataccatgccgttgtcttgtttaacatgacatgaatttagtttctactaatttttaattttaagaatggtgtgtatacatttttttcttttataacttacattgcctttaggaaatgcagttgcacctcattgaattcattgctaaattttttcttgtgagaacaaattgaatagcatgtagaagactgtaggaatttactatctgaacaattttaaataccaagataattgacttgaaattggcaattgctttaatattgtttctacttaaaacttccatgaatcataatacttattcatggattatatgtgtataattttcctaaatttctttaaattaaaaatgatttttcatcctaaaaggttataaagatcatggctgttatatttttctcacaattgtaattactgaaacacaggtttgtttcatgtaaaccgtagaaatattttggagactaattatagacagaaaggaagccacatattaaatataatatccaaaaccaaataggctatttgcaatgaaagttatttgatgttttggaaattatattcatgattatttcattgtctatttgaatgtattttaatttagtttcacaaatagctacaaatatgttacttttatccacttcccttaacatttctttgataatcctatgctgataacaacagttataaaggaaaactgaagtacttctatatttgttatttaaagtgggaaaatatgtattaatgactgataaatggctgaaattactctagttgatacctagaactcaggaaaaaaattatattttgaaaccagttcatttccttgactttttcagtagccagcatcatcctgagtaagtatatactcaataaatattacctaagtgattgagataatgaatgaggtatttttgaggtaattttgaagtgtcaatttccagctttgagaattttgtttttgtgtgtgtgaatgtttttattcatcctgccccatagttactgaaattaagatgaaaatgatagtatatagtaagtacaaaattgtcccatttccctttcaaatttacaggatgaaaaaggcaaggcttgaccattagtcaccactttgttgatgacagtgtcttggagacaagtgagccacactgtccattaggaaaacatttccatctaagaacccaatgcacagaaaccccattattcatcttgaattagaatttgatataaatttaccctttcccgaaccaatcccagatgcagtcaagatccataaagacatatattgcttaccatgcctagctcagagctttgcctgaaaaaggcccttgataaatggtggatgaatgaataaatgtattattttaaaaaccggtttctgtaagtccataatcacatggacacagccaaggacactctcaaggcagtcctgcaggttatactcaatttgcttaaaaatcgtagtggtttgagaggaggagtggattttctcttcaaagtaagataagtatggttgaattgtagaaaatcatgtccttttcttccatttgctctaaagccagtaagagttgaccactgctgcaatattgaaaagacattttaaagaatatgttgctcattgttcttcgaccctaaaaccctcatttcattctcctttgcctagtcaaatacatttgttctcataatgttccagtaaagatttccttgcttccctcccccacacaatcagcatttggagtgtcttgttgccatacaatcctaagtacgcctctatcatagcatcgtataataatactaatagtggctaatatttgtcgtgtgcttactctgagcccgaaactatgctcaggtcattataagcattattttatttattattcacaaaatcccaagagttaagtaatattattttcctcattttattgatgagaactcaaaatcagagagaggataagtatcttttccaaggctctccaattcagaagttggagccacgctttcagatcccggagcatctgcatctattaccaattagctatactgcaaaagccttcatttgtctgcctcatcctccatcctgagagctataggaaggtggagaaaatgtcttgtttatctttataacttcagtacctggcaatcattcctggcagagtagtgcttcactatttaccaaaggactaaatgaacgaatgaaagaattgtatgtggtgtgcacagaagaaattagaacattcccagggctggcggtagggtagaaaaagcttcgtgcagaagatatttgatccagctcttaaagaataagcaagcattatctcagaagaacaaaaagcacatttctccttgacatgtttttttgtattgttgattgtttatttgctaccaaagtgttaatttttaatttaaacagtttttcactggagaaattagttcacaaataagttgtatacctgtcagcaaagagagcttagaatgtcagaatgcccatgtttttattgatagtgtaagtgccacactgtgtttataattatcccttgcttttgttgattattagttcttcttaacataactgcattttaaatttgtgagagtagaaaagggaaattctggaaaacaaccattaaagccataaccttcctcagggatcaccgaacgagggttatagacaaaagggaagaaaggaaacttaaggcactggtcccaaaagataatcaacgtcaacacacatttttgaaggggccctaagcaatgagagcagaaatatgccaaggaaaaatgggtggtaccagaagaaaaggaggatccaggaaagagctagtagagtttacaagtagaaggagccctacagcagccacaggagtttagggacatggatgaagatttctgcatttgccccaaaagtgccattaagaacactaaagcttatctttttttttacaaatctagttgtcagaaaagccttacaacaaattttctaaatgttctcttctttccaaattcagttgagcctgaagggtttatgctgtccactcccacctattcattgccaattcatcttccctataagccaccttcatctgcaataactgctccccacaggataagctgacattctgggcttctaggcaggaaatccaatgttctgtcctttcataagtcccatggcaatgcagagagctgctggagtcagtgccttccacatattctctacagctgaaagaatgcaagcatcttcccaaagtcaccattccatccacacgtttgtttcttcaatacatctggcaatgggtagtacacagggagagaagaaggagagcagggaatctgtaaaagataacatataattcttatgacaatactttcaaggaaactataatctagctgtcaagaaaaaagaaactacaaaacatcctgaaaacaattaatccctaatttatgttactgagtaaaagcacagtataaattcacagaagtctgatcgctatgagctattgcaagagggaaagttttcatggaggatacggaaattaaagtaggccatgacatatgagaaagattatttatagaacagaaaatgggagcacattcaagagagaaaaatgtcgcaagtaaagatgtgatagtgggaaaaaaaagtttggatgggatgaagaacagagactaggtaggcctgattttaatagataaagaatgtcaggaaatagtaggatatagaagtggataaattaagagaaagattagatgatggattccctcgaccaaactttggtaaaaatccagccagagaagaaagaatcattctataattctgtgatttaggtatatgccatgttttcttctcaaatgtttcctacaggttttgattatgtatggctacaattcactttctgactagaaaggacctactttactctgtttggactgctgtaacaaaatgccattgactgggtaacttttaaacaacagaagggtattagtactggaggctgggaacttcaagaccaactaaccagcagatttagtgtctggtgaggaaccacccatttcctggttcgtaaatggtctcttctctctgtgtcctcacatgacaaaggaacaaggcagttctccaggacctcttttataaggtcaccaatcccattcatgaaggctctaccctcatgacctaattggccccatcttctaatacggtgacattggcgattaggtttcagtgaatgaaatctgggaggacataaacattcagaccatggcaggatcttacaccaaaatggtagcatctttccttcatgatggatttatcaataaaaactcctgaattatattctcagacgaattctttcattttggaactcaaagcaatacaaactgtttattcttccagaattttttaaaatatataatgttatgtagacagaaagtttttcctgagcagatttttttgggagtttggtttttgaaactagcttattaaatccacaaaatcttcagtccaatttttgatttctgctaattagaagttttcactaggcatagttttgttagtaagtcttgctttaagcccccctcttttttttttttttttttttttacttcacttgaatctttctaaagttcttaattgaggattttaattgaaggtttttagacctatgatgctctcctatttctctcaaagggccaaagacatgttttgttctggggaggttcagatatgatcagattaagtcttctttcactaaaaattgagcaaattccctggatcagcatcactaaaaaagagtctctggggcaatagactgatgttattactcaccattttaatgtacataaaattaaggaactatatttactcacttcagaaaatttctaagttgtgcagatcaatataaaaggtgccttatactgagcagtggttggtttgaacatttctgtgattagtgcaatctattttcagagctaaggaagccagaagattaaaaaagcagacccttcactacctgaggggagttaacagtctagtgcacaagaaagcttgcatcagatgaccaggattcttacggtgcctctttcagccaagggttgtgccttctctgatattaggccataatgatcacatgcactcaacatgcaatgcctcatttagttctaaccatcatagtactgttatttccactttacagatgctgaaacgaaggcccaaagaagtgaagtgacttacttggggtcacacagttcatttaacctcaaatcctcatttttttctccagtgtataattttggttttctgtttcctagtttgtgaagtgcaacatttggagactgtttttaagcagactgtcctaccagaaaattctagaagtcttaatatttcttaattgtaaaataagtgttttagaagagatgccattacacatagtttacaaaaacacaagtttatcatgggaccaactgtgtccagggaactctggaatttcttaaagaacaggtctaggggcaaatatggaatgtaaatgggaaagaaattgtaaattttgctctacggccctaataggatccagaatctatttgtttttaccattaggtcctgtgaacactaaagataatcacagctggcaatatgtaaattatccatatttgcagcttcttgaagttaaaggttgtgtgtgtttggctggtataactgcattgccacttaattaccaatataaatgctctcaaattatagataccaatgtaagcccctcaacttaaagatttatttgcagaactctaagtaatgacattgagcttcacattcacattgtgaggtgagctgaagaggatcagcttctgtgtgtaattgtgcatgattagtcttctgccttgaaacagaaaaggagtatttcataggattcccaccatggctggggaggacaggccgtggctggggaagacagaggactactctgatggagaaaatgcacacctttgtaaagaggcactctgggatggaaagagcctggggtgggttatgagagccatgaaggtgatgcacatgtgcataaagggaaagcatttgagtggctgcctcttcaaattaaatattctgtgacagaagagtaggctgcatcctgtgtgttagctctcatggcactgcaagctagagagacgtataacaagaaccatcatcactggtcaatttccttttaaagacctgtccactgatttactcattccattgatcagacattgcaattcacaagctcctattacattctcttggttaaaagtgaggtccagattgggctcgacacatgaatctgtagagctttcccctctacctggcaaacaatccaagtcgcacctggatatatcagaccttactcatcatttatgtccaggagtgctgcatttgttttacaatgccatctaatttgtcagctcagttcaaaaaaatttcagcacctgcaaaacatcatgaactctgaagttgacaggaaaagatggcatgttgtttgaatagttttctcaagatagaaatgtatgagtcttgaaattgtacataaagacaaaagcacagcatgccatgaattgcaggaactcatcgcggaggacatgcctattagaatttatgctacacaaatgcaaaagtatgttcttataaattaaatagtttgacttttccacattttatacacatgtaatgttgtcgttcttgattttgtacatgatagtgtagaataagctttttgccttagactttttataggcagaaatgtgccactgcaatgaaaaaacttaggagcattttatggatgactgtattaccatcctcatcaattggcatttattgaattcaggcaccataaataatactgatatatcttacatatagtggaatatgtgtgtatgttttaataaatgatttaaattattttcaggccatttttacattaatctataaggaaatataagctcctttaaaatggttttgaaacttagtgtctcaaaaggagtacaaaaacaactccgaagttcccctatgcttctggaaacattaaatcctcttggcaatgggtgacatgtgaaaggactccctcagtttgccctgaaatactccctttggtcctaaaaacattacgcactcctttagggagttcgaggcaaaggagccagtgtgttttgagggacaaggtataaatgctacggcatccaagaggattagctgccttttctggaaaattaggaaattgatgtataatttttaattacacataaatttcaaactttccatcaaagtcaaattgtgctgatgtagtcaaacgtaatctaagcattgattcaagaacctgctgatggagtgaaaatacatggaaacttgttaacaggaattacaattatctacatctcagcaaataacgccagagtgtcatgtaatatgctgagctcaggcagcctatagccaatgcagatcttttttttttttcttcaccattaatatttacagttggaagcaaaacatggctgcaatctaagtgctgcacctaacaaggaagttgttggcttgataccttgtttcctgacactgtgaagcactgaaacagctaccttcttaatcatcgcctgatgatattgtgttgaaactggaggggagcacatggctgttttataagagccacaaccctgggagattttcttcattgtttagttgttttacttcttgatagacatactgggatgttaaaagcataggactgaaaattgtgcattatggagttttttctttgttctcctgctgaatttttctaggtctatgcagacactgtttgtaaagacagtttacctcctgacacctgctgtgtgctaggcaccttcctagaactgaaaacaaaacccttccacccatcagcctactttattgtagttattctcacatgcaaagtccaaaaaaaacaaaacacacacacactaagcaaacatcagtaatcagagaagcatgattggttacataagcactgtgcatagtaagagacctgaaatataaaataaccatttttactcttctttcagtctgcagatatgccaactaagggtaatacagttgaaattatggggtagatttggggttacatttatatagtgctctatctaaggatgcagctgtgcgtaattaaacaagccctgataatttggattctaagctgcttactagctgtgtgactttggacaaattgcttaaatcatcttttaaatacatgcaataatctctatatcattagattgtggtgaaaattaagagatgacatctaaaatgccagaaaatattaaatcctcagcttgtagttactttttccatatccctatgttccaccttttagttctaacgtattttacaggtaatcccagtgtagcgaatgaaccagatacaggaaagattaactacctggatcgaatgctcaaagaatcaaagacctagttgtcatctttgtcatagaattaatctatttactctgggttcctgaaactagtaaaagaaccctaacaaatagcagcaaacgaattttagtgaaagagaacaatgaaacatttaatagaagaccaacttctaagaactacttaataaaaatgccttttaatattgaggtgatttctgctcaggtccaccccacaaagaggacctggactgagttgagctgtgttgcaactctttctcgcttgtcaaagttgtagctcctcctcgtgttgctaaatcacagcagatggcttccttttacacccaacgccgtcagtggaatgtaaatgcgtctcctcacaacactgaaaatactgaggctgtgtgtttaatctgtgctgtacaagccgaatgaccctgaaaagaacatgagcactgagcacgtttggagaattggcatcaatccttggaaacaggattggggaggatttttcaggcctagtgactaatcatggttttcttcctgaggctcctaactcagccatatccctgaggacaagcaatctaaatggtgattgaatagaaaagttatagacccaagggaagtatttttttttttaaaggggcagtgggagtgttgtttggggtatgggaaaaagtagagagagttgcgctgcactgcaaaattgaagaggcttagtttatagtttgaacattcaattctatgtctccttgggagttaaaaaaataaaatttccctgtttcagattatttaagtcactaagaggaatactttctctaagcaattacttcaaaattcagaaataatgtaaataattcatgtcagtatgataccaagtatgagacaagaattatccagaaaaaaaactatattttgagagtatgaatagcaaattatagaaataaaatataatcaagcacattagccaggttatctcagcttctttcttaaatagatctccaagctgcttagaaaacagagaacctgatcttcattttattaaaacagtctccaaaaattaaccagtggctaaaggagaagagaacttgtcatgcaatttgtcttttgagccttttgtagcaaaggaacagagttcttgtcacttctgcttcccacctttccttgggcaagggtctcaaactattatttcaaaaaaagatgtggtcattgtgaatatcataattaccctatgtactgtatataacacagacttagagatcccaaagcataaaataaccactttagctttattgtatgatctaattttatagcaggttattaaattctgtgctaaatttatacatagagatggagaaattttagttcagcagtatttttaaactaataggaaaatgctgttagactttatttttgtcccctccaagaataaatgctttagattcctcaatacaaatgaaaacctagcctttgcttctgttgtgcttttgcgtatttaggtgaactgttagtaaagtcatacataaggtttagggtttgtttttattttttttttaatcctgctaactttaaaacctatagacttttaccaaatggcttatgaaagcctgacttctgaaacaaacctttagttctaaaactaaatactatttcaataaatcctcataatatgaaggtttctatctttgctggttgtcaggttgcttggtgttttaagttgctttgagttcatagattttagaaatgttcacttgggatctgaccagcctctcagcttcacaggatccatctctgtttagacataccaagtctcaaactattttgaagagaaaaggctgtgcagtgaaaggctacccattaaagcatgatgtgtgtctttcatcttccactaggcagagttcgaaactgaaagtctgataatttgatgtaaactgacagtgacaatagaaatggctacttttgagattatttaagagaaggtgcaaggtatagacattcatcaatgaaacactaaaggaaaggtttttatttctgtgtttgctttttaaaataagaatagagtaaatggcacaatagattatataaacaaggacttcaatgacaagctgtcaaagttaaaataatatattttacatgggtgacttgacgccacactttatcacttacatgaggggaagccaatttgagtctggtcaataaaacacaacctccaaagttgggcctggggcaaagctgacatagtgtggcagagcctggtggtttggcatccacttctgctgggacacagcaggagttggcactgctaccatctggggtatgtcctacatttaagccctatttgattaatcaacacttatgcaggttgaagggacgatgcattggctctgctctgaggcagttcaggctctagtaatttaatgcaggtctgaggcataaatgggactagtgattcaaaaactggatttactgcagtctcacaactgttgaaaattaaagtacatgtgctgcaagttaggggttactagggtatctcattataggaggctattttttttcagaggtttgaatctttgctgaattactgagagacttattcgaatgtaggcttggaccaaataattttctgataaattggccataaatcctcagtaaaataagcttggtgttctcagcatatctattggctttttgatcatttttatggctttccttttgctggtcaaattatccttatatgctcctaaagctcctctgacatggattaagtcaacacaaaccaatagaccttcattactttggcaactggttttgatttgggggcaataaatatgatgacacagactagattacctctgctgaagggatatgtgataagccgtagggatgtcagggatcctgcattattttttctgcgtaatgtgagaatgaattaatagcagcttttaactagctgaagaaagttggaaagaagaaagaaatctgaatgaaaagagagccaaggtacggcttataggttaagagcagtgacaccagtcgatcataagaaagtccatgaacacccaatgtgtgtccaacaccgtgcaaggcacaggcaggcagggtcagggccaaatatgtgaggaaactaacatgtgatgtgatccatatcttagtgtctgggagaggagataagaccatcaatgagagcaagatttattgtgcaataaaagtgtagagcagagagaaataagcaaggcctggtatagccaaggaaggggtaatggaagaagcaagatctgcaaatatgggggttggaggaactattttccttataaaaattgtttgttaaattattacttttccaacattttgcttggaaaaaaatgcaaacctaaagagaattgaaaaaaagttacaactaatgcgtgtaactctttaacccagattaccaactttttaacattttgatacctttgctttatctctgtccatatacatgtattttttttttgctcagtaattagaaagtagattgcagatgtcatgacactttaccactaagtattttagtatctcttaagaaagaaggcttccttctataaccacaatgctagtatcacactcaagaaatttaacatcttatatactatccatattcagactttctaattgtcccaataatgtcccttatagattttttaaatccaggatacaatcaattgcatttaatcatcatttggcatgtctttttagtatctttttttatctcaaactgtcccctgcccttttaattcttttgccactgaatattctcttgcttttggaattctgtataaaatcaattggcatatttatcccttgtcttctaaaattatttagtatggcagaaatgggatatgaagaaactccaatctttttctacactacaaaatgcaagttagtagacgacccagcagatacataaaaagggaactcaaataatgaagctactatgttgaaaataagtggtataagtcatcagcctaggaaaggaccagtagtgagtacacatgaaattgctccctccattctggccctcctgagagacaggaaatcaggtttcttgacatggtatctagatgggttatatgcccagttttggtaaacactttcctggcacatgagctgtctgccacttcctattctagttcttctccatttgtggctctgcataaggagttatccttctgtaaagtttcccaggcatgcaggaaatatcccagaaccacaggcatgctttttgttctccttaaagcaattggatcatggtgattccttcagcctaaaacatacttctttacctcattctcccagcaacttcctttgagaaacttagcgatcccatgaggcaccttcctttctccttgtttttccttcatgttcacctctaaactaacaccacccatatggaactgtaattgctttatatagctgccccacccccaggcactatcactaaacagtgaattattttaaagataatggttatgccttttacttccatatctccaggatctaatatgctgtctgaaagtttgaaggcattcggtaataatttgttgagtaagtgaatgaaagcatgaaaaaatgaatgaatgaatttcaccaccaacaaactttctgggttctatagaactcttcttatgactgagaagaacttagtaatgtgttaaacagggcaatcagtgttacaagtgtgtgagtcgataataattgatcagccacttgggcaaagcactgcattttatattattgggaagttccagagtaacaaatagtcatgccttacagtcctgaaggaagggatagatttggcttaactcacattgaacaacagctacacattcatgcgcatatgttatgccaggcaggcctagctacagctcttctcaaaaatgtgctggccctggacattgctgtgtaagagttacaggtgagtggagtcacatgggcttctctggagaggctttgcaaagtacagagaaagtttgaattatcttttaaaaagaggagaggcatgattgaataaacggcatgtttcaggatagagaagtggtttggaggaacaggtgattcctgtttgaaaagtggcagatagagagagttgctctgctggaaccccccggccccggcactagctaggctgcaactggtgatgaccctcatgaggaaatgggactcattaataaagagcctcaacttaaaaattgttgggtggagtggcgcacgcctgtaatcctagcactttgggaagccaaggtgggcggatagcttgagcccgggaggtcaagtctgcagtgagccaagatcatgccactgcactccagcctgagcgacagagtgagaccctgtctcaaaataaataaataaataaaatcaaaattggcaatttatatttgatatggacaggtttgatatagttcgttcccacgacttcctagtcacgtaagtacggtcatttttttctgtggggctggatggaggatgtagattctggaggaaataaaagtgtgtagagaatagatgaattacctagggagaggataattgggccaggattgtgactgtgggaatgcagagagagaaattagaacagaattgtaggggaattggttacaaatgggtctgggcatagagtaatgaagagatgaaaaggatgtgctttgaaaactacaagagtttgcagctcatagcactgaatgagttacacgctctgaatctttagttagcaaccactgttttctaaaatgaaataaagagaagaaaagaaaaaaaagggagagaagcatgaatgtccacacagcttttctgagaccaaaataggccaagctaatgtccagtagttcacctaacggaaacaaaaagaataattcacatgtagcaaatgatagctggctcctgcttattttttacctttatttttgtttttaatcctcactagcagctcctgattgtatcacgtgataacgtttccattctagatacgaggggcaggaaaaggtaaaaacaaacacattgtttgttgatttcacaaaaaggaataatgctcgtgtctggttggctccttggtcatattatcccttatctgccactccaattcctgccagcagcacctcagagatggcacctccccttgctgcttccgttcctctgcaggacacatggtgaggtttttattacgtaaaaatcccaagaggaagaagctctgtgttgataaagtcaatagctcattgcatgctgctagacaagctctaacttttaattctcttctgccaagtggcagtctgcaatgtctttgtggaacagacactgttccaggtgccagggaaacaattgggaacaaggaaggcaaatatctgcacctgaatggggcttccattacagcaggatacacacaaaaactctatagacttcacatggtactgaatgcttgagagaatgaaagctgattgcaatcaaagaggatggtcagggaaggtctccccaagaagatgacagcaaatagtaacacctacctagttgagttattaggagaattaaagcattttctgtgttaaaaacatctggcaaaccactgacacagggtcagaagaaatggctagccattatctttcaacaataaatttacaaagcataatgaaatataactgagtttgagctgctgggatttggttcttgtatgagatgaggcgataatttttattcacaaggccatgtgctccaaagaaaacaatgctatcacttataccacctgcttatggagagaaaaatatgaaagcaatgtcctcaaacctctagctgcatctatgcttctgcctaaaatctggtatcctaagtaggagagaggttgtgaattatcagggctttttcttgatacttatttttacagatctaatgcctatgatggctcctgccagggactgtttggcccaccactctacttctagctagcattgtggttacacagtttgtagaatgcagaaataaacttgtctatttatgaccaatgtcacagcacatgtcaaatctcagtgtcactgggccctttccctaaaggtctacaagaggaaatatgtcatgcttgagttaatgttgaggttgattgtttaacctggaactagaattccaaacatatatccttatgttacatcagttttttttttctcatttatctccaatgtgtccacaggaaatttccacagtagctgttctagcctcttccttcctatcatagctataccattccttctggtatggaaatcatatcagaaggttcccaggaagcgtcttccaggctgcggttccctggacggtcccatctcagctcagtttttcctcccccagctattgtgatgacccccaatcagcatagttataagaaattgtaatcacatggtgagaattaatgagaaagcctttatattggattccttctttttccagcaagagacttcaaaccctgctaactgcagtcttacagcccttggagggggccgtagctcaccattgttctgttctcggcaaacccagtgggagcttatctgttttctgggagaagcagagcagccagatgaagagatggggcagtgccaaggagaaaatgatactcagcatgcagtgcagatccctccctcccctgttccctgctgtcggcctgctgctcagagggaaaggtgcctggtggctctctgatcgccatcctttcttcacattcctaagccttttatttggtggaaggagcatctggctggatagcctcctccttatcccaggacacttcccgagttctctcttttggctttttaataccttattttccccttatgactgtaaagtggacagtgtatttatggttgaaaattggctgctatagcaatattaattttaaaaacagagttttggcacatattcaatattactatggaaacggccgcttctaacaattcactcataagatatagttcaaggactgaggtctgtgtgggaggtttttaccatccaccaaattgacgatctacttgtcagaatagcaattcacaagaactgctctccaaatttgtattccttttttaaaaaagttagtggatgagcattcgagagatgcctttattttactttatatatgtagatggaagataaatattccaactggcatgttaaagacacaatgtgtttaaaataatttttccatgaatcactaattctcttaattgcacataatggtcttacttggttatttgatgtaacactaaatacacacacagacacaactagtttcagaaacgcacatattgaagctggaatgtaacctgtaatcaattgacacattcaaacattttaactttccatcttaaactgtctccacatatttctatgtaactgatatacatacaactgaattccaggaaagacttgaagtaattcattccagtgtggtgttttccaggagccagtttttaaccccaaatattgccttcatttttaaccgcaaacatacttctgttggttttataaaacgcaggcatgagagaaaggacctctgggggctgatggttgcagcattagttcttgaattccctcactttaagtcaaagctttcatgtttgcacctctgttcacttgggaatgtgaggttacattttccaaaaaatcctgcaatgtttcatattttttcagagctccttctgatatgtttattgttttcacattatttcaaatgctgtcatcggccctaaatatcatgaaagataggtcctgatgctgacaacagaatttgtctcatttctcttatttccagctcattttgtgttttccaaattagattaactctcaagcaattagtaacagttgattctgataggcccaggttgcacacccttccaccagcgccacatcagcacagtgagagtgataacccgaagcgcctccttgttcacaaggatggccctgagtggatggtaggagttctgaaatccaaacaggatcaagaaaatcaatcaggggaaggtcacttggggtaataaacaagagtaatcacatggatcaaagttcttgtcctgtgcgtatgtcctatgagaagctctttatccactgaatgctgtaattcttagaacaattctaagacgtgggaattgttgtccccatttattatacttatcctacatatactgtgggaaaatggtatatgagcagagctcttaaccacttcattacacagccaggagtggcagaggtagggctgcatctcaggccttgaatttgctctttcattcttatgacatttctgagagaagtgggaaaacagtatatgtaggctaagtatactaaacaagtatcgaaattggattcaaatccctttctgtctgcttagcaagtgcatgctgtttccagttccccttcagaagaaacaagatgaaatttcttttctgggattaagaggaaaacacacattaacctatggtgctagcacattccagcatacaataatcaggatggaagtttcaaaataggttttgacagtctcaccatagaataccatggaataaccttgcttgggtcctatataggccagaacccagttaatgtttcagaataaattctctttgaggagaacaaatgaaacatctatttattttattctgcagatatggagttcaaagtaatcacagtttaaattaatcatacatacaatatacattttttaaaagatgttaatatgataactgactgcagatagcagcatgtcatttttcagaaaaaaaaaaaacaattctacattatatttataattaatttggggtatgtcttttcaggaaaaggttattcaaaagctcagtgttagagcacaaccaatccaaatagggctggccttaaatctcgtcctgcacctggaggcctccatcatcagttcatgtgtcccagcagtttcaattatcaaaagatccatcctagtgccgtatattttaagcacagttgaagaatagtggagcaaaaaaaaaaaagcctttcaaccatgggaatttaaaagcaaagggccctgaagaggcgatttcaaaaccctactcattcagttcactctaaagcttaatgacatgccctatttgatacagttaggggaactctttcatcaaaaactttatatgaggctgggaattgcaatattaggtttgtaggttggctcccttggtcatactgcaacgtcctgagggaattctagtttatcttttaaaagcaaatagaattagggaaaatgataaatggtatactaatgactactaatatgtttgtgtatttgagaacttcctataggctgtgctttttgtattttacattctttgtgttttatttggtcccatcctttgaagtagatgttaatattccattttataaatgatgaaaatgagttcctaagaggtgaaataacttgctgtgtttgcacaagtaattggcagagccacgaatcaaacccaggtctctgcctctgaagactgacctcttaaccacttcattacacagccaggactggcagaggtggggctggatcccaggccttgaatttgctcttttatttttatcacatttttaagaacagcaaagcaactgtagatgaaggacttggttcctcaggagtcccaaaatatgtgaaacaggtcagccctctggttcaacctgaattgaggtactaacaaggactcgggacccacccccatgagtccttcttcctctcctgttgcagcatagcagatgagaggatctgggaagcctcagtttacccaatgtaatcaatctcaggctgaatgagaagagaagggcctggaaaagtttagaaaacagagacaaaccaagtgatttttctcttgtgtgcatgggtgtgggcactcccaactctctcatccaggagaaccgccatttactccaacagatgacatgatttaccagacagattaagatgaaatcaacatctaagaacaagagtgtgcattttctaaagatcattggatagtactaaggtgtttttctggtcagatttcatctgctcttctgtgtcccagccttttgacctttcaagcccaactctgcggttctgttcctctttcccaggccagagttatctttattgataaaacatataattatttacaaaagcatggccacacagtatggatggagagtttgccctctagttgacataaactattttttctaaaaaactactgaactctatgaaattctatatgctttacttcaaaagctccagtcattgtcataacccagaatttttcacagtaatatgaaggagagatggagtagtaaacatatttctaatgatctaatagtactatattcttgaatgtctccaaggcacctaagaccagcttttcccagcctgacctcatattcttcctacacaaacctcatgtgaacccagtttttcctcatgtgagcccaatttcaatgactgacatcccaatccacctgctcatctaatgtggtatcaacagccatcttcatccttcctctcttccccactaccccacacaatctgacatggggtgatgctgaatttacctcagaaatccctgtcaaacattctttcccttcaattctcactcctttgctaaatttagacctaggtaatctcttatcatgactaataagataaactaacttctctgcctccaatttcttccccacctacactatctcccatcctccaccctgttaccagagcttatcaagtcatgcttttgcttaaatatcttcagtggctcctcactgactacaggacaaagtctgagtttagtgtggcattcacatttcttaacaagacccttctactttatagtattttctctcaccaactcttttcaccctttcccaattcaaacatacacattcatggtcaatgtattggtcaatatagtattttctctcaccaactcttttcaccctttcccaattcaaacatacacattcggtcacactgggtttcttactctttccctaaattctaaggacttttatgtcttcttgcgttttatgttttgtttttgtttttgttttgagacagagttttgctctatcacccagggtggagtgcagtagcctgatctcagcttacatcaacctccgcatctcgggttcaagcgattcttctgcctcagcctcccaagtcgttgggattacaggcacccaccaccatgccctgctaatttttgtatatttagtagagatagggtttcaccatgttggccaggctggtctcgaactcctgacctcaggtgatctgcccacctcagcttccgaaagtgctgggattacagatatgagccaccgagattgtctcattaaagtggaatttcctccttgaagtacttgagcatccactaatccttcaaaggacaatcatgtctcattccaatcttgctccacctactcctcaacacaattaattcatcacatggtcataacacctatctgtaatgtattatgattatttgtgtgtgtgtgtgtgtgtgtgtgtgtgtgtgtgtgcgcgtcttcctcttctcctatctccagaatttgagctccagattccaaacttttatttgtctttgtattttcatttcctagctcagtaaatgctcatagtaaatggtcaataagtattgctgattgaatgcacaaactaatgaaccacatttgagcaaggattattgtgagtagatcccagacaatactatgaagctgttaaaatattatattaattgtataataatttaaaccaagacacaggggacaataaaaagagactaaggatagaaaagatatttaaactctctaggatgttaaacacagatttcatttgtaatagattggtttggtaacgtggggatgagtcctagagaaagctaaataagaaggtaaaagagtttactactgatttactctgatagaaatatgtctttgaaaaaatcagtttaaaaattcaaacagtaactcctttctgtctttaatatttctgtgcaactcagtcacagtttcatgttagccattgttaaactgataagagctcaggtttgctaaaaagtgtttgcaaacacatcggaattaacattaatcaaaccactgtgtaaaaataacaactttgagagcccaggatccagctccctttgacagggctctacctgccgttgtctgctgctagatacttggattcagcgttaagcacatgtgcctttacaaccattcaattgccatgttgaatccgaatcagagtgattcctttggaaaccccctgcgagaccagcgtatcacagtccctcctctgtgtcaagaatttttcccacaagacccaactaatttaatttctttcctttcccaaagcaacaaaacaaaactgtaaaataaccatttcttcagtcccaaattagaacttttggcaagggaggaaagagatcatgaataatacgtggctatagatctagaatcattttataaatataagtgtgggctcatcttttgcctttgttgctacatgaatcatctcagtcactgagattaagagactgagcaaatatagtaggtatttcatgccatattttctgactgtagactttagattctagatatatgattatttgtaaatgatttgagaataagaaaatctgactttcttttaataccttggtctttttacagtactgagtggtaccagcttgctctggttggtcttcattcctgagtagttccattgtcctgaatatttatttgcctttgctatagaattcgcatcccaatgatttcaatctttccagttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgca

SEQ ID NO: 740 - DNA, 210253 bp, Homo sapiens; identical to SEQ ID NO: 739

SEQ ID NO: 741 - DNA, 276995 bp, Homo sapiens
catgtgcgcgcacgccgctttacgcatgctccttaagttccccgtactccctcggagaccctagctacacgccgaatccgttactccgggttttcgcagtggctcggtggcctaccccgatcgaaaccgtgaggcttttgctgagggagggcaatgggagaggggaggatggacgcagagtttagaagtagtttgccgaggtgcagtcgcacgaatggatttcatcctcactggtgtatttaatagtttgtaatctaccaaacagcaactgccagaagccagtcccagctaacctactggcgtgcacgaaagaacccagcgatgctgatctcgtttcgttatttttctgacttaaacggttaaatctaaacgcgattactaagaaaaaaaattttatacctatcattgtacacagaaaaaaaatagaaaaatgtttatataagcgtaaagctggtaggacaggaaaggaagccgaaacaaaaagtaaagaaaaatccacaaggacaacttttggagctagtgcctgagattttggatttctgagtcccaggaggtgctgatatcatttatctgcggactcgtattatgaagcgcaaggtcctagagcgtgtgattttacaggcataaggaatataagatgaaggctgagacaaaataggatgggtggcctaattttcttcccccaccctctcgtccctcccatacacatacaacctgacaactaaaagggccgcactccatggaagaactcctgcagagttggactccccaccggcaaacaggaggaggctatgaagaaacttgcctgtctccgattttcttgggaattgaaaaaataaaatttttaagcctttcatgaaaattcctagcaaaaactcacattcacatggatttgcacaaagattcatatcacctgtgagactcatcccacaaaaactagccacactgaaaagagagaaaaatgtaaaaccaagatagaaaaaggatggtagtctgcagatattgcaattatcagaaacaagtatatttaaagaaatgaagggaaatgaaaaaattatcaaaaataactaagcagattaaaagaataatttagaagtgaaagctatcattatcttagtacttagaacgttgatggaaatgtgtttttattaaaacagaagggctgatccaagatagaaaaatataaatccaaagaaatagaaaaaattctgataagagcaaataatgaaatagtgaaatatacaataaagagaaccaatagaccaaaaatttgggtgttgggatatgtaaaaggtttagaaacttttggaaagatttgatattgccagttttacccaactcttcaaaaaatttaaaatgggtggcaggggcaggtcacatctcatgagacaagcataatgattatacccaaacttgaaaatacgttgcaggaaatgaacattataggtcaaactcataaaattaggtgcaaaaatcgtagacctacaagtgatgtctttgtggtgtgtgtgtgtgtgtgtgtctgtgtgtgtgtgtgtgacggagagagagagagatacaactgaattggatttaataaaggaatgaaagatttagttagcatttaaaaataaacgtgtaattcttcgtattaacagaatgaaagatgaaaaccattgatcatctcaatagatgcagaaaaatatttgataaatttaacacatgattttttaaaaatctcaagcaaggattagaaaatggcttaatataaatagaagctactgaaaaatttttaaatggagcaaatatcacacttaatgaaagattgaaaacttccacggaatttgagaataaaccaagtatgctttctatcattacttgactttttttttctttttttgagacagtctcgctctgtcacccaggctggagtgcagtggtgctatcttggctcactgcaacctccgcttcccgggtttaagcaattctcctgcctcagcctcagcctcccgagtagtgtgactacaggcgcatgctaccacaccgggctaatttttgtatttttagtagagaggggctttcattatgttggccaggctggtcttgaactcctgacctcaggtgatccacccgccttggcctcccaaagagctgggattataggtgtgagccatggcgactggcctacttgacattttaatagaggccttacctaggagaaataagcataagtaagaaatagaatgtataagttttggaaaggaagactaaaattaatcattatatgttttaagtatgttggtgccatatttagatatttagaaaaaatggttttaaatcctatggattaattacttttgactttttaatttcaatatgtttaggggaacaggtggtatttggttacgtgaataagttctttagtggtgatttctgagattttggtgcacccatcatccaagtagtacacactatacctaatgtgtagccttttatccctcacccccctcccaccctttccctgaatccccagagtccattgtattattcttatgcctttgcatcctcatagtttagctcccacttatgagtgagaacatatgatatttggttttccattcctgagttacttcacttagaataatagtctccaatccatgttgctgtgaatgccattattttgttcctttttatagctgagtagtaatccataatatatatgtatactacaatttctttatctgctcattgattgatgggcacttgggctggttccatatttttgcaattgcaaattgtgctgctacaagcctgcgtgtgcaaatatatttttcgtataatgacttcttttcctctgggtagatccccaggagtgggattgctggattaactggtagttctttaaggaatctcctccgcttttccatagcggttgtactagttcacattcccaccagtagtgtaaaagtgttcccttttcaccatgtcccagccaacatctattattttttgatttttttattatggccattcttgcaggattaaggtggtatcacattgtgcttttgatttttatttccctgatcattagtgatgttgagcattttttcatatgtttgttggccatttgtatatcttcttttgaggattatctattcatgtctgtagcccactttttgatggaattttttttcttaccaatttgtttgagttccttgtagattctggatattagtccttcatcagatgtagagatttcgaagattttctcccactctgcgggttgtctgtatactctgctgattgtttcttttgctgtgcagaaaattgtagtttaattaaaccccatctatttatctttgtttttgttgcatttgcttttgggttcttggtcatgaagtctttgcctaagccaatgtctataagagtttttccaatgttatcttctagaatttttatggtttcacgtcttagatttaagtctttgatccatcttgagttaatttttttataaggtgagagatgaggatcacctccttggttaggtgtattcctaagaattttattttatttttttgcagctattgtaaaagggtttgagttactgatttgattctcagcttggacgctgttggtgtatagcaaagctactgatttgtgtacattaattttatatcctaaaactttgcttaattcatttatcaattctaggagctttttggagtaatgtgtagggttttctaggtatcatatcatcagcaagcagcaacagtttgacttcttcactgatttggatgtcctttatttctcgtctgattgttctggctcagacttccagtactgtgttgaatagaagtggtgagagtgggcatcgttattttgttccagttctcagggggaatgctttcaacttttccccattcaatataatgttggctgtgaatttgtcatagacagcttttattatgttaaggtatgtcccttctatgccgattttgctgaaggtttcaatcataaagggatgctggattttgtaaaatgcattttctgtgtctattaagatgatcatgtgacttttgttttgaattctgtttatgtggtgtatcacatttattgacttgcgtatgttaaaccatccctgcatctctggtatgaaacccattggatcatggtggattatcttttccatatgctgttggatttggttaactagtattttgttgaggatttttgcatctgttttcatcagggatattgatctgtagtgttctttttctgttatatcctttcctggttttggtattagggtgatactggcttcatagaattatttagggaggattccctctttctctgtcttgtggaataatgtcaataggattggtaccaatttctcattcaatgtctgatagaattcagctgcgaatccatctggtcctggactttttttttttttttgtaggcagtttttaaattaccgtttcaatttcactacttgttattggtcccttcagagtttctaattcttcctggttttaactgggagggttgtacatttccaggtatttatccatctcctctaggttttctagtttatgcacataaagatgtacacagtagccttcaatgatcttttgtatttctgtggtatcagctgtaatatctcccatttcatttctaattgtgcttaatttgatcttctcctttttcttgtttaacctcctcactagtggtctatcaattttattcatcttttcaaagaaccagctttttgttttatttatcttttgtatttttttgtttcaatatcatttagttctgctctgatctttgttacttcttttcttctgctgggtttaggtttggtttgttcttgtttctttagttccttgagatgtgaccatagattgtctatttgtgctctttcagactttttgatgtaggcatttaaggctatgaactttccttttagcactgcttttgctgtatcccagaggttttgataggttgtgtcactgttattgttcagttcagagaatttttaaatttctatcttgatttcattgttgacccaatgatcattcaggagcaagttatttaatttccatggttttgagggtttcttttggagttgatttctaattttatttcactgtgatctgaaagagtacttttataatttcagttttcttaaatttattgagactcattttgtggcctatcatatggtctgtcttggagaatgtaccatgtgctgatgatatattctgtagttgttgggtagaatgttctgtaaatatcttttaagtccatttgttctaaagtatagtttaaatccattttttctttgtttaatttctgtcttgataacctgtctagtgctgtcagtggagtattgaagtcccccaatattactgtgttgccatctatctcatttcttaggtctagtagtaattgttttgtaaatgtagaagctccagtattaggtgtatgtatatttaggactgtgatattttcctgttggacaaggccttttatcattatataatttccctctttgtcttttttaactgctgttgctttaaagtttgttttgtctgatatatgaatagctattcctccttgcttttggtgtccatttgcatggaatatctttttccagcccttccttatatgttgagtctcttgaagacagcaaacacttggttggtgaattcttatccattctgccattctgtatcttttaagtggagcattttggccgtttacattcaacattactattgagatgtgaggtactattctattcattgtgctatttgttgcctgaataccttgccttttttttttcattgggtttttattttataggtactgtgagatttatgttttaaggaggttttattttggtgtattttgaggatttgttccaagatttagagctctttttagcagttcttgtagtgcttggtagtggtgaattctctcagcatttgttagcctgaaaaaagactgtatctttccttcagttatgaaccttagttttgctggatacaaaattcttggctgataattattttgtttaaggagggcaaagatagggccccaatctcctctagcttatagggtttctgctgagaaatctgctgttattctgataggttttccttcatgggttacctgatacttttgcctcatggctcttaagattctttccttcatctagactttagataactttatgactatgtgcctaggtgattatctttttgcaataaatttcccaggtgttctttgagcttcttgtatttggatgtttatgtccctagcaaaactggggaaattttttttcgattagtcccttaaatgtgttttccaaacttttagatttctcttcttccttaggaacaccagttattcctaggtttggtcatttaacataatcccaaacttcttggaggctatgctctttttttaaattattttttctttgttttggttggattgagttaattcaaaagccttgtctttgagctctgaatttctttcttctacctgttcaattctattgctgagattttccagtgtattttgcatttctctaagtatgtccttcatttccagaagttgtgatttttttttaatttatactatctatttcactgaagattgttcccttcatatcttgtatctgtttttataattcactaagttggacttcacctttctctggtacctccttgattacttaataatcaactttctgaattctttttctggcaattcagagttttcttcttggtttggatccattgatgttgagctagtgtgatctttttgtgttgttaaagaaccttgttttgccatattaccagaattgtttttctggttacttctcttttgggtagactatgttagagagaagatctggggctcaagggctgctattcagattcctccatcccatggagtgctcccttattgtggtgctctcccccttcccctaggtatgtggtttcctcagagccaaactgcaatgatttttatttttcttctggatgtagccacccagtggagctaccaggctccagaagtgtctgcgcagagtcctgtgatgtgaactgtcttcaggtttctcagttgtggataccagctcctgctctggtgtaggtagcaggggagtgaagtggactctgtgagggtacttggttgtatttttattaaatgttctggttttctgttggttggcctctagccaggaggtgatgctttcaagaccacatcacctccggttgtgtgggaaggatacaaacttgccctaggctcaggcattagatgagccatagagctcccaaagaactatgtgcattgtctttggctaccagggcaggtagagaaagaccatcaggtgggggtagggttaggtgcgtctgagctcagactctccttggtcagtgtttgctgtggctgctgtagggatgggggtgtggttctcaggccaatggagttacgttcccaggggaattatggctgcctctgctgcatgtaggtcaccaagaaagtgagagaaagctggcacttacagacctcaccccgctcccacacagcccaaaaggccagtctcacttccatcatgccctgccaacagcatcaagtttatttccagatggcatgtgagcagggctgagaacttaccctaggctactagcctcccaactgagaaagcaagcacagctttcaggtttcatgcctccccacatgcctcagcttctgtgctgtgtctgcactcccgatttgctccctctcccaggttctgtccagaaactttgcattcaatcaaaattgttcagctggaagtttccttctcttgccatttttgttttgtttttgtttttgttttgttttgttttgttttgtttttttgagatggagtctcgctctgttgcccaggctggagttcagtggtggcgatcttggctcactgcaacctccacctcccaggctcaagcagttctcctgccttagcctcctgagtagctgggactacaggcgagtgccaccatgcctggctaatttttttgtatttttagtaaggacagggtttccccatgttggccaggctagtcttgaacttcttacctcaggttgtatgcctgcctcagcctcccaaagtgctgggattacaggtgtgagccacaacacctggcctctcctgcggtcttttcccagttcccctggcagccctttccaaaaacccgtgtgagacaaagtcagaaatggcttccctggggaccaagaatgcgcatagggctcttcttgctgcgtcttctactcctgtatttcgctcagctctctaaatttgtctcagctccaggtaagtccaaatccttcccctgtgatctggaccttcaggttccccagtgggggtatgtatttggaggcagatgatcccccttttacacattcacactttgggcattcacagtttttccactgtatcccagggcagctatctgcttctttcaaagggtctgtgaattatctcagctttcctggtatgttcctatggtagttcttggagtaaaagttcacaatgtgagcctccacacactgctctgtccatccaagtgggagctgcaagttagtcctgccccctattcaccattttttccctatggagaaattattagttaatgaagttgcaggatgtaacattgaagtacaaaataaaatagtatttaccagtaacaactgtgatggttcattttatttgtcaacttggctaggctgtggtgcccaattatgtggtcaaacaccctgaggatgttgctgtggaggggtgttttatatgtgattaacaggcaaataagtagactttgagtaaagaaaattaccctccataatgtggtaggcctcattcaatcagttgaaggccttaagagcaaggacagttttcatgaagaaaaagaaattatctccaggaattcaaggtagaaaccctaactgagttttcagcttgctgtcctgcggaattcagtctcaagactgaaacatcatctcttaccaggatttcccatctgtggacctgtcccacagatttcagactggccagcccccacaatcatgtgagccaattccttccagtcagtcaaacaatcagtctacctatctaagagcctattgcttctgcttgtctggaaaaccatgactaatacaccagcaatgaaaattaagaaaataaaacttgaaaacaatgtcatatgatttcttcattcatgtagtaccaacatccatgtctctaagatgccaaaagtttttgtcagagaaagtaacaggtgggacaagggcccataagagagagtatagtctgcagaaggccaagaaagaaaggagagctacacactctagaatctctttccagtgtcttccttttgctgatctctcatggccttaacatctttaacaagctgtttcacaagtttatttctaaagatgaaaatgtttttcttcatttattcaatagaatatatattgaacaaatactttgtaccagaaatataacattttaaataagcttaatcataaacggatgtttttcagtagcatcacaaacgtaaaatacctggaagtgaagctaatgaattatgttcaacatttatacacaattctctatgacaggggctggaaaacttttttataagaagcaaatatgaaatattttagtgtttatcccactttcttctgcattctaacaacacgttaaaaccgtaaaaattattttgtgaaccacaccaaataaaccacaggttggatttggcataccaacagccattgtttcctaaccaccacctctaaaacagacttccgagaaattaaagaagacttaataattgaagaaatgtgcttccttagtctgtgccactgtaataagacatcacagattgggtaacttatatacaatagaaatttatttctcacagttctgaagtctgggaagtccaagatcaaggggccagcattcagtgtctggtaagggctttcttgctgtgtcctcacatggcagaagaggtgaatacaccacatgaatactgtgtgctcatgtggcagaaggcagaaggcctaagctagttacttctggtccttttattataaggtggagctctcatgaaaatcacttcccaaaatgccttgcctcttaatgccaccacaaaggggattaggttttagcttataaaatttgggggttatttcagacaataatatgccatattcataaagtggaaaaatccatattatgaatatgttaatttttatcaaattaatctatagaattaaagaatcaacaaattgaaatgcatcaatattaaaatttttttttcaaaagacaatgttaagaaaataaaaaagcaggccacacattggtgaaagacatttggcaagcatatatctggcaaagaacttacatctagaatataaaaagaactcttaactaatcaatgagacgaaacatatatactaatataaaatgaaaaaaatatttaagtagatacttcatgaaagaagatgagcacagggaaagatcttttttatctttaatttgcattttaaggaagatgcaaattaaaaccacaatgagataccactatacatccattagaataaccgaaagtataaagacaaacaatatcaagtgtttatgaggacatagataaactgaaaatctcatacacttcttgtgggaatgtaaactggtatagcactttggaaaatagttgagcaatttccaaaaacattgaatttgcacataccatacaaactaaccattccatccttatccaagagaaataaaagtgtatatctatatagtcttatatacacaaaagatcatgacagatttacttgtaatagccaaacactggaaacaacccaaacctccaaaaaccgataaatggataaataatttgtgtgtttgtataataaaatactactactaccacacaaataatagagcaaattgatgataaaagcaacaacataaatgagtcacaaaataacatgttgagtaaaatacaaaaggactctattctatctgatcaaaattctaaaaactgcaagttattataacagaaagccaatcagtttgttgtgtggagacagctggggaacaagggtaggggaagtgtgataaattacaaaagggcacaagaaaacttttgttcattactttgattatactgatggtttcatcagggtgtacatatgtcataactgatcaaattatacactttaaatgtacacagagtactgtatgacaagcctaaataaagccattaaaaagagtgtcacccagacacgtgaacagagacacacaatgaaacaaaacaatagaaaattcagaaatggatccaaatttacaggcaaatttactatataaaaagataaaatttctagtccatggcaaaaagatagaccatccagcaaacgggaatggataaagaggtgaacatcaaaaataaaagtttcatataaacttctcaacagatctagataaattccaaatggatcaaaggtttcagtataaaaattgaaactatgaaagtactataccaaaatgcaaacaaacttctaaataacagtaaaatgggaaatagcatttcccatgaatcagaatttacaagtaattaagacaaaagaaaggttaaatcaaccatataaaaatttctaaaatttgcatggagaagttccagtataagtaatagtgtattaagtgattcaaaccaactctcctactgagaatgatacaacaaaatgtttttaaacagaacgtctgttctgaatgcgcagaagagctacaaagtctgtgtgtaaggaattgtgttgccatgatttgcaagaagaaagagtcacaaaaagatatcctggcatttgggggagcttctccctaaaaatagttactgattagaaagcagctgctgaaatgctgataagacgagcagagcagatccttagacttgtgagacagaaacataaaaattaaagttataaggacctcaaaaaaggaagggtcctaataaaaatcccatgtgactcagaaagccctagccttgagtaaaagtataccagaaatcaatcaccaatcataagattgaagctcttctttgaaacattttctaggctagatcatacatttggccacaaacaaatcttttaaaatttgaaaagattgatgttataccaagtattttttccaactgaaatggtatgaagctagaaatcaataacagggagaatattgaaaaatttacaaacatatgaagattaagcaacacactcctgaacaaccaatggttcaaaaaagaaaagtcaaaagggaaatttaaaaacatattgatacaaaataaaatggaaacacaaaacaccgaaacttacagaatacagcaaaagcagttctaagagtgaaacttataaacacctacattaagaaaaaagaaaactctcaaataaacaatctaactttccacctcaaagaagtagaaaaggaagaacaagctaagcctaaggttagtttgggctagcaaaaggaagaaaatgataaagataagagccaaaataaatgaaatagatgctagaaaaaaaatcaacgaaactaaaagttgcgtggtttttttgtttgtttgtttgcgaaggagaaaaaaaaagctggcaaacctttagctagactaagaaaacaatagagaagactcaaaaccagaaatgaaacgggaaacattacatttgatactacagaaaatcaaaagattgcaagagactacagttgacccttaaacaacatggctttgaactgcgtgagtctacttacatgtggatttttttttcaatatatacagtctgccctccatatgcatgagttcagcatctgaaaccaaacatgaatgaaaaataagagtattcatgagatgcaaaaccttcttatatgaagggcccaattttaatattcacaagttccacagggcctactctgggacttgagtatgtgtggattttggtacccatgggtggtcctggaaccaaacccctgtggatcctgagggatgactatactatgaacaactatacactgataagttgggtaacttagaagaaatggataaacttctataagcatacaaccaatcaaaactgaatcatgtaaaaaacaaagtctgatctgaactaaaataaaaaaacaaggagttgaattagtaatgaaaaacttcacaacaaaggaaagtccaggaccagagcttttactagtaaatactaccaatatttaaagaacaattaatactaatccttctcaaactgttccaaaaactcgaagagaaagaaatacctccaaactcttttcatgagcccagcattaccctgataccaaagccagaccaggatactgaagaaaaaaaaaaaattacaggctaatatccctgatgaacatagatacaaaaatcgtaaaaacaaaacaaaaagactggcaaattgaattcaaaaacatattaaaaggatcacaagccttgatcaagtggtattttatccctgggatgcaagaatggctcaacataaaagtgacacattaacagaatgaaggaaaaaacatgatcatttcaatagaggcagaagaagtatttgacacaattcaacattcttcaatgataaaaactcaacaaattaggtacagaaagaatgtacatcagcataataatggccattggtatagtttggctgtgtccccaccaaaatctcatcttgaattgtagttcccataatccccaagtgacatgggagggagccagtgggagatttttttttttttttttttgagacgcagtttcactcttgttgcccaggctggagtccaatggcacgatctcggctcaccacaacctccacctcctgtgttcaagcaattatcctgcctcagcctcctgagtagctggcataataggcatgcaccaccatgcccggctacttttgtatttttagtagagacagggtttctccatgttggtcaggctggtctcgaactcccaacctcaggtgatcacctacctcagcctcccaaagtgctgggattacaggcatgtgccactgtgcccggcgggaggtaatttaatcagcaaagtagttacctccatgctgttttcctgatagtgaatgagttctcatgatatctgatgattttataagggacttttcccccttttacccagcacttctttctcctgccaccatgtgaagaagaacgtgtttgcttcccttccaccatgactgtatgtttcctgaggccttcccagccatgcagaactgtgagtcaattaaacctccttcccgaataaaggaccccagaagttattgcatctcagaacttttcccattaatccagtcatacatcatttatatcaatgacatatgtcaataaagaatgtaactaggtctcaatttaatctattggaacatatatctgcatttttctttgcaataggaacatttatttagatttaaatgtccttaaattgcttgtcagtttttacttaatcatatcaaccaggagttggaagatccttaaatttcttaaacttaacagcatgctcttttgcctcccatctggccttctgaatgtagagtttcctttccttagaatattcttcctccagtatgttaccactttacccccattttggtatagtcccattaatctattcaaatagtttcaggttagtcattttctccttgaagaagtttgctgtgcattcatatacaggtaatgtccctcttttgtttgctctcagaacactatagctcccatattaacatgggtgcttgcctactcacctatggaaccaaaatatctatgaggacagaagacatattaattctatttacagctgtatccttaataaccagtaaaatgtatagatcctgataataagtcagtaaatagttttgaataaataaactagctggaaatcgtcaattatacattagtaagaagccagaagtatactacaatactgtatcttgctgatattgagctactctgttacccttaagttagtgtaaagatacaagtttttcattggaggaatccaaaattattataaatcctggcatgatatttaccttcactaaaaattaattatgattcaaaaggatatagagctagattatttatttaaactagggcactggaaattttataaaactagtactcaggtatcacagtagttaagagaataatagtgtactgcaatgaggtcaaaactgaagagggcctacagggtcttttgaaagacctacatgagtgtcagctgccataggtcaggaatgaggacagttccttgtgatttgtgagaaacatttactctatgatcttcagagaaagaccaactgaggaaagcatggttataaagtgacattcaagcccttctcataaaagtcccataaagaaaggacattctcaagaaagtgaaaagacaacccatagaatgggagaaaatatttgaaactcataaatctgataaggatctagtatctagaatatataaagaactcttacaaatcaataataaaaaacaacccaatttttaaagtgtacatcgaattgaaatagatatttttccaaagacatatgaatgccaataaacgcatgaaaagatgctcaatattgttagtacttatggatggaaatacaaatcaaaatcacaataaagtaccatttcatacctactaagatggccataattttaaaattgttgttggtgagaatatacaatgatgcacctattttggaaaacagattgtcagttcctcaacatcaaacatgtgacccagaaattttaatccagtgtatatgcctaagagagttgaaagcacatgttcacacaaaaacttgtacatgaaggatagctgtattattcatagcagcctcaaattggaaacaatgcaaatgtccatcaactgatgaacggataaacaaaatttggtatatccatgcaaatgaatattattcagccataaaaaggaataaaatactgatacatgctacaacattgatgaaccttggaaacatgctaagagaaagaagtaaaacacaaaagaccacatatagtatgaatctgtttatacaaaatgtccagaatacaaatttatagagttggaaagtagattagtagttggtaggggatagagagagaggggaatggggaattattgctattgggtatgggttttttggaggtgatgaaactgttctaaaattagatagtggtcattttgcacaacctcacaaacatactaaaatccatcaaattgcacgtattaaaatggtgaactttatgatatatgaactatatctcaaaacagtataagagactgtaacaacagaaaaatacttatgtaataatttttatgtgaaaaacatagtacttgttgcccatagggcatgatcacatatataggaaggaattgcactgagtaaagatgggaagacattgcacccaaatattaacagaggttgtctctgtgtagtggggtgatgtaagattttattttcttcaattaaaaaacaatttcagctcttctattataaacatgcattttcataatgaaaaaaattaaaaattgttaaaagtaccataaagagagcagatgatgtcatagtgcttgcagactcttctagactttagagtcaaagtcagagcttgccacctatgccgggcaaggaacaagaaaggtgtgtcagtttatcatgaaacagaatgactctcaaaattgatgttgtgtcaggaagtactctgctactggcaagaactttttaaattctagttgggttatacaaagcaaccttgagagagtaatttgagattgaagggtaccgggtgattgctagaactcatttatataattagtgaagaaagtgcctttttagagattctcatatatgagtatggatttatggtgactcagtgccagtcatgtaaagtatatatttttaaattttcctggaccaaataaaacaagatttttagcctcattttggcccataggccctattgatgacctctattctggtgtttcacttgagtggaataaatgtggaggtcaatgaagttggatccataaccccaagagaaaaggatgttgtgtgggctgtgtacgtgtaaaagtcccttgactgtggatgatacaaggtttgtggatggcagggaataggagagcaggacatgatacaggcagacacatgggcttcaaaggagctaatttatttttacattaatttgaagggataatggactggaagtagtactggagaacaaagagaggagggatgtgtagtaggaaacacctatttgagcagctgcaggaaaaacaatatcctcagggaataacaagttttaagttaaggctagaagttggaaggagtatttagtgaagaagttaagagttaggaaaacagatttatcatagcagcaagcccagtggaaaggcttgatggggagaggaggacagggttgttgaggcatagacagtaagaggactaaagctcatgtagctaacaagtactatgggagcccaagtgaattgaaagtgctggtaggtttgtcatggccactgaaaaggctcataatgtgtttaaaaataagcataagacatgagtatgacaaaattggccacaagaaaaagaaattgtcattgatgagaattcaaccttggataatgtttttaaaaatctgactcataattttatttgaaactggaacctcaaatacataaaggtttatcaaatgcttactatgtcctgaattctgtggtaactagtttagtctagcaacacttttaatcttcacaaaatcctatgaaatagataatccaccacttactgttttgtttctttcacttgatttttgtgccttattttcttcacttgaaaaatagggctgatagtaatagtatgtacatcacagaggattaaaagagacaatccatgagacactgtctagtgccaggtccataaagcttacctattattaccattactacttcttatacgactgctaatataatgactattgttcttgccatttcacagatgaggctaagagagattgagaaacttgtccaaagtcatgtcgcacagcgaatacgcagaggagtaagatttcaaatgcaaatatcctcacattactcctcttagctttgctgaagcatttgaatggcttccatttggttttaagatacacaccaaaattctcaacaaaacttgtatgatctaaactgcacttacctctaagttttatactatgtttccctctctctgtgctccagccacaatgatcttcttttacttcctgtaagtcaggttgcttgttctctcctcataaacggttgtgtagtactatctctgtgtcagtggcactcactgtcttacatattttcatccttccatgagaagagttcatcttttctttagggaagcttttgctaacttctctgactaggataatgacccagtcacatgttttcctgaaactgcatacctcttcttggtaacacttaacatagctataattttttttgtgtgtttttctgattagtacatttcctccagtagacacaagtcatcctctttctttattctcctttgtgggtctgacctactatttaacatggagaggctgaaagaaaaaaaattaactaaaattgattgcaaaaaagaaaaggaataaaaggaacacagtaaagtgttaaataataaaacaaattggataaagagtttaggaaatgaagtatttttaaaagagatgaataaaaagtaagaactaagtaaaataatgtaaaaagatgtataaacaagtaaataatgaacttagaagaagtaaaataaaatgtggaccagcaacataaaaacattggattaggcattcaagacaggtgagaacaaaccgtccctgacagctgaatacctaggccctggtttcagacagggacttctgagatgagacaagatccaaggagatgggagcagggagggtgtcagaccatgggctacaagagctttagggagcaaaggtaactattgcgtttgctttcttttgagaagttttaggttgttttgtcaatgacagctaatgtttggcaaagtggtaacacaggaagaaaaatgtatttcttagcataattattgatatggtttggatttgtgttcttgcccaaatctcatgtcgaattggaggaggggcctggtgagaggtgattagatcatgggggtgaatttcccccttgctgttctggtgatagtgagctgatcatttaaaagtgtttggcaccttcccccacctcttttcctgctctgccatgtaagacgtgcttgcttcacctttgccttacaatgtgattgtaagtttcctgaggcttcccactcatgcttcctgtacagcctgtggaactgtgagtcaattaaacctcttttcttcataaattacccagtctcaggtagttctgtatagcagtgtgagaacagactaatacaattctctataaggaagagatctacatgtcttctaacgggcaggctaaacataaaaaggtagtcacagactacgatacttgtgttttgcctggggtgcataaggtgtgtaaagtgaaggatagagtataattaggaaaatagaagagatttttagaggccatgttgggtagagagaagaaagccaatgaggaataaagccaacttctagcagaaatgacagttaagaaaagggcctcagttttaggtgataactgcctgatagtatgccactgattcataagaaacgggaagataaaacaaggggtgagcaaagattttggtgggaaagatttgataactatagaattagtgtagaatattgtaggatgagttcagttttagagtcaagaccctctgtgttcaaaccatacctcatcacattctgttagtattagcttttatgctcctcagactggagtgaaaaatggagagatgtgctcagtgtttcagttctttctgaaaaataattttactagcagtcataaacattttttacactgacaaaaagcacatatattttgaagtaggatgaaacatttgcctgacgaatttaaaaaataaagacatttctcactgattagtagtagctgtgggatatgccttcatatttcttgcagcccatattcaatttcctttgtcattaagaggactttagttaaaaaaaaataataaagaggctgtatgaacctgttttgaatcactataaaattggggttgggtggtggtggaatgactttgtatatctaaccacctagccctgatcctgacatatgctcagtgactgaaagtactattttccttgccctgctcctcctctcttccatttatgacaagaataggtgatgcttcaatttttatttaaccatttttttaaattcctcttccaatattgggcaactacagatctttccaaccaaaatctttgctcacaggaatatctataaaatatttctatatcaaatatatagtggaggatattcttttagaaaatattcaatatatacaggtataattttattttttactttttttaaaaaatatattcctttaggcgatgaaaggacaagccccaggagtcaggatgagtcctaatgccgtcacccagtcacaccgcagtgcttgcctgtgtcctgccggcccgctccttgttgccctgcactgcgcggccgcagcggcaccatgattgtgtttgccgtgctcctgtcgttggtggcgggtgtttgagggaacgagtttagttcttggtctgttattttcagaaatggaaattggcctataccgggagagtgaatcccagacgtggctgcattgtccatggccttctctgtgaaggaaaacctttcttggccaggacttgcagtaggtgacctatttcatcgtcctcgggctaccgtcatggtgatggtgaagggagtggacaaactggctctaccaccaggcagtgtcatttcataccctttggagaatgcagttccgtttggtcttggcagtgttgcaaattccattcgctctttattttctgacgaaactcctgttgttttgcagttggctcctagtgaggaaagagtgtatttggtagggaaggcaaactcagtgtttgaagacctttcagtcaccttaggacagctccataattacttgtttcaggaaaactccattctcagttcatttcccctgaattctctgagtaggaacaatggagttgacttgctctttctttctgaactccaagtgctacatgatatttcaagcttggtgtcttgtcataagcatctagccaaggatcattctcctgatttatattcactggagctggcaggtttggatgaaattgggaagcattacagggaagactctgaacaattcatagttgcttctaaaatcctgttgacgctctgcaagagtttgcagataacatgtacaatctttacagtgggaatgcagtggtagagttagtcactattaagtcatttgacacctcccttatgaggaagacaaggactatctttgaggcaaaataagtgaagaacccagcaagtccctataaccttgcgtataattttgaatattcagtgattttcaacatgatactttggataatgattgccttggccctggctgtgattatcacttcttacaatatttggaacatggatcctggatatgatagcatcatttataggattacaaaccagaagattcgaatagattgaatattccttgtgccagaattagaaaaggggtttggaaattggctgttttgttaaaatatatcatacattgtggtttaaagtagatagcatactttaaatttattaaaacctcacatttcttctctattttgtgtgtgcctatggttttttttagagtgaattacagtattgatgtgaatcaaactgtacagtgtagattccataatatactgaaatatatcatagccatttaataacacgatttcattccctttaatgagtttggaaatatgcactgaaagaaattaaaacatttagaatagcttgtgttatttattatggaaaaatgcactgaatttattagagaaacttatgaatgtttaacttctttacacagcataggtgaaaatcatatttggactgttgtatactatgaacaatttgtaaatgtcttcatttgatataagtatctctgaaacaagaggaaaggtttttaacttcgaatagccctaaaatatggatgtgcttatacagtcacttagttttggaactctttctgattgacagaggatggctgttttttaaccttcttcaagtttggtgacccatactctagtatggatactaaaaatattacatttatgtaagaagaaactagccttgtggagtatagatgcttttaattatacacacaaaaatcattgaggcatgaacataaaatatttttagttcagtaacttctccccctgtgtaaggtactatggtttgtggtccaacttcatcctgtagaatattaagtggaagtggatgagttctactttttggaatggactcatgtctataaagactgacacgttaataataattccgaaaaaatttttctttaaagctcttgtaccgaaaaaatttttctttaaagctcttgtacttagccaatatttaatgtcctgtttacataatggagtctgaaactcagaggaacttcctggggacccaaaaagtataatgtatatcaaatagagtgagatatatattcattctgtatattcaggtcataaaacacaattacatttaaaagaattttagacagaagcgactttgaatatattacagctgcaatgcagaaacacattaaagttttatggataaacattttttccactggagggtgcaatttgtcagtatatcaaaatagtcacagttcctttaatgagtatactttataaataatatcagagagctgattatttccaagacactaacatagaatgctgagcagatttcatgaaactttaaataaatgaaatttcaccaataggaatatgggctttattccacaatatccttatgtggaatatacttacaattaggatcaagtaagctgaacataattttattcttctgttaccttttttggataccatatatgactttcttggctattaatactgcaaaaatatatactaataattcatgctgaagatacagtcctacttataatattattaagttttatagttgttttctttagcagtctatgcatttatttacaattctttatgaaatatggatttattttattagactttatactcagtaataatgagtagtctaagatgaaatgtaaattaaataagcataaaactaacatacatttaacaaactttcttttattatatatatcatatagtatgaaggctattagataatatgtgcttgagatataatactaatgaaacaaattataataaaagctagtatttattaagcactggctaggtgttaggcacagttctatatttattaactttgcatttgtaatttacttccttatcacaacaacctcaacaaataggtatcattttctccatttcacagatgaattgaatgtgccaagatttcttgtccaagtccatacaattaataccagaactccaccgagatggcctggctccagggcccagatttaatcactattctacagctatgttaaccttgttgatgccatccactgctactcaaataccaacgtgttgatttttattttagacacttgaagacaggcactttccattatgaattaatgtttcaaagatatccatcaaatatgtatttgtgttttctattctgcctaaattaatagaacttctttaattatgacttagataaatgaacttgtggcagagcatcttaattgcctaccccagcagctctttccatccctctcagtaacagaacaccaatattttgctggcatattgccacagtataaggctgcattttccagcctccctctcagatattaatggccacataaatgaatgggcaatgaaatgttaagtgtaagtgttgtgtggaacttccagggagtctcctcaaaagcggaggtctgtgatcttgctacacttactcttaattactcttttccactacctgcaatgtgggcatgaaaacagctggagcttaacagccattttggatcttggggcaggataacagaatgacagccagacaaggcaggaactgctgtttcctttaagcccatattttgaagctttctcgcatacacagctgtatctaatcctactaacaagtttgataggttttaagagttcattttgtctatcttttgagcctcggtccaccccagaccacagcctttctttctttttttttctttttttcagacggtaatcgcactctgtcactcaggctggagtgcagtggtgccatccctgcttactgcaaccctgcctcctgggtccaagctattctcgtgcctcagtctcctgaggagctgggaccacaggagcacaccactatgcccaactaacttttgtatcttttgtggagatgtggagatggggtttcgccatgttgcccaggctggttttggactcctgaactcaagccatccacctgcctcagcctcccaaagtgtggggattacaggcatgagccactgcacccaattgatgtgattctaccatgaggtcatcaaatatccttacaggctacatgaactttgaatatgttattaagctactaatatattttatgcttattttttacctcataattttttaaagatcatttctacctgaagtccaaaattaattacttaaataattctacaagtagtagtaacttgtgtagtagtgattagtgattgacttttaaattgtcaattattaaaatactttagtttttgcagattatatttccccttttgtaaccaggaagatacttgttttagactgtgtgtttgtgccctgtcccctgccacccatctgttgaaatcctaacccccagtgggataatattaggaggaggtcaggcctctgggcagtaattaggtttagatgaggtcatgagggtagagccctcatgatgggattagcatccatagaagaagagagagacaagattctctctctccgtgtgtgttctcacaccaaggaaggccatgtgaggttgttttcaggaaaaggactgtttccatgctgctgtaaagataaactcaagattgggaagaaaaagaagtttaattggacttacagttccacatggctggggaggcctcaatcatggcaggaggtgaaaggcacttcttacatggtgatgacaagagaaaatgaggtgatgcaagagcagaaacccctgataaaaccattggatcttgtgaggcttgttcactaccataagaacagtatggggggaaactgcccccatgattcaaattatctcccaccaggttcctcccacaacatgtgggaattataggagtacaattcaagatgagctttgggtggggacacagagccaaaccatatcattccatccttgacccctccaaatctcatgtcctcatatttcaaaaccaatcatgccttcccaacagtcccccaaagtcttatctcatttcagcattaagccaaaagtccacagcccagagtgtcatctgagacaaggcaagttccttctgcctatgagcctgtaaaatcaaaagcaagctagttacttcctagatacaatgggggtacaggtattgtgtaagtacagccattccaaatgagagaaattggccaaaacaaaggggttacagagcccatgcaagttcgaaatccagaagggtagtcaaattctttttttctttttctttttttttttttttttgagatggagtctcgctcatcgcccaggctggagtgcgtggcacgaagggcagtcaaattctaaacctccaaaatgatctcctttgactccatgtctcacatccaggtcatgctgatgcaagaggtaggttctcatagtcttgggcagctctgcccctgtggttttgcagggtatagcccccctcctggctgctttcacaggctggcattcagtgtctgtggcttttccaggctcatggtacaagctgtcagtggatctacaattctggcgtctgggggacagtggcctgctcctagtggagcccccacacagctccacgaggcagtgccccagtagggactctgtgtgggggctccaaccccacatttcccttcactgccctaccagaggtttccatgagggccccgctcctgcagcaaacttttgcctgggcatccaggcatttccgtacatcttctgaaatctagacggaggttcccaaacttcaattcttgacttctgtgcacccacaagctcaataccatgtggaagctgccaaggtttggggcttacgtcctctgaaaccatgggctgagctgtaccttggccccttttagcaatggctgggacacagggcaccaagtccctaggcttcacacagcacaaggtcctggggccgggcccatgaaaccattctttcctcctaggcttctgggtctgtgataggaggtgctgccatgaagacctatgacattccctggagacattttcccccttgttttggggattaacatttggctccttgttacttatgcaaatttctgcagccagcttgaatttctcctcaaaaactgggtttttcttttctactgcatcgtcaggctgcaaattttctgaacttttatgctctttttcgcttttgaaatgaaaagctttaacagcacccaagtcaccttttgaatgctgtgctgcttagaaatttcttccaccagataccttaaatcatctctctcaagttcaaagttccacaaatctctagggcggggcaatatgccaccagtctctttgctaaaacatagcaagagtcacctttactccagtttcccaacaagttcctcatctccatctgagaccacctcagcctggaccttattgtccaatattactatcagcattttgggcaaaaccattcaacaagtctctgggaagttccaaactttcccacattttcccggcttcttctgagccctccaaactgttccaacctctgcctgatacccagttccaaagtggcttccaggtttttggatatcttttcagcaacgccctgctctactggtaccaatatactgtattagttcgttttcatgctgcttataaagacataccctagactgggaagaaaaagaggtttaattggatttacagttccacatgactggggaggcctcagaatcatggcgagaagtgaaaggcactttttacgtggtggcagcaagagaaaatgaggaggtgcaaaagcggaaacccctgataaaaccatcagatcttgtgagacttattcactaccatgagaacagtatgagggaaattgcccccttgattcaaattatctcccaccgtgttcctcccatagaatgtggtaattatgggagtacaattcaagatgagatttgggtggagacacagaggcaaaccgtatcaaggaccctctccgagaacctgacgatgctgacatcctgatcttggacttccagcctccagaaataaatgagaaataaataggtgttatgtgtgccacccagtctgtgatattctgtcgtagtagctcaaactgacagagacaggcactgtggtgtactcttcttgagttcaaataaatttaaaagtattttatgagattagcaacatgatatgatagtaaagaataagtatgacacagccattttctataaaggaacttgcaaacttcctagcttcctggcatttcctctttgctcagacacaagcctagagtcttctgatttgtcttttcccttcccccaatcttaattaattatttattaatacaatttcaacttttagattcgggggtacatttgcagatttgttccatgggcatattgcgtgacactgaggtttggggtatgagtgatcccgtcacccaggtagtgagcatagtgcccaacaggtagtttttcagcccttgttcccctccttctctcccttctctagtggttcccagtgtctgttgttctcatcccatgtctacgtgcactcaatatttagctttcactcgtaagtgagaacatggggtatttggttttctgtttctgcattaattagattaggataatggtctccctgctgattttaaacttgccctctgcctctcatttcaaagaaaaagaataatgagtcttgttctaaggccttttcctcacgatttaagcagggtttggggcaaaaataaaaaaaagacctacagcttcgctcttgattagaagatgaccaaaagtctatgggagttatggaaatcatacaggttttaagattcagccatatgtaataacagtagcaatatattatggttttaataatgctatcttctatagcatttataatatgttcagcactacactaagtgcattatatgtattaagtcatttcatcctcacaacactctaaaataagtactaatgttttgcagctgagagaactcagtcactgtgatattaacttgcttaagatcactcagctgaagtggaaataccaagacttcaactcatgtttttggccttacaatattactataaagtcttaatccattcagataattgttagaattattgcattgaattagctcaatgaaaaatacaattggagaaatataaaatctatactaaatattttttgatctgtactatcagattctctttcttggatcgaagtgtaaatttgtgtaaatcactgttagaatatgcgttgcattaataagatttttatttttttaaccacctttgataagttccacaaaaattttagtagttacctcaaattcttcattttttttctattttatgggatttcaccatgtataggtcttaagatggatatgacaactcaagtttagattcagtcttgggaaataatcactatgtggcaaatttactatctgataagttattgattgtatctagttctcttcacttctggttgctcttgcaggtaaataaaattatccacttccatgtctaccagtggtatgtgaaaggaagtaataggtaggactagaaagatcctttaaaatcaatcaattactccttgtatttttcagagaaaaagaagtcccagactgataaaatagtcttgaccaacataatttacccaaagaaaaggtagaggtgaatatagagcatgcactctagtatcaggagttctaggctaaatcttggctttgcaattgattaatcaaaaatcttagacatgttatttagtctcttggaggatcaagtttttaactggtaaaattagagatattaaagatgatagtatctctcatgaaattgtcatgatgatcaaatgctcaaatataaggcacagtgttttgcaaactattaagtgttatacaaatgtttagctgtaattaatagactttgcttcccaatttggagagaaatgctataaaatgtgtacaccatcaacaatttggagttggttcttgtatgaagacaagaacagaagaaattatagcttctttattacatgttttataaacagttacaggcattatcttaaatactaaataattagactacaattcctgcttcattttaaagtcatatgtttataatctcataaaattatttttagggttgcccagtgcaagtagaacaggactacccccctcatcatcttatttttgatatttttcataaatcacatttaaaatttgaaaggaatgtctaccatttgcccactgccagactcctcttataaggtattccacatgcctgttgccaggtgagtagacatgaaactggattctgggagagctggaatcaaagagggatgtatgctaaagtcagaaaaggacaacaggggaacactctcccatgatacaggatttgataccctggcaaggaccctaggaaacagtgcaagcatgctgatagaatgaaatttgtagtatgaagaaagtgatgagccacaataagcgatgtagaaaatgctagaattgacatcccagagggtgaaataagggattaaaagactaggcaaagtgggcatgctaaagtggatataccatgtatatggaaagatcaccagatacctagtttccatggaaggcctagaaccatcactgtttgcaatcaggaacattttggtgagaggagtaccaatatcagagtcttagcagtagctctcttctgtagaccagggctgatgatagcagacgctatttgtagtaggctgaatagtgcctaccccacctcgaccaaagatgtctatgtcctaattctcggaacctgtgaatgtgtaaccttcatagtttaagggactttgcagatttaattaaattaaggattctgagatgaggagattatcctggattacataggtaggcccaaagtaattacaggggctccttataagagaaaggtaggagggtcagagttagagaatgcaatgtgacaatggaagtaggggttggaatgatgcagcaatgaactaaggaatgcaggcagcctgcagaagccagaaaatgcaagtaaatggattattctctagaggatccaagggaatgcagttcaggtaacactttgattttagcctagtggacatattttggattttgacattcaaatctgcaagagaagaaattttgtgttgctttaggctactgtgtgtggtaatttgttacagtagtaatgggaaatcaatacacttaaagaactgggccaactggtggaaatgacactctaagacaaccgagataaaatggtaatgcttaacagtaaggagtcaggtcgatgcagttacaataaagaagagcaaggtttgagtggtagtcagcagatgtgagacacagagggttacaagagatgatgaccagaacatggtgtccttaggggcaagatagacaggcagccaacacagatactactcagtctatacaatgaaaagaaatcaagaatagatgtccagaaggctgaggccagttgctttagttaaaaattcatgattcctcttctaaatttttggttttcaaaccccaaattcattgactgaaggagaggccaggtctctaacaaaaagggctcttagaaagtgtatgtggtaacagttcatctaatactatcacagtaggactctcctatatttgggtaactatattctgaggaaagataaatatacaaacattttaaggactgcttaaactcagaatctgagttgatattgttactcagagaaccaagaatctcatcacagcccctctattagaatgaagacatatgagggtcaagtaataggatcctggctcatatactgctcacagggtccactggttccaaagatatacttcggatttattttcctagtctttgaaggtatcgtttaaatgggcatacttgatagttgacacaactcccactttggttctttggcctgggaagaaagggtaatcatagcaaggaagtttaagtggaagtttttgaaactgcatccccatgtggccaagatagtaaatcaaaaaacaatattccatgtcaagaatggtagaaattaatgcaatttttaaaagttgcagaattggtgatactatattttcatttgatccactggtctgatctctacaaaactgagatagttcctggaggaatgaaaatagatactataaactccgtcaagtagttgccctaattgcaattgccataccaaataaggtaccttttctagagccaattaaaaagaaattaggtacatgtatctgggaaatgtatttaagtagaatgtaagtggcactaaccacagttctctacactgcacctgatctcaaggatgtaaatgatcgtccttatctctctcctctactgtgaactccagaagaccctcaccttcagctgttcaaggtgatttactgatagcatgacccaggctcccatctgtgaggggtctgagcccttggctcacaaagcccttcttagggcacagcttttatacttgcccatttacatcgagattggtcaacgatgtatcaagagccacgtaggtgggagccaaacatgttcctcctgccatactactagaatatggttaactgacaacctatagctgttgacttattcaaggtccacctctacttttgagccacgaccatgctcttctcagggcagccaatgactgagtaaaatggcagtacatgggcctaatcatttctgcctaaagtaagatccctctaatgggttcttctaataagctctctgctccagaattcccccagttgagctggagagacatttatcagtcctacattgtgatttgcttaatcccttgccaaatgctgtctcctccttttgtgtttcacaggtgttacctcccctcccccaataccttgtttttactcctaactccatctctgtgtctgcttcctaaagaacctgagtgaccagcacaaggaggtagtgtagggtagaggcatgtggatgcatctatgggaatgagcatatggtatgaagatatttttattacttgttgtagtggttttaaaaattcattgataatcttctctggttcctggttcccctcgtcttgagtttaggctgaacctagtgactccattgtaatgaatagaataaagggaaagtggtgatgtgcaactctggagactagtttataaaaggcactgtagtttcctgactcttctctcttgtatagctttctctgggagaagcaaactagcatgtcatgaggacactcaggtatcactggaacagcccatgtagtgaggaacagaagccttcttccaacagcctgagtgagcttggagagagatccttcagtccccagactgcaacctcaggcaacaaattgactacaacctcttgaaagattgtaaactagaaacagcaatttttagttgccaagagttggaggaatttgttaaacagcaatagttaacaaatatagatccccagaaataatccacagttgaagaggcactgaagaaacagagaaaatgacttgctcagttatcatcggtcagcctctggcatcagccacttcagtgatagtataatggttccaaagatagagaagccatgtgggcaaggacagaagctattcatggttccaataacataggctcccattcaccaagcttatctagctactgctgctcctagaagtccaatctgacaaaaatagagcacaacactgaaacatcctttgaggaaagcagtcaattaggccagataattacattagatcctttcttctatagtgcagaaatgggcacatgctcttagaattcagttatgtcagtcacatcctatcccataccactgagcagctgctggcctgacagaatgatggaagcatttgttgaaagtacaactaagatagcagctcagagatgattccttacaagagtggggcatcatctttcaggagatagtatgcattttaaatctgtgaagtatatggcactatgtcccaagtaggcaaatatatgggaaccaaagggtaaaagtaggagtggccctatttgccctcctgtcagagactcggtaggggaacttatgtttactgtccatgccattttgatgcatagaggtcatcatgttttgaagacctcctttcaaagggggaatgcttccacttgggtcccattaattaagctacaactgtcacccgtgcacttcaggttgctcctgctaagagatagcagtcagagagagaactcaacattctgaaagaggttattgagccagatcatcaagcaaaggtaggaccacagaagcttgaaatatgttagtgcattgtagcttgctcatgtactgcttttggaatcctgtgattaccatgtgataaagtctgtgttaacctgctagatgatgacagacacatggtaccattgtccatgtgcctcagtggataggctgccaaatatcagtcatatgagtgagactatcctaaattaatcagccatcagcgaaaccacccactgagtgtagcagaggcttgagcaatccaacaaaaatcagctgaggtgatttagaccacagactcgtaagttaaataaatggtggttgtgttaagtacctaagttttagagtggtttgttaaggagcaagagtgagctgatataagaaacagcttgccaagagaagggttttagaaaccagaatactgtggcttttttcttaaaacctatatgatccaaggatcattttgagaaaatgggtattcgtgcttctgaattaaatattttatcatctaccatgatcccatcctggtgacttgaatgcaaccacaggcgaatcttgaggatttctttattttacattaggtgtaacctgaagtaatgacctagtagcctgctacatgttatcctttcctctggttctacttggacccagcttggaattcttaatctgatggttgtgttcttatgggctccagtacaaacacattttagacagaaaatagactgtaggattattaatcatacatattgtggggtgaacttgagaagtagccctgtacccaccatgcagttatgatctgtatggcttttatttcctttttttttttttttttttgagacacaagagtctcgctctgtcacccaggctggagtgcagtggcacaatctcagctcactgcaacctccacctcccaggttcaagcgattctcccgcctcagcctcccaaatatttggtactacaggcatgtgccaccatgctcagctaattttttgtatttttagtacagatgcggtttcgccatgttggccgggctggtctcaaactcctgacctcgtgatccaactgcctcggcctcccaaagtgctgggattatggatgtgagccactgcgctcggccagcttttatttccttttattgacttattgcactggctgaaactttcagcaccatgttgaataagagaggtgaggagtgcacattcttgacatttccctaatcttaggatgaaaatattctgtctttcaccattaaaaataatgctagctgtggggtttgcttgtgatgctctttatcaagttaaagaagttcccctctatccctgtttttctaagaatttctgtcatatatgggagttaacttttttcaaagggtttttctgcatttaacaatatgatttttcttctataagcctgttgatgtggtggattacattgatttgctaatgttgaaccaggcttgcatacctgaaataaatctcattttgttgtggtatataattctctttaagcttttttaaaataatttttaagaattaaacttgctagcattttattgatattttttgcatttatgttagggagaaatattggcccatagtttttcttttttataatttctttacctgttttaggcattagggtaatgctaacctcggaatgagtctgcaaatattctctttgcttctatttctggcagacattgtagagagtttggatcatttctgcctcaaatgtttggtagaaattatcagaaaaaaaaaagacagaacatggtgcttttatttcagaagattattaattatattgattactaattattgattcaatttctttattacatattacctttctcagaccattctggctgtcataacaaaatactttaacctgggtaatgtataaacaatagaaatttatttcttacagttcttgaggctgagaagtcgaagatcaaggcaccagcaaatctgatatctggtgagagcctctttctcaaagatggcatcttcttgcagcatcctcacatggtgaaaggggcaaggcggctcccttcaacctctttttataagatcactaatcccattcacaagggccccacctcttaatattattactgtaggtattcggtttgaatatatgaattttgggggagggacacaaacattcagacaatagacatattccaattatttattatttcttttacaaattttgtagttggtgtcgctaaaggaattggtccatttcatttaagttatcatatttgtagacacagttgttcatagtattcctttttattgtccatgggatcagtagtgatgacttgtctttcatttctgatattcacaattcgtcttttctctctttttaaatacatgtcattttggcagaggttcatcaattttattgattatttgaaaggatcagctcttctttcactgattttctcttttgttttcaattttattgatttctgctctttattattttcttctttctgatagctttgtattttctttttggtcttctttttctaggttcttgagacagtagcttcaattatggatttgagacttatcttctctaatgaatgcatttagtgctattaattttcctctcagcaatactttcactgtgttctacaaatgttgatatgttgtattttcacttttcactgagtttaatgtgcttttaaaaatttttgagacttcctttttcatccaaggattatttagaagcatgtttttgaagtgtccaagggttaggacatttttctgttatctttctattattgatttatagtttgattttattgttgtcagagaacaaactctgtatagtttttttaataagtttacattccagttccataagaatgtggaaacatagaaacaaatgaagacaaataaaatgatccccaatttcccaacagatgtcaactaatattaatgttaatcaattgatatttctataatatgcttatttatataggtatcattatgcttatctcaatattgtagacaatattgctttgatcttattattctgcttttttccctttacatttctctcaccttaaatatttttgaaagtacgatctttttttcttaaatgtaaaatctcttcacaattaagtacatgattgtatatgtttatcctacatgtcagtaaatcaccaactagaccagttgcagtggctcatgcctgttaccccagcactttgggaggccaaagcaggcagctcacttgacgtcaggagtttgagaccagcctgaccaacatggagaaaccccatctctactaaaaatacaaaattagccagcatggtggagcatgcctataatcccagctacttgggaggctgaggcaggagaatcatttgaacccaggaggcagaggttgcagtgagctgagatcataccactgcactacagcctgggcaacaagagcgaaactctgtctcaaaaaaaaaaatcaccagctattataaaaacaagacaaattatatcacaaaagaacaaaaacatagaaagaaatcataagaaatatatcgacctgtgaaaagtgtctttcttttggtgtcttcacatcctagtcttctgcgtatttatgtatggaacagtattgccttggatagatgcatctcttacttactcttcagttgtccatttgcatattctatcagctccagggatatcaagctctatataattttaattattttaaatttattaagtttttttatggctcaggttatagtctatccgggtatatcttccatgcaagcttgagaataatgtgtattctgctgttaggtggagtgttctatagaagtcaattagattatattgccttatgttgttgagtttattctagattatttctgaatattttgtctaatatttgtatcaaattttgatattaaaatatcaaaaattaaaattcccaactataattacacacttgtctatttgtctttcaagttctatcaatttttgcttcatatattttgcagttctgatcttggggacatacctatttaggaatgcaatatattcttgctttgtgtaatgtttctttcagtctggtaattttctttgctgtaaagttgactatacctaccattaatactagtcaatgtttaagtgatatatctcttaatatcattttactttcaatctgtctatattgtcatagtttgtgtgggtttcttatagacagcatatagttaggtcatgttttaaaatctactttgtaaatctgtcttttaattgacatattttacccacttacaaataatataattattgatacgtttgggaaaacatctgtagttttttttttgttttctgtttgttttctctattttaatttccctatttttttctgaattctagttttgatatatccattttaatatctctatagtatttttgagtgtatccctttgtatagctttttgatggttgctctagataacttattgtatattatttatataaaaataaataattataatttataattattatatatacatgtctatcatagtctatttgtgtcataattttgccaattagaatgaagtgtataaaccttaccttcctttatgcccccttactctcccccatttatgatataattatctcaaatatctcctctacattcacatagaacaatgtcagtgttataatttttgcttcagtgattaaacataatttaggaaactcaagaggagaagaaaaatctgttgtcttcacttgtatttttgcttaccatgtctttctttatttgatgttccaaaggtcctttctttatagtttcctttgtgtttagagaacttttttttaattatactttaagttgtgggatacatgtgcagaacgtgcaggtttcctacgtaagtatacacgtgccatggtggttcgctgcacccatcaacccgtcatctacgttaggtatttcttctaatgctatcccttcctatgcccccaccctttgacaggccctggtgtgcgatgttcccctccctgtgtccatgtgttcttattcttcaactcccatttatgagtgagaacatgcagtgtttggttttctgttcctgtgttagtttgctgagaatgatggtttccagcttcatccatgtccctgcaaaggacatgaactcatccacttttatggctgcatggtattccatggtgtatatgtgccacttctttatccagtctatcattgatgcgcatttggtttggttccaagtctttgctgttgtgaacagtgctgcagtaaacatatgtgtgcatgtgtctttatagtagaatgatttataatcctttgagtatatacgcagtaatgggattgctgggtcaaatggtatttctggttcttgatccttgaggaatcaccacattgtcttccacaatggttgaactaatttatattcccaccaactgtgtaaaagtgtccctatttctccacatcctctccagtgacttttcaatgatcaccattgaaactggcataagatggtatctcattgtggttttgatttgcatttctctaatgaccattgatgatgaacttttctcatatgtttgttggcctcataaatgtgttcttttgagaagtgcctgttcatatccttcacccactttttgatggggttgtttgtttttttcttgtaaatttgtttaagctccttgtagattctggatattagccctttgtcagatggatagattgcaaaacttttctcccattctgtaggttgcctgttcactctgatgatagtttcttttgctgtgcagaagctctttagtttaattggatcttatttgtcaattttggcttttgttggcattgcttttgatgttttagtcatgaagtctttgcccatgcctacgtcctgaatggtattctgtaggttttactctagggtttttatggttttaggtcttgcatttcagtctttaatccatcttgagttaatttttgtacaaggtgtaaggaagaggaccagttgcagttttctgcatatgcctagtgagtttttccaacaccatttattaaataaggaattctttccccattgcttgtttttgtcaggtttgtcaaagttcggatggttgtagatgtgtggcattatttctgaggcctctatcctgttccattggtctatatatctgttttggtaccagtaccatgctgttttggttactgtaggcttgtagtatagtttgaagtcaggtagcatgatgcctccagctttgttctttttgcttaggattgtcttggctataggggctcttcttttaaagtagttttttttttttttctaattctctgaacaaagtcaacggtagcttgatgggaatagcattgaatctatgcattgctttggacagtatggccattttcacagtattgattcttcccatccatgagcatggaatgttttccattttttgtgtcctttcttatttccttgagcagtggtttgtaattctcctggaagaggtccttcacatcccttgcaagttgtattcctaggtattttattctgtttgtagcaattgtgaatgggaattcactcatgatttggctctctgtttgtctcattggtgtataggaatgcttgtgatttttgtaccttgattttgtatcctgagactttgctgaagttgcttatcagcttaaggagattttgggctgagatgatggggttttctaaatatacaattatgtcatctgcagagacaatttgacttcctctcttcctatttgaataccctttatttctttatcttgcctgattgccctggccagaactctgttgattaggagtgttgaaagaggacattcttgtcttctgtcagttttcaaagggaatgcttccagctgttgcccattcagtatgatattggctgtggttttgtcatatatagctcttatgattttgagatacgtttcatgaatacctggtttattgaaagtttttagcatgaaggggtgtttaattttatcaaaggccttttctgcatctattgagataatcatgtggtttttgtcattggttgtttttatgtgatggattacgtttattgatttgcacatgttgaacgagtcttgcatcccagggatgaagccaacttgattgtggtggataagctttttgatgtgctgctggattccatttgtcagtattttattgaggatttttgcattgatgttcatcagagatattggcctgaaattttcttttgttgtgtctctgccatgttttgtatcaggatgatgctggcctcataaaatgagttagggaggagtccctctttttatattgtttggaatagtttcagaagaaatggtaccagctcctctttgtacctctggtagaattcagctgtgattcagtctgttcctgcgctttttttggttggtaggttatttattactgcctcaatttcagaaattgttattggtctattcggggattcaacttcttccttttttagtcttgggagggtgtatgtgtccaggaatttatccatttcttctagattttctagtttatttgtgtagaggtgtttatagtattctctgatggtagtttgtatttctgtggtatcagtggtgatatcccctttatcattttttattgcatctatctgattcttctctcttttctccttcattagtctggctagtggtctatctattttgttaatctttttaaaaaaaaccagctcctggattcattgatttttttgaagggtttttcatgtctctatcaccttcagttctgctctgatcttagtatttattgtcgtttgctgacttttgaatttgtttgctcttgcttctctagttcttttaattgtgatgttaaagactgtcaattttagatctttcctgctttctcctatgggcatttaatgctataaatttccctctaaacactactttagcattgtcccagagattctggtatgttgtgtgtttgttctcattggtttccaagaacttatttatttctgccttaatttcattatttacccagtagtcattcaggaggaggttttctgtttccatgtagttgtatggttttcagtgagtttcttaatcctgagttctaatttgattgcatggtggtctgagaggctgttatgatttccgttcttttgcatttgctgaggagtgttttacttccaattatctcgtcaattttagaataagtgtgatatggtggtgggaaaaatgtatattttattgatttggggtggagaattctgtagatgtctattaggtttgcttggtgtggaactgagttcaagtcctgaatatccttgttaattttctgtctcgttgatctgtctaatattgacagtgggttgttaaagtctcccactattattgtgtgggggtctaagtctctttgtaggtatctaagaatttgttttatgaatcttgttgctcatgtattgggtgcatatatatttaggatagttagctcttcttgttgcattgatctcttcactattatgtaatggccttctttgtcttttttgatctttgtggtttaaagtctgttttatcagagactaggattgcagcccttgccttttattttgctttccatttgcttggtagatattcctccatccctttattttgagcctgtgtgtgtctttgcacattagatgtgtctcctgaatacagcacaacgatgggtcttgactctttatccaatttgccagtctgtgtcttttaattgggacatttagcccatttacatttaaggttaatattgttatgtttgaatttgatcctgtcattatgacgttagctggctattttgcccattagttgatgcagtttcttcaaagtatggatggtctttacaatttggtatgtttttgcagtggctggtatgggttttttctttccataagcaatttttatttcatgtagatctgctggcagcaaattatcttcatttttccttagaatgtcttggtatctgtttcatccttaaaatatttttttttctgaatataagatttggtgttgacaattttctttctgaacttgaaaagtgttttcttatttgcttttcacctccacaatttctgatgagaaattctctgtcatgaaaacagatttttacttacaggtagggtgtaatttccctttcattgatttcaagattttttctttgtgtttaattttcaaaactttgtcaataattttcttagtgtatttatttgagtatattctgtttggtatttgttcaccttcttgaatctgtagttttatgtctttttccaaattgtgatgcttccagccattatttcttcaaatagtttttttttcttttttggtctcatctatttcccctctctttcaaagactctaatcacacaaacagtagatttttttgttatagtcccacagattccttatgcttagtgtatttttttccttctattttctttatgttgttcagattggacaatttctattgttctatcttttatatcactgcttttttcctctgttccctccattctgctgtcaagcttatctgttgaggtttgtttgtctgtttgtttaggttatcgtatttttagttctaaatttttttatttggttcttttgtatacttcttttctgatactttctatttctttttttttgtactttaagttttagggtacatgtgcacaacgtgcaggcttgttacgtatgtatacatgtgccatgttggtgtgctgcacccattaactcgtcattgaacattaggtatatctcctaatgctatccctccccacttccctcaccccacaacaggccccggtgtgtggagactttctatttctttaagaggctttaaaaatttttttcacttcaagaatgtttgtaattactcatagaagcatttctatgatggctgctttaaaatctttgttagctgggcacaatggtgtgcatctgtagtcccagatactcaagaggctgaggtcggaggatcacttaggcccaggagtttgtggtggcagtatactatgcttgtgcctgtgaatagccactgcattccagcctgggaggcaaaggtagaccccatctcttaaaacaaaaaagacagatattaaaagcatctttgttatataattcattctaacatctttatcaccttggtgttgacatctactgattgtcttttctttttttcccattcaccttgagatatttctgctttttgctgttatgaataattttttattgaaacatgaaattttgtattttgtgttaagggtcgccaggtctatttaagctttctgtactagctgatttcctttgacgctgctccagcatgggaaagggatggatgttccttgctactggcaggtcagggagaagaagggcaggttccttacatgatctatgctgacacctaagagtgggtgtcctctgtggcctccgctgatgtttttcttgatgagagaaaaaggaatgccttattattgctcccatgtgccttccactgccaccacagttggggtatatgtcctcactgacgttggttgggggcaaaagttctaactttccagcagggctcctatgacactaccatagtggggaggggtacttcataactgttgggcgtgccaggaaattcaggttccccaggtagtctacactggaaatatgggaggagccttgttaccacctgatagagatgaaagtcccaggtacctactcaatctctgtaacaccccagcaggaaagttagggtaacttgttagaggctggtgagggtggcaccccactcagcctatgctggcataggcagaggtggggacacagttctttctgtggtgtttagctggagtagaacagttacagtatacaagttttctgtcttactaggttgcccctttcctggtctttttgctaaggagaggaggctttatttatttatttatttctattttttgtctttactcactggcatttctgggttgctggcttcttcagctccaagtctgagatatatgaatccaaaagaaaacccaaggagcttaccaccatgtcatttcttgtgccctgtgtcccatagatggtctgctttcttctcactatcttttagagtctccttatatttattgcatataaaatgtccaaggtttctagttatcattagcagaaagaatgggaaaaatatgtctactacagtttcctggaagaagtcgcaagaattattttagataattaagtgattgaaaaaaagatcaaaggaagaatacaatttcatgacacatgagaattacataaaattcaaaattcagtgtacataagtaacgttttaatgcacatagttacattcacatacatattgtctacagctccttttgtgctacaatgtctgaggttgaatagctgtatcagagagtctatggttcacaaagcctaaaatatttactgtctgagcctttaaagaaagtttgctgatccctggcttacatcatggaattacttacattttattaacagtgagtagagtacttcctctatcaaaacttagagaaaaatgaatgtataaattcagatagactgtactcagttttagggaaatataattatctatagcaatcataagtaaatcctcatactgttaaaaaggtatatatacagttttcagtttacaccaaatgctactcagttaaggttgaataaattttccttaaacattgatgtcaaaatcactcttttaccattcttggttagtgcaaaattttttactcataattttttcttctagcaaagtctgctacaaatactgttatgtattttttctactgtcaaaatgttccccaggaaacctgaatgtttccacaaatattttttattataaatgtttttgtatgtttgtaacttcttttgcatgttgaaattctatagccaaggttgcaaggttgtcattgttgtaatgttgaccataagagtcataaacagcaagttgaacactaaatttgaaagacattgtgcaagaaaagaacaccaaaccaatagtattatttcccatttatctaacctttcaagggcacttagcagctagaaaaagattataaatacagacagatttcatgattagaagcttcattagtaagaaggtacagaatactaatcacaagactttcatttgcactgacaaggtctgaccttgctagcattcatcagtgacagtggaattgctccctggtggtatcaaccacaggaaagacagagaaaacatgtttttcgtggaggaattcatcaaaagtaagcagaactgtatcacacaccattgcttccaggagttcccccagagaatagctagcatcttatctgaatcagtttgtttagtctgtaaaatgtaaaatgttcaaagaaactttgcatgttaaagaaagtttaagctttgaaaccttggaacaacaactatcatttcacatgactcttcaccttaaatcatctaattgaccatgaataggtgctttggtcaatattaaatctagaaacatagatatagtatactctgatattaactaggaattataaatgttataaactcttgtaaatgtttccatttaaaaatattgtgaaactaaaatgattaatacattaaataaatcaaaattgtatattttaagtctggaagtgcattttcatattccaattataagtgtgtattaagcgactgttttcctaaatgtcattattttatatgaaaaatgccttcattgtctgaaagcattttactgagttccgaggtttgtgattggacaaaactgagcacaattttctcatctgcaaataatttactgctaatttgttgtaaagttagctaattaaataattattgtataaaacgaaatataatttagtggaagcgctaaggctctggagtccgacgggtctgattttgaatccttttaattgcttaccagttactggacctcagtttacttatctgtaaaataggaaaatactacccaacatccatgcaggattgaaataagtgttaggcaaatggtgattattataaccaaactccaaattgtgtaataaatacttcaaatacatttacagaaaaacaactaaagaagatcagcgagttaagtgaaaatctaattgagttgagagttgtctagggcttaaagattctctgtttattataacaaaaacattattattttacattttaatgtttctgaagttgatgttaaaataaatggacaatgaatcaggtcatgattaaattgtgtacagttagcattgtctacatactggccagcttatgagatcccacaagaatgtgaattttgactttaatttgggtccttattattgattaaaatgtctttgcaaagattaaactctgatacagaattaaaaagcttttattaaaacaaaatgtgatgaaaggccacagaaggaacagatgtcttaaagtagatcatgaaacttttatttctttaacttcaaaataaatactacggttagatttctcaaaattaaaaagataaatacaaaaatgtatattataaaacatatctaactcaccccctgtctctcagccacccaagtgttcttgccacagagaaatagctattggtctttcttttcatttcttgtaatgatattttatgcatatgtaaatagataaatttaatcatatacctttttgtaattcaagtgttgcatacacaccatacatatcatttttcacattgcttttttacaatatcctttggagatttttatagtcaagctaataaagaatttatcttttttgctttaacagctgtttagtgctccattaaatatacagaccatacattttaaccagtccccttttgatggacatacatttttttttcctaaacttgtataactacagtgaagtcatgaataatcttgtacaaagaacatggaattttcaaattaggaaaagttgatataaacccgttcattttgaaagatatgcatgcaggctcttggacatttctgagtgaaggagaacaggaaatatggttagagactagaagtgtataaactataggatgctttgaatgctgtggaatgataattcataatatgacaggaaatagtactgaactattaaaagtaacgagaggtcatgaaaagtagtatttaaggaagatgaatgttcagagtttttatttcctggcaccctggaattgtttggagctttgagaaagagctttatgagattttcttgttaaaataaaactattggtgtgatagagatacaagcaggcaagatgactaaatcagacaaaaattgtaggcagaggcagaaaattaggacctaaattctgaaagattaactcagatgagagaagcaagataatactctgacattttaagtagcaggcaaagtccagagtgcaaaaattcaagagtggatttagaaaagtacttcgtgaattttgaaactaaggaataggctatgtggtctttcccctatgtacacactattctgagtttgagtgaccctgggaaggtttatggctaagatatcaagttgtggtcaatatctacaagcaccatgcactcctgcttctcttttgccatatagattttctcagtttttcgtttgcttttcagtaagagcaaatatattaatattttttctttatagtgttttaatgttttattattagttgagaaagtttttcccactccaaatcatgtagtcacacctgtattctattctacagtttattgctctatatttttcatttaaattattaatctattggaaatttatattgatgtgtagtgtgaggcaggggaaaatcttttcaaaaccctttactattatcctgtggcattattttcttaatgtttttcctttaattcaatcaattcgtttcatctcttcatctttaatttcaaagatagtgcaaaactccttttaggtggcaaatcttttcataagacctgttttcccttctttactcatttttaaatatagatgactagtattttccaacaaactttacgattagattcttttaggactcccttcctgtctgctttcattctattaatgtcgtctttctgagatttacattacattacattacattatattacattacattggagggttggttgatatacgttataccagctcagtgattcagcagcattaggggcgtagagagggggcttgtgtagttacagcaaaggaatattttctctgttcaagctggtgtttgttggtattatagtacctgccattagctttcctgtctaatttacttttgtatctaaccttcattatggacacgtgtggctctgtctgacatccttcctaggacagtagcttactgcctcagggaggagctgcacctcagtcagaagaagccctgtttccttgccgtgtggtttttgtatggtatggtttttctttcccttgtgtctcctggaagagctgcttctgaaagtcattaatctgcaaaaaggttttaaaaatgaaataatttccatttgtcttccattctgcccacttggtagtccttactttatattgaagttttaagtgatttccataaaatgtagttatagccattttttattgaacaacagaaacacagacatcatgatactttccatactttatcttatttggagagataataaaacacagtggctaagagcatgaactctgaatacagagtatctgatttccaatcacaggtcttcccccacaagctgtgaaaattgttcaatttgcttaacttctctgtattttggtttccttacctgtaaaatggtgttataattcaaataaattaatatataaaatacttaaagcaatgctgagcacataataagcacaatagaagtgttttggttgttgttgttgtctttgttttaatggtggtagtggtggtggtagttatttgattttcacagtagacctgtaaggtactatttaagaaacgggcttgagaaacaggttcagagattttaagcttgtatatcatgtaattgcgtggaatacagttggtaattattaaatatttatttaatgaatgaagttacaatgatagcattaaagctcaggactggctgacatcaaagcttgagcttttaatccctattcctcaaaatatctcttctacttttgtcatggcaaatgaaaccactttctccagaatgggaattgcatattgatcctccctggcttcctttaatcttttatttatgacactgtatctgtcagaaattccttaaatttttttctatagagcttgtttccttctcaagttttcagtgcaatatgggctttccaaatttttttatgtgtttgtgcacacatgcatgtgcatgtggagggtgtatgtgtgtgttttaaataatttcacttggtaatgtggtgttaagtagaagaaggagagattatctgcttattgtcagtttgtccaatattctcttgtagttatatttttccttatttgggatctttgttagttaccagaaattgaactaggttaatatctgtagccattaatatttttaggttatgatttttacttatggcagtaggacctttctgactataactcatattagacctagctatccacagttttgttcataccttaaattaggggtcagcaatcttttttggtaaagttctaggtagtaaatattttaggctttgtgggccctatggtctctactcaattgtagtatgaatgcaatcatagataatatgtatacaaatgaacatagctgtgctccaataaaactttatggacacagaaacttgaattttatataatttttgcatgtcatagaatattatttgatttttttaaccatttaaaaacataaaaacctattccattcttagctttcaggtctcgaaataggtggctatttagagttcgtcttgcaaaccacagtgcattctctattcccccttcatgccctatatggctataatccctattattctagtgattccattttatccctcatactaagctagaattatcattcttaaacttaaatcactaacctgattatatcattcctatatcagtcagggctctacagaaaaaagccaatagattttatatatatatatatatatatatatatatatatatatatatatatgtgtgtgtgtgtgtgtgtgtgtgtgtgtgtgatatatatatgtgtgtttatattacacacacacacacacatatatataaaataaaacttattatgggaattggctcatgtgattatgaagaatgagaagtcctatgaactgcatactacaagctggagaaacaggaaagccagtgcagtaattcagctcaagtccgaaggccagagaaccaggagctccgatgtctgagggcaggagaatatggatgtcccagcccaaacagacagaacaaattcgcccttacatctgtcttgttctgtttgggttctcaatggattggatgatgctcattcacattggtgaaggcagatcttctttactcagattatcaattcaaatgctaatccctctggaaacaccttcacagacacatccagaaagtatgctttaccagctatctggacatctgttagtctagtacaattgacacatgaaattaaccatcataactcccctctttacaatcgtttgttgactctctaaactttatggcatgacatttccattcacaaaatctgcatagtctactctttcagacataccattcgttacttctctctcagcattccttagtcaaggcaatcccaattatttgctgattccgcagataagtacattcttttttcccctgggccttgaatttctttatcacactttgctacttggcatacttattcttacttattctttaaaagtctatttaaaatggcacgtattttatgaagttgtctctgaacttttaggaagaattaatcactttttcattcatggtttcatagcactttgaacattttttaacacagtgtatcattatgttataatccactttgttcatggttgtttataccaattttaatataaactcttgatgtaagagattgaattaattcacatttgttttccccaaacctggtatgtattttgtgcttcacaaatgatttttaatgctacaacaaagaaattacacatgaatgtttacatcagccatactttaccaaaaatctgctttttagggaagatttaaaaaatacagattatttttggaaagtacataatataatatatgggtttacctttttgcaaagcaaagaatcatttgataaagaaaaatttctctaaaatttctttgttttgaatttttttcttaatgggtttgaatttttaagcttatagtttcatttgccaaaaactatcaaggttttaaggaaataacagcttttgtgctgatagcttcgattaccacctataagtaagccaactgagaaaaaaaaatctagatctgatattttgagaggtttgtgtttgtttgtttgtttttgtaataaacacatcagcaaataaatattcccagagcaaatgtcctagggatgctaatggtgaaaatgcttcaggcagctattgatccaaactctgggccttcattctctgcctcctcatcctcctaattcatacatctcttctccttctttacggagaggctagatacatttatttatagatataagtgtagttcatgggaagaaagccaccgcacttgtatttgatagaaagcttcctggagattcttcagacttgtgtgccttgtgattatttgcctgggaaagcaacccaagttcgccaaagtaaagagtcagcacatgaatccctttgtacttttttggccattccttgtcctgagtgatacacagaatctatgcaatcattatttatagcaagatacaagaaaaaatactatagggagctaaaggtttcagtccacaaagtgtttttgaaattaatgttgatgtcactgatgacaaccactcagaattgttcatattcttttcttagtagtgtcaccgtgatttatgacatgaacagaatatgtttttttcatatcgtctctcttacctgaatgtcaggctctgttgctatttctacttctctgtagtggtgataattgaatgaggagaagcaaaaaagcttcagctgtcttaatttctgattaggaacataaattaactagaactagggctgcttccagaactccaaatcagttttttaaagaacacctttatctgtctttaaatgaaatataataatttctgaaggcaattataggctttgaataaagtaagtttatatatgccagtaagctaatcaaataattgctttatcttatgtgacttctagaatttataatatttgtgtttctcctataattctagaagtatacatcaattcaatgtttgcaaacctcagtaacacatatatgcacatttttaatgaagtcagtgattttgtgatggatcttatcttcaacagggtctaatttttttcatgtgccaccatgtacagtgacttcactcactggattttgttgttgttaaatttaaaagcatggtaaggacactcaagcctgtcatggattcttaattaaactttttggctgaggtctctcatggtcatttcctccttttggttgcctgcatccgtttctctttcatttgatagcagtgtgctaaattccttttggggagttatacttttccattgagtgtagttttaaaacactgtactgcaaatcaaggtgcactgccctaccctagttaggctactctgactctctcttcccacactttgatggaaaaataggaaaaaattaaaattcactcatttgaatggtattttccttatgaaattatgtgtgatgcttattgtcttgactccacaccaccatagttccattctattcatatctattctcttgaattctcatctgttctatgctgcactgggtatcctgccaataaattctttattttcttaaggtaatttgttacttgcagtccaagaactctaaattatttgatgtgaatctagccatggaaaatatttatcaagtcagcacctttcaactgttcacatcctagttggaaatgagcattagtaattataagaaggagcccacagttgaatgcatcttgattactggcacataatgcctgttttggagaaaaaaggacgcttctgcctgtcaatcaattgctcaaatgtgcaaagaaaagtgacagacctatacttaacacatactccattttcaaaacaaaaccattaccaacacctgaagtgttggatctaggggtaataaagcaaatttaatgagtgattcagtctaatacttcatgagtatctagcactgatgtggattaagtactaaaaacatagattatgaaacaaactccctttcttaactttctataggataggaggagagtagaaaggtgtcacaacttttcctatctactgggccattcccaacagcattcaaattcaaatgttctataataatatagaacattttatatatatatatatatatatatatatatatacactacaatatgaattatatatgtatgtatatacacatatcccttgcattttcaatctgcacttatttctcctttcattttctcttgaacacattgaaatttctcttgtcaaggtcatcaatgacctccatgtcaccaaactaacaaccagccctcagtcatcatcttctttgacttagtagtagatgactcgttaatcactctgttcttagagaaatacttattttgccttctaggaaaccatcttttctggattctccttctactcactggctgctttttcttggtcttgttcttttagatttactgaggtaggtgagccacagggagtagtccttgttgcttcctttattattattattttttataaataactcctcttacccactaagtgttattatctctccaaatggcttaatgtgcctcattatgtcaatttatatatgtaactcagagttctctcatgagttccagattcaaatatacaactctttatttgatatatgtacttatatgtttaagacacttcttaaaatttaatatgtgtaaatctgtattccttctttttttaaatgcccactgagcagaagggctccaagtggagtaaagctacgtggcatgaaattctaaatcttttgaggaaatgttttacataattttttactttctctgaacagcagaaaattgatttttctcctttattctacttctctctagctcacagaatatagtataagcatggcacatgtatacatatgtaactaacctgcacaatgtgcacatgtaccctaaaacttaaagtataataaaaaaaaagaaaatttcagaaaaaaaaacaaaaaaaacttggagggtgtcttagaagtctttagggaaaaagatatatttagtcctatattagaattctacaaagaaacagaacctataggatttgcgtgtgtgtgtgtgtgtgtgtgtgtgtgtgtgtgtgtgtaatttattagggaaattggctcacgttcactcccatgatatgccatctgcaaactggagaaccagaaaagccaaagtggtgtaattcagtctgagtccaaagatctgagaaccaggggagctaatgatgtaactctcggtccaagtccataggcctgaaaactggggggtgccgccggagtaagtcccagagtccaaaggcctaagaactaatgtctgagggaaggagaagagaaatgtcccagatcaagaagagagaggaaaattgcccttcttccacctttttgttctgtttgggttcccaaaggattggatgatgcccgcccgctttggagagggcagatcttctttactcagcctactgattcaaatggtaatctcttttggaaacacccccattacacacccagaaataatgttttacaagctatctgggcatctcttagccaggtcaagttgacacatacaattaaccatcacaagtctctcactcaattggtcctcatctacttgaatagctacttgtggaggtgaactttattaaatagctatttgttatatagttttcttaggctacacaaaagtctattttcttgcaatctccaccttggttccaatttagcctagatcaagcctaatcagttctttcttttatatttacagacttcagtatcccactgtctgaattcaaccccagtctcatttcatctgtttctctaccacataaataccgctaatccaatgaaacctcattttttccatgtctgttcataactgtcctcattagttgccttagttcccattgtctctaagcattgcttataagccctccacctattacttatccttccactctgaaagctctcactcttgaagtagtcctgtagcctcccagctctgctgctgtactagcactcatttttgctgctggaagggtcatgccactgtgctttttagcatcattacaaatgaatttagctggatcaattcagctggaccctttgctctgttatcaaagctggtaggtgactcttgctgcctttccatttctctgattcttcttctctctatttaaatacttgatattatcttttattctaaatagttagaaagaataaataagaactagtatttgataacacaatagggtgactatagttgctaacaatttaattgtacattttaaaataactaaaatagtataattggattttttgtaacacaaatggatcccatttttctcacctactcctcaggaagcttgctccatcaaatatttttatctttttcataccttcagtttttctggttccttccttttttttgcgtgtatttcatgttaaaaaaatacttggccataaatccctcttaaacgttgcctccccatcccatgttttctgcacaacccatcttttggaaagtgtactttgcacttactgtctctacttgctaatgttcaattcactcataaaaataactgacatttggattttgtcccaatgttccattgatatttctgtcaccaaggtcactaaaaatccccttcctgacaaatcaaattggtccttatcagacttcactttcctgcagcattaccactgttcatcactctctttcctgaccctctttcgtctcttccatgacaccacaatgtcctggttatttctcttaaatctctggcttcttatcctccaattattaagtattagtgtggctgctgaccctctccttttcttactctacattctcttctcttccagagtgacttattggctgtgctaactgagataaatcactggatctttgtatttttatcatctataaaatggaaaaaatagaacctgcttcatagtgttatggtagatattaaataaataatgcatagaaacgttttagagagcatctggtttataagaatgactcaatatgtgttaaatattgtaaggttattcagatactgaaaaatgcaatattgaaaaggtatcaattatcccgtcattaacttttacaataaatgtaatccccattatacttcaaatagtagtttttcaagaaacaacagatgctggcgaggttgtggagaaataggaatgcttttacactgttggtgggaatgcaagttagttcaaccattgtggaagacagtgtgatgattcctcaaggatctagaaccagaaataccatttgacccagcaatcccattactgggtatatacccaatggaatataaatcattctgttttaaagatacatgcatacgtatgtttattgcagtgctattcacaatagcaaaggcatggaatcaatccaaatgcccatcaatgatagactggataaagaaaatgtggcacatatacaccatgggatactatgcaggcataaaaaggaatgagatcatgtcctttgcagggacatggataaagctttaagcaatcatcctcagcaaactaacacaggaacagaaaaccaaacactgcatgttctcactcacaagtgggagttgaacaatgagaacacatggacacatggagggaaacaacatacaccagtcctgtcagtggggtgggggcaaggggagggagaacatcaggacaaatagctaatacatgtggggcttgaaacctaggtgatgggttgattggtgcagcaaaccaccatgacatacgtgtacctgtgtaacaaacctgcactttgtgcacttgtatacctgaacttaaagttaaaaaaagaaagaagtattgaaaagatataaattatcccctcattaacttatataataaatgcaatccccattatacttggaatagttgttgttgaaaggaaatagaccaactgcttagaaaactatctggaagataaactgtacaagggaaggcaaaaacttaaaacaaagtttcaggccgggcatggtggctcatgcctgcaatcccagcactttgggaggccaaggtgggaggatcgcctgagcccagaagttaaagaccagcctaggcacatagtgaggccccatgtctaaaaaaaaaaaaaaaaaattaaccaggcacacgatggagcctggctgtaatcccaggtactccagaagctgaggttgggaggatcacttgagttcaggctgctgtggccacaaactgagattgcgctactgcctgcactccaggctgggtgacagagtgagaccctaaaaaaagaaagagagagagaggaagaggaagaggaagaagaggaagaggaagaagaggaaggagaaaaacaactaagtttattggcaaaagaatcacaaaggtttaattaaacaaaatttttttttatatacgggtttcatacatgattttgtagtttggacattggctatccatctggaaataaagttaaatctataatttagaaataaaattaaaactgtaagttagatcattcataaaaatgtattccatgtgggttaaagtcacaaaattttaagaaattttaatatatgtattttaattttttaaaataaaatttggaataaaacccaatgggaacccctgtgttagtaagcctgataagaaaaaaaagcattcttcaataacacaaaaatcaaaagtcataaaaacttttcaaaatcaaatagataaagaaaaactataaactttaagagaaaatgaacctattgagaaggaacattttcaacatttatagcagactaagaattaagatcaaatctttataaggaaatgctacaactaactaatttttttttttttttgagacggaatctcgctctgtcacccaggctagagtgcggtagggagatcctggctcactgcaacctccgcctcccaggttcaagagatgcttctgcctcagcctcccaagtagctgggacgacaggtgtgcatgaccacgcccaactaatttttgtatttttagtagagatagggtttcaccatattggccaggctggtctcgaactcctgacctcgtgatccacccgccttggcctcccaaagtgctgggattacaggcgtgagccaccgcgcccggcctctaaataaaaatttttaaagagttaattgaaaagtgaatatgatatgagttggcaaatcattgaggagtaaatgcaaatgctaaaagaggctcaatttttctaaatatgaaaaatacacaaatttaaaatttcaagttttttgtaattaatttttaaaaatctatacaaacacagaataaatgatatgatatacctttacatacccaatagccagcttcaaaatttatcctcaaaatttctgtatttgcctaaggtaaattttagcatttaccctagagaaactcttgtgcatttgaacaaacgggtgtgtaaaatgatttttattaatcattgtttgcataaagtaaattggaaacattgattcccagaaaaatgaaatcattaaactatagtacatgcatactatgaaatgccgcgtggcattaaaaagtatgtgagttaaatgccaaaatcttcaagacacgctgttgagtgagaaaagcaagttgcagaataatacatagagtatcatactgttatttaaaaaaagaagcaaaataatatttatgtctctattcatctatccatcatctatcaatcatttatgtatttatcaaactgtagcatagagtggtataaaacgatattcattaacaaataacaatgattacttctggagaggagtgtgggattgttgttcatcaaagattctttatatttatcctaatatttgggatttttcacaataatacatttataattatgtaattaacaataaataccattataacaataattaagagcattggaataagcaagttgggtgtgaatctgaacagcagcacttattatacaggtaacttgggtctctcaatctcttttttgccattgtcaaatagggttaatttaatctactttgtggagatgctgtattaactgagataatgtgcataaaataatctataatatagagttggtattgagctgaagataaatctttgtactcttattaaatcaattttgaatatcagggaactgggagaaaaagtacttttttcctcagaagactgcatctgctcaccagagtttaattcaacaagggtgatgaccctgtcttaaacttgcaaattactgatgatgactctagtatctgatgtattgcaggtgtacatataatataccttttgtatagtacgtgtaaaacaaacaaatgcttgtacattaatatgacatcaatagtgtccaccagtaagaacagctgtcctactttctgaaattgtatctccagaacctactatgttctggatcttcacttggttttgaatagacagctcaaattgaatatattttaaaactgtaccttctatttttgtctataaatcttccttttcttctattttctttgttttatggcacctaatttattcttgaaaagtctttcatcattttgattattgttctactgtaaacattttagactttaacgacaaatgctgctgactttgtaagattttattttgcttcttttactgcactgtatgtatttatttttcttttttaaaaaatttaacttttagataccgggggtagatgtgcagatatgttacatgggtatattgtgtgacactgaggtttgaggtatgaatgatctcattgcccaggtagtgagcatagcacccaataggtagttttcagcccttcacccccttcttcttaacaatagtcctcagtgtctattgttcccatctttatgtctatgtgtacccaatatttagctcccacttataagtaagaacatgcagtatttgatttttctcttcctgcatcattttgcttaggataatggcctgcagctgcatctatgttcttgcaaaggacgcgattttgttgtgtttatggctacaaagtattccatcttgtataagtatcacatttactttatccaatccatcgttgatgggaccctaggttgattccacgtctttgctattatgaatagcgctgtaatgaacatatgattgcatgtgtatttcttgtagaatgatttattttcctttgggtatatacccagaaatgggattgctagatcaaatggtatttctgttttaagttctttgagaaatcttcaaactgcttttcacagtggctgaactaatttacattcccatcaacagtgtgtaagtgttccctttatctgtagcctcaccagcatctgttgttttttgacttaaaaaaaaatattctttctgactggtgtgagatggcatctcattgtagttttgatttgcatttctctgatgatcagtgatgttgagcattttgttacatgtttgttggctgcttgtatgtcttcttttgagaagtgtctgttcatgtcttttgcccactttttaatggagttgttttctgcttgttgaactgattaagttccttatagattctggatgtaggacctttgttggatgcatagtttgcaaaaattttctcccattctgtatattgttcactctgatgatagtttcttttgctgtgcagaagctctttggtttaattaggtcccaattgtcaatttttgtttttgttgcaattttgttgcactttaaatgtaatatttcctagggattcagtgagcttttctaaattggagaaatcatattttttcatatctgaaaactgtagtccattagttcttgatacttaccttctcccacttttttccttgcttctgagatagaactttctattttccgtgtctctttattgttcattctttttcaccaactccttatctcacattgatctattctaaaaaaaacttcagatctatcttctgtttagtatattgtagtgtcatctactatttattagttaaatttttgaaaaaattttaatgactttttttatttttagaatttatgttcagtttattttcgaataggcctaatcatttttatcatgtcttgttcttgttttataaaataaatacattcttttatctcttaaaattttttatttgtatgtatttaaaaggcacaagtgcaatttgttacatggacatattgcagagtagtgaagtttaggcttttagtgtatccatcaccaatgtacattatacccattaagtaacttgtcatcatctatccctcctccaactccctcaaccttccaagtctccatcatctatcatttcacactctgcatctatgtgtacacattatttagctcccatttataagtgagaacatgcggtatttgtttttctgtgtctgagttgtttcccttcagataatagcctccagttccatccatgttgctgtaaagacatgatttcattttttatggctgaattgaattccattgtgttatatataccgtattttctttatccaatcatccattgatggacatttaggttagttctatatctttgctgttgtgaatagtactgcattaaacatataaagtacaggtatctttttcatacaatgattccttttcttttgggtagctacacagtaatgggattactggatcaaatgatagttctattttaagttctttgagtaatttccttattgttttccgtaaaggttgtaccaatttacccatacacagtgaataagaacagtgcattcttcttttttttttttttttttgagacaaagtctcactctgtcgctctgtcgcccaggctggagtgcagtggcatgatctcggctcactgcaacctccgcctcctgggttcaagggattcttgtgtctcagcctcccaagtagctaggattacaggtggctgccaccatgcccggctaacttttgttttttttttagtagagacagggtttcaccatgttggccaggatggtctcaaactcctgacctcatgtgatccacccgcctcagcctcccagagtgctgggattacagacgtgagccaccacgcccggccagaacagtgcattctttgtttaacatattttctcaaccagttattttctttgattctttttttctgtttcttaacaaagtgttattttataatctcttaagttagctccattatcatgaatcttttgagtgtgaattttcccactcattgtgtccaatgtctgtcatggcagtgggtttctagtttgatttatagttttaagctgtgagctcatcttcggtagaggttggcttccatgggaaccatttgtgaactgtgaattgtagcatttccacatgagagtttagtttcatctcagttctcattgatttccctgtttctgaactactcttttctttatttccttctttcttcccttccttcctctctcctgcttctttctttcctttctttcttccttccttttgtcctttcttccttccttttgtcctttcttccttccttttgtcctcccttccttcatttttccttccttcttttcttatctttcatttgttccttccctccctccctcctcctctttctctctctgtctttccattccaaaagtcaagaattgtctacctcaattggttattttactttattgctgttgagctcacttacatatttctataaaagttacactttgctcaaatatagacatatatttaaatgtgtttgacttgggaaggatggtttttgctgtttcttgtataggtgcccttgtctatattcttcatttttatgaatgacaataatagcccaaatgccgaagctcaaaacctgataaaattcgttttcatgttgccttaatctctatatgtctttagatgtatctagtttattgctgttttgtttcattttatcatccccactgtctctgctttagttcagtcccttatcatctctcttgtggacaacggcaatatccttctcactggtttctgtgctttccatctgcccttttccaaacattgctacattgctgctagatttatctttctaagcacaactctgagtatgtgaattcactacttaaaacctattaatggtgtcttttcctcatactgaaaatcaaacttccttgattttgtggatttgctgagtcttatttcctgacatctcttcacacctatgtttctgcaatatcagaatatttctagtttcttgatttgcccaactgctttaggcctctattcctatatacatatcctttttctgtaaaactcttaaacttcactcttgccctatttatttgttatacctttagttttttcatactgctataacaaaatttagactgggtaatttataacaagagaaattgacttcttataattttggagactgggaagaggaacatcaaggtaccagcaaatttggtagctgccaagggcctgttcctcatagaaggttccttctatgtgtcctcatgtggtgcaaggggcaaataaactccctcaggcctcttttataagggcagtaatcccattcatgagggttaggtctaaccacctttcaaaactccccacctcttaatactatcacattggggattaggtttcaacatgtgaatttgggaaggggggaaaacattcagaccgcagcatacccatacttatgcttgaaaattcaacgtaaatattatatgtttttctaaaggaattcctgactagcccaaatctgacacatggtagccattgactcatttgtataatggctatatccacttacttttttatattcaaaccccatgtatataattcctataaccatcctttgtataacatgttctctcaaccacttattttcttcgacacttttgtcttttgaaaaactaattttctttgtttctttgattgtgacactcataattaaagacaccctaacagaaggctttctaataccataagattctttacctgagtctattcatttttttttccagtctatcaatcggccttccatgttgtaaattccttagtcttggggttcatggtggaggcctttttagaacgaatggagatcaagttggttcagtatgtagatgtcccagaatggtatcgttgcaaaaggcatgacagaaaacataagaataaagatgaaaagagacttcacaagatttagtgaagaactaatgttctagaaatcatgggaagactctggtcctaatgttgacactgacccaccagatgactctgggcacacagaataattgctctgcttctcaattctccaattgacaaaacacagggattagaatagggagttaataatgcttctgtaatctgaaattcttttactctaattgttaaattgcccaagttaaattatttgcatgaggggaggaaaaaatctttaaaaataataattgtcatgaattctataaaaattaaataattttaaatggataaatcctacttcagcaagtaaatctgtgagtatgtgagagaataatattgataaaaaacattaagctgactgtcaaaatattagagacatgggcagaaaatataaagacttcaaaatatatgttatatagttaaatatctggcagatttataaagctttgtaaaaatcagctatagaaattgcattttaaagtgtaacagtgaacagttttaacaatggaaaaaggctctgtactagcactaacaccaattagaaaataaagcattctggttttaattaatggatgttttcatggtgtctaataaaaatacaattttaaggacttgaacaatttaatctgagaaaatattgtgtatttaaagcaagtgtattttttaaataagcaaacatgtttacattcatcaattatagtaaaacaaaagctcaagaaatcccagagcatataatttcatgaaccgagaataaaatgagctctggacttacgacaaaatctgcccctgaatgatcttcagaactctgttcattttatgcagtagtttaagttttcttctgtcttggcccaacttacaaacagcagaaatctgagttgtgggaatataatttatgaacagaaaagattacttgtctgtgaattattttctgaagatgaaagtaaatatacaggaacatacggtattcctttaaaagttgccagatcataattgtgtggcaaggcagttatcagaaattaatccctctattgagagcaattgaagacactattctaatgtaggcccttttgaggaggcagcatgaacagaagaaaactcgcagcaaaggcttgaggggggaatgaatccaatccagcctgaaaaaatctgcaccaggtttgaaaaatcaccccatcctcccgtgtaagtgatgctaagaagcacaaactgcattttgaatctaagtccctgtattttctgtgaaggagctgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaagtaagcctttcccactttgggcatttttcctggtttatttctggcttattatatttcttacaaataatggataatgttgcatgttctataaaatacaatgctaaaaaaggaagtttttatttgttttttttttaagtgtcctgtgttaaagaaatcagtgataccagtcaatgtgaacagtcagttttaagattctatgatttccaataggtattcaggtacagaaattttgtttttaacctttgtagtagtgagctggagaatgaaatggtcacatagactagaagatattttgttgtgtttacgcttttacaaaatagatttggcccttactaattgatatcctttaaaaggaagttattcataacctgtatttcattttattcccacatactatatatttatcttcacttttaaataactctgtgttgcaacatttgctctcataattaaggggatagtctcaatgtttcccagaggataatggttcaaagtgtttctttcaccagagaaatgggcttttactgttatgtgtttctgttttataaatgaagatattattttccacaaacttccccaaatagaagcaagagcaatgtttctgagataatcttgtcggttctatagcaggatggaaaatcagaggagaccaaattgccccagctgtgtgtttatgaagcacagtagctattcaacacgtttaaaacgaagacagggagagtgtgtgcttgtcaaaggggccatgtgatttgtgtctgttgaatctgaatatcaataaggcaaagcgtagagcagctgccgttgaacaagacaacttggcattagcacacagtgttggataatctgggtcaccttctgtggctgcaccagtgagattgttacttgtacggtttacagttgaacatatattagagactgagtgaagaaataagtaaatgctgtgggtaggtagctgatggcacatatagaaaaaccaagtcaaactttaaacaaatgatcagtataatacttgactgcaacgcacactcacaaaagattttttttcatatatatttactaaagagttgttatttaaatagttatttaccctccttgaaacttaatgtgggccccaggcaatgaggaatgaggaagagaagtgctgtgtttagttgtgcaggtaggagaagaaagggagaaaaagaaataagtcataaaatgaatgtgaagtgagtttatggtgcattttatggcaaacagctttgtcattcaatgtaatatatatggaaattcctggagtttgctgcagtttgttttaaaggaaatgaatgtatgatatctttaattaaaagtatagtaactatgaattgataaatatatatcatttgtttttgctctctttgagtaagtgattttattgatagattctaaatactttgtaattattttatttgttctccagcatagtatttttattcgtttaaaaaagtacatttgaagtctcattttcttcgatttttaagcaggtagacttttgtctgtgttgatatatttattggcaagatataatcatattgctttcccaatcaaaacacgtagtttagaccttgttagctgagtttttttcccacctgactttaaaacaatctagcatcagccttcctttctacccttattacctagtattcttgacacaaattctgtgttccagacaagtgaataacataatatctagcagtaaaaattgctaacattgtgttaagcattttctatatcatatatgtcatttacttcttgcaacaaccctataagatagatactatcatagtaattcacattttatagaagatgaaacaaagattcaagtcactataccagtgtacctcaaactttgaggcacctcagggagctggaatgcctggttaaaatgtgcagcctctcaagtctagccccaggtacttagtagatcctaggaaactataatttaattagctcttcatttcaaatacaggtaaccagaagctctgagctatacaataaatctttattaagaacctactacataatgatgctaggaatcatcagaatagttaaatataaacatatctctctcttcaatgagattatttaggagaaaagataaacactatgagctttataactgttgtcactcttatatacataataaccctgtcaagtagaatttattattaattccattttgcagctgaagaaactgaggcacatagaggtttattaatttgtccaaggccatactactagtgaatggtagatctggaatgtgaacctggagatctggctctggagtgtgggctcttagcttgcatgtagttattcccatgaagtgataatgcataaggactttaagtgataatgcttaagcagactttattatgttctgcttggaacataatagcaaacaaagaaatgtccattatccaggtatggtggctcaagcctgtagtcccagcactttgagaggctgaaatgagttcacttaagcctagttcaagaccagcctgggcaacataacaagacctcatttctacacacaaaaatataaaaaattaatggggcatcgtggtatgtgcctgtagtctcagctactcaggaggctgaggtgggaggatcgcttgagactggaaggtcgagactgctgtgagccatgatcctgccactgcactccagcctggtaaaaagggctacaccctgtctcaagaaataaaaagaaagggagaaagaaatttcagttattaatatcatattaattgaaggaatcaatgattctttcttcgaactttgaaatatgttcccttaaatttaagagaaaataatcacctccagctccatactgtattttgtatctaaagttctaccttgctcagctaccaggggaacgctgtttatgttttgatcaacctttatgtccttccagttgaggacatgtgacatgaggaatattagagcagagttcaggaagtgacattccctttctgttcctgagcaggtagacattctcctaacttggagttgcaatgaatttgtcctgattgtttttatacctgttccttgattttgcaaaactggttctaatgtgtgggaccaattaaattttaataattcaagaagagctattattttttgcttctgatgtattaaaagagaaacttattagagtgagactctcctgtgatccattattcagagactgttttaaataataacagtactttataataaactctttttgggaccttgatgtatgaatctgttctgaagggttttaaagaaacaaccataccatgaattagaaaagtaatgtctatctctctagtcctttataaatttgggggtaaacaatattttcaatgtaaatgccacatcgagattaatttaaaagtaactgttttaatctacgtttaaagtatgatcacaacatgtaaaaaaaatgtggtttgacaaaactactttagagttaccagaacaatgttaaagagtttggggtagcatccagtcttccaaaaaccattagcaattattaagtaattgatttgaatggcattattttaaaaagtactttctaaagtactaaaagaatgaagaacaaatagagattaaataagaaataattgaatttgcttaatatgtcagagaaggctgatgttattcattagggagtaatcacatactcttaaaattctacatgtgtagaaacattgaaaactttgatcgttactgtgcaagttaatatccttgcagtggcattttgtaaagtgcctacctaattattagtgtgagaaaaaggtatctttttgcttcctcataaatgaaataatctcatcagtttacagtaaaatcatcactactccatgaaagttacccagggtttcctacattacatagcagagttaactgtggcttcttttattagatacttctcttagcaaaattttctggagaattgcatgcttttttttcatcattggtgattttcaaaaattatcattcatggtctcacaataacaaatactggaattcaagtggacaagaaaagttagagtgagtgtttaagcaaaccgtgctacatctatataatggaatattactcagtaataaaaagaaatgaactatcaagtcacaaaagcacatggagggagcttaaataaatattgctgtgtgaaagaagctcgtccagaaaggctacatattgtatgattccaattttatagcatcctgtaaaagacaaaattatagagacatggaatgatcagtggctgccagagaatcaagggtgtagagaagaggcacaggggacttttagaatagtaattattctgcataatactttaatggtgcatttgtcaaaatgtacagaattttacagtacaaagagtcaatctaattgcatgcaaatttataaaatcatttaggaaatcaaggaaatcccaggaagtaattcagactctgactcaacaatctaactgcattacaaatgtatgagataatctcacagaaggggttggggaaaaactgttcacctaagtagtttatgtacatttccttagatattacctgacatgctttccctgttctagtatcccatccaagatatcacagtacattttgctgtcttgtattttgaggttcctcttggctgtgacagttcctcaggctttccttgtttttgatgaccttgaaggttttgagttctggccaggtattttatagattctcccaatattggagttagttttgtgttttcctcatggtgaaactggagttatgggctattggaatgaagaccacaaaggcaaagggttatcctcattacatcatatctataatattatcaatgatttatacaatcaacatgatatgtgactgctgatattgaccttactcacctgggaggtggtgttatcaggtttccctgataactataaagttatgtcttttattcttctccatactgtactcttagaaaaggaagtcactgtgtgtaacccacacttaagaagtttggagttatgatctctctcctggagggaaaaatttacataaattattcgaaattcttctgcataggagatctggctcttctctttcatttatttatttattcaattgtttattcatatcagtatgaatctattgacatttattttatactctgggttataagtcaatactattttattttgttactcaaattattccatctttggcctgtgggagttcttttcagttggctcctattttcttttcacgtactccccatcaatgtggggtgctttttaaaaaaggattttcttcctttatggctctacaatccctttcagactgatcttgtgtatttcctgacccaatcctagcataaatcaccatttctccaaggagctctgtttccttttattagagaatggtaaccaaaaccaagatctggatgtgaggtgtgcttgttgctgctggggtgtcaggtcttttaggcaatctcagctgaaagagcacagaaatatgtctgtgtactagtccgtgtatatacatgtttctatagatatctctatatgtaaatctgtgtctgtctgtattaagctaaatatgagttcatattgatgcctctaactccatttccacatggatcattctagctgtctccccttgcttatctgtaaatttcaacagtgagaaacctgatttccactatctgccatttattcacttgtttaaattcagtatacatatatagcggtattggactgttaacccatactcctatgggaaacaactttaactgtttaggtacagtacttatagctgtttcattttgtttttagtttttcagaatccacttgtttccaaaactacttaggtgaacagttctcccccaaccccttctgtgagattatttcatacatttgtaatgcagttagattgttgtgtcaaagtctgaattacttcatgggatttctttgatgtcctaaatgattttataaatttgcatgcaattggattgactctttgtactgtaaaattctgtacattttgacaaatgcaccattaaagtattatgcagaataattactattctaaaagtcccctgtgcctcttctctacacccttgattctctggaagccactgatcattctatgtctctatagttttgtcttttataggatgctataaaattggaatcatacaatatgtagcctttctggacgagcttctttcacacagcaatatttatttaagcttcctccatgtgcttttgtgacttgatagttcatttctttttattactgaaaaatattccattatatagatgtagcacggtttgcttaaacactcacctactgaaggacaactttgttactttcagtttggggctattagttcctagggctactgtaacaaagtactacaaactgggtggcttaaagcaacataaatgtattctctcatagctctggaggctagaagtctgaaatcaaaggtaagaagccccttgcttccactgagactccacttggaatccttacctgccttttcctggcttctagtggtgtcattcagtcccgggtgtttcttagcttgcaactgcatcactccagtctctgctactatcacatgatattctcactttatctgtctacctctcttctattcttcttataaggacgtcagtcatattggagtagattcaccctaatgaccccatgttaacttgattacatctgcaaaaaccctatttacaaataagggcacattcacaggtactgagggttaggactctgacataccttggggacacaattcaacctataacatctactatgaataaaactctgatatatgatttaaaaaacacttggttaataccacttttattgggtaaaattggtttacaattgattttttaaacatagtaagtgcttggtaaatatttgtggagtaaatagttgttatgtttcaagagacattatatcgatatccttgtattaacatgtggtagaagaaagattatgctaaacaatgtgcccatattgttctcttattttccccctctttacactgtccctaccttttacatattcagcctttcactttgaattaagtgttcagaaatttcctcctatgtaaatttgccctatgaaattaacttagagtctgatcaatatgtaaaatagcactagaattaggtgtaaacatgcctccatatttcctcgggacaaatagtttagctgtcttccatatgtgaatgttcaattttttaacctactttttttcacaaactgcattcattacttggggcaccaaaagattactttcctttattattgattcaaaacagtgattgcaagttattttactgtgcatgtgttatttgttgtgcttattaataaaatgtcatcttttattttatgtacatatttttgacttaacaataaacagtaaaatttctgaaaggaagaaggtactcagtcatctagtattagatcctattggttgctatggttagcaccctttatcagtcatctagtgtccttcctagtttaataaaaagtagtgattccttcaaagtttcgttgcaacatgctaagtagattgtcctatatttcctagtttttatcttcagaaaagttttattaaaagcaaaaccaaaggcagtgtacttttaataataacactatgggattcagtcatgctgtatcccatactgctgtatcccatactgctgtatcccgtacatgtaggaattagcatgactatttggagttgaatggtttgacgggaccaaaaattttactggttttagaggcaaccaatgtaaagttagttgtccctagccttaagataggataattaataaatattaaaatttactatttattccataatttttttatttacttatttatccaataagtatttattgagggccgtaaatctatatatctgacactgttctaggctccaagggtacagtagtgaatagaagagaccacaatccttgatattgtgaaatttacactttagtggggtaagagagacaaaaaccaaataaataagtaaattatgtaattgtgagctggcaaaaagtgctatagaagaaagcaaaagatgagtaacagagagcagctggaccatgaggatatcacagtgaataatattttgataaagaaaatagcaagtgcaaagaccctgaagcaggagcgtgcctatagtgtttgagatactgtaagttgtccaacataactgaagtggattgagtaaaacagggcaaattaggaaaggtgtcaggggttttacaataagtatctctcattcttgcaatcatactacatagtagctattaagaccattaggacaccttaagcaaatgacagcctagggtacatactaaaaacacagctacaaggggatacaactgagatttaaaacaagtttgtcagattctaaacctcccacaagctcacaccagcttatttattccaaaagataaacattgaggaatttaaaaggccagttattaaagcgttggtggcttaaaatcagccacggtggaagtaatttcatcacagaatttggcaaacactacaaatcagtgtttgggaagatttatttttttaaaaaaagttagtcctaaataataaaagttttcattctacctttaaaattttttcagggtaaaatgtttatagtttcaaccactatcccattcttgtgactaaaatctgccaaagcaggaatggctgatatgtaacctagattaaccgcattgtgtagtctttttggttctccacgtaattgtcctgataattcccagatggatgactcttttctctacattcagaattcttggaacctttaaatacttattttactttctgcaaattagtgagagcagagtgctaatgaggctgagtttacggttcaatctcaacacaattcagtttgctttgcacagagaccagctctgtacaacaagcaattatgtctagtcagatggtctcaaatttgtagtttttaatacaaggagagaaaatgaaattaactcaacaaattaagcaacaccattgaaataatcagttgcgggtttgcagcaataactttttcacataggtgatgcattattattattgtgtttctgtctataattttcattatctattcttttaatatagctgaagaataaatatttatattcagcattaatttttatatgagttgtgtcagtaaatacagattctggctctggcccacaattagttgtgtatctataaatgcatcatttaaactttctaggtctccaatttctcacttgtaaaatgagggggttatattatctaattaccacgttttttcaaggcctacattttatgatttcatgattattctaggtaatcgaatcatagacattgatgagcagagtgtttttagtgaccagtcactctacatgatccagcttccactaggttatattgcaacaaaaaacaaacccaacatcttagtgttaaaacaacaaggtgtatatcttgttcccaccacgtactgtgtgcaagttggctgcagctctgcctcgtttgtattcttcattgctatagtgaatgtttgtcccctctccccaaatgaacatatgtatattgaagccctaatctccaaagtggcggttttagggggtggggcctttggtaggggattaggtcactagggtggaggcctcacacatgggattagtgcccttgtaaaagagacctccaagaaattccttactccttccaccatgtgaggacatatggagaagatggccctctacctatgaaccagaagttggccctggacagaccccatatctactggtgctttgacctaggactttccagtctccaaaacaagaacaacaacaaaaattctcttgtttataaagccacttagtctatgatagtttgttttggcagcctaaacagattaagacattcattttaggacacaatctgcaggggcattcccttttagagaacactgttttaatggcagagggaaaaaggtaatggaggaagcatacaatagctcttaaaagcttcagctcagctttgacatacctcggtttggctcacatttcattaacaaaagcaggtcatgtggctaagcttgacatcaatggactaaagtccatattcaggcataaaatatttggaacaaataatgttttctactccatcttttttcctctttccaacttccagggatcaatttataaacaaatttctttaaataaccattaaaataaatattagaaatttaaaagacttgacaaaactattatttcagcaactatatattaagcagttaaaatgagcaaggtccactgttctccaggcacgtacactgtagtggggtgggcatatgtgtaaaggctgtccagacatttttgcctaagaaaatcatcacactttttaaaataatgtcagaagtctgtgcatggatctggctactattttcacatgtagatagaggtagaaattttattccgaaaaataaaactagtcttgtgtatgaagaaatgttttctgaaagaaaatataatcaagcttgcttcgaaattattagccctaatgaaagtagttatattttgaggttacggtcaactcagatttggcaaacagcatatacagtttgtagattaggaattcctatttctctttaacctcatttcacttatcattagcacctataccagaggttgggtaaggaaagagaggaaaaatgaaatgtaaaattttacattttatatatcaatgcctgaaaattacatcaaacacaatattgcaaggagctacttaatactttcacagactaggagccttaaaagaagcctttacagcctactcattatagtattgactgtatttctacaatttctcctaaagtaatcttaaaataattaaagcattactttctgtaattataaactcaaataattatagatgtaaatataaattgctttctcttcactaacctcattatatcaaatttttttttgtttgttttctggctttttttttttttttaacaacccctctatggagcaactgaaatcaggaaatgtatgtgttgtttaactctttctactcagctgcttcagttagcaggctagctatatgaactacttgaagttcagaatagccatagaactaaggcaaagtttgcataaacgtagttttttctgtaggctggtaaatagcaattgtgtccatgtagagggactcaatgtcaatagtgaaagcagcccactaccccctacccttttattctcatattccttgtttttggagataatacatctctaaagcctttttttttttttaaattagaggagtctatgattcatgttttccttgcctaccagatacaaccaacctctgttacccaatttctctatgtcagacattaggctgaatgtttttacatagtttatctcatttaattgaaaccttgtgatgaagattttattattcccattttgcagagatatctaaggcttggagtgcacaagtaaagccactaaattgttgatttagatacttaaattattttttaatatgagtagttttcacacaaccatatcacacggtcagaatttggaaataccagcgtcaccattcataagaccatggacaatttaaaacttttggtccttctgaattaaacagtcttctatagatacagcatggaaactctgcaaacagacttttggctttatgaagggaagcattaatgtaaatataattgttaatcgtaaatcagaaaaacataagggagagagatgcagtgaaaagatcgtcaatcaagcttgtaagtaggttccacctgtgaataataatctattgctcaaaccataagaaatacaggtattaaagataatttatcatgtattcatcaccagctacatgtgctacaagtataattttaaatatcaacatactgtatgccctcaaagggaatttgttgtgtgactgatgatagaatttcagagagccaagagctttgggaataaactggttttaaaaaatccagatatcataccaaacatgtattctatcaagtacatttctttaaggtattttttaaaactctaataggcagtaatgcgtactggaattgcctaggttacagattgtcacaaaaatatgttttattaattcttagggtcagttgtagtccttgccatcaatataactattttttaaaagaaggatagtttttattatgtcctttttctagtagatatttcactgttaattgttcatggctggtaaactcatatttatgaagactcaaacatttatttaactcaatatgcttttgtttcttcctgacatgtatgtaatcatattttataaagtacattggtcagtgagattgtatgtatgacatcggattaaaaaatttaatatgtaaaataaacacatcgggggcggtcattaaatgatgggtttctgtgctacaactcctgatgctatgatttcactgttcctgtgtaggaccaaaaaatcaatttaaaaaataagtcttagtaattgtgatgcatgtcatttacagactaggttttaagagacactaatccataagttaacaaagtgaaagttggtcgattattgattcttaaagtgtggcaaagactgatgtgagggaacaggcaagaaacaaccaagggcacagtgcatttgggacttaatagaaaaatgaagcagtggggagcgatgtgagatgagggtgtaggggcagtgtctgcataattaaaggctttaaatgctataatgaattatcttatactagagttttcttgtagtcagaggttcccaaatgttttcacactgtggcctgtagagagaggataatatctgtgcaccatacttgctcatgtagtcaggactgttgacaaccagaggtgatcacttggtggcttttgcagctctggcaccctttagcctactcttcacgtgttgggaagtgccatgaaggggggttgaaagccactgaaggactttaaataggaaccctggcatgctcagacttggccagaatgagaagggaataaagaagggaaagcaaggctgtagttagagagacctagcatgaaatgatggagacctcaaacagcgtggtcctggtaaggaagaagcagagtgggcttagatacttcaggggaacattaacttattgtttaatgagaaatgggtgagagcaaaagggaggatagcgaagaatgatttccaggcccctagtttatgtatcttaaataatggtatgactttatctaaaatagtaatgcacggaaaatataggatgaattgttacaatttaaatctctttattttgaaatattggagggactttcaggtgaaaatatccagcaggcagttggatatatccctccaaagttcaaaggggagacccagttagaagataaagagtataataaaaaaaattatagactatataaaacttgcgatataaaatattaacttgctgcttgggttaattacatttttataaataaaatataagctattcataaaaatgaaaaaaaaaagaaaatcaagtctctgaaatttctactgaggtaagaaatcataatcattccttttaaaaataatttattcctttaaaaaataactatgtcacataattgaatttaaaatgtatttgttagttgttttttaaataaaatttcagaataataataaaaaaagaagataaagagttgggtccttacttacaaattcagtaactatcatcaagtccatcctctggactacttattagaataagaagagagaacacaaaaaatctagagcgaagttctataaaataattttacactatggattcaaggcttaaatatgagtgttcctactcattggtccagtaactcttctaggagaaatagttgaaaatgagagcaaaaaatagcatgtgaaggaagccgtatgttatgtataatagtgaaaaattagaaataaccttaatgttattaaccaaatttgcacgtttatactaataaaatgtttgaaacataaattgtgttgctttgggatcaaagaaataaacacagtccagtaatcaaaagtaaattaaagcaatttaaatatttcctgcagtctcttaagaaacgcacacatatacacacatatacaattagaatataaggcacagagaaatattatttctccattttatgttctcaatgtcttgtaaaactattatttctcaattgttatgttctcaatgtctctcactacttcctaaggtctaacctctgaaaaaggttggacctttctcttgaaattctcataggttcttttcttctctcagaaataaatctctactctttcttatataagtcccctctcctgggttcccaaattttgtttatttctttctggttgtcttgattctgcatcacaaaagcccaggaataaagctagtgaaggtacattttttaatataggtgtatggaagatgagcaatcagagccaaaggtacaccagtgggcaaggaagggggaaagaatctcaacacttagtcaaaaggtcatttttgttttccaaaaaggttaagcaaaaataaaaaaaataaaaataaacacatcaggatgtcaaatcttatgtaatctacaatatgcaatttgtggtgtaaaaaatatgcttggaaaaaacaaagaaaaattctggagggaaacattttagaatttttttttctttttttttcctatgttttttggggggaacagatggtatttggttacatgagtaagttctttagtggtgattgtgagattttggtgcacccatcacctcagcagtatacactgaacccaatgtgtagtctgttatcccgcatccccctcccgccctttcctgccgagtccccaaagtccgttgtatcattcttatgcctttgcgtcctcatagcttagctcccacttatgagtgagaacatatgatgtttggttttccattcctgagttacttcacttagaataatgttctctaattccacccaagttgctgcaaatgccattaattcattcctttttatggctgagtagtattccatcatgtatctatctatctagatggatagatatatatcgatataccacagtttctttataccacagtttctagaaatttaatagcaattatcactggacattgaaattacaagggattgcaatatttttctttaattttgttataggttctacattttctgtaagtaggccaaaaatcttcaataaacataaaacagattattatttatattaaaataaattttattttaaaaataatttagttattcaaacaataaattttaagtcacagagctactaacagaagtagctatatatagacagaagtattaagtaaatatttgctatttttaaatactgaaaagttatattagaaaaataccagtttcaaaaatattcaagaaacgaaagatagtttatttcaattataagctatgtgggtttgaatcattttacttaaattctatgttttctcatctgcctaatgggaataattattttaaactgcataggagtgttgtgaggattaaatgaaaaatgaatgtgtgacactctatgacgtcttaacttgatttgatttatagtcagacttgagattcacaatagacttcatcaagcaccaattttacttgtcttgaagaaaatgcacaggaccagtgtcatagcatgcacaatgacaacacagcagaggtctcctgattctcagacacagctttggatgtcccagtcattctgcaccctgggtgtgtgtggccacaaggaataaagctgattgaatacaacttcagctcgggaaaatcatcagctctgagatcctcccttcagtttttatatcaagccatgtgtttgtgactgagtagtcacatctaatcaggtttatgtgattagccctatttcttcagggcagctccatttcattagttcccaattactcgttaaacaaccttgacaatgagttacacatgcttagtcatttccatggaactctcatttatcttgcatcaatataggtaaatatctaactattcctcagttgctgctgcaaatcagaggtctagtcttcagccatttccagagaggaggccaaagaaacagctgttagtcctttttcggtatataaaatgctcaggatagtgcctgacacgtagtaagcaaacaaaaacttcacagaatcattgaatttgttttttcaaaattgacaaataaagtgcatattctgatattgtaatttaaaaaaataatagaacaaaggaatccactgcttggttgtaatatcttttcttcattgataattttcaaaatgattgttgctaaaatcatatgcctctgtcaaattcctttcacgtcaaataaaattaaatcctatgatgtccttgaaatcatgttgtgttacaggtcagtggttatcatagatgactttaaatattcattacaggaatattgagggatgatggcaagtcatggtcttgagagtcgttgctgaaataggctattggagtgtgagttggtcattaaactgtgaaggatcattcatgtcaacatgaaagtccccttgattaggaagttacctagttggtaactgggaatattggttgaaggaagtgaaagtgtagtgaaaagagaagtttgtccaagagcacggcttataagagggttatgcaagaagatggtagctaaactattttttataataaataaccatgaatttgggggtcagagagtgaaaatagagagatgatggggacagaaataagggataagagaatagatgaggcaacttgttagaaggccttgccctttagagaaaaatagccagtaaaatactcctctcagtgggatgtacaacagactagttagaagaatgtcaaattctcatttttaacacatcagtgttactacttataaagcctctctgccttgccagatcttcagttcgattttattacttttatagcttagggagtagaatggtagcaaatattacaactgggctatgaacagatataacatgtcccacattggcctctctgttgaagccaatgtgatagaaacaactcttcttgaggcatcgcagtccagacgtttgatgtggtgactgacagcaaagtgaggcttaacctgtggtgtggtgaagcattctgtgcagcagtggagcacaggtggatgactcaggagactaagctccttctcccatatttaccaaggaaggccatgccaggggaaacacacatgctgagtaaataatgaaagagaatcaactggatagagttgaaacattctcaataaatattaatttttaacaattactagttaatttatttagttattctttgaatttgagcagaatctctttctctcctttttttaattccttgggcttgtgtgtgctctcaagacttagaatgtgaggtcacaacgtttcctgtgatacagacttgaaagagtataggcctttctctgtactcattgtagctcagtactattcctagcttcttagccccttcatggctttttaaaggaaggaaaagctaattattggtgctccaggactgggcaaagccgagaaaaaagagatttttcttttccttcatgtggcatcagtttgattgcttgttttctagaaaatagagagaaggttacctatcaaagggcacagtcttttcccaatagcaatcgtaacaacctcatttattgagaaccgaatacttagaattgtatacaaactctgaatcgtataaaactcctgcaatgtacctgttatctatactttaaaatagcgcacaattattctcatggaagttaagtgatttgacaagttggcaaagtaagtgacagagctagaacagaattaaaacttcttgttattcccactaaaccacctataggtcttgataaccatagaccttagaaaactaaacatttactaattgtttatttgtaatttatcttcccaatactaatgtaacagatttcaactttctgtccaaattaccctaattactaaaaggcctatacacctgtaatgaaacatgaattttgaaatacatttgcacagaatataataaagttttcttagagttaaacttcagtactattgtaggcgcttagtgtctgaagaccactggctgccttggatgacctctaaatgcaccctccagctctgtgatttaatgaagaaatcactgacatagttcccatgttttgcattataatttcataaaatttttgtttatatctgtaatttaatgcaaagccatatggttatcagaaataatggatatttaatttgattatttaagcatttgacttattttgtttcattcaagggaaaaagaaaaactattttgaattctattaattttctgcttcatagagaattagacatttatgaaaaaagttcataacagaagttctcaaagtaaagttaggttgatagattcatttaatgcacaattcttatacacttataaaatttcaaaaattcatatttgtatcatatattcataggtcacaggagaggtaaaatgagtacgtggaatatggcctgaatatataggagctaattagaaaataaagtaatatgctatattttagaaatgagaaaagcagaacttggtaataaagggcttagtttgataaaccatgagttgagaaccaaaagtggttctggcccttggaactgcaaaatagtttcacctactgtaaccaggctaatatattgctcctggtagcctgctgccactccaaaattttctcctcagagtttgtcatttttgtgaattcaagctcttcagaatgtttcaattacaaaaggacaattttacattaacccatcaacatagacttactttcagtttcctaacttaaagtagggacttgaaagaaaaagatctaaaataggtcaacggtagagagtttgtgggggattgtaagcatgtgaaattgatgatggtggtctctgtaacgggatccctgatggatcccacagcagcatggaggctctgacttcttgcaagggagagaggcgctagggaaagaagatgttagagacagtaacaaagcaaaatttcctcatgtgcagtttatccaaggatggctcacaaatagaattattctactcatgaaggaaaaagaaatacaactagccaaatgatccacctggaattatttcctccttagctacacaaacaggtaaaaacaaatccatacattacattttacaattatattctgaagaggtgtccacttctgagcaagatggagtaggtgggactggattcaccctccagcctgaagcaataaaaaaagcaacctggcaacacatatgaaacaatggtttccgagacatcagctatcagagaatgaagagtagtcatccctaagaaatggaaaacaaacaaggtgagccctattgcttgaacttactaccatgagagagtttccgggcaacagcacagggagagggattcatagagagccgagtgtttgaggagacccagacagatgaaattcatgagacggagtacctgaggggagagctgcacagagacagaccagagatctgcagaagctccttttagtattcagctgagtttatatcagcacatgcatgtaaggaaagttcccaagacctgggaaagaataaagctgaaatgattagagataataatgcccagcactcacagagggccaagaattgtacctgtgcccagtagccagactgaataacttcatgatttatgaaacatttggtaggatattgcttcggtagttacaaatattctcctccagattcgatacggtcttgtgctgcttaacaaatcttaaaagcaagacttaaaagaaccaaactgtttctaaaaaactgcattgcagaacacagctcaagaaggcatgcatagaaacaggaaaataagacccaaatgaggagaaaaataaatcaatcaaaacagatcataaattgatccagatgttagaattaccagataagggcaccaaaacagttattacaactgtattccagatgttcaaaaagttaagtagaattatgagatatgagaaagattcaaatcaaacttatagagaaagaatctacaaggtataagacgaaaagtacgttggaagagatgaatgacaaattagacgttgaagggaaggttagtgatttgaagacatagcaatggaaatgatccaaaattaaacataaagagaaaaaaggattagaaaacaaaacaaagcaaagcaaacgaaacacccacaaaactgtgacaactttacaaagtctaagatatgcaaaattggactccctgaaaaagagagtgagaataaaaagttttgaagaaataatgcccaaacttctctaaaaaggatgaaaactatgaatacataggttaaaaaaaaaaaaaaacttgaatttccagccaacagcatgtggagagtgatccatgtagagcctaatgtttgaggagacccggacagatgaaattctcgggacagagtacctgagaggagagctgcaacgggacagaccagagacagaccaaaaaaacaaaagcaaaacaaaacaaaacaaaaaacaaatcccaagtacaagaaacacacacacaaaaccatacccattttctttcttaattatatctcttacttttctctcattctgtcaataagcaggaaatgttttcctgaaatataattatcttctctaattcttgaataatattttgtttttgaaaatattttgtctgtcttttttcttctatggaaaattgtgctctcatttcactctaattttggttcctctgcaggtgctccctattttctttctggtttcttaatgcattttctttatcttcagtgtattgtgatgtgccttggttggggatttatatttactgtatctttattttttcaaatgttatttatgattcttaagactttttgagcttcttgaatgtgaagtttcacaaacctcgtgggtttggggaaaatttgaaccatttatcactttgaatatggtctcttcgccattctctctgttctgtctcagtattcctattagatgaatatcagaaccttttcttctatcattgttgtctattaatcttactaacatattttcctttcatctatttcttttcagctatgtctaatatgctctaatttgttgatttagttttaaatgtcagtgcctacattttccttttcaacagatctgtttgccttttaaaatggacctattcttttttatataatgtgctttatttttcatattacaatttaaaattttataaagatatatatcttacatagttatatatcttctctaaagttatatatcttatgtagatgattatatatctgtagctatttaagtatatagttgttatatatagttatttttatctagttatataaaagttatatttgtcagtctatcttaagggttggggatctaatctatctatggtttctgctaacttgttccttgtttgtttttcttatgacttataattttttattttgagtctttcttcaagaggtttttaaaaacatttgttgtatttatcctatgagtaccttttggaactgcatcctggtcatatccctgtagaacattttttgctgtgcttttgcaaagtagccaaggataccactggctcaaaatcagttttttatgttccctttcgtgtgtgtgtgtgtgtgtgtgtgtgtgtgtgtgtgtgtgtttgaagagaagtggatctcagatcatatgggtactgtaaatgggatagatgcagagtctcagggttttgatttcctggaggtaggatgtgaaaggacaggaagtcattagcttcattgttgctcaccacatccctgacagtaggaagattattttttaggccttctttttccctgaacagctcagtttcacatccccccagctcctttccatgaccattaaaaaccaaactcttgatgcaagggatccgttttttcttcttctctcccctctatcagccaacaggacagacacagtatgaacgtccattgagtgtcatgctgattttcagctctttcatcccctgtgttacctggtgatctccctttccttcacttacatatttaaataatatttgttgtatttgattcattatttctgattatttgtaatgggaggattttaagtttatgtacatttgccctctcactaaaaatagaagttaattatccattcactaaaataaagatatctgtgttaaaatgacatgctttttgtccatgcttttgcaggacaatttccatgcttttgcaggaaattgtgtttcttgtgcctggctctctggtactaaatgtatttttaattgtaatgagctctaatcaagaaagaatttttctttaaaataaatggctttcaaaatgagaaatgaaactaaaatatactgtggacattaatcttctcgattttatacttatatgacaatctcacagactagttcaacgtttgtaaacttgcatttgaataggtaataagtactaaaaataataacttcaagagctaggatgatgacattttaaaacttaattagtaatatttaaatttccatgcaagataattcatttcttggacaatatagtctttaaaaacttcatttaaataaagatgttaataatgaaaatacttaaatatataagtgagtggacatgtgtcttttatcccattctaacgaattgatttttactttattcaacactgtgggataataaacatacggcactttgcaagtattttattttagcttttaattacattgggaaatttaatatttcagtatttccttaattttctaagattagttggttacatgttttatcaaattaatgtttgtgattactgcgaaaatcttatactcaaagtagcttcaaattactgttcatgataaaatttcatttgattgacttttatctcaattcaataatcaaaaattcatgacactgttggattttagttcatgctgttatctttctacagtaaaagcaaaattagttagagattttatatttatttcaagatgtcacatatatttgtcttttcagtttccagagtccttagcatgcatagtgcttaatagagcacattcctggacagcctgttattattcattgaaattttagattgcatatataattataatgcattatatgtacatacatgtgtacatacaacattgcaagtttcattccataatgctctttgctttcccatctatattctccaggaaggcttgcatttaagttaagatctaagtttacaaagacacaacttaccagaatctctgggacacatttaaagcagtgtgtagagggaaatatatagcactaaatgcccacaagagaaagcaggaaagatctaaaattgacaccctaacatcacaattaaaacaactagagaagcaagagcaaacacattcaaaagctagcagaaggcaagaaataactaagatcagagcagaactgaaggagatagtgacacaaaaaaccctttaaaaaatcaatgaatccaggagctgattttttgaaaagatcaacaaaattgatagaccgctagcaagactaataaagaagaaaagagagaaaaatcaaatggacgcaataaaaaatgataaaggggatatcaccaccaatcccacagaagtacaaactaccgtcagagaatactataaacacctctatgcaaataaactagaaaatctagaagaaatggataaattcctatacagcatcccaagactaagccaggaagttgaatccctgaatagaccaataacaggctctgaaattgaggcaataattaatagcctaccacccaaaataagtccaggactagacagattcacagccgaattctaccagaggtacaaggaggagctggtaccattccttatgaagatattcaaatcaatagaaaaagagggaatcctccctaactcattttatgaggccagcatcatcctgatacaaaagcctggcacagacacaacaaaaaaaagagaattttagaccaatatccctgatgaacatcgatgagaaaatcctcaataaaatactggcaaaccgaatccagcagcacatcaaaaagcttatccaccatgatcaagtgggcttcatccctgggatacaaggctggttcagcatacaaatatcaataaatgtaatccagcatataaacagaaccaaagacaaaaaccacttgattatctcaatagatacagaaaaggcctttgacaaaattcaacagcacttcatgctaaaaaaactctcaataaactaggtattgatgggacatatctcaaaaaataagatctgtttatgacaaacccacagccaatatcatactgaatgggcaaaaactggaagcattccctttcaaaactgacacaagacagagatgccctctctcaccactccttttcaatatagtgttggaagttctggctagggcaatcaggcaggagaaagaaataaatggtattcgatcaggaaaagaggaagtcaaattgtccctgtttgcagatgatatgattgtatatttagaaaaccccatcgtctcagtgcaaaatctccttaagctgataagaaacttcagcaaattctcaggatgcaaaatcaatgtgcaaaaatcacaagcattcttatacaccaataacagacaaacagagagccaaatcatgagtgaactcccattcacaattgcttcaaagagaataaaatacccaggaaaccaacttacaaaggacgtgaaggacctcttcaaggagaactacaaaccactgctcaacaaaataaaagaggacaaaaacaaatgaaagaacattccatgctcatggataggaagaatcaatatcgtgaaaatggccatactgcctaaggtaatttatagattcaatgccatccccatcaagctaccaatgactttcttcacagaactggaaaaaactactttaaagttcatatggaaccagaaaagagcccgcgtcgccaagtcaatcctaagccaaaagaacaaagctgaaggcatcatactacctgacttcagactatactacaagcctacagtaaccaaaacagcatggtactggttccaaaacagagatatagaccaatggaacagaacagagccctcagaaataataccacacatctacaaccatctgatctttgacaaacctggcaaaaacaagcaatggggaaaggattccctatttcacaaatggtgctggaaaaactggctagccatatgtagaaagctgaaactggatcccttccttacaccttatacaaaaattaattcaagatggattaaagactttaatgttagacctaagaccataaaaaccctagaagaaaacttaggcaataccattcaggacataggcatgggcaaggacttgatgtctaaaacaccaaaagcaatggcaacaaaagccaaaattgacaaatgggatctaattcaactgaagagcttctgcacagcaaaagaaactaccatcagggtgaaaaggcaacctaaagaatgggagaaaatttttgcaatctgcacatctgacaaagggctaatttccagaatctacaaagaactcaaacaaatttacaagaaaaaatcaaacaaccccatcaaaaagtgggcaaaggacatgaacagacagttctcaaaagaagacatttctgcagccaacagacacacgaaaaaaaatattcatcatcactggccatcagagaaatgcaaatcaaaaccataatgagataccatctcacaccagttagaatggcgatcatcaggaaataacaggtgctggagaggatgtggagaaataggaacacttacactgttggtgggactataaactaattcaaccgttgtggaagacagtgtggaaattcctcaaggatctagaactagaaataccatttgacccagccatcccattactgagtatatacccaatggattataaatcatgctgctataaagacacatgcacacatacgtttattgcggcactattcacaatagcaaagacttggaaccaacccaaatgtccatcaatgatagacaggattaagaaaatgtggcacatatacaccatggaatactatgcagccataaaaaaggttgaattcatgtcctttgtagggacatggatgaagctggaaactatcattctcagcaaactgtcgcaaggacaaaaaaccaaacaccgcatgttctcactcataggcgggaattgaacaatgagaacacttggacacaggaaggggaacatcacacaccagagcctgtcgtggggtagagggagaggggagggatagcattaggagatatacctaatgtaaatgacgagttaatgggtgcagcacaccaagatagcacatgtatacatatgtagcaaacctgcacgttgtgcacatgtaccctagaacttagagtataataataaaagaaaagacctaagtttgttttacttgagtgtttgggaggcaagtattttttttcataaatgatatgtaagaactctaaattctcataaaatcataaacatttttcaacctcttggcaggctatagaattgttaatcctttttcaatggtctttaaatgttgtcatgttgccttctagcttgtagctggcccaaggcctgagtgagggtggtgctggattgtgtcgtcagggtactaaacacctgagtcctaaggatcaaagctgaaaaccaaagtagtgtgtcaaaacccaagaggcaggcaagagcaagggtcagaagcaaaataaggacaactgagagcaatgtgggatatccagcaggttagagcaattgaacttgaagaagtaacttggggctttgtcttgtaggatatagattccgcaagtaaaaaatttttgagccaaagaaagagaggaaccagacactcaagaacttcacagtatcactgagttgtgtgtctcatcatggtatattttgtagtttatatttcactgataatggaatgacacaactcaagcctttgtgtctgcagcacttcagcatttaatagctgaaatatatttgagcagctttattttggtcaccctcctttcttccacccacatgattaagatttgttaatggagatatttgtcagactgtacaagattgtgaattagatcttctctgaagtgcgacatatggctgaggatctaatcttatttctgcctgagaccttgtgtacctaggatgatcctaataaagtattatgtcttcataaagacaaaagccaggcttactgtgaaacacagcatcacatagctggaagagagctactttggtctctactattagatctaagaaagatagcatcttaactcttctaagatttaaaaaaaaatttaagacaaagtaaggcataatccttcattaatagattttatagacagaagactataaaaatatgagcactagacttgagaacctgagttctagaactgtctaaactacaaaatacaaattgtttaaatctctcttggactatttttctatctgcaaaatggagacacaaataatgttcatagtatattaacaagaaacactttttcatcacaggtaaaatcaggggctctagagccagactgcaggccttgaattctatctccactacttaccagatgttttgcctcagaaaattacctttgcaagcctcactttcttcatctataagatggaaataataatggtacttacactattttatgaagcttaattgacatcatcatggtaaatgatttaaaaagtgccaaactgtacctggaatatagtaaacagtacatttaaatttctacttgtgttatccaactagatcactgaatttccttcatattttcttgtatcaaaactgtcttgctacagatccagaagtcagttgtatctccaggtaagaagagagtgatagacttcagaactaaagtgaagtgatttatcattgagatcccatttatccgatattggaactccaggcttttaggaactgatctgtctggtaaccaagttgatatggtttggctgtgtccccacccaaatatcatcttgaattgtagctccgataattcccacatgttgtcggaggggcctggtgggagataattgaatcatagaggcagttcccccatactgttctcatggtagtgaataagtctcacaagatctgatggtttcataagggggaacccctttcacttggtcctcatttctctcttgccagccaccatgtaagacgtcccttttgccttctgccatgattgtgaggcctccccaggcatgggaaattgtgagtccattaaacctctttttctttataaattacccagtctcagttatgtctttaccagcagcatgaaaacggactaatacacaagtctcctccttgattgacttcctctctttattctctagtcctattaggtgagtttgttcttattatcttgttcttgctatattgggcttttctaatcctgagctctagttttcctatgactgggccactgaatcttgtggcatgggtcatctgaaacgccatcaactgcttgccataatctcaattctgtcccgtgtttgcaccttgtccaacactcctgatatccatccccttctaatgattttcttcatgttgattatctgctcctaattgttcctttctagacttgaaaaatattaaattgtgctattatacatatattagttgtctttgggagttagagtccacaagattttttggttaattgaatgtgttaggaaaagatgaggaaggatccacgatgaacctgaggattctggcttgatcaattgtatggccagtacttccatcaactttctagctgaggtatggagtatggcaggaggaaaagtactgcatgggagtgcaggatgaaagatgaccagtagcgttgctatgtttgcaagttgagttagaatggagatgtcagatagtgtgatagccttcatgctgaggaaagagggatgtgctagagattacaacttgggggatatcaatctatacgtagcaagtagagatctgatgattgaggatcacccaggtgagagtccacagggaaaagggaagagggcccctaaggtccagtcattttaaatgacaactgagaaaagagaattcacaaaggagcctatagaacttagaggggaaaagaaaaaagtcagaaaagtatgaagctataaaaaagaatagcttttaagagatagagagataagataattcaaatatcaagacttcaagtaagaaaatgactccaaatgtgttattactggggaccctggccagtaggttcatggggtggtgaggacagtagccagatggcagttggctgtgcactgagtggaaactgagtgagaatagatggtgaacatagacaactgttctgagaagtctggctgtaaagaggggaaggcagatactacaggagccatagggaaataaaggagagataaagagggttatgttatgtactttgcttcttttcttttgttctatttttagcaaaaatgtgaacatgcttacatacttacagagaaaagagaaattgcagatggaaaataaagagaggcaagaccctacagggaagtaaaagaatcttattctgagcacgctgaaattttatccttggataaagagacaaaacctagtagcctggttaataggaggaaaacaggaatagatgtatatggatgtagataagtctatatcactggtacagggaaattaaagaaggtacctctaacaggttctatttactctgcaagtaaattgcagacgatgaaaaagtggggtaagaggattaaatgcttcaggcgagaggaacctttaagtagtagttttctccacaaattttggaggttaataattttcagtgttttggacaaaatgaacaagttgattctaaaattgaggagaataacaaagaataaaactggctaaaacactcctgaggaagaataatgacttggagggaatatgtcctaccagataatatagcaagaattattataatgctataacaattttaaaaggatgacattggctcaaggggtaaatatataaaacaaagactcagaaacggccatatataagtggaaaattatacataagagaaatggtattgccatcattgggaacagaacaaatggcattaaaatttttttgcccaattatttattgatattgaaaacatagagttgatcttcttctcatttatacataaaaactaattccaaataaattaattacatgggaaaagcaaaaactttatactttacaaaagcaaaagaatatttcattacctcaatgtaggaatacatttatttaagacaaaagtggtaattatgaaaaaattaaggataaattcaattacattaaattaactataatagtcaaaaatactgtaagtaatgtagaaaaaaaatcaacaaactgggagaaggaatttgcatggcatacagtcaacaagataatgatgatcttagtatgtaaagcactccttcaaatcaatgagaaagtgacaatggaccaattaataaaatggaaatgagacatgaagaactatttcacagaagaggaagcacgaatggtcaaaaacataagaaaatgcagtccatctcactagttatcagggaaatgcaagttcagatcacagataaatgccattttgcatctagattggtaaaaatgattacatcttacaaagccaacctgacagacatgtggaacaacaagtaagagtgactcttacatagaactaatgcatgtatccattggcataagctctggaaagcaatttgaagttattttataaatttgaccataaatttactctaaattgactaagtaattccactcctacacacacactaaaggaaaaatcttcaatgtgtatgtgcaatcgtgtacaaatcaaaatatgtaaaaaaagttcatacagcaaaaaacttgaaaaataaaagtatttttgccttgacaagaaaaggaaaaaaaaaactgtagtatatttatataacaggttgttagagaatattgaaaatgaatgaactactgttatgtgcaactacatgcataaattgttaaaacctaagttgaaccaaaaaaggcaggactccatagaccatgatgtgctatacagacgtgcctcattttattgtacttcacagtaatgtgcttcacagatactgcattttttttcacaaattgaaagtttgtggcaactcagcatcaagcaatagcatgtgctcagtttgtgtctcggtgtcacattctgataatttttgcaatatctcaaactttttcagtattttgttacatgtgttagggtaatctgtgatcaatgatctttgatgttcctattgtaattgtttttgggcaccacaaaccatgcccatatggcaaccaacttaattgataaatgttcagtatgtctgactgcttcactgataggctgttcctctgtttctctccctattctcaggcctccatattccctgagactaaacaatattgaaattaggccaattaataacgctttcaatgttcaagtgaaagtaagggtcacccaactatcactttaaatcaaaatctagaactgattaagcttatggaggaaggcatattgactaagataggctgaaactaatcctgttgtgccaaacagccaagatgtcaatgcagaggaaaagttcttgaagaaggttaaaattgctactccagttcacacacaaatggtaaaaaagtgaaagagcctttttgctgagatggtgaaagtttgagtggtctggatagaagatcaaaccagccacaacatttccttaagccaaagcctaacccggagcaaagcccctactctcctcaattctatgaaggctgagagaaataaggaagctgcagaagaaaagttggaagctagcagaggttggttcataaggtttaagggaagaagccatctccataacataagagtgcaaggtgaagtagcaggtgctaatgtaaaggtgcagcaagttattcttaagatctagctaagataattgattaaagtggctacactgaaaagcacattttcagtgtaggcaaaacaacctcctgttggaagaaaatgccatctaggactttcatagctagaaagaagttgatgcctggcttcacagtttcaaaggacaggctgactctcttgttaggggctaatgcagctgatgactttaactgaaactagtgttcatttatcattcagaaaattctaggccccttacaaatggtgctaaatctactatgtctgtgctccataaatggaacaataaagcctggatgacagcacatctgtttacagtatggtttactgaatattgtaagcccactgttgacagctaatgctcaggaaaaaaaaaaaagatttatttcaaaacattactgctcattgacaatgcccctagtcacccaagatctctgatggagatgggcaaggatgtgaatgtttttatccagcccatctatgaatcagggagtaatttcagctttcaagtcttttttttttttttaagaccgagtatcactctatcacccaggctggagtgcagtggcgcgacctcggctcactgcaacctctgcctgctgggttcaaatgattctcttgcctcagcctcctgagtagctgggattacaggcatgtgccaccatacccggctaatttttgtatttttagtagagacggggtttcaccatgttggccaggatggtctcaaactcttgacctcaggtgatccacctgcctcaacctcccaaagttctgggattacaggtgtgagttaccacacccggcttcaagtctcattatttaagaaatacattttataaggtgaacactccgtagatagtgattcctttggcgattctgggaaaaatccattgcaaaccatctgggaaggattcatcattctaggtgccattcagaacatttgtaggtgcctcattaatgcagtaggtagcatggtagtctcataatctgaagaaacattcatgattcatgggaggaggtcaaaatagcaacattaacaagagttggaagaaattgattccaacccttatggatgactttgaggggttcaacacctcaatggaggaagtaactgcggatgtggtggaaatagcaggagaagtagaattagaagtggacctgaagatgtgactgaatagctgccatctcatgatcaaagttgaatggatgcaaagttgcttcttatggatgaaaaaaaaaagaattttgtgaaatgaaatctactcctggtgaacactgtcgaaatagcaacaaagattttagaatattacataaacataactcataaaacagcaatgaggtttgagaggattgactccaattttgaaagaagttctattgtggttaaaatattatcaaaaagcacagcatgttacaaagaaatctttcatgaaaggaagagtcaatagaagcaacaaattttattattgttttgttttaagaaattgccacagccatctcagccttcagcaaccatcaccctgatcagtcagcagctgtcaacatggaggcaagaccctccaccagcaaaaagattatgacttgctaaaggctgagatgatcgttagcattttttagcaatacaggtttttaaaattaaggtatgcacattgtttttgcaggcataatgcaatggtacacttaatagactacagtatagtgtaagtataacttttatatgcactaggaaaccaaaaatattgtgtgtctcatttcattttgatatttgctttattacagtagtctggaactgaacctacaatatctctgaggtatgcctatatttgtaaatcttagggataaataaaaagtaagcaatataaagacctaaaaaaggctaatatacacaagatggggccaaaaaatggaaggcaaagcctgcaatggtgagctaaatgttaggagtgaagtctgagtctgttcaactgtctctgatagagtaattgacaaaataaagaatagaaaattcagaataaagttggccaaagaataatatttatgccataaagtcgatgaaagaatataagacaagatctcatggcaaaatgtgggggaatattaactagggacacaagagcccctttaggtcagcttgggctaaaatctgctagtgttagaaaacacatcaaattaaaatcagaaaaaacaaacacatttgtgaaactaaatactcctgtatgcaactgaagggaagtaagaaggtatgtcaagttctctttaatagttccagatactttcccaaggcaccacaaatcacacatatttcctgaatgtctcatctttaatgaagctgcactaagtagaagcattttgtgtgtcatcaacttggtttccagccattctacttttccattatcagttatttgctaaaataagacccaggctcaaattaagaggccaattattcttttatttatttatttatttatttattattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaatatgtggtgtttggttttttgtatgaaaagaagatcttgttcatttttcctgtttctttttactctgaagtaaaggagatattactagtagcagtagaatataaaaataacaaataattgtaccatcagatgactgtatctagcttttgacattgtttaatattatctaccatctagctttactctccccaacaagtctattaagtgtcaagtcatctcaaagtcaaatatcatgaaattcagaccctgaaaaaaaaataagcgacttgtcctagctagattgatgatagaatcaaaactaacattcagatcttttgactcatgctttccttgaatcaatctaaataagccactttagatttcacatgtctagtttgcctttatctaatagctaaacttatttttattctaacattaaaagagaatattatgcatttggaaaaaatgctgttgaaaacatacattgaagctgagagtgttggtgtgtgcctgtagttccagctacttgggaggctgaggcaggagtgtagcatgagcccaggagttcgaggttgtaatgaactatgatcatgccattgcatgccaccctaggtgacagagagagacgccatctcttaaaaaaataaaaacataatattttaaattagacattgtgttttggaaaaatggaagagttatactctaaagatctttcaacaaatcttcagtatgcctttactaaatggagaagctatgtattgatatgtggtaatactattggtggatcagaaagtattaggtaattctaggtcattatgaataccaactgaaacagttcttccccaaaatcttcatagcacatctctcaaaaatggaatataatatactctttaataagattattgtctaattttttaacataagttaaatgcaattagatatttgattttctaatggttacattttaaaatatattgattttgattttgaataacattaaatgtttttccacatctagggaggacacatctatgactagcagtggcatgtgctcaggaaaggtaaatgtatgtcctggttcaggtgtattctcacttaacctctatgattttcatattcttcatctaaagttagaggagtttatttagatgcctctgtggtagatactatgggttgacttgctcagccttcatcccaccctccacctatgtggttttctatattgtagattctggaaggctaaaactacatttctcactttccttgcagtagggttctacacataaattaggtttcaccaattaaaaacacttggaaggcagaagtgaagtggaaatcattttcctcttttggctacatctacaggcttgcacagttatgatgacatgaggatcttggcaacagcattccattgtccactctccagctacctaagtgtcaagaggcagttttgacaaaggcagtgccaatcctacccattcaccagtgttcattcacttgctttgtgaatgttcagggaccatggcaatggtggcagtgacacagaggcagtcctaatccttggatcatagctatgaccttgtgttttgtattcgacaattccagcttcagcctgagagttctgtagtgttctgttagtcattactggaaggccctgcagagcctattctttcagccattccagggatgccttttgcatcttattctcaatactaaatttatttctacttaaaatacttagagttggtttttatgtcctgctctgaaacctgatatctaagtttgctgtgtgctctaatgttcttaggttactggggaacttggtgtgttttctaaaacatagtctccaatatttatggtaatttcttaaataatttaagtttctttctatgtagagtctatttgtaatgtaattttattactatcctataattatccttgttggtgttgagtacatgggagtcaagtgtataaacatatttgttaatgaatcaacagcttatattttcaggaattaggatagctattaggtgctattaaaatagagtatacatatatgttccaaaaaattttatgtactgatacaatgaattagaatgtctgaagtagatataagagtgtataattaactgtattttctaaaaggattttttgtatgaatatgaaaaaatattatttatatatacatatatatagagagagaagagaaataattatgcggatgactgctaataatctgtgatttttttatgagcgtccttttacagcattcatcttgggttaaccattacaacacctgaataactatttgatatttgccgtcacctccttaacgtcttgataatcaatattaactgcacatgaacactttacattcttcttgagctaaaactattcaaataccttcaatccttgtgaatattttcccaaattgcaaggagttcttgcaattcctctattctttatattttaaagaatgtaatacagaaagatctacataatataggtgataaattactcactttggaaactgatatttgagatctaattgaaaaaaaaaaaaacaaaaagcaagaactgagcaagcctgcaacattatcagtctcaattctgggaatatctttgttactgaattgtaaggagtgcaaccaaggatggatgataggtggggaaaaggaagtatagtgttcagtcctaatattggtaaagagtgcctggaaacgaacagcaccaaggaatgtaagcagaggaataggtcagatccaggaaaggaagcagggtagggcacatacaagaacatgtttcagaggaagcagctggccagcagctgctgaacactccagaaacagagagattcaaattgctatatagcaagctgtaaagtccaaaatgtaggagaatgggtgggtcccaggtggtctgagggaaattgaatggtcaaagaagaaaagtcgtgaaaacagtccagccaataataaaaaggataaattaggataaaacaaagataagatatctgaagtatcaggaatgagtatctttttgatattgaaggcagatatcctgtcctaaattttgggttttctattatactttggaaggaagaacttatcctacagtaaacagtccaggctgagcagaaaactgaaagtactacgctgagatggaatatatactcagaggcaaaaagcctgtcatatccattgggtggcaagcttaggattgtagtggagtgttatgtggagcagtcaggctctgggaagataattttgtgctgagagcaagacttaggcacagaaacctcaagggacaaggatcaaagaagagagaaaaattggtcctttgctgaaaattcacttgcaccaaaaagaaaatcacacagaaaggcatgaagtaaacatccaaagtcaagtagagaggggtctctgtctgtgctttcttgccatctacagtcattttcacagcagacaaaagcccacaggtgctcatttctgaagcagggcaaatgcaattagctattacaactcaatagaatgatctgtattctagtcacatcatgttgttagttgtgtttcttagcagcacactgaaaaaaggagtcgatttgtgtggcctgaccatttttccctcttatagtaaaaacaaatgttatgtctgaaaatttagatatttttacctttattttatttgttctattcaaagatattttgaatataagtggtacctgtaggcaaaaatcaactaacatttattaagcacctttttgcttgcattttacatataatagtttatgcagaactatatagttttcacagaacttagtaagttctcatagaactgatagtaaaacttcagactaagaatcagtattgcagagttcaagcttcagatgtatttctaagcagctaaaaccttgagcaaattacttccccagtcattggtttttacaactgcaaatgaggatgttaaaagctgttttacagcttgtttggacaggattaaaggggtttacatatgaaattctgttaagtttaatgaatatttattaacaaaataatgtttgccaaacagcatgcaaaggcttttgggatgatacaaaggaaataagctgtggttttggccattgaggtctgagtctaaagagggagactgaaatatacactttaaaattagagaaaatgcaggaactgtgagagtacagagaagttcagtatgaaagtaactaaaataatagccacatccaatcactcttgatgttcaatgagttattttctctttttgtttaaattatttctaatcaaaaggcaaggaacagaaatgtccattatcactgacaggtagatgatttacagttgtgaatgatgagttactcattaatgtattagtactggaggtattacgatgcagtaggtcagagccccaaggctcacagcaggctcttgtccattgtaacttaactatataacttggaaacattccagatcctctctctccctggtccttccacttactagctacgtgaccttgaacaagttacttaaactctcttttcgagctaccatttaacccagcaatctcattactgggtatatatacctcaaagagaataaatcagtctaccaaagagacacatgcacttgtatgttcattgcttcactattcacaatagtaaatacatggaatcaatccaagtaccattaatggcaaataggataaataaaatgggtatatatataccatggaatactacacagccattaaaaatgaaatcacgttatttgcagcaacatggatggagctggaggccgtaatcctaagcaaatgaatgtggaaatagaaaataaaatactgtattttctcacttataagtaggagctaaacgttaagcacacatggacataaatatgggaataatagacactgtggactacttggaggggggcatgggctaaaagctacctattgggtactatactcactatgtaggtgatgggatccttactccagtcctcagcatcacggaatattcccatgtaacaaacctgcacatgtactccctgtatctaaactaaaagttaaaaaacaaaacctctctgttctaatttatcatctacaaaataggagtaatgataggttgtacattgtaagattattatgaagattaaatgagctaatctatataaaaatttttaaaaagtgctagtaaacagtttggacttaataaatgttatctatattcatgaatgtcatttttactataatgatggtgatgatgctttggcatatctttttgtaaaatagagaataaaaagatttatctattagttgtatgatgaggattaaaatttaaaatgtctggtttaataggtccttaataaatatgaactattatgataatagtgattactactaaaaatcattccctatatatgtttagcatttcacaatataataaatgcttttatgtaaacaaataaataaaaaatataaatttataaacatataaaaatgtgtgtgtatatataggatttacagtatctacatatatgtatatatgtgggtatatatatgtgggtatatatacatatatgtgggtatatacatatatgtatatatgtgggtatatatgcatgtatatatgcaggtatatataaatatacagtatatatgtatatacacaaacgtgtatatgtatatatttatgttacatgtatatactgtaaatcatatatacacatatacacacacacaatgacacacatatatttatatatttatactcacatatattcatcagtgtgagtatatatatttatataaataattcacaattgcacaagagatgaacaggccagattgttctattcctatgtattattcacatttcatagtttgttcattagactactgtggtcttctacagaagatctttgaatttgaatgtcttactacgtctttgctgacacacacacacacacatacacacagtttctggttggtatgtggactaacataacaccttctgtttaattaattctgcattcttttctcctttcgtttcttccattgctttcctacttccataagtataacactggaatccacatatttagagaaatttacggccaggcgctgtggctcacgcctgtaatcccagcactttgggaggccgaggcgggcggatcaggaggtcaggagatcgagaccttcctggctaacacggtgaaaacctgtctctactaaaaatacaaaaaattagctgggcgtggtggcaggcgcctgtagtcccagctatgcgggaggctgaggcaggagaatggcatgaacccgggaggcagagcttgcagtgagccaagatcgtgtcactgcactccagcctgataacagagcaagactacatctcaaaataaataaataaataaataaataaataaataaataaataaatttacttatgtactgtagttgttcaagatgaaggttacacacagagaactgggtatgttatttatgagcatatttgcattcatgtagcatcttaaatgtagttggcaaccctcttctagcacaatggacacctgctggactaacaatatgtttatacaaggaaagtgaaaaatatctacgtttgcacactggctgatgaaatgaaaatagtttaaaccagtgatttttgtgtatagctttcttttaacttttttatttgggctgagaaccatgtgtgcaatggtatgatgtttataaacatttgaatgataaatttctctatgcacagagttacccaacagtgtaggtttacaagaagacactacattattgaaaacaaagtaattaaattttcgaggtcaaagttcaaggaggatcctgcccttgagactctctttccctcctcaaggagaatgagaagcctcactgggttggcaattttcggaatagaaaaatataaaaaaaaccctgacatcttccaggcctaggaacacatcgtcttttgtcttcgccctcaccaaacctatgcagaatgttgtggcacctaaatccccgtttctgggctggagactcagcattatctcttgtcaggaagttgtcagatccctgcatctgcagaccacagataatagggaaaaggaacgtcaaggtaagatctgtgtaattaattagcttgttgagcaaacagttgaaagggaaatgaatttattaatttttgaaatgtatttttaccagattaagagaagctttagagttctatcaaaaaacttccagatcaatcaacaagtgatacatatctatatctatatagatatagatatagaaaattcagtgaataaaaaagaagttacatactaataaatatattagcatattctatctggttcacctgataaccatatttgcatagtcatattagttcaataatgacttttgtttttaatagaaattaaaattacatagggcagtttaggggagtaggaaatatcatatgcttctctttgcattatgtttgttaatatcccattggccaaagcagtcatgtagccaaacctgacatccacagggtagagaaatatattctcccatggagatgaagacactaatgaatattttgatgaacaataatctcacctatgacacctgccattcatctgacatagaaatttccgatgaattaaaaatctaaacttaaaaagctaagctaacttttaaattttaatggttttatactgacacaatttcagacttctaaagttgttgcttgcagcattagtcacagtagccaagacatggaaataacttaaatgttccttgctggattcatacagaaaatatgatatacatatgcaatgggatattattcaaccatcaaaaagaatgaaattctgccatctgtgacaacatggatgaaccttgagggcattatgctaggcgaaataagtcagaaagagaaatgcaaatactatatgatctcatttctatgtggaattttaaaagtcaaacccatggaacatagaatagaatggtgattaccagagcctgcagggtgaggacatttgagagatgttgatcgaggaaacaaacgttccgttgtaagatgaataacccctggaaatctaatgtgcaagaataattttgctttccaagattatacaaaatatttcttgtatttcattaaaaattcatagtttttaactcttgttgcaactactttatttttttccggatttattgatgtacaattgacagataatattgtacacatttaagatgaacactatgatgcttagatatatgtatatattgtgaaatgattaccacaatcaagttagttaacacatgcatcacctcatatagttagtgtgtgtgtgtgtgtgtgtgtgtgtgtgtgtgtgtgtgtgtgtgtgttgagaagatttaagatctactctctctggaaatttcaagtatataatacactattaatattatttatatcttttaatgggaaattccccaattaccagtgcttatctgtttcttatagatttgtaggagctctttatctgttaaatatgctggattcttttgctcatcttttaaattttgagtgatatatctttctttgtacagaaacttaaatttcatatagccaagtgtaagtaaaacctaaggcttttctcatagtttctgctattcttttctgtaagtcgtaagtaaattatcacatcatagattttcccataaacaacataacttaggcatgttgctccagatttgatgagatgaaaaaatttttaatgtccctgaaaaaatatgtgtatataatcaatatacaaataaaccttagcaaggaaagataactacatagtaactgtttattagttgctattcactgaaacaaaagaaatcatagaaactgaatgaatatgcaacctctgtcagtcataaaacattgttaacaggctgggtgcggtggctcatgcctgtaatcccagcaatttaggaggccgagatggatgaatcacctgaggtcaggagttagagataagcctggccaacatggtgaaacccagtctctactaaaaatacaaaaaaacaaaacaaacaaacaaaaaagctgggcgtggtggcaggcacttgtaatccgagccatcaggaggctgaggcaggagaactgcctgaacccaggatggggaggttgcagtgagtcgagatggcaccactgcactccagcctgagggacaagagtgaaactccgtctcaaaacaaacaaacaaacaaacacccaaaaataaaaacaatctgttaagatagaaaaaatataatatggctacaaaataatgacaattatctattcaaataaaataaaagagagcacttttatattgtgttttttacacatagcaacatttaatattattcttgtatttttcattatctgtaatatatcaactgcattaatccctttccacaatattttatccagttaaatttttttacacatagcaacatttaatattattcttgtatttttcattctctgtaatatatcaagtgcattaatccctttcaacagtattttatccagttaagtttttttattttttaaattgacacatcattgtttgtattagtccattctcacactgctataaagaactacctgagactgggtaacttatgaaggaaagaggtttgattgactcacagttcttcaggcttaacaagaaacatgactgggaggcctcaggaaacctacaatcatggccaaaggtgaaggggaaccaagaactttcttcacgtggcagcaggggaaagagaatgtgtggtggaggggaagtgccacacacttttaaaccatcagattttgtgagcactcactcactatcacaagaacatcatgggggaaatctgctcccatgatccaatcacctgccaccaggtccttcccccaacactgggaattacaattcaacataagatttgggtggggacacagagccaaaccatactgttgtacacattttttgggtgaatgtgatattttgatacatgtatacaatctgtaatgatcaaattaggccaattgagatatacatcacctgaaacatttatctcttctttgtgttgggaacattacaattctttctcttctagctatctaaaaatatgcagtaaattatggttaattataatatcccttatttactatcaagtactagaatgtattccttttatcaaattgcgtttttgtacccattgaccaacttctctttatacctctttgcttcctttccctttccagcatctggtaaccatcagtctacctccatgatatccacttttttcactcccatgtataagtgagaacatgtgatatttgtctttctgtgcctggcttctttcacttaacataatgacctccagttccattcatgttgccgcaaatgacaggatttcattctttttgtggtatatatactacacttaaaaatccattcatctgttgatggacacaggttgattccatatctcgcctattgtgaacagtgcttcaataaacgtgggagtgcaaatatctcaagtctttaatctattttgagttagtatttgtaggtctggttaaattttaaaagggtaacagattcattaactagcacagttaaaaccagtttaaaaacgcctggctaagatttgctaaaaacctgactaagatttgctaaggttcttggatcgacatcttccaccaaatttgggaaatatttggccattattaattcagaatatttttcctccctgttctttttctcctctccctctggtactgcaattatatgggaacctacttggaattatcccacagatcactgcagctctctgcagttttttgaaatattttttctttccattcttcagattatgtaatttctgttaatcgtcttcagatatgtgaatccttccttctctggttccaatgtactgttcagcccatcaagattattcttcatttcagatattttacttttcaattctgaaattctcattgggtccttcttatagttttcatttctctgcaaagttttctcattgtttactcatattcattcttttatttaagtccttgaaaaatattaagttcttgcaagctaatttcaacagttatgtcatttcaatatttatacttttttcttgattataggttagatctaataatttttattgtatattggacattcagacgataattaaaggggttcctgattatgttaacttcctttaaaagatttggaattttgttctggcaggcagctaaaatatgttttttccctgtaaatcttgattttattctttgaatgcttttattttgtttttgaatgtatggcatctttctttctgtataatgtggtctctactcctaaagaaaggcctttctggtttctcaatgcttgagatgtttagtgtcatgtctctccctactggctgagctggaactccaactctctaatttctgacagttttgtttatctctcaatctctcagcagatgatatctgctaggcccctcagagacccatgatgattaatgagtcttttgagcccatcctctgagtggctctttcttctctggtgctctggcctataaactctaattgcttctgctgcctatgactctgacctcatcctcttcagctcagaaacattgctgctcatctcattgtattccttctgtctgcccacagcacaaaagccattccaaatccaaatcccaggagatcactggtgtatttatgtgtgtttcacatctagcaaaaatcatagttctgcactaacagtgctcagttcccaaaaatagaaacctcatttatttcctacctttttttttagttgtttacatcaggagggcgagtcttgtactagctaccctgtcattccatcacaatggccaaactagtttggtttcacaaaaggcatcaaatatttcctgtgtgtctttgtgttaagcactattttacacatatgaactatttattatctcatcataacaaatttcggaaaagcttggggttgacggtaaatgctatgtcaacacagatcagccaaagacacagtttcagacactttctttctctcagctccaaagctgtgcctgcataaaactaaaataaacagatggaaagcaaaacatgctgaggggtacaaaaatccacatgtgtggagaaaagtaccagaaacaacatctaatttttccattcatatagactctctaagagtgaaattatacttcatgaatataaatatccaaacaaagacaaccagctgaagcaaagtagtgtttgcatcaacttccacatatttgtttagactttcccaaataatgtgcttaattaaaaataaccttcaggtgcaatgagttgagttgttcagtttattcaaagtaacttgctcttatttgagtgactagatgcatttttatttttgttttgggtgaattcagtatcctgaaaatggccaacacttatttgaataatttaaattatttcttttcaaataaaatgtttaagatataacaattgcttcttacactaacattctaaaaggataatcttagaggtgaactgaggtcaattgccatgtataaagcttattctgacttcatatttttgaagattagccttttatttacaacaatttttctactcaatgcatcattgctacaggttttggtttaagaagtaaccctagatatatcttaagatcttcactaggggacaggggttttaaacatcattgccatcatcattcttgcatcatatcctcatcacatgagctttggttcaaaaatcagattttaaacgatttcaaagtcagacttttttttttttgagacggagtctcactctttcgcccaggccggactgccgtggcatgatcttggctcactgcaagctccgcctcccgggttcacaccattctcctgcctcagcctcctaagtagctgggactacaggcgcccgccaccgagcccggctgattttttgtatttttagtagatacggggtttcaccgtgttagccaagatggtctcatctcctgacctcgtgatccgcccgcctcggcctcccaaagtgctgggattacaggcgtgagccaccgcgcccgtcccagatttttatatgtgtctgttggaatataagaaccaaagcaccataaactccagctataaaatttgcttgttattaatacacaaagaaagtgaatattaagagacgaagtctgagccaagaaaataaaaaaagtaattatttttggtttaatttatacatgccatttttgcacaaaatagtgccaaaatttaatgtcacattcaaactttaaaattcattgaagcaaactctctctgtttagagatgccatgatattacatggagaacaccccaatgacttcaccaaaaaaccattaaaattaataaacaagttcagtaaagtttcaagatataaaatcaacatacaaaaatcagtgatgtttctatacaccaatagtgaattgtctgaaaagaaagcaagaaagcaatttcacttacaatggctacaaaaaaaaaaaacaaaaaaaaacccagaatgcctagtaataaatttaaccaaggaggtgaaagatctctgcaatgaaaaccaaaaaacattgaggagagaaactgaagaagacacatatatctcatgttcatggatcagaagaaataatattgttaaaatgtccgtacaatgtacacctctgcacctgcagattcagtgcaatctctatcaaaatagcaatgacaggtggggcacggtggctcacgcctgtaatcccagcactttgggaggccaaggtgggtgaatcacccgaggtcaagagttcaagaccagcctgaccaacatggtgaaaccccatctctactaaaaatacaaaaattagcttggtgtggtggcacatgcctgtaatcccagctactggggaggctgaggcaggacaatcacttgaactcgggaagcggaggttgcagtgaaccgagatcacgcctttgcactccagcctgggtgacagagtgagactctgcctcaaaaaaacaaaaaacaaaacaaaacaaacaaacaacaaaaaaccaatgacaatcttcccaaaatgagaaaaaaaaaatcttaaaatttgtgtgcaaccacagaaggccccaaattacccaagcaatcttgagcaaaaataacacggttggatacatcacatgacctgacttcaaaatataccaaaaggctagagtaaccaaaacagcatggtaaatggaataaaaatagacacatagactaatgaactgaatagagggcccagaaataaatccctgcatctacggcccactaatttttgacaatggtgccaagtatagacaatggggaaaggacagccttttcaataaatggtactgggtaaactgcatatgcacatgcagaacaatgaaactagactcctatctctcaccatatacaaaaatcaactcaaaattgattaaagacttaaacataagacctgaaatgaaactactaacagaaaacataggggaaaagctctgtgacattggcctaggtaaggattttttttttttgtaaaaaacctcaaaagtctgagcaacaaaaacaaatatagacaaataggattacatcaaactaaaaagcttctgcatagcaaagggaacaatcaatagagcaaagaggcaacctatagaatgggagaaaatatttgaaaactctacatctaataaggggttaatatccaaaatatataagaaactcaacaccaacaacaaaagtaaacccatcaaaaaatgagcgaaagacttgagtagatatttctcaaaagaagatatacaaatggccaacagataaatgaaaaagaagatgttcaacatcagaaatcatcagggaaaggcaaatcaagatgacagaaattttcacctcattccaattagaatgactactgtcaaaaaatcagaagataacaagtgttggtgaggatgtggagaaaagagaaattttacactctgctggtgggaatataaatgagtacagccattttggaaaatattaatagtttagagtttcctcaaaaaataaaaatagaactactgtatgatccagcaatcccactactgtgtatacatccaaaggaaatgaaataggtacttcgaagagatatctgcactcctatgtttattgtagtaccattcacaataaccaaaatatggaatcaacctcaatgctcatcaatttttaaatggatttaaaaagtactatcacaagggaatgttattcagtcataaaacaataaaatactgtcatttccaggaacatggatgaacctggatgacattatgttaagtaaaataagtcaggcttgggaagacagtgcatgatctcactcacatgtggaatctaaaaagttgttcttgtggaagtagacagtggaacagtagttgccacaagatagggaggttagggaacaagtggggataggagagattggccaatgggtgcaaagttatagttacacaggaggataagttctggtgttctgttgaatagcaggatgactagagttaacaacaatgtattatatgttccaaagagaagtttttgaactcattacaagcaaatgataaatgttatcagaaattgactttttaaatatgagactataataggacctgataatatcttctaataaatgaatataggaaaatcaccttgatttacactaaaaaagacaatattaaacaaaggtatattattgggaaattctctaaaatgctcaatgatggctttaaaaatagaagtttggggggctgaggtgggcaaatcatgaggtcaggagtttgagaccagcctggccaacatagtgaaaccctgtctctactaaaaaaaaaaaaaaaaaaattagccggacgtggtggcgggtgcctgtagtcccagctacttgggaggctgaggcaggagaattgcctgaacctgggaggtagaggttgcaatgagctgagatcatgccactacactacactgcagcctgggtgacagagtgagactccatctcaaaaaaaaaaaaaaaaaaaaaaaaaagaaagaacggagaatattttttaaatattctcctatttgaaaatagaatttcttaatacttttgagttcaaacaatggaagtaaagagatttggtcaccaatttaaaaactagtttgtctgtgtaattacaatttcttttctctctgagtgtaaacaaaatatttaggatcagtttattgcttgtaatgtgtcatcatttctctctttctttttttttctcacccatttaatttgtttactcttttttcccctgtgtttccagcaacataggaggatttagaaacaaaactgtcttgggcagagggagatgatggcaaatggatgaaaaactggcttcttgtttttggtggttactatagcaataatcatgatgggagatttttagccgcaagtggtttctataacaacatgatagggtgctttagaaatagacctgaggtaaacagattctttaagggcctcttaaccccttttatcccacaaaattagcatcctcttggaggatgaatattagttggcttatttgatgaaacgcttaaaatcttgcttttgttttgtaaagattaaatggttaattattctataaagacctggccttagccaatcagctcttaggctccttcacttcaggaaataattgatagcatccctactttatttctgcacagcaaattcaaatagccttaaagatatgcatttcatagtattcaccaaaaattggaaaaccataaatagtcctcgtgagaaagtgtgttcactctgacatagatcactcaagggctcttgctttactaatacttcatatacactatgatttcacctattgggctccctgacaggtggagcttttcctactctaactaatggagtctgaatactcatcctttattaggctattcagtgtgtgccagaatagacctggtccctattgagttataattcactaggtattacatggggaagtttagtaattttttgaatttattaaattttagtatcataaaaactgacatagaaaaaagcaaaggcctccatttcatacataagcatccttcaggagcccttataagtgaaagatcaaggggaatttatgacaggaatgtggtacaggagtagatggtggtaggcaggaaataatttttcaagagaaagaaagatggaaggcttaaatttagttaagtagttaaacagaggaagatggggatcaagtttggttgactttaatagtgagttattgattatctactctatgttgtacactataggtatatacaatgttgaatagtatatgggatttattttaaaaactaaattatcatatcaagtaaagcactcttattaaactattaattaaattaattgatttgaagtggccatatatttacaagaatgatttcatttatgttatgatgtctcatgcattttctacagtagagccatccttatacttttattcttttctattcagttaagctgccaattcaaaacatcagatattctctttcaaatctcagaaggatgtcagcaaccatgcatctccttctctctgatttcaaacagtacaagctattcccatttccctggtgttttgtgctcagcaatgaagcctcggaattcattacgtaatcacttgccatagccttctggggtggagtttgccaaatggatccctgggagatcaagacccattctccatgtgtgccatagggctatgcacatgagctgaggcatgtctgtattcaccaaggccctgctcagaacagcatgtgccagaatacactgggcaaggagccattcataaattcttgaaaaatcttatccagaccaaaggcacaatggcattgtagttgttgtgctcattgccatggggcttttagctgaataaaaagaaaataaaaaatatattcatgatgacttccaagttatccagtaaccacagtaacctaggttttccccaaatttggtccacaactttgagtcacctgacagaaacaaatcattctgtctttgttcaagcatagtgagccatagagtgagtgaaacaaatttccctgggataaaaaccaatgaatcagcaaagcaaacaatcatcatatatttattttactattagaaggtggtattcaaaatgtcatcaaaaccaaatacatacctcatacatacaggcatactgaaaagcatatattatagttcctgaacttaaagagtttgtttgctaattgtaaggacaagtcttcatatatggcatgaagaacactttaggttgcatatagataagtgttcaattgtatcttaacaataataaattctgtggctgctcaggccaggagctcaaggggtatgtaaaaatatgaggaggattaatgggaaaagtacactttgcattggacttctaacaatttgaatatacatcacagttaaactctcagaaagtattctgagatatttttattcatggctactataagaagaatgtcataaagaagataatttaaattctggaggaataatgtcttactcataaccacacattatttttctagactttagttctctgtacaaaaatgcgagaaaactgttgagagttgcactatccaacacagtagccattaatcacatatggcttttgagcacttgaaatgtgactaaaattaagtgtgctagaagtgtaaaatacactaaggatttcaaaggcttaatgttaaaaagtgtaaatatttcattaatagtttttacactggccaggtacggtggctcatgcctgtaatcccagcacattggggggccgaggtagacagatcacttgaaaccaggagttcgagacaagccccatctctactaaaaatagaaaaaattagctgggcatggtggcacatccctggaatcccagctactcaggaggctgaggcatgagaataccttgaacccaggaggcagaggttgcagtgagccaagatcgcaccactgcactccagcctgggtgacagagtgagactctgtctcaaataataataataataataataataatttttataccaattacatatttaaatataatgctttatctatatttggttaaatatttaaaattaatttgcctgtttgtttttcgttgttaacatggttacagaagacttaacattccatatgtagctcacattatacttccattagacagcactggtataggtgcttgctatttaagtgtagtatgtggaccaacagcatcagtattacttaggagcttaccataaatgccaagtctgaggccccactcctcctgactctgcaaggttaacaagatcctcagcagttcatatgaacattaatgtttagaaaatgctgatctagataatgttttagatgtttctttttatgactctgtcttccttttcatttggatttttttcaaataaatattttacagtctgggcatcctgacctagcacatattagatgcataaacttggggaagttatctgacattcctgaaactcaattccatatttataaaatggatgtaatacctccaatcccataatttttctataggggttaaatgaaacacaagaattatgaaaggaaccaataaattggagaaatttttataatatcaaaaataatattgaaaaattagattattctaattattttcattcttatattgattgccaatactattttgatgtacagtggaatgaactagagttcgaagggctgttttcatttattttacaaatgtcacttttttaacattaattgtgtataataaaacttagcacactgataagtctctagtagagatattaaaacttttggatcttcttttagaacaaaagtgttgtgtagctaaattttcctgcaccatcattatataattgacattgaaattatatctgttcgttgatcgattctgcaaaacatggctttatggagcgggaaaaaactttttcgtctttgttcagaacacttttagctttactgtgagaatttcaatttgctagaggcaaataaactagtaaaatatgtctattccatagtaaaaggggtcattcaaaagcctgtccttattaaaatatacattgattataataaggtcagtgatttcaggcctgattagctttaaataaatgtaatgtcaaaggaatataattagttcctcattaaaatttttcatgattgacagtgagtaaaaatgaccttcacaacttgcatcatttagtcatgttctaaggatgacaaagggcagggcatcttctatgaggtaaatgtgtatgattgcagcctgaggcacatgcacttggtcccttaccctacctaaccctaacgcccaagacctgatccaagccagaccctgtgcttaggtgtgtaggctgtgtaaaggaggacccagaagctttgattctcatggggatgctttgagagaaaaagaaacctttgaaccggcaggacctgatttcatctgtgatgatgctgatgatcagaaattatatataaaagcaaatagcaacgtgcctatcagatataggggatttaaaatatgttgacagaaaactttctcagtgaggccactgaccttctaaagaggagctaatagtagaatagggatattaagatacaggtgatgtcaatgaattttggccaaaaccaatcttcttacctggagtaagaaagtcgtgtttcaaggagtttgcatgagtattaattgtggttgatgatgatgggaacctgccctgattattaggtatgattctcagagaatgtgtgctggtgctaagcttgcatttctcagaacccccaaaactctctttgcaatattatatagtttcattttcttgaacttattcatttgttaaatatgcatttactaagcaccaactatgtacatggcactctgctagtcaatagacaaataataagatatatgtactttggaccctgcattgaaagaaaaagcaaataatgttttttaaaaaactactttatgcttgattgttataaggaactttatgtgtattatctcttttattcctaataataataagaacaaggatgattgataatgctcactctgtgccaagccctgttaggcattttatgttcattaatttaaccctttataacaactctatgagataggtgccatttttacaaaaatggaaactgaggcagagcgatgttatcttgataaaactcatagacttagtaagtggcagagccaggatttaaacccaggcaccaaacttcatgcgcttatccactatatatatggctccacatcattttctttagtaatcaggacactgaggctcagtgaaaatgttttttcttaaagtcacagagatggtaaatactagaaccaaaatttaaatctctgtctaccataaaaatgtcctcttctcactatattaaattggcctcaatttagtatttaagacaacgtgtacagtaggaatacaaaggaaaaatggtcttaaaggagcccatctacttcttattttaactgctccatgtggattctatcacgcagtacatcaaagtaagtgatttaaccaatcatttgttctgcttgattttatcaaaagaggtcaaagtaagaatttcacagcaaggcttaaatgggaattcaggtttccttgctcactcattcattattcaacaaatttctattgactgccttaccatgtgcaagccattttggctatgtcctgattaaagatgtgcccctcctgcaccgcctccctccccaccccaatcctggaactaaatttcattctctgcagaaagccaggctaaagagaattcagcaaaccactttattctcataaattggcattcttagacctggaaattttgagttctatctccagtagcattgtttataccttctatttcattctgattacatttcattagcaaaacatagcaaatgtttataaaatcgtcagtcttctaggtgaaacgatgtaagacaccattcatttgattttttggaaatatcaaattttatgttcacaattcctctattctactctgattatttaggtaaaattaggttaaatatagataactatagaattaaaatttaaaaaactgtgcctttacacgtttggaaaattactcaattttttttcaaataacgccaaccatatatattgaaaataacattattccataccacaggtgacatattcttttcctatccctagcagcgacttccccaagtccctgcttgtctcaacagtttgaggaaaaaaaacaccagaaatatacatgttccagaacaatgaataaattcccaaataactttatatacattagtgaggatacaatgaggagtgtttatctagctaaatatgaggcatattaaaaattgctactttaacccagatatgagcaataataggagttttatctacgcctccttcctttccttctgctgacaaaggatacatttaattcttgacgttaatatcagttaaaatgagatctagagacagatataattagagagctagggagagaattaagttagtaaatcttaagaaaagactgagtatactgatgataagaggatatttaaatagaattttgaaaaagatcaaggatcaataattatacatttaaatatacatatatgtatgcatatacatatgcatagttttacataaagaaactattaaggtaagagctatggctttgacagttaatactcaagaaatatttactgagcacttggtataaataaatagatatggagcacaatacaaagatacagcagatgctctgaacaattaagtccttatcacaactcaaattccatagctagcattttgctgagccaagaatttaaatggtacttaaaatttatagaggccggggactgtggctcaagcctgtaatcctagcactttgggaggcctggatggctgaggcgggcagattgcctgagctcaggagttcgagaccaccctggcggcaacatggtgaaacccccatctctactaaaatacaaaaaattaaccaggcatggtggtgggcttctgtcatcccagctctttgggaggctgaggcaggagaatcacttgagcctgggagatggaggttgcagtgagctgagatcatgctactgtactccagcctgggcgacagagcaagactctgtctcaaaataataataataataataaataatttaaaaatgtataatcagatgttaaatattttcttgcaaaaaacaagggagctggggaacagaacctttttaattcaatttcataattatttttgtccgatcctgaccattcccaggtaatttacaggaagggcatagttggcaccttgaattagtccattgttaggctttctatgtaagggtactcgtgtttttttgtttgtttattttgtttcattctctttcttaaaataaaattccttcagtgaaaattattagtgacttgtacctttttaattatttttattgctatgttttgtacttgttcagtaaattttctattaagaactcaaaactatttctcaacatcttataaaggtaagagctagcatttaccaaacacttacgatgtgtctgcaaagcatttaaatttagtgacttaattctcacacaccaaaaaaaaaaaaaaaaaaaaaaaaaaaaaaaaaaaaaaaaacagaaaccaaggctgggagaggcagagcaggcctggtacccatctgttgccccttcccactgtattatcctgactcgctggtaaatctcctatgattgctaaatagaaaagtcaatgaaaagattgataataaaaaccactgaatacaactttcagattcttgattgatgattttaaattagagaattacctgtttcatagaaaagtgcaatagaactatcaaggacaaaggaataaatactacttacaatagagaaattaacatgttcttccctgaaagtcttgcaccttgcactgtttcattgctctaaataaacatactcggcctcataatgaaacaaaattaccaatatggctattttccaagtcaatttaattattagaaaatacatacacacagatgcatacacacacacacaagaaatatatttactgttatttgggtcttcatcttccttaaaactggtcaaatttgtttttacttctcagcagacaaaaaaactttattttagcactagaaatacttaatgcaaatatagaaataattgcttatagtaactatataaaatcttttcttttctcttgtgcagaggttttcaaattgctggtctcaaaccctagctccttggaggtgtctctaggggaggcaggagactggtctgactgggctccaagggaccttccctgcttcgacctgagcagatctgctttccaattgtgtacattgggattcctcatgacattttccttgaaggaattctgctgctcttaaaaagaaaaaagaaaggaaaagagggaaaacaaaaagtctgaaactcacagtggtagaatttcttaaaacagccagtagatggcaaactttactgcaaggaaacaattttgcagcctatataatttggtctgaaaatagcaattaaactctacatccagtaaaatttgctatcctgtatataagtcttctgttaaatcaggaaacaaaattctctatggtactttctctgggaactaaatttcaattataatttaaaatatcctataacttctttctgtgtccatttaagtcttgctctgaaggtattatcactatgaaaattattgcattgttcactgaaagtacatacaatgtgctaggtatagtaatgtagatgacgtagttttttcattaggatgaacccaactatgtattttattaatgagtttggttgaggcagcacaaaggtcacaaagaaagatttttaactttgtcctcatttataaatttaatcttgttactttttatttccttgtagattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtaagtgtgatcatatctgaatcacagatggtgtagttagctctttctaagtggcagaagcagaggtgacattttatttttcacacaatcatttatgaaaatggccaagttcttgacaggaatcaatcactagatagaaactccctaaactgctgaaaatccactgaatgcactgaattctaagtggttgcctgctgtcactgttgctgttttaaatggagctctacatgatttaaaactggattcagtctagaatgaatgaggtccaagagaaactcaagggcagttcaggtttcctcatcagtgcatgttcctttcattccagttcaagcctgctttctaatccccaaagcctggcactgcaaccttctgggaaggcagtttggaagttgatgggtttctagtgctgacttgagtattatcaacagatcagtggtagtaaagctgatggagcatggtatatcagataaaccacgatttttattaagaaaaaaagcctgttcttgttttacgtcttagagcaaacaattgtacctcatatttatctatctattctttacaatgtttctgttgatagaattttattttaataataaagtaacaagttgacaactcatcattaccaagttacatgctattcagcctcttcacactcagtatttatcctccctatccttttgaatcactgttactgttttaggtcaattcttcacgatggccacatttcttgctttgctttattctttggcttttccatttacttgtaagggggtaacttacctagcctatgctttctcacatgcattcattctaacttctgctcaccactttcttacagttcctgactcatatctctaagacaccacacacattttaataccatgttctcccttagcacttgccgtttttgtaccttcctgaaagccttcctgaggctttcagcttttaaacttgccttcttctcccaacactttcacacttagttctttattttgtcattctttttccaagtgttaagcaatatatctatttggaaaatatttctcttcaaaatttgcaccagaaccctccagcatcattttacttttaaacattctaaaactatatattttataaaatagacacattcctagttgctctaaaatgaaatttttcccctctccctcctcctttacatacaaccagtcttcagaatctgctgttttgacatctaagatatgttccaaattgagctcatccattcttttccttggttaggtttatttcaactcttgtgtgtactactacacaacctcccagacgttctacttatagcttctaccttctcgaagttgttctgaacactgcctttgaaataacttttctaaaatagacctatgccgtagttctgaagagccttgagagcttcccactacacagagaataattttagcctctccctgaaagcacttcacaatttgggcccatgacagtggccatgtcctcacacattccaccgaagccttctatttcctctaataaatcttcttcatttcttatacaagtcatttctttccccctggaatgtccttcctcacttcacaatgtctactctgaagttctgctatactttttaagacctagttcaaatatcacccaacacaagaagtgtttccaggttcctttccagctggaataataattccacactgctgcagtaattatattcattatgtttgtactagttgacacctgtattaaagaatcccctataattctttcctattttacatatatctatgtttttgcacccccccccaaatgttagtttctaaaggacagagtattgttttatatttattctttaattcatcaatactttctgagtttctattagatgtcagttagtggattaagaagaggagtcctcggccaggcgcggtggctcacgcctgtaatcccagcactttgggaggccgaggcgggaggatcacgaggtcaggagatcgagactactgtgaaatcccgtctctactaaaaatacaaaaaattagccaggtgtggtggcgggcgcctgtagtcgcagctactcatgaacccgggaggcagagcttgcagtgagccgagatcgcgccactgcactccagcctgggcaacacagccagtctccgtctcaaaaaaaaaaagaggagccctcttcctccaagagcctgactcagtatttgtgagtaatggctgcttaatcaactgttactaaattgttctaagttttacaattcttccatatatttctgggcacccttccccatcctgaaactcaggtaaatgaatattaaataagaattcactttttgtattattttatgtatactctatgatgctaaaatgcttatgtcaaatggaaaattattttatcaagtgacttaattgtcaatactatctaaaagttataggaaatattttaaaagcttataaaacaatagttgtatgaaaagctccttgtttgtatgccatactgaggtgtctctttctttggtggagttatggcaggtgaatttcaatattttttaaatttttgaataaaaataagaaatttttgtggggctggcttggaagtgctttgtttacaatggtcacatttaaaaatcaatacagttcattaagatagtgtcttccattttctgcttctatctcaatattgtgaatggtgattaaaaggaatagatataaaatcaaattaatgtttcattcatttcaactatagtattgtgtaatagtcttatatttgtaaaaaaaacacagcttgcaaaactatattttacaatgtatgttttttaaatatcttaattaaattggattttaatgaatcctttcagtcgtctaaatttaggcataaaagatggaaagggtggccaggtgtggtggctcacgcctgtaatcccagcactttcggaggctgaggccggcagatcacgaggtcaggagatggataccacactggccaacatggtgaaaccacatctctactaaaaatacaagtcccagctactgggaggctgaggcaggagaattgcttgaattggggaggcagaggttgcagtgagctgagattgtgccattgcactccagcctgagcgacagggtgagaccctgtctcaaaaaaacaaaaaacaaaaaacaaaacaaacaaaaaaaacagctagaaagagtatattctaaatgtgaaatgtagtcaaattccatcataaggcacttcaccttacaatgaattcatttatactgtaggttgtatcacatccctgtagggtccaatgggaatgagtccccttttctcactataacacttaggtccacaatgaggatgctttccttgtcaatccctgatataatagtgttgttccctatttgactatattcttcccttgttttctatgaaatcagctacatgttattatttcaccttttcaagtgacatatataaaactttcttgaaaacagaatttaaacaagagactcataaggcagataaaaatcgggtctattattagctggttaggcttgttcgggtaaaaaaaaaaatgcagtcataggcttgctcaccaatctcctacacaagtagaatggcctgtgttctagtagctcatgggtgtttctcagccctgactactcattagcaattacccagggagctctgaaacagaggtgctcagactctacttccagagggtcaaatttaattgatgagtctaatgtatagccagggctggcggccaaatattaagttcatgtgagctttatttggaaatttttcttgcaccataccatcatttagacacacagggaagtgtgtttatttcattgctatcccatgaccaccagtgtttgtggcagcccaggccaactaacgagaaccccaaagaaggtctgtagaaccaagggaaaagccaaagttgagaaggaaagaaaaaagaccatcagcaatcagcatggatgtgctggagtgctctgcctcaacttagacctcctgatgaatcctggaaactgtattacaatgacctagctgctgtgcaccacatccaaatttagagtgatcataaagaactcctcttacagaaaaaaacctgtgttcctctgagcagcaaagtaagaaaaggtaataaattttaaaaggcagagaggtagaaggggaaaaagagctgtagcacatagagagggttcacactgcgtgaattctcctctgtgcactccattatgcttcatgggcagtgattcatgaactacagaaatggtctcagagagagccactgaagaggctggtgagaatctgctgtgcataagcaaaaactccaattgaagctgaaagtaagtggatgcaaacttttttaatgaaaagaatattagctctaagcatgtgactgcttttagttcaatttcatgcaatgaatcatttcataattgaggccttctttaaaattagccagattgattaatgtacatttttctcattcagatgcctgcagtatgagaaaaatagggctgtaagagggcagagaaaggccagttcaatgtatgttgaaacaaatcaatgtagaaaaatatcttattcctctattacaaaatagatctttggtataaaagtaatcttttgggaaataagaaaatgcactatattcaatgtacttttcaactatatgatgaatttccttgcagaaataaaaatgtacaaaaattcatcatatagtgaaggaaatgtatttgtacttacagagtagttagaagactagttagttcatggagactagttaggaggccattgtgataacccaggtataaggttttaggacctggcctgggagagtggccatgggcatgaaaggaaagagaaagtataatgtctctagaaacaagactcacttaacatttatcaaggtcagagtattttcaaacttattgtatccaaggaaaacttgaaaactctgatatgaaacaaatgcattaaaagtttaactggcattgtcaacttaataagcttacaatgtagatcaatgggtctcaagtgttggcatgcatcagactcacctatacagcttatcaataaaatactgttttcagttcaacagatctgaggtgggggtccaagaatatgcatttaaaacaagttcccatgtgatgctgatgctgttagtttggggactacactttgagaaccactgacatagacagttatgtggatttccatgtgacatccttgactgttatttcacaaagtccatgaggcaaggaaacacaaatcaataaaagcaggcttttatataaagcacttattgctagtaacagttctaggtacttgatgatatgatttgagtgattgcctcctccaatactcatgtgttggagacataatcaccaatgcaatagtattgggaggtgggaactaagaggaggtatttaggccatgaggatggaaccttcaggaatggattaataccataataaaaagggctttttggagtgggttcacccccttccactcttatgccatgtgaggaacaatgttcctatcctctggaggatgcagccttcatggcaccatcttggatgtggggatttaccagacaccaagcccactggaaccttggtcttgaacttttaaacatccggagctaagagaaataaatttctgttctttataaattacccagtcctatatattctgttataccagcaccagatggactataagacacatgatatggattttttaaatatttgtcgaattcattagatcattaatttattcaacacatatatattgagtacctcaatgaattgggcattgttctatgttctgaaaatgaaagcgtaaagagaagtgatgacaaagtctcttacattctgcaaggaagagatagatgtctataaaacaagtaatagatatactgtatatagtaggttagagggtaataactgcatggagaaaagtaaaacaaaataatggtattagggattaactttaggtagaatgatcaagaaagtcttcactgagaaggtgacatgtgaataaagttctaaagaggagaggatgggaaccaaggaaatgtcttgtggaatagcattccaggcagaggaacagcagatgcaaaggccctgaggtaaagagtccttgcaatgtttgaggagcagcaataaagttagtgtgactggagtgaaggaggaaggagataggtcagagcaataatgaggtcagactgtttgggaccttgtaggccattgtaaggactttggcttttactttaagtgagatgggatgttattggagagttctgagcagagaactgaaatgatttgacttacattttaacaaggtcactctgcttattatgttgaagatacactgcagggggcgataagcatggaattcaagtgtctaagggaggttaatacaatagtccaagaaaatccactccttgtgggagagaagagtgaaagagacctatcaagttttttgtttctttttgttttaattttttttttcagatggagtctctctctgttgcccaggctggagtgcagtggtgcaatctcggctcgctgcaacctccacctcccaggttcaagcaattctcctgcctcagcctccttagtagctgggagtacaggagcgtgccaccacgcccagctaattttttgcatttttagtagagatggcatttcaccatgttagccagggtggcctcgatctccggagcctgtgatccgccgcctaggcctcccagagtggtgggattacaggcatgagccacctcgcccggcccctatcaagttttaacagtaactttctcccctccctgttccacccttaacatttaagatggaaattaacaaagaaggatcatggatcatgcaaacaaaatgaaagcatgcctttctctctctgccctctattgccctctgatggcaatgtctagattattcagaacaaatctgtcctttagaatattctaacaagaatgcagtctttcttagtagcttctgtccaccatattgccatgcagtgtctttcacgtacacaactgcaacatattttacctccctgggttacatgatggttactcatttaaagtgtcctatcagcacttcttttacttttaatgataattcctgttcctcttgggccttctccaatagtcctcatccatgctgatgcataagtctaagaggtatgatgtaactgacactgccattacagtggcacatatcaaagacataattcgaatttcagtcgttgtggaggtttgaatctgggcttggtgttctatcttttctaaatatattttgatcaactaaatcactttgaaggcatctgtggcaaataatatagataatttaatggtcatgggaaataatttgaggaaaataaaatatgttattaaatataagcttatttcatgagaaataatattattatatcaaagaaaaatggttgtttttatatgcgcttaattatgaaattgataatgttttatggtgtcttataaagaaaattaaacacttgttcaggcttttgctcagaactagagtcatttgaagtagtttttatgaataaatgaagtttccaggttttgacaaatgtttgttgaatgagtgcacaaaataacaaatattcactcagcaaatacttatatttgcaatgcactgggcattgtgcggacttcggagatgtaaaagtgactaagataaaatgtattcctgacaaaatgctcacaaattattctgggatcaggaatgtaaacaacaattaccatctgtctataaacatcatgctgtggaagaacaaagaaagaagctggtaatgttggttggagtcaggaaatgttcctaggaaaaaaaatggcctatgagtagagcaaaaatgcatccctttcagaatgtaaaactgaaacttgtatcttcctcctacatttactattattatttgaacaataacatgttgaatatcaagggagaaggactgcagagatattttggaaaggtgttgctatgatctgaaaagtttggtccttccaaaatgtatatgttgaaatgctgtccaaggcgatgaaaaggtgaggcttttgggaggtaatttggtcattgcggggaagctctcataaataggctatgtgcccttataaaagaggtccaagagagatccctcaccccttctaccatgtgaggacatagaaagaaattataatctatgagccagaacgacagctttctctctgacatgtgactgctatttctcctagtgcctacctagttatcagcagggtgtgtgtgccagtccgaatgcaaaggggatgagccaaaaaatatatagtaatataaagaacggatgtggtggaaagacaaatttggaagtagaagacagggattccaggctcagcctagatgttctctagtggtttggtactgataaataacaattatgaacttccatttcctcattcaaagattggcatggtaatacaacctaacttttagggtcatgatgagaatgaaatggattaacaaaagtttttccatagactatttaggctatgaaagagttaattgccaatatttctgtctcttaaaacattgctactaatgaatacctatggtatctaaacaatgtttgcctttgttttttacaggtatcattttcttatatttgaattgcattcaagtaatcttatacctgattacttgaaagtattattttttgaatactgttagaacccaactcaggaatagattaactgaagttcggtcaaaatctctctgccacacttataaatttaaagtgtaatattttaatatgtgtaggcaagaattcaacttctaaaatggccatatcataaaataaagaactaagaaattactactattttaacaatttcatatatttaggaatagtaattatcctaatgaagagaaacataagaaagtaatttgctatgattaaaacataattatggaagtacgaaaatatataatgtttaatactgatgtatttaacataaaatgagaatgttgtaatttttctataatctttcaaaaaaacataaaattaaagcataaaccattcataaaagtagtgtatttttcaaacatagcatcttggagtctctgaaatgggttactccagcttttaaaatttgatatatattttgctattttcataattcttttaaaaagtgtgggtgtatatatatgtataaaatatagaaagtgtagggggaaagtcattcgtttaacttgggaaaataatatattactatcttgtaaattttatgatatttatgatgcaagtgaagtgggagaaatggcatacagatggatttagagaaaaatggctggagaagaggaatgaagaatgagctcacagaattagaagaaactgttctccaaacagacaactgtaatcattagatacaaggaagtaggagaatttcctcccaatgccccactcctagggctgacaaagagaagacattctttctcttcctagaattagtttcagcctccatgatattctgggaagatggttttgaaactgtcaagaacattcttaaactttcactgatggtaaaatggtaccaaagaggacacaatgtgaaaaggattaagaaaacctgaaaaaaatgtttaatatggaaaccacaggttattacagttttgtctagcagtaaagcaaaacttgtagaaacaaaaaggattataatagtcacaataacaaaataataaaatataatcaaatagttaaataaaataatgacaaagcattaataatatttataaagacaaattttctgtatcatcagatttaatacatcatcagtcttacatacatttcagatatcattaagaaagaaaaattatttggttaagttgtaacaagaggctaaggcactgctgattgtaaagtgcatctcggttctagagagttaaaaatgtgagggagtaaaaaaggagtcagaattgacaaaattcggcagtccttcagagatagaatcctgggcttgtaaaatctgctttaagtgaatgattcaaaaagagaattttgttatttttggtgtccttaggaaaggtgtgtctaaattcacaagccagaaatctcattggctaaaacgccaaagatgttcccactgaaaataataattatccacgtttaatctcttacaacatcttgctaaacattgttatgcttatgttattaatcagagcaggaagtcatccagcctctccttattgctttaggatgttaaacagattgactataatatctaggaggagaacttactgtaaatctatcactataatgaaaaccgaatgctacagttccacattgctctgatacttgtgtcaccgacttgcactgataactgttgtacttgatatacataaaaagccccaaaatagcatacataattattattcaaaagaaaaatattatgcatagaggcctgttaggcatcacatacattgaatggaatttgaaatttaagatgatagtctgaagccagactacaattatttccaaagcgtggactctgcagataatgagaaaggcattcagaatggtttatcaacaccttgctgcgtgcatggtgtgctccctgcccactgtaaagaatgatgaagacagcgtcaaagtcaagacctgttccatcctgataggatataatgtccattatcttgtggcacggaatcttaacatggatctctaaatgccgaaagatgccaattggagtgcaaagtctctaaatactgatcacaagtttggggcacaatcattctgaaaccataataggttttaaacatttgccaaagccacaaatttgacttttgggcttttgatttatggcttgtggaagcactgagaagctctgtttggcatacagtttgccttcctgtagaggtggttgattattccatagctgtgacttgattattcatgcattcaacatttattgagcactttttaaatattcaagaatatgtgctaaatgccacagatattggtgttaaaggtcaaaggccctgacctcaaggagctcacaattttgtagataaaatagaaaaataagcaattgaggacaatatatatagacatttatattaaggggaattttgagagcacagtgaagcagcattagaggcaaatataagtaactatagtttccagaatcatgggatacacaaactggatatttgggaactaactggagctagcctggggaaggagggagtgaggagtggggcattacaagtaagggaaatacctatatgcagcctggagtcttgagatacagtggagctgtgaggccactgctgtgggtggcaccagtagaatctacatcttttagaagcttctactgcattacaaggcaattatgctttatttcagagacagggagatagagaggggatgatgtcaaaaatttaagcagacgagggtacaattatatttgtactttatagtgatcacatttctatagaaatgtagagagtgattgcgaaaagagaagtcaataatagtgagagcagatgagacatgatgagggttgaattaaggtcacagcaataaggatggcaccttagatccatttctaagagagagatgatgagatctgatgactaattaggacacggggaatagtggcaaataagatgataactcctagaactatggcttggatgacctggatgataataccattcactgagaggagagttttggcagggatgggggtggcgcaaatcagcacaggtggggagatgaaggttatcattatttggaattgtggaatgatgcctgtattagtccattttcactctgctaataaagacataccctagactgggtgatttatttaggaaaaaggtttaattaactcacagttccacatggctggggaggtctcgcaatcatggcaggaggtaaggaggaacaagttgcgtcttacatggatggcagcaggcaaagagagagcttgtgcagggaaactccccctaataaaaccatcagatcttgtgagacttattcactatcacaagaacagcacaggaaagacctgcccccatgattcaattacctcccacagggtccatcccataacacctgggaattcaagatgggatttggatggggacacagccaatgcctgtgagataactcaatgccattgagatctcaatgcctgtgagataactgaagaagacattctagacggtatcaggaggatgatctgggccagacgcagtggctcatgcctgtaatcccagcactttgggaggctgaggcaggcggatcacttgaggtcaggagtttgagaccagcctgaccaacatggtgaaaccccatctctacaaaaaatacaaaaattagccaagcatgatggcatgcgcctgtagtctcagctacttggaaggctgaggcatgagaattgcttaaacctgggaggcagaggttgcagcgagccaagaaagcaccactggtggcaaagtgagatgagtgagactccatctcagaaaaaaaaaagaaaagggtgatctggtctggaggtacagaatgctaatgtatatctacattcgcttatgtgaaaacgtcacagggaaaaatctttctgacttctgtgagaatgatcacctgtttctctacctatagtctcttctcaactacgaatagataaaccaaacattttttttcccaatgcacctttaatcccatggcttttgctgaaacttggcatttattcaatgaaaccactttccacacaatcctctttgaagagtccttatctccatgattcattcttaaggccaagagggaaggttggctttcttgctgaaaccactgttcccatgagtccactagtgggacatttaacttcagttttaaaaggatggcttccttgggtggacaagggggaaaaagcattccagacagagatcagtgtatacaaaaactttgagtggtagaggtatatggtaggtttgaggaaaagcaaacagtctggtatgacatatgactagcatgtagaatgatgacagaattttaataggagccattggaattgtatggaccatgcttttggaattctgtgagcttcttattctcagtcaccttcatctttattccactgcagccatacattgatccaatttcaagttagaccctggcgtcattcaaacctgctttacaacagaaattgtcaccacatcctgaggcttctcatttcctttctactattgaatttttagcagaacctctgtcgcctggcctttccatacccatactctctctcactccttctctatcttgacatctccccaacaatcatggacttaatgagaagcatctcaagaatgtgtctgtcattgctctctaaacattcttgtttttgaccttcaactttccagtagtggaaagccccattttctaccttcttctcgtctagctgtaaagctattaatccacttcaaatatttattacctaattttagctatatatttgctattgctttgtggctttttctacattaattgttgatttttttaaatggtatttgacacgctggctgctccaaatttttccagtctctatattttatactcccagtaatgtcatttatatttattgataagtgaatttaaggttattctaaattctcttttagagttgtctttgcttccagtcacttttcaaacattttttattctacctaccctgaagaattaagggtggaatgcaggaaatgacaaacacactatagtaatacctaccattgatgtagcatttactgtatccaacctcgttgttagtagtgatagagcagagctcagtcctggatggtctgtcaaaaaaatttatgttctttccactcttccatgaccttagttatgccaagtaaaatagccatggaaaatctcattcacagactgcagtagaaatagctaagcctcaaagagcaagccacttacctagaaacaagtgctattgcaaaaatttccattttcaccgacataaatttagagttttttattttttaaaaaacaatcaaatttaatatgctagcttctcttttaagttggttatttgttgaatctagtaacagttgtaaataatagatggtgttagaatatcctgctgcattttctgtagagaaaaatgggcacaaatcaattgaactactactgacttctgagttttttgaaagtcttttaataccattttaatatataatttattatttggggttagaaacaaagaaataaagatggataagtatagatattcttccttttgtgtcttttaaaacctgtatgcaaatgcaattattgcatatcaaatactattttggcacttaataaaatagtttgttatttaaatactactacaacttgtataaatcataaacttattttgcttagcaaataatacctactaattttggggggataagtacagtttttttttaacataacattaccttaaaatgaagtgttaatagcttctaatgatgccattaattacattgtcaccagtttttgtatttaagggtagtattttacaaaaagaaaaattaagataaaaatgtctatgcaaaatgagcacttagatcaataattgcacattatatttgtacaatagattttttgtggaaaaaagtgttttttctctagcaaatacttagtatgtatcaggtactgctataagtacttttgaacacatttaattagactaagagtcctatgagataattaccactatcgtctttttcacatgaggaagctgaaacatggaaaggctgagaagcttgcccaaggtcatacagctaataagtggctgtgccaggatcccgacccaactgtctggctttggagtctgagctcttacccactgttctctctgctcctttactaaattaagtgtttaaaaataatggaaaaacatcgaccagccacttttaggcttccaacaaaagtgcagttaacaataaactttgttctaaaaatgacttatttgttttcacggactaaacaccacaagctgttgtatgcaataattctttgtaacagctgctctgccttgtgcaacttcccacaagcacaccaaaagttaatatcaattacaattaagggggaaagttattttgggtaacagaacatttgacaagtgctctggtaaacaaagcattgtcaaattgctaaattatgaacactttgctaaaactttttctgttttttctgtgctgacttttttaaaaggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacaggtacattttctctggcgttgggtgattggcttagaactccctgaccatgaactattttaccactctgttgaatttagagctctcacgttctcggcttaaaatttggggtgtaactttatactttaactgatgaaaacattcagatttcactaaaaagggtattcttggagaccatctgtctcaagagggaagattttacaagtcattcttgtaatagtttagaactgcttatcctatggaaaatggccaatttttcaattccatgaaataaagctgttgtagataggaaaggtgcaaaaacagagctagagattattatatatgtgtacataagtttgtatctatatgtcaaggatataaatcagatgacagcaataaatccttttaaagtgttatataaaccatgttggaaaaggcagtgatatttaattacttatatcttgaattaatttccatgtgttcagggaattgggtgaatatttttgagaaagcataatggcgagaaatagccatgtgattctgcttcaaattgaagtctatcattggctttcaggcaaaatagaacagcaataaattacatctcaatatgatgaatataataaatgtgtgtaacagtaattgagctcatataaaacatttttaaaagaactttctaatacttatttaagccacgacactgaagaactttctaatctttatttaagccacgatgctgagttaccaaatacataacaatttttaacaagattagcacttaaaattatcgtttgattcttcgacagctcagtggaaggcaagataagtatttatgtttccatattacaataaggagtctaaagtttagggaaatgagaagacgcccgcaagttcacacaattaattctttgcaaaaggaagaccagaatggttttcctttatttagtaaataagacataatttatgccaaatctaatttcaaagtgaatcagagtcaaaaggagagcaataaaaggcacatatgcttcaaaaatttgcaaaaataatgacttttttttttttttttttttttttgagatggagtcttgctgtgtcacccaggctggagtgcagtggtgtgatcttggttcaccgcaacctccgccttccggttcaagcaattctcctgcctcagtctcctgagtagctggtattacatatgcccaccaccatgcctggctaattttgctatttttagtagagatagggtttcaccatgttggcgaggctggtctcgaactcctgaccgcaggtgatctacctgcctctgcctcctgaagtgttgcgattacaggtgtgagccactgcacctggctctcaaattttaatagaacaatgtggttgtacattctttttaaaatataacttttaattacattccatgtcttgcctttgacttttagttgtaccccaataatgctctaggggcataaatctacattcctggagacaggtaactggccaacacagagacagacaggtcacaatggaagtttccacacaaggcctcctagaggaaaaggaggcttacccttccatacttcactgtttccagaaagcatcaggacagaaacgacacaactttttgattccaatggaaatgtaaacaaggctgaaactttgctatcttttattctcctcacttgaatatgccatgaataatttccctattgtaccattatctcttattgcctaaatgttgagatgatagtcataagatcaatccaatataacctgactttatgttcccacaaaaatttaaaatgtttgctatgagatacattggaaaatcagaactgaaaaaaaaaaaaagaacttcttgcataccaaaggaattatgcaaatggagcttctaattccgtgaggtccactagtcagccagccaagccctttggcaacagggtttttgtcgctaatgttttacctatactagatttttagtaggtattttttaattgaacaaatggaatactgaatagatttctaacaacacatatgaagattacagtcacttacaatatttggtttggtgataaaaacacacacagccatagcgaagaggactctacctgccttataaattcatagatattcttttcccaagaccctcattttgcctaagctgagtgtgcaggtacattttttacaatactaaatccttgaggagaccccgacctaaattaaaagtctcctcttaataaaatcaacaactttcttcattagatttgtattttggggctatttgataattccagtcattccgttaataattagaaatagtaaggcctaaatattcttgcaatctaaaaataagagaacatcgtaagtcacaattcatttaataaaggcttttcctgagtttttcataatttatggtttcacttttcatatggaaccttattaatgggctctctgtataacagagtgccatgatggtataaatcattctctaccaccttaaaaaatattaacaattttattaagtgctatttagtagcaacatatttagtacttcagatatgtggaatactgtgtctattctttatatgcatacttaattgtcacaataaccttgtaatataggtactatattcaatttatgaatgaagaaactgaactaaatagtcatggtttgcatgaccctgtactttaaattttttaaagttaataagacattaatatggaaataaatcatgcattcagtcctgtatagataattccccagagtttttgaggtagtaagatgatgccatgggtcttgggttgatagacagttgaagaaacagtataaagatatctgatctcaatatgactaagagttgacatgaaaatttcatttactttccagatatagctgtaactgcacgggtagtggattcacagggacacactgtgagaccttgatgcctctttgttggtcaaaaccttgtcacaataatgctacatgtgaggacagtgttgacaattacacttgtcactgctggcctggtgagtgacaaaataccttccaccaattatttttcatttgtttagaatacacatatcgcttatagcaaatgaaatgaaaaattattgttgttaaatgttttaaatcaatttcttctagctaatattgtttagttttattcttcagtgctcacacatatttactgctatactaaatgttgtctgaagtaggttaccaagctgcccaatgatcataaccctctagaggaatagaagggaaaaatcaatggaaagatgaaattcagcatgatcttcatggagaaaaattcactggaagatgctcttttcttccaagatgttctcttatatggcaggaatatatagaaatccatgaaataatgttaaactattagaaacttgtattctcttaggcatttgtaaagagttatatttgttaatataataaaaagttaattatctataaaccataattaaagtttacatatagaggataattagacgagtatagaggtgatacaagaatcaatagaaaacagtatgtaacatttgtgttacattacaggccataggcaaatattgatgctaattttgcaaaacaaactgcctgacatacagctttgcattgcataacaacattttggtcaatgacggaccacatatacaaccgtggtcctgtaagattacaatagagctgaacaattcctactgcctagtgatgtcatggctgtcttaacattgtagtatcactcactatccatgggattgtggtggtccctcaggaagtattccaaaagaacgcattgttgtcataggagatgacagcttcatgtgtgttattgttgctgaagacatttcagtgggacaagatgtggaggtagaagacagtgatattgataatcctgactccatgtaggcctagactatggtgtgtgcttggttcttaatttttaataaaaggtttaaaagcttaaaaaattcaaaatagaataagatgtaaagaaattatttattgtttatttatttatttttattttttgaaacggagtctctctctgtcgcccaggctggaatgcagtggtgtgatctccgctcactataagctccgcctcccgggttcacaccattttcctgcctcagcctcccgagtagctggtactacaggtgcctgccaccatgcccggctaattttttgtatttttagtagagacggggtttcactgtgttagccaggatgggctcaatctcctaaccttgtgatccgcccgcctcagcctcccaaagtgctgggattacaggcataagccactgcgcctggcccataaagaaattattttatacagctgtacatgtgtttgtgatttaagctaagcattatttaagagccaaaaggtttaaaaatttgaaaaatttataaagtaaaaaagttctagtacactaaggttagtttttaagacagaaaattttctaataaacctagagtagcctaagcatacagtatttataaaatctacagtagtatacaataatgttgtaggctttcacattcattcattactcattgactctcaagagcaacttccagacctccaagctctattcatgttagtaccctacacaggtgtaccacttaaaaaaatcttttatactgtgtttttattgtaccttttgtatgtttaagtatgtttagatacacaaataccattgtgtttcaattgcctacagtattcagtacagtaacatgctgtacaggtttgtagcctagcagcaatagactataccctatagcctaggtatgtagtcagctataacatttaggtctgtataagtacactctatgattttcacaccatgatgaaattgtgtaatgacttacttctcagaacaaatgtttgtctttaagtgatgcatgactcttttttaaaatctaattctcattaggattttttgataaaaataaaagacacagcatctcctatctcctcttgctttatttactgggaaaaaatgataaacttatgattactcaaggcctagttatataagcttactgatcatctgtctctctctccccactaactttattgtctaagaaaatgataatcttgtgggtggaaaggaaacctggagactagtcaatctaatcagtagtagcttctggttgaaagatatcctattgcctaagagacatttaacatctttggttaaatacattttataggaaaaataaatgaaaatataaaatgaagtttggaatgctgtggcttggaaatctatatatgttatgtcttcccacttgcagataataaatgaggaatatttgctaacctttggtcatcaacttgacttaaaactgaaaatttggctgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaacctgaaaattttccaaactatgtagtttcatgttcttgtcaccaaccaacactcatgaaagatctctgtccagaagcagagggcggagtggatggtttaggagtaggatatgtttcctgtttattaactgagtgaactcgggtgagtttcctcttcatctctaagttcctcatctgcaaaagagggataaaaatactttacttgtagtattattatgaaaagtaaaattgtaaaaatagagccttgcacatattaagcactcaaaaaagggcaactatgtagcaaattctataccatgaggtggaaattatgtaggagggcgagagtttgtaatggagtcaggcagttaagaacatctacctcaagaaacccaattagtacatgttccattcattcatggattcaagcatttaagccacatggatttcagtggctaatacaatagggatctgggaatataaaaggtatcgtcccttcctccaaggagcctaaattctagtagcgagacatatgtcaaaacgtatatagtacaatttttggtacaataagaggctatactaaattctgtaaaaatgaatagagaagaagtgcagggatagcttgatcaaagaggcaccattttagataagctaaagatgactaagttccataaatgtattcactagctgtgtgactttggacaaattactgctctgagcctcagtttcctcatttataatatccacaggatggagctgtttcagagataaatccagtaatgtatataaaactcctggcttatcctggaccacagtaagcactaagtaaaagttaaataaatatcaaaattaggaagttgtgtagtccattacttatttaataaatgaagaacggaaggagaagaggaaagaaagaagcaagaaaggtggcaggcacccatagaaaagagcatgtctggctgggcgccttggctcacacctgtaatgccagcactttgggagaccaaagcaagcagatcacttgaggtcaggagtttgagaccagcctggccaacatggtgaaaccccatctctactaaaaatacaaaaaaaaaaaaaaaaaaaaaaattagccgggtgtggtgttgcatgcctgtagtcccagctactcaggaggctgaggcaggagaatcacttgaacctgggaggcggaggttgcagtgagccgagatcgcgccactgcactccagcctgtactccagggcgagagggtgagacttggcaaaaaaaaaaaaaaaaaaaaaaggagaagaaaagaaaagagaaaaaaagaaaagagcatgtccaattgtggaactttgaatgattgcaaaaatactggactgtgtagggctggaggtagaaacattgaactggggagcaggactaaagccagatcacaaaactccatatctgccctgccaactacggggcagagaaataacaaaatttgctttgttaatttcaaaagagttccctggcttcatggcagatgatcaaagaaaataacactaaaggcagggaaatctagtgagtagattcctaggtagtttgaagagatgagcctgtttgctagaacgaagacaacagtggttaaggttggggcgaggggtagtcctgagagtcacataggagctggaaatgatgtggggagtgagaaaagggcacaggtttaggacagttctgcctctgggtttctgccttgggttactgcatggatggtaattttgcctagatagaacatcctgaatacccttgtaacctatcttgctgttgtatacaaagataaaagttaacactacaaactactctatatctaagaaaaggagaccatttcttcagctcatgacttcactgccacagaacacaatggcaagaatccactgatgtaattgcctagggtcctcatttcagaagtaattaataattacaagaagtgtcagtcaccttaaatgcttactttcaaagatttcctgatgcccagatgtgattggaattgttaacaaacataatataagaaccccagggatgtgactcagtatcatgttgtttatttgttcagagttttacagaaaaatttgttaaaactattgaatacagtcttgactgaaggagtctatttatatacatggttaaagaaagcagcaaataaaatccccacagggcctcagtgttggggacaggactggcaagactataaatcagaatcttcctaatgttcacgattggaatgagataatgcatgagccagaaaagcaaaaaaaggatttatgatgattctaaattactccctaacctggcttatgtgtgtctcgagtcttagaatgagaagaaaattgaaaatagtccagcctttcttcaataagtccattgtggcacaacaaataccagttaataaaaacttattgtaaaaactattatttaatgtatttgaagaaccttaagtatgaaataataatattcaaaaggtagacattcaagtttaagagactctgaatgatctttgttgcggggggtcactacaaaggattgttgggtcttgatctgacatgttattttactttcctttttttttttttttttaactttttgactctaagtttcttcttcagattgttgagaaaggccccaagggtctttttgtaaaaaatatattacactgttgagctgcagaatttatgttgtggttatgatttaacatatgatctcatttaggtgtttattaaaactaatacaaaatgagcaaacacattacaatctcattatttgcttattaatagtcaattccctggtttatgtgctaaactaggattataatctaaattgttattttcaatctttgagtagtactagtgattgaaggtctactgcttacatattgctcagtcctggactggtaaataaaatgaacacagtctctgttttgtgaagcacacagcctgctgagggaggaaaccatatacacaaatcaatatatatttaaaattacaatgagagcaatgaaagaaaagaattgggtggcatgagagaaaataaggggatcttatttatatctgcccatgatggaaagttattctgagaaagcaatacaagataaagtctgaaaattgagtaagagttagccaagaaaacacttgaaggagagttttctagaagagagaaaaacatcacgaaggctgtgggaatgcagggagtttttacagttatgttaaggatgttgaattcctttctatgtgaaaggggaagttgttgaatgattttaaagtaaacacatactatgatttagtttacaagttttataattctcaactgtaaattgtttccaaaacatttctcagcagagttaaatgatattgcaaagggccttaggcgactgtgaagttgaattgtgtttctttaaaaatatgaggtggctcacgcctgtaatcctagcactttgggaggccgaggcgcgtggatcacctaaggtcaggagctcgagactagactggccaacatggtgaaacttcgtctctactaaacatgcaaaaattagccgggcatggtggcacacgcctgtaatcccagctacttgggaggctgaggcaggagaatcacttgaacccagcagatggaggctgcagtcagccaagatcacaccaatgccctgcaccctgggctacagagtgagactccgtctcaaaaatatataaataaaaaaaaaaaaaaaaaaaaaaactttatacatttcttttaccacgttacaaaacacttgatattatcctattgaccatcagtgttatatgtgcatcctactaaatttacattttggggcgagcagtatacatagtatataaatactcttacaaatcaatatggaaaacaacctaatgaaaaaaacaggaaaaaatatgaaatggtaaaaaaaaaaaaaaacacccccaaaatgttcagctcaatattaactggggaaaacgtaaaccaaagtaacagtgagatactatattttatccaaccagctggtaaaatttatatatttggtgatagcaaaggttggcaaacgttttgagccacattcacaatcatccactgctggtaatgtgcaaatggtacaactagagatgtttggcagcttttattaaaattaaaaatgtacattacttatgacccacaaattccatctctaggcataaactgtagggttaaactcaaaacgcttacacagacagccatgtataattgtgtccgaaattggtgggttgttggtctgattgactcttcaagaatgaagccacagaccctcgcagtgagtgttacagttcttaaagatggggtgtccgcagtctgttctttctgatgttcggacgtgttcagagtttcttctttctggtgggttcgtggtcttactggcttcaagagtgaagccgcagacctttgcagtgagtgttacaactcttaagatggcacgtctggccgcgtctggagagttgtttattcctcctggagggttcgtggtcttgttggtctcaggagtgaagctgcagaccttcatggtgagtgctacagctcataaagtcagtgtggacccaaacagtgggcaacagcaagagttatttcaacaagcaaaagcacaaagcctccacagtgtacaacatgacctcagcacgttgccactgctggctccagcagcctgcttttattcccttatctgccccccgcccccccaccccccccccccgcccacccccccccccccgcccacccacccacatcctgctgattggtccattttacagcgagccaattggtctgttttacagagagctgattggtccattttgacagagcactgattggtgcattttcaaacctcgagctagacacagagtgctgattggtgtatttacaatcccttagccataaagattctccaagtcccactagattagctagatacagagtgcctattgttgcatccacaaaccttgagctagacacagggtgctgattgatgtgtttacaaaccttaagctagacacagagtgctggttggtgtatttacaatcccttagctagacataaatattcttcaagtccccaccagattagctagatacagagtgcccattgggcatccacaaaccttgagctagacacagggtgctgattggtgcatccacaatcccttagctagacataatccgtactagactcaggagcccagctagcttcagctagtggatcccacgcaggggccgcaggtggagctgcccgccagtcccgcgcagtgcgctggcactcctcagcccttgggcggttgatgggacccggcgccgcggagcagggggtggtgctcatcctggaagctggggctgctcaggagccctgggggattgcggggggctcaggcatggcgggctgcaggttccgagccctgtcctgaggggaggcagctgaggcctggcgagaattccagagcagcactggtgtgctggcactgctgggggctcctgcgtaccctccacagctgctggcccgggtgctaagcccctcaatgccgtgggcagcggcgcccaccggccgctctgagttttgggccggcaagcccacgcccacccagaactcacgcagccccgcaagcgcccgtgcagcctcggttcccacacacatctgtccctccacacctccccgcaggctgagggagccgactccattctcggccagcccatagaggggctcccacaatgcaacggtgggctgaagggctcctcaagcgtggccagagtgggtgcccaggcccaggaggcgcccagagcgagcgagggctgcgagggctgccagcacactgtcacctctcataatgatattaattgcaacatcacaatagcaaaaatgtacataaaacaaaggttaaactgtaagacaatggttaaggcatggcacatctatattctgaaatacttggcagtagttataaattgtgagttagatctatattactaacatggctagactgtgcaagggagtgaataaagcaagttgctaaagaatgcagataatacagttccagttatgttaaaacagtcacatacactaaaactgtatgtatttcttacagttgctcgtatttataaaagcaaagaaaaagttcaagtagagaactttcattgatatttaatgttttaattatctataaagtgacaaatcatgttttactgttcttattcctggtcctaataaaataatccagctaagtccatgcaaatttaaaacaacctcttattctgtttcattgaatgctatgaaataaggatttacctttactttgagttttaagagaatttagtttggttttgtggatatttgctgacttttcagctattgaaatatttttaaatacaaattcacaaatgagtatttgaaaaattggaggctttcattaaaatgttcaggttaaatccaggttatcctgacatctaattttatttcaagtcttattaatcaaatttttctttaaaattttttggtcaaaattatttaagtgattttactgatactagtacttgtttccactaagcctcctcttaccagattccccttaccagctccttgagggcaggcacatcaacttgctaaatcaatgccagtatagcagtcaacctccttttaggcaaatgctctataattcaacacctttgacttagcagcttctctgaattttcatcatgcaggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggtgaggccaaggagatgggatatgacttgactttctggtattttatggcagaccatggctttaaccaaatggtgtattagcaggaagagctgtactgtgtaaactctgctgctgtggtgcaaagggtcccccttgtgggcatgaaaagtatcttgtttcacatttcagaattcctcaaatcacgagagaaatattaaagagggataaaggaggaatgaaagggatgacatttttatatgctatactgggaactggagtgcatctcaagttctttacgttacacacagaaaatgttgaaatttttatgctatcaaatttgataatgatgttaaattttatgttattcaaatttgctagaaaagttattgtacttatatttacactgggaaaaatgacctagtctcaagtaatcttcctcaacgattctgtagctaaagtcattccacatatcaaatttaaattactctttttttttcacaacttgcttacctaaaacccagaggaaatttgcatgtatgttatccaatgaacagttttgtattgtctgctttctgttctgaaaattttcagaattattgaggcattccccaattcattaatggctagcaatttacctacaattgcattgatatcactgagaaaaccaattacaatctagatctctatcatatttctttctcaatagattaagtgatgcctctggaaaatatatcagttgttgttgaggatttctgagaaaagtaaatgagaaataagaaaagaagggggtgtctatttacacttaggattctctttcaatgtttcagttttgaaatttaatggtctttgatttgtggcagtgtttgctgcaaggtcgataaaaaaaatgtttatttccttattcactgacctttcaaggagaacatacagtaaaaaaattccccaggtgtcaatatcaggaaagtggtattttccctgaacaacttctatcatgcatgctttccaccctagtttaaaaaatgcatccaaataaatcttgatgtgactcaactgattaaatgcatgaaataaatcttgtaatatataatatttcccaattatgtaagctgctagaaataaatatgagatctgcaaacatacaggtctttctgaaatatatttgtgtatttacctcacctctggggatatttaaatttcctgtttctgtttcttactattgcctcttttcaaaaatttgtttctaaattatttgattttggtctagtgtatgcattttcgtcagctactttatatttttcttggaataaggtgaaggcattataaattattttttaaatattggttttagggtcataaaggggtgattctgtgaaagtcaaaggacattgctaatattacctcatcaaataaaaggaaatgggtgaccccttgaatctgcagatctaaaaggagagacagtagaatgttccagaaaagtgttgggcttgatttctgaagagctgccaggaatgactatatgagttaagatgtcctgactgccccaaatctctgtggcttaatgcaatggtttatgttttactcatgtgaattccaaaactgggttcccatcatcagttgtcctacaaatggcaattcagggtcacaggctcctctatgtttttcccccgcttcaaaatgttacttccaaatttgctgtgctcttatgaagcaagctactggagaaggaaagaaaatggagtgtgacacctgcagattttatgggccaaccactacaagtaatgaatatctcttttacccacatattactggtcaaatgtaatcatgtaactacatttaattgcagaaaagacgagaaaatctagtctttctgtgtacctaaaataaagagaaaataagttttgcaaacagataaccaatttgacacaatagctagaactggtacactggggatacgaacctagatcttctgattctaagtttatcctcctgcctactatgtcacatatttttatgtctacacgtttttctatattttgtttttaaataactttttaaatgataatagtatatttatgtgcagttttaagaaatacagggaggcccatgtatgctttacctaattttcccaatagtaccatgttgcaaaactatagttcagctatcagacttgcatattgacattgacaaagtccacatccagaacaattatcatcacaaggatgccacctctctccttccctgcctcctcatcccttatccctggcaaatactaatctgttctgcacttgtataattttgtcattccaagaatgttatataaatggaatcatgcaatatgtaaagttttagaataagagtttttttttttttccactcagcatcattctttggagatttattgaggttgtgtgtatcaatagtttgttccttttcattgctaagtaaaattcgatggtatgtatatatcaaagattttttaaccattcagccattgaagggcatctagattgtttcagttttcggctattaattcataacagccgctgaataaagctgctagaaacattgttgtacaggcttttgtgtgaatataaatattcacttctctaaggtaaatgcccaggagtaaaattgctggttcctatgatagtttcaggtttagttttctaagaaactgtcaaactgttttccagtgtgtctgtaccattttgcattcccaccagcaatgtacgagtgatccaatttctttgcattctcaccagcatttaatgttatcactgttttttttaatagtcatgttgataggtatgcagtgatatatcactgtggttttaatttgcatttacctaatgcctagtgatgttgaacatcttatatgtgcttgtttgacatctgtttgtcttttgcaggaaaatgtcaccccatgttttttgcctatttcctagttgagttgtttttatttttttaactgttgagtaattttccacatacagaccctgggcgttttttgtgaggttatacctaagtatttcattttcttttgagggatagtaaatagtattctgtttttaattcagtttctacatattcattattagtgttgggaaaggcagtattgtgcatgtggcctttgaaacccctactcagccacataagaatgggccttgggcctagaacacttccttcccaagagataaagcgtcctcgcagaccatgctggagttatcaccttgtgtgggaatatctttccctgtttcagactcaatatgtactccctcgttctgcttaaacatatgtatcatatggcacctagccagccccactgctgtaactttcttctgcggggagggcaaaaggttcttctgctgcagcatgaaatggttgcatgctgccaactgccccgcatctgctgaaaggaggccctgctgtttatggggactgcttatggggtcaccacatagctgaccttgctctgtctcttctctatgtgagtaaagcattgttccatctagtacttgactgtgttgtgttttccttggtaactccaatactaaaatgcagtggccaaacgtgtccagacttttactcctggtaataagcaacagatgccacttgccaaagagctagaacataaaaatatgattgtttcttggttgttgattgtgtatagtgagactttgtttaactcacctatgagatctaggaattttctttttgtagattccagggcattgtctgcatggacaactatgccatctgcaaagaggactggtgttatttcttcctttacaatatacatgctgtttattttactgtgttgagtacgagttgtgagagcagacgtcttgcttcattcaccattttagagggaaagcattcagtcttttaccattagctatgaatttttatcgatgctctttttcaagttgaagtagttcctctctactcctaacttgctaagagtttttaatcataaatgggtattgcatttggtcagatgcattttctgcaattgatttatcatgtaagtttcttatttagcctattgatgtggtagattgctctggttcattttcaaatattgaaccagacttgcacatctgaaataaatcccacttggtgtattttttttcagtttgctaatattttatgacttttttgcttctaagttcatgaaagttattggtctatagttttctttctctctctttttttttttgtactgtctttgtctggttttaagatcaaggtagtattgacctcataaaataagttggaaaatgtttcttaattttctattttctggaagagagtatgtaaaattgatgttaattattctttaaatatgtagtagacatattcagggaaatcagctgatcctggagattccattttctggatcttttgaattgcaaatttaatttcagtattgttatgagactatcaagaatacttattttcggcaatttgtggatttcaagggattggtcctttttttttctaaaaattgtgtattttgctgtcgttggatggagtatttctatatatgtcaattagatcatgttggatgattgtagtgatcggatcttctatattgctgatttttctgttgaacttctgagcataatgttgctcataatattgccttattactcttttaatggctacagaatctgtaatgatttctctgttttattcctaattttgactatttatatcttttctccccttttatgtccacctttttacaggtttatcaattttactgattttttttaaaaaaatagcttttggtttcatttattttctctgttttcctatttgcaattttattgatttctgttcttttttatatccttatttctgtttgctttgggtttattttctgttttttaaatttatttttatttttctagcttcttgaggtaggaagttttattactgatttaagaccttttcttttttctaatatataagcattataaatttaactctcaatagtgcttcagtagctgcatcccacatattttgatatgccatacttccatcttaatactgttctgtgtatttttaaaattcctttttgacatcctttttgacctatggatgatttagaaataagaattgaattgtttaatttctgtttagaaatttttctcttgtctttctgttattgattttcagtttgatgccattatgattagagaacacattctgtataatttcaaataattcaaattatttcaaatttgttggggtttgttttttggcacaggatacaatctatcttggtaaatgttccatggttgcctgaataaaaattaaaaaacaacatgtgttctgctattgtttagaggcgatttctatatatgtcaattaaatcccattgactgatggtgttgttcacattttgtatatccttactgatacagaatagcactgtctagcagtccattacttgtttagaggagaggtgttaaagtccccacctataattatggatttgtctctttcttctttcagttctatcaatttttcttcacgtattttgaggctctgttgtttgatatatacacatttagggtcattatgtcttcctggtgtgctgatccttttatcattaggcaatgattttttttctcatattcttttcttgctttgaaatctagttcatttgatattgttatagccattcctgcctttaaaaaaattatatttacacagcatatatttttccacccttatatttccaacccacttatgtcattaaatttgaaatgattttcttgtaaacagtatatcaaacagcaaattgttgggtcatgcttttttaattcatcttgccaatttctgccttttaattgatgtatttagaccatttatgtttaagtaattattaatattgtagggcttagctctatgattttattatgtgttttctgtttgattcctttctttctctttacttcctatgaattagttgactatttttgggatttcatcttgatttctgtatagtgtttttaaatatattactctgtgtaattttcatagtgattgctctgggtatgactgatcacagcctattggtttcagtattttaccacttcaagtgaagtataggaatttcacttctatttaggttttttttttttgccttcttcactttaaaatatccttgttttgaggatcagatggtgttataatttttattttaatcattacatataatttagaaaactcatgaaaagaaggatactccattgtgtttacttatgtgtctattctccattgtttgtcctccccaccttaggcctcaagagtctttctttttttttttaaatcattttatttaggtttacagagctttctttagccattctatgagggtaggtatgctagtgacaatttcttttggttttcctttgagaatgtgtttattgcacattcattcctgataagtagttttattcaatgtggaattcatggttgacagttcttttctcatggaacttgaaaaattctacacaacttttttttctgcaccccatggtttcaaatgagaaatctgctatcattgtaaagtggtgctgggtgcagggtttgggggaaggaaggccggctcggcaggaaggcaggtttgcaggcttttgctcccttttccaaagaccaacaaagagaactttcccaactcccaacccaagcccttttggaactgtgtgtggttgttggcatcctgtggtgcctccttgccatccctgccctttccatgcctggcaacgggtctttgtggctctgcagaatggagatttaaacccaagttcatggcaaaacatctgaagttcatcaccaggactgtgatggtataggaagggaacgtggaaggtgcatagaggaccctaaacagaatcctcactacggatgggctcactgaggacattaagcttcggcggtattatgagaagccatgcggccggcgacagagggaaagctatgaaaagtgccggcggatctacagtatggaaatggctcacaagatcaacttcttgatgcgaaagaatcaggcagatccgtggcggggctgctgaggcgggcagatccgtgggtgggctgctgaggcttgtggatgggacacccagtatgaaaccctcatccagttttgtctccatctcttttttttatacaatcccatttcctattacagttctgcaataaactcagtaaactcaaaataaactcaatatgtttgcaaaaaagaaaaagaaaagtggcgttgccctataggtaatagattatttctatctaactgctttcagtattttttctttgtctaattttcagcaatttatttgtaatatgacttggtgttaacttatttgggtttatcctatttgagatagtctcaccttttaaaatcagtagatttatgtcttttggcaaatttgggggcttgtcagccaatttttctttgcatattctttcagatccttttttatttttccccacttctgggactctaatcatacaaatattgggtcttttgctatgcttccagaggtttctgaggctctgtttttatttttgtttcagtctattttctgccttttgctcagaatgagcaaattcttttgatctgtactcaagttcattgattctgttcttttttgtctcccatctagtattgagcccattcagggagttacttcatctattgttttttacaagtctataatttccattttgttcttttaagcaacatatgtttttgctgatacttctgttttttcttcatctcaggagaatttgtaattgctttttaaatcatttttatgctggttgttttaaaattcttgttagataattccaatatctgatttatctctgggttgacatcatttcattttattttctcattcaagttatggttttactgatccttgtgatgacatgattttgaattgtatgctggacattttagatattaagttaggagactccatgtcttctttgaatttttgaatttagcagacaatcacctttttaggttttaagaacaggtcctggcctacttatgtggactgtgggtccaatgatcagtttattttctgattctttgctgtgttgttttgacctccttggcttaccttgtgccattgggcctcccaggatctctactgatgatccctgagtggtcagaaggtgtttccttaggtgagaatgttccatgtccttctgagaaatgggagtctttgatttatggagatgaagaggctcctttagtgggtgttgtggtgagcttctccctgtctctgggggtagagagcatttcctaggctgaatacctgttgtggcataatcccctttactgatcccccactcacagggtatctcttgatggaagtggggagtctcacaactgctaaggaaggaaaacacttcacataacaggccattgtggtagcataattccttttgccatggcccccttgcctatgatgcctctggggagggggggagaagggaggctcagcaacagaggaggtaagctctttctctggctgctcttttttcttttcttttctttttttctccttctccttctcctccttctccttctccttcttcttcttcttcttttttttttttttttatcagtagggctttgtttaattctctttgcccattcttccaggctcgccttgtgttgtaggtgggactctcgttcaatctggggaaagaaagagccaacctcggccaccttctcttgtttctgttgctgaccggggatcagcaaacaccaggacggaggcacctccttgtgttatgctggaggttataaaaagccctgatgctttgctgttagtcctggggcgtctaaccagttcaccttcctcttccacctttcagagttctgtttggttgttacatgtagtttttagtcatgcttagtggggagaaacagggagagagaagtctatgctctcttgtccagtctaaaagtccctatgtaacatttgttaaaaacacttgtgttatagtagtataaagaaaaaaaatttttttaatggcttcaggtagaaaagcaagtgttaactttctctttatcttcctgatagtaccaagaagttcaaaatatcatttatttttatcaatgactatatttataattaattattaataaataacttactatttcccttgcctttcttccatcccgaatagttggatattcaactttatttttatttgttatacgtccattttatattctgcagatagaaaacatacagtttacttttttacatgctatgtgtatttatagctctattggttgttagattaaaataaaatttccattatgttgaaaaatgtatttgtgcatagtacatttactgacagctccattcaaaagaacctttccaagtgttaaatacaggtataaactgttctttttttgtattataattaagaatgtatttattactcttcactacttgtgtaattaccttctatattgaaaatatttgcatatgtaacgtaatttttctaactttttataatgtaaaaatgatatataccagagtagaaaattaactgacagtctcagaattatactcagggagttagaaatagagagagcatgagaccatggaagatgacaaatgaaaacaggaactcaaggaggcagagaatcctagtgagaggaatcaagaccccctgaaggaggattaacttttattcaaggtttcttctagaatttccagccggtaaagcaagttaccatggcccagagaaaccaaaagtctcatttggtaaggtaattgagaaaaatctaaagatccatttagatattttaatgactagaattgaaccatgcctctagaggcagtagtggttactattctctaattctccaaaatcatttcaaaaaaaaatttggcaaaatatgctcatatcttgtcataactatttgtgaccatagttgcaacactcaaattaaaatgagaatgggacattgccacttgatttaaatgtctgtgcatttacttaaacctgcacatccacataattttaatggtaagcaaaataaatttataattggagaaggcctgtagttgaataatactattcagtccattccaaagtcagtaaattatctttattttgtatgaccacccttgaccactactagaaggaatgttggctgcttctttgtattctgtttgagctttccagtccggggcactgggctcagttctggggataaaatgatgagagtacatggtctcttcccaagggaaaatgaaagaacaagaggaaaatgatgcgcaaagtgtaagacaatatgataactgtcacagtggagccataaaaaggcaccattagataaatcaataaagaggaacttttgtgctgtttatgccagatagaagttagtggaaattataagaacccaaacagcttgataaattcacattttgaagtacaaatcaacgttactactgaaacttttacaaggatctcatgacctgtgtgcttacccttgaaccatcctgttctaaccagccaagtgaaattggaaacaattgatatgtctttcacgtgaacatttcatttctatttatcaaactatactcatgataatacccttaacaagtttccaaaccatctcatccaagtccaattttcatttctaactttccctcaccaactccaattagcatgtactccaactcagaggaacaccctccctggtctctggaacgctacattgttgcctctgaggctgggattttattctacttcacccatctgctctctgtatggaaagaactgagtgcagcaggggatcctatgaagtcctggcttcaaacctcgggcaaaaatatcgggtttcttaacaataaacaccccgatgagagccacctggcaaagtgactgcacacagggctttcgttctcaagttcatccgcttcaagcacaatgttgctaaaaatgaagcgttcacttttccttaaaagtcaaatcctgtcactttacctaaatccaactaaaatagccatagagggccaagcatatatcattcaaagcttcatatagtcatgaaggaattaggcaatggtacagtcaatatctcctgctggaagagaaattttcaatagaattttttcatttgctgacttcacatttcaggagcattgttcctagaaatgcacttttttttcttacttacaatttcaaatttgagaatataaatcctaggactctcaaacagatatttgatatgcataaataactgtaactctaaaagatgaaactttgcttctatcctcgtttacttcataaaacatcttttcaagattcatctgattcatttacctttgcctttaccatgcatgttaatttctatgaacaaaactattcatagtgtgtataactatttacgcttgtactccttttgattttactatgttagctgcaataactaggacaggtataccacgttatacatacattaatttaaaaaatgatttttgttgattgcttactgcctattatttagaaagatattatagcaaggaggaaaatttaaaggctaatatttggaagaccacatacagaccaaaacagaggcagatatgtttgtagaccctatgacagagatagataactatggcatcaagggccttggctgctgtctcaggttggcattcctctgttgacttgtaatcacacaagtaagggaaaagctctcaaatgaataatcagcagacaggtgccaactcttcaacttaagtatgctgaccaatacgtattagaaaaaatttctgaaactaaagaacaaagccaggaaatccatcattaaagtcttgaggtgctgtcctggcaacttagaagacctgaaaggtagattttcataccagagttctattttgatgagagagatgtgggcctcacccatttaaaagagctttcaggagagtaatgtttcctgagaatagccaaacgtttgttagagtaagaagctgatgaaaatgttcattggggaggttgaggatattgggagttgtcctcacagtagaccatcctgcgagctctcatatgacgtggtctagtgtgtgtttactactcatgaggatgcccatcttgacatcccatgctttttttctaactacccaagatcccaaaatgttttttattaagcatgttaatcattaagtacaatattattgacctacacctgacctaataaatgattaattatagctcttttcccaatgtctactacttagtttgttgagagagtctgtcttctgatattaacacagaagaccctcagaaacacccctctcctcctgcatcccctccccaaccaccatgacacgcacattcacctagagcttcacttcagtcccaagcaacccagttgcgagggcaagaaaaagtatccaaaacctcttcctgagaccaaccaatcctcttcctgaagaattacatatccctttctcaaaagaggttttattatacctgccattggcaaaaaaaactacccccttagtcattacttaggaaacaattaatttctgaagaagctataatcagcattgattacaactttccctaaagtacatcaggaacaataccactatgacttataagtctgcttacttcagtcacccactgaagtcccagcgtcccagttcatcatttctggtctttatcccagaatgctctctacataccctaatttcatgcaattttctaccccattctgaacttctctctgtatgctgaagatttaataagcccaattaccaatatcctcaactttttttctaaatgtttccttcacctgcttgcttaagctcaaatcatgctatattctcagggtaccatttcttctgcaatcttcttgaatggtggttgtcttttattcttcttccaaatctcatgtttgactagtcccaaaggtaagctaaatgtcctcatgtcattgcttcatctaggaaattagtcttccatcctcattcagaattttgtatccagcgaaactgagcctcataaatgaaggaaagacacaatctttttcagacaaacaaacgctgagagatttctccacttccaagccaggactacaagaactgctaaaaagcagctctaaatcttgaaacagaacttcaaaatacaccaaaatagagcattcttaaagcataaatctcacaggacccataaaacaataacacaatgaaaaaaaaccgcaaggtatttatacttttgttgacagaaaatcaacaaagaaacaatggacttaaactatactctaaaacaaatggacttagcagatatttacagaacgttctacccaacaactgcagaatatacattctactcatcagcacatggaacattctccaagatagaccatatgataggccacaaaacaagtctcgagaaattttaaaaagtagaaattgtatcaagtacactctcagaccacagtggaataaaacaaaatcaactccaaaaggaactctcaaaaccatggaaattaaataacctgctcctgaatgatcattggatcaacaatgaaatcaagaaggaaatttaaaaattccttgaactgaatgataatggtgacataacctatcaaaacctctgggatacagcaaaagcaatgttaagaggaaagtttatagcattaaatgcctacatcaaaaacccacctcatgttgaagtacatgtctttgaactgcactgctcactacctcttttggttgcaacattcttcctacctcacggtaccttctcctcagtcactgattaccttaatatcttactcctgtcatcattttgaggatttcagcatccgtgtagacaaccgatacaaaccattatctctgttatttgaaatccttatttccaatgactgtgactgccatgccacacacacttctgcccacttctttggtcataacttaggccttattatcgctgataaccttcctaaaaacatcactttaaatcattctgttttatgaccagaacctccaattattccagttcatatactttagaactttttccgttgagcctagtctgttgtcttaaccactttttttccagtcattgcctcacttaccttctgtctcagctaaggtttcaaggtccagcactataattattcccttgcatataccttcggctcacctgattctttctctcttcattgtacttgcctgacaaaggtacaattatggttaaatcaatcctctaccttctccacacttacaaccaatttgaatgtggttggagaaaaactcacaagccacacactgaactgttgagtgtcactttaaatttatggtgccaaatctcatggggcctttagcactagataaaaatccttctagagctctacttcccaagatgagcctttttaaatcttctatttcttcaaacttccaatacctcctccctcattgttaccctaagttgatcatcaagtctaatttcatcaggaaaatagtatcttcctgccaccaaaagtgttgtcagttctgaggtttgatttttatcctttttacaagctcatacgttatcctgttcctgttttgtgaatgctggcaaaagacataaaactttgtgtcaggaaaaaatgcacaaccagcagcatgagcctcaggtttacatgaattacccttgcacccaactcccacagggttggtactacatgggcccagatgagtactgcacagacagatttttgtcgcaactgatgaacatcaagttggggaattcatcgcttttacggtaagcagtaagaagcctgctccttgtcccagagggagacattacttcattcttcagagatgcttgctgcaaaaccaaccccaagaaatgggcaggtaaagatcagtcagggccttgcattcttaggattcccagtaagaaactgccaggacacacagggcccatgatgagttgcttcttccagcaatccatcccatgaccccacttgttcttggctgaactcgaattttcatatgaatatgccactccatgagccaccctgcttaatgtgactgacagagactgggattaaatctgttcaatttgcctcatgcagcatttaattaaggagactatcaagaggactctaagcaataagatgaagtcaacctgtagtatacatttcaactctactccccagggccctggactcagccaattgtacataagtcccaggggcaccaatcatcatcttaactttagatagccagaaagtagtctaaagccagtcagttatccattgtgacccacgtaagggagcttagattgacatactgatctttgatgtcattaccaataatgacaggggcaataaacgagcaacactaacccccaaaggagagacattcccccacatacaaacatataacacaaagggacagactctagttcagaatttctggttaaaattgatttatacctttgttacattggtttggttaattcagtacaacagaagcatcgcttgcagctcccattgccatttatggcaacacttaagctgcctgagtattaggaaaagcgtatgaatatatgttattaagattgaggttgggcacagtggttcacacctgaaatctcagtgctttgggaggccaaggcaggaggtttgagaccaggttaggcaatataatgagactctgtctctttaaaaaaaaaaaacaaataaaaaaactgaaacaaagttgtgggacctatctctttgtacgcatacaaggctgaggaggaggcagttcaggagcttccattagtggtgtcagctatggtgaagtagtttaggaccagccaagtttgcaagacttttggtgtttttataacacctggacagggatgacaaatcctgtagtgagtttagattgtcaactgcagctgctcctagattcagctagaccatacaattgttttgccagcctgcattgctgaatctaaggaataagaagcctaagtgcctctctcccctgaactgcctggggtttaaagtgatctgtgctcgggtgctagaattgttattctccctccatggccatgaaactagggtgtcccaacccagtagctataactttacctcttctccaatcatctgctcataccaataccttttgtccagagaggtcagacatgaataggaataggtcactttaaaaaatatttactgagattcattcattatatttcccacttagtccagttaggttactataagtaattatactagttggtgaatagtatattcaaccagtgttcattgtctttatgatctaagaccatgttaattcaataaaagaatccaggtagctacatcaagttaagtttgaatctcttagtctcccctttagatgtggctgcccttcaaagtgtgtacaaatcaggctgacatgaggttgtcactaggggaagaaaatacacttcaggttcataaatggtcaaggcataatcatgaattttcaaaataagtttacataatttttctacccatccatcttgatcattacctaggagttggccaacaggagacaaatctttcctgcccatggccatatttaatgctcaaacagccttaataaactgttttaataaaatctgtgggccagaaagaggcaaagaaggtagatacagaaaggagggagagtcagaaatcttcaggattggtttccaaaaagtctattccatatctcaatgatgccagcagccttatcagagaatgataagagtgtggaatgtccattgaatatgtttactactggcccattgctaggtggcctttatgacaaaaatacaccattgtcagattgtagatggtcttgaaaactgaaaataagaatcagattatcaaactgaaatagcagcaaaataatctaaaaatatgtcaatattagcaaggcaccaatggtagtcccaagagagggtcagagatctgacacagccaattttctagaagtgagcagggaaaatgctccttgtaatgtggcctcctttactgcaaaacaatcaggccaatttttggcaggagtctcctttggtatgcagtttctagattagaaacatatagtcctttgctgtagttcgtggtagtggatatgttttctggtaagaggatggatccagataatgatggaagccatctagatagatgctgggtaatccatttgattctagttgttctcattaggggttatagcaacagccaccagaaaaccatactatcccccagttgggagtgcaaggaatggaggatgatggggagattagcctatgggagtggacgtgggaaaaggcttggtcctttctaaggggctggtgaccaagtgccagagctgcttcctatccatgtatatcctgatatctgatgagtgtcagggcccagaggaccccttttttcttgccccccctgcatgccattgtgctctgccctgtcaaagggtagtcaccaagcaagaacagtgccacacctgagtaagctagtaacttgagatctcatataacaatgttatttcttcttaaagaagttgatgttgtggaatagggagggggaggaatcaggggtcatagagggagagagcagctcgacactagtaaacaaggttttacattcaatttcactttcaattcaatttctcttgcttgtggctcaatcaaataaactcatcatcatcaaataaaatcatcatttttttttctaactaaagttctatattgaattgaaatgatgtcattgttgactccatttatttcatctttcagtactccttgactcagctgtcacagatacgttgccttctggctggagccacagggcttgctgccctattgtcataataatgttttttcctcctcccacctagaggagagctagaaacaaccaaggcaccatataaggctgtttgttttaatcccaatctgattgatgggcaggaccttgggggtcttttgcttccctctttcacctaccatttcagtgggagtccagggaactcatcttctacatctgaacccatcccaaaggctcttaacatttttcttccagaaagacatgtctctttcaggatctcatctttgttgccataactgttgggtctgagatttaattttaccctgtttataaaggaatgagttagcctgttactgtttcatggatgctggcagaagacactaaactcttgggtcaaagacaaatgactatattactcacagcacagcagactgcatgagtatcatgtttatgtaggtttcttttgcattcaagtcttacaggggtgatttgctagatggatggtgtacctgcagtggatttgcatcacagctgaggaacaatagcttgataaattatctgttttcatagcaggcagtaagccaatctgttttttgtcccaactttgaacctcatgtttcaaagttgcttgctgcaaaaaccaatcctgagagatggcctgggtagaatggtaaggatcttgcattcttggtacaaccaacaagaattgcagtgatcctcagtgcccatggtatatggactctcccaacacctacctatctatctgtcactcatttacttgccgcctcccaattcctgcctatgtttggactacttttccattacaacattcccacctgaagtttacttatgcatggcaccctgttcattctctatgattcaggatctttagcaattattctttatacatcttgcatcattgattttccactctattctaaatcattctaattggcttgcctatctatcctctggaaaaaaaatgctccttagaatgcatacacctcctcagatatcctcttctgtattccaccctcctctaaagagatgtgtatacttactctctactttttcacttcccggtaacctccccattaaggcagtttttgttacttcggtgaaaacttccctgtcaacaatttccatttgctaatctaaaacttaattttaagtccttatcttaactggcctctagtttacagttgttctctctgacctgctggatataatttctttatttaacatctgcccccttttcttcttgttcactatcattctattgctagcatatcctctattttctagactctaaatgctggagtcccctaggattcaatccttaaacatattttttcaccccttggaaaatctcatgtaatctcttgactttaaattttagatagatgtttacaacatctaaatttttgtctccagccctagctcctctcttgaacttcccttaacttttgtatttagatagctaaaatgattttcaaacataacataacccaggcaaaactttttatttttttatcttcatgaaacccaaaagaaaaaaattaagctaaagcaaacaaacaaaataatcacaaaacaaaacaaaaattcacaaaacgacaaaaacacttcttccccatctcagtaagtggtaacagcatattcacccagttggtcaggccataaattcaaagccgtatttggtttctctctttctttaatatcccacatctgattcctccacacagtttgttggcttctcctttaagctgtgtttcaagcacgatcatacttcccacctctaccatttctactctagaccaagccactgtcatgtctcacctcaactacttcaatagcctaatgttttggtgttcttccattcttgactttctaaatcagttctccacacagctttggtagtaacataatatgcatcagatcatgtgagtcttccattcaaacagtccagtggctcacatgttctcaataaaacttgtactccttaacatattcttggaagcccttgtgtgatctgtccttggttatcctctccaaaatcacctcctgagtcctcactctcttcactgtagctaggctgggggtcttaaagttacttggttaggccaaactcatttctgccttaggggttttacatttatttttccctttacctaaaagactacagatttttgcatggtgattccctcttttaaatctttattcaaagaccacttttccagagaggtctatctaaacctcccacaaaaatgccacctctctctgcaccccaacacatacaaacacatgctctatttccttacccttattaatttcttcatattacttatcactgtgtgatcttacgcacacacacagacacacacacttccattaatttttaatctcccctctctcagtccttactagaattgtccaccatgaaatagactttgaacatcttgactactatagctccaggacctagcacagtgcctagcccataacaggaggcccaaccaatatttcatgaatatcaaaatgctgaaatcaatcagttgaagcttgagagaaatctcaggactctcagttgtaagcattgatcatcaacccacatgtcaggtaaagttttgcccttagcagctaaaaactttaataaaccttttgaagattctttcattctcctaatccggaagtaactagatgagcctcagaattcttgctctaattatagtgtatgccatattttgataaattaagttttccatgccacttgacatatcataatttgaaaaatgtgttctccttatttcagattgatcttccattttcaagagtatctaacaccttatctttaagtttctcagttccattttcttcctatcaagaatctaaggatttatttattcaaaaattcaaagatattatatgagcttacatttttatgagaaaggcttttgttaaaaatgaaacctttttttatgaactctttttttaatggatcatgacaaacctataggggtcattactggaaatgtgattaggatcatttgtgcaatgaagcacttcctagcttaaggcaaatttggcctagctctagcctgctgtatcctcccggcactatctttgagtcaagcgtatgttcttagttaattggcttatggcaaaagtaattttgtcagttagatgtttccgtagagctgcccttgctgagttagtgtcttaagacagagccacaaggttttgttgacatgtaagttttctggttgttttttccatttttacttcctgacatctcccatagtgttttaaaaaagaggaatggtggctagaataaagttatgtatgggcaagccatttttggcacatgcgaaaccatcaattcttcaagtatcaaacaatgatatagatgtcagccaatagcgtaagatttttcaaattcgatcaaacaaaatgtcctgctctccacaatctaatatttcttcagattgaatttagagtttagatcaagatgggattactattacattttcccaggtggctatattgatatcttacagctacagattaatctttctccattttttcctctcttttctcttccttgtttgctcttacctcctctttctctcaattataatggttcttaatgaattcattatgtaaaggattctcatatccaaaactctatgaaccctttccaacaaaagggaactagacctacttttgatgcctctaagatgcagctatataaatttcagacctgtttttcactcctctcatggtagtctgaccccaataaggaagagggtctgaatgaaacatttcataagtgtcacagataatctactgctgaagctgtatatgtttattgcttttttcaaagagtttcttcagaattacccctttcaaaataacagtttactctctactgataaaactgtaatcaagatctggttatcatcttttgttaacattttattgaagtatcacacacagataaaagtgtacacataatatatttatagctcaatacatgtgttataaagagaacatgctcatgtatctagtacccagagcaagagcatggttaaatggatgctactttcttttgaaggagatgactagtgccagtgtagttagtgacagaggcaaaattcagttcaatcatcaaaacattttcagataattaaaactgtctacaaatgagacaggcatccttgcaaagaaaaaagattctatgtgattagagttgtttgtggataggaaagatggaattcttgagtggttggttggactggatgacttccttgggtctttccaaccaaagatgtacgtaaaatcaaactctgaagatcaatgttctaatggtaacatcaaggcaattataaatgtacataataaaatagtattttctaaagatcagtgaaaatgattcttaggagatatttaaaaatcatttttcttttcttttctttcctttttttttgagatggagtctcgctttgtcgcccaggctggaatatagtgccacgatctcagctcactgcaagctttgcctcctgagttcacgccattctcctgtctcagcctcccgagtagctgggactacaggctcccgccaccacgcctggcaaatttttttgtatttttagtggagacagggtttcaccgtgttagccaggatggtctcaatctcctgacctcgtgatccgcccacctcagcctcccaaagtgctgggattacaggcgtgagccaccaagcccggccccggccaaaaaaaaaaaaaaaaaaaaaaaaccatttttctagctcattcaggaagtaaattaaaagaatggtggaatgggctttttgctttccatatcatagactattttaagttaaggatactatcagtgaagtctggatgaaaggatataataagtttcataagatggaagatttatatctaagcttgttccttgcactgggtaagctttggcaaacagtgaaattgttacatctcttcctgctaatgataacataattttatttcagcacaaaggagttacctagataattagtataacaaaatttttataactgttgccctcaaattcaacaactgaattaaggattcatctttgtgcactttttcatgagaaagtttgtttctttcatattctttaatacatgaccatctcactttgtgatttaaatgttttaattactgcagtgatttaatacgtcgaaaaagaggcagataaagaaaaaaatgatcgagattttctacttaacacctcggttctgcagagcccaaggtgattaaattgaaggcagcattcctttagagtcacctatgagacaatagtctggaatattatcaaaagttttggcaaagaaaatcatttttggggtgggaggttaaacagaggatagggcttcaaaatttatctatttatttgagtgagttttagcatcattgacctggccaaactccaacacaattcattatattttgcctgtctcaaatgcccttgaaattctaatgaggccctatatttctcatcttaacctactttcataatattgcttgaagcggccatccagctgtggtcattcacttaagaagaatctagatttatctagcagctaagggtatccagtatctctgatttccccacagaagcaggaaggtcagtgaattcgttccagtgaaaagatttgaacagcttacacaaataggtaagaacatccaaataagataatccaatttctcaagcatttctcatagtgctcttagtaggaaaaatgagagacacaagcaccaagctgggcacttaacttcaatcatagttaaattttgtaaagcccccaaaaggtaaaatgctacaagaaattaaaacaccaggaagctctacaccaagatgctttcctgatcatctgaagccttttttgcctttgaattctcatagttggctcttgtgtgctttgatccatcctgtctgagtgcatctccatgccaaattacacaaagcagccctgcaggactgacaaggcccaggagccagcgcaagtgtgtctggcgcatctctcgttgttgaactgtccttgttggtgaggattttttagcatgcaaagtgtgtccttagaagcagtaggaaaagggaagagattcctcagctcttcatatgttttctttcatgaccccaatatcgtatctgacaaccattcccatttgaattattactcttagatcctgaacaatcattaattaataccatctttgtgagcgttcatttaagcaataccactctagggccttcaataccactctagggccttcagccagcttctattaaatgggttcctcattctggtttactctcattctcctccttttaatattttagcctgttcaggcattatgcattgggagaataagagaatttttcagtgatttaaaggaatatatataatagaaaaataaaaggagactagattattactatacttgaatcattcaaattggcataatcctcacttacttcgtatctcataggtaaattcaaattataataaacatgcagacataatcatcaaacatagaattctcctttcagtggcacagaattggtaattattttctttaagtccttacagtgatatcttacaaagatttcctccgtgaagcattcaggcatcaatttaatctgcatatgtgtaactaaacgtgtttcctcaatgaacacaattacttttgttctttgtagtaaattctctcactataatacacatagtttggtcaaattaagaacctatagaaaatgattaaagacacaagaggttacacatgcagccttcaatttgacagatgacagcataactcattgcaatagtaataatgagtattgttcctatcttaatttaatatgaaaactttccacatccacttaactaacatgaaaaattttagaaatttacacactgattggtgaagtcaactacataccaaccattaagataattgacttccttaaaaatgtaagttctgcactccttattgtgaggaagccaaataatttatgggctttaagcagtaaattcttcccttgcagatgtgtttgatgctttccaaagggtctctcctcctttagactggaagaggtttggctcaggatgtaattttcgaacacataaggtgtgcctagcactgagctgggcagtcccttaggaagcaaagtgaggagaaactgtgatggtgacggggagtagggactgtggattcagaattcttagtgtaacagccaattattaatattatctgtggccctatatttcttcatctacaaaatatagacaataacagtaacctaacttacagggtggctggtaatgggataaatgagttaatatattcaaaatgcctagaacagcacctggtgcaaagaaagttcagtgtaagtatttgccatcattaaatatccccctagagggcaggtacttagggctcatgactgtatttccaataccttatactgctcctggaatagacttgataaccaataaaatgtgataaactagtgatgaaggaatagataaatgaattcagagaaaaactcttcttttgaataatatacagctattttaatttgataattcatccagtaatttatttatttactgataagaaaggaaatctcagaaaatatactataataattattcaaagacagcaagacgtttttcaaagaaacatctgggtttaaatcagtctgctttaagtatcaaatgaatgtgtttattcattatgtccaccagaagctgcaaaatagaaaatatgcccaaagtaaaattgtcatagaaaaaaatcagacacatataggtatccagatgtccaataacaaaaaattctggtcacatattcagcaaagatttattaggagcagactctgtgccaggcactgttgcatgccctgaaaataataagcagacaataatccctgcctttgcacagtttacagtcttgggaaggagagagacaagaaaggtacacacataaaaactcactttcagggcacgttttgcagctctcctaacctcactgacctctcaggatgcagacctgctccaaatcatccattctgcaggaactaaattaaggttcttctaaaacagaagtacaaaattggtaactaccctcaaaaatcataggttaaaattatttgtcctctacttttggtgcagaattctggacttctgttcgagaatcactcaagggcttgaatgggcccaaagttacattttgagaattcttggccctcctgtgctattttctttcaccagttcacccttcatcccacacatatccctggcttgtaggatcttttagtcaaaacacaagatgtctataatagagtttccataggaactcaaactaaaattgttgatattggggaaagctaaaatagggatcatactaacaattctttactcgagattttctaagcttcatctctgaatcatcagataacctcaagcagaatgcaactggacccgctacgctctccattctctgcctcttgcaaatgcctttacatgactatgaataagtgtacctggagctggtcctgaagcaagaattaaggagctgctacatacacgatttctccactttttcaatagaactgctacttaagatactctttgttgaattctcaaatgtcccttatacaaagacccttttcagaaatttcacagttaaaagttgaaagaaatgtcttttgacaacctgatatgcagcttcctcctgttgaacactgtgacgtaaacagactcatgatatttctctttctgtcttggctaccatgaagctcggagtttagtttttcttcctccatgccagtgtttcctgagctttggttttctggaacattttctctcctctttatacatcttcaactctattaaactgctctggtatttttattttgttttactgactaccagtttaattggaactataccatttagtgtaaactaccacaagtcctttgggcaaataaagagaatatataagcaaataaataattatgaacaatggctactgagccttaaaaccagtggaaggttataagagctttttaatagactcaaataagtttaatgcagaagttacaacctgagggccttgggccagattttgctcttggatatggtttattcagcagatgtaataattttaaaagaaaaattagttaccaacatccttaagttagaaaatttccaataaaaacctgaattgcttacctctctactttctgtgccagaccttgttttaatactgaatcttctaaaaaatcctctaaggtatcaccattctcatcatcccaaatctcacaaatgaggaaacaaaggcatggagaagttcaataacttattttacaggctcacacagcttgcaaatggtaaagctggaacctaaacttggaccaccaggctccaaacactcccaggtggtcgtgctattacctggaaagaatgatccaaaggcttggacccacatttccccctgacaacaatggatccactttccaacctggcatcaatagctggaagtgaaaacagcatgtctctttcaacagtcacctggtgtttgcaagcgtttccgtttaagacccttgtcttaattctaagctgagagcatattatcctgagatgggagctgcatcttaaatgtattttcgacatcctgtaggtttagtctttgcttgaagttaattaacattgatgagtcccacaggtctctatagcttcctgtgaagtcctcaacattgacaataaaatggccaaatgagaaccgaaatacatttcactgtagcacagcccataaaagcagttttacctaaattattccccaaagcatttcccacttaattgtttagcatttacggataataaggacatgaatgaccacatttgcatatttatattgctcatttgccctgtgtgccgtagtcagtgctttagaaagatttgtgtgccacctgttctctgtcagttatctcttctctctgttaaagattcttggatagaaaaaagtaaaactaaagctaatctccttcattaaaggtagagagacttttaataaaacgagacttgctctgcacttcagaggataagcagaaacctttgaaggattttctgtctgaggagtttccagggaggaaaggatatgatttagtcagctagtcagctaagctcattaattctggtaacttgtttctgaaaaaagggaattttcctgtgaaatgctgctactgcaaactaccctcccccagctcatatcacaacttctaacccttgagacaaacctgctattgttaattagtcgaattagttgtacaactgtacattatcattttttaaagttgtcttactgattctcaaattgtattttcttaaaaagtagttgagaattgcttttccaaaacaatatatctttaaaagaacaatgtaaatagacaaatgaggcatttcttgaagctgctttttggtattccctttgatattctatcaggaaactatatgtctaatatgtaagaatatatgtctaatatgtaagatattaaattgtggagtgagaagtaggttttcagatttttctcctcctccagagtctttctcctcatacttctcctcctgactcctcagggtgccaagttcaatagtacaagtgatatatacatgtacaatatacaagtaataataacatgttagaatatgtattattgttatactattatatccttgttattattagggttattatgattactattataatcttttggtgacctttaattctggattgcaggggactatagagagttggaggagactactcagaggcattggcaggtatactgaacgcctcaagagctcctagagctgacattcataataatcactttaggtatgaaaatacatagttaacatttaagattctctttttaatgacccaaaaatgatagagaacagttcagagctttaaaaaaagaagttaactacaatcagaagtggttaaaaaacaatctaagggcttgaaattgtaattgagttagattcaattaccttgaaaattatcaaaaaggaactatccatttcccagcaaagttgttgatctttattcttctaaagcaatttgtacaggaataaattctaacattcatatgtctaggggctaaaaccgacatgcggatgttagaatttattcctgtacaaattcccccagtagtggggggtaaaacactacccctgaaatcacatacccctggattgtgttcaccaatgttcaaataccagctcttgccagtttcttgctatgtaaccaagaactggttacgtaattgttctgtgctaataatggatctattaataaaggatcaaacgatatggtaaatatacagctcctagaacaccctggcacatagtaagagctttgcaaatatctgttattattattccacatctttgtatctcttatcatactctttaagatttagaaactgttgagatttttcaaacttgtgaggacccagttaccaatctctcagtcaatttagattgcagaccaaagatggagtctcccttagcagagctaaaagtccctgcatctctgcatgcaaagtagacagcacttccctgaattcatatctgtcccagaactttgatttaaaaaacaacatgatctggaagttgcattaattcatttttccacattttatttctcagaatttaatcacatggtcaaaacggactgcaagaaataatagtctatatcgtcttaatatagccatcacgtgctcctctttaactctggaggttctttatacaatctaagaaggggagaatatacatgggggaaaataagtcatctctattatgttgagtgttattgcattctctctttgaaatattttcagggatatgatattaagctcttttaagaaaatcggagcgaatattttccctgcttttatcctagtaactgtcaattgttaataattttatagttattataaaaagcaattccatagtaatagctatgtttttctatagccatgagtattggctacgacaatttcatttgtttactttctccatccaagttaacagtcttccctgatagaaacatttagatcacaagtagctcgctttctctcactcaacagttgacatcactccattggtccttggcagtagaaccatcatgttcacattcttgttcccaacataatctttttctttttttgagacagtctctctgttgcccaggctggagggcagtggtgtattctgggctcacttcaacctccacctccctggttcaagcaattctcctgcctcagcctccggaaatataatctttaaagcacaaagtctggagtattttggcaaatgtagctcaatgtagctaatgtagctacattatgttaataaagctaatgtagctaatgtagctacattcagcaaatatagctaatcaggaacttaattcttttggacactgtttgtagagaggcatgttttcctctgccatttgtctttggtaattctccctttcttctagatttttgtatatctttttaagtgtgaatttaacagaaagttccctgtgccgctccatagaattctctaaatctctctacatcttttttggagctatatttgattttggcacctggcgtactaaaaatgacttgaccttagatgtattataaataatttaataatgtttccaggaaccttcagttaaaggaaatgaatgattattttatttaattttatccatttattctacaattttttattgggtgcaacaatttttttctaaaaagtttgtttacatgaatacaagagccttctagttattttttaaactgtttttactacaaaaagaatacaagtttattaaaggaaaatttgaaaaatacagaaaggaaaaaaacacaaaagcgtggggaggctatttctattgccaccaaacgaaaataatatatgtaatatattagcagattctcttctgaaattgtatcttcttttttccccaacctcccctcaccaaactgagtattagtatgtatttatataattgaaactgttgtgtaaactcatctctctctctctctatatatatatatatatgcacacacatagtatttaagacatgatcaaattacataaacatcattttaatgtctccataatattcctccttatggatttgctttattatcccctattcttggacatttaggtagaacctactactcgatattatatataacactgcaatgaacatctgaaatgaaaattattttttgatggatttctggaagacaaattactaaggcacaggatatgagctactttaagtttcttaggatcaaataaatggcaaaagcacattttaaaggagataatagtagggcaaatgaattttctcaaaataagccacttaacctaaacaatgtcatcattatatcctaaacattttcgggagactaagaaaaaaaactcaatttcacagcattacaataaagcctgagtttttaagaatgtcaaaaatctcatgtttttctctcttccctattcatcaagtttcctcttcactggtccaatgaaatagagccacagcacttttatttaaatctctatttctcctgcattcccattagtgaggaaatcaatcagcagttaagaaatcaatcagttaaaagaataattaaatagccattccgaaaagaaaagaagtagaagataagatggctatggaagagtttataatctaataatgtagaaatcaatcacacatttaaaaacaaacaaacataaccatgaaattcacccctgaaatgcttcatgagagaattgctacatttctttatttttaaaatgaaattaaatattactcttattaattttctctttatctgtcccagggatggcaactgtccttaaaatttagaaaggacaatggcagcaacaacaaataaaaacctgattttaaaataggcaaaggacttgaattagacatttctccaaagaagacattcaaatgaccaataagcacatgaaaagatgctgaacatgactagttattagaggaatgcaaatcaaaaccacagtgagataccgcttcattcccattaggatggctattatcaaacagaaaagttacaaatatcaagtgttggtgaggatgtggagaaaatggaacccttgtgcattgctgttggcaaggtatcatggtgaaatgctgtggaaaacagcatttgactcctcagaaaattaaacatagttattaccacatgattccacaattctgctggatacacaccttaaagaggggcagcattattcacaatagccaaagataaaagcaactcatgtccatcaatagatgactggctaaacaaaatatgatatatatggtatgaatactatataaatataccatacatatatcatggaatataattcaggcttaaaaagcaaggacattttgacatatgctacaacatagatgaaccttgaggaaatatgttaagtgaaataatccagtaacaaaagacacagattttattattccttttataaagttcctggagtagttaatttcatagagtcagaaattagaatggcgactgccaggggctgaggggaagggaagcgagaatttggtgcttaatgagtagtttttcatttggaaagatgaaaaagttctggagatggatggtggtgacggttacacagcaacgtgaatgtagttaatgccacagaactctatacttaaaatgatgaaatgtcaattttatgttatgtatattttaccacaataaaaaaattggatagggctattggtttcagttcatcaatagttgtttaagtggtctctcagaggtctaggtggcatgtcttcaatctttttatgttagacataggagctgaggcattttgttgcagtttctaaagtcttgaaaacttagttttcagtgccctggcatccaggagccactccaccaaactccctgccaccctgctgcgtgctgaatgaaaatgatgtgagatctgccacagctttgtttttgtctctggtacatcaaatgtgcaactcaaaacaaaaacaactgtgaacttccttttattatggtattattaaaggattggggaggagtggcaggtgggactgagaaggggaacaggagacactgtagaaaggaagtcaaatctttaaaagagataatgttagcttctgcttcctgaaagaagtataggaagaagagcccagagaaggggtgtttgtgtgggggggagggggtggggcgggaaatataccagatataattgtgttcttttattaagtcactacattataaacacatttataaaaatgtgttttaaataacaatagagaagttcaaacatagctataacaattaaatattctgtgctcagaggaggtaaatggatgaatagacagcagacatttttcccatatgccctcgcttagtgccagcagtgggaagggtgcttatatttgaattagagactctgagcaagccaagaaagctgaacaatagctcccaacattctcctgggcagtagaaagatgacaaggtcagaaggcacatttgattgtttttcatatcataggtatgttcagcttttccagggctccaaggtttgacccagcatacagaatagaaagtgaggcagaagttactcggttcccttcattgtgcataacatgataccttgttttgtttacccataaaggtcctctgttgacattttaaaccagagtaaatataatacaaaaaaattttaaagacgtgaatttttttaattgtagctaaaatagcaaatcaaaatatttaaaattttccttcctcatcccatgaaaaagataactctaggagcttctatttgattcttggtgattgatctctttttaggtagagacatttcctgttaaaacttccatttctagcccgaggcccttaagaataggctataataggcattaataaggttatacaaatatactcacttatgcattgtagcttcatatattttgtgacaacattaaaaaaaattctaaggattgctgaaatactttctcaagaaactatttctccaggcaaagagttgcaagcagaaagtttcatggtagacagcacaaaggagtacatgccaattgtaattagaacaagcaggagaattcgcttggagaccagaaacacaattccttttatggcatattagaagcatcccaatcttcctcaatagtggtgttcatcaaacagacaacattctgaaattcccttaagagattgctggagtgaaaataaatttgtttttagtgtgatatcctcaggacagaaaccttataaaatcatttgccttgttggcctgtccacctcctataataaccattgatcccacaggctaatttcaaccaactttgatagaggggcaaagagtctatagctagacagaggctcataaatttcttgtggtttcttctgtttctttcagaagagttgtttaatggtatcattttgaagagtataaaaaagcaaaccaagtttctgctgtgaagttgtcactgtaatggaagatgattacatcagaagaagttcaaatggaaaaaaaatgtttgtagttgccttgtggtttcctgataacaagcaaagcaagcaccatatataacaccacacagtggcaggcatctttacttctgatagttgcatcctggaactttataataaattcgactcttgggttttgcacatccaagtggctgagtttttcttgtttattggagttgaacttaaccagttctcagttctcagaagtgtgctgacataattgaaaggctttcaaagagctgatggtgagttagtgaaggaaaaaataagaattcagaaaaaaatattaagaaggaagcaacagaccctcctacagtaatatacagcagggtgacaactcaagttcaagtctaggatagagtcagtatctgagagggtccaggtctcgatgtggtaggagatctgcttacagaatttgtagctgaaacttggggggcccagtgcaaaaacaggttttattctgaggaatgtattcaagaaactatgagaaattaggaatgaggccagcagagggcttacaaggctggtacagcatctcgtggtgtctaaatcctagggaaaaggggaactcaagcagctgggtagcttctcactacatgcaattagaggtaccagggtggtgctgctagtacctgaaggccttttggtccttactctacacttcctctacacctgaggtcctaagttttcactctggtgacaaggcaaaaaaacaaagatatacatacacacacacatacacacacacacatatatatataatttccttctttaaagtgagaaaagggctcaaaatctgagtctagctaagacctcaaagattgtatggctgaatgagaaaaccaggttaacaggatcataattatagacagctggaataagtcttgtgttgaataggaactgatactataaaggtaactcagataatttgtttccataattttcatctttcaattctttttacttgaacatgctctgagctgtaaagaaataggttacacagcactgggtattcattttccaaactctgctagcaatattgttcaatctcaagaaaagacccaaggaactaaaagggaaaagagaaacaggataaatattttttgatgaaactcctattttataagatgcaaaacataaaactatggggctctaaagcctcacctaagtgaatcaatatgactacagagcttgtaataaaatacaacactaaaaatactatgaatcaaacataaaatatgcaaagttcaccagatcttcagtggactagggaagctgtccttgcaaaggaattaagtattatttgaaatgagaaagtgtaactgaagagttgggaatttcattttctggagctgccacaacagtgcccaagtagggaatcagcttataaatgcaggtagcttgtaaattcggcacttgatgaagtaatatccagggaaaaggtacttaatgttcccaggggaatatatgttgtatgaatgcatatactgtgcaataataacaaaatatatactacataattagactgagtatatattttacaacataaatatagttagggctgttaatcaaattaaacaggacattttaaaacacagttaagaatgcagagaggaaaaaatagattaacatctaaaagcacatgcaaaagaggcacagcaatgaatgcaggaccaaaaagtaccaaaaaatagtattgcatgcacaatgtgttatctttctttctagaagtagtcatggaaactaatataaacaatgacttctgaaagctaggtttgctcctcctaccttaatggcttcagaatctcagcttctactatatagtagatggaaaattctcaagtgaagcccagcaacagcatagcaagagaagggctggctacagtggctcagtagctaatatttccagtgaaatagcgaggctgttttcagtcttcctttacaaatctagatgaatatgccaggcactctcattaatttcttgaaaagtagtcattttttttgaaagataaaacattcagtaagaggtgaaattaatggagaaatattctcactattattttactagaaaaggtataaggatttaaatgatttgaatgaccaaactctctaccaaaaaaagtatcacccaattagttcaaactaatactatagaccatgcttcacccgatgtaatttacatattattccaatcatagcccactataacctctgctttcatcaacaagaatagagtttttataaagattaaggcacatttatctgttcttctgcttttttcaaaactgcttaaatctataaatgtatttcaatatgtatcgagaaaacagaataaagttaagtgaatgtataggaataaaaggtgcttctgttaaattttttacaaaaactacgataatgatcttaagactagttttagaatctccctatatataaatagtgtttagtcatcgtttcttaaactttccacaaaatttatagcggtttgggtggcactatatatagttgaccctagaacaacatgggtttgaactgcatgggtccaactatatgcagattttcttctgcctgtgcccaactatgtgcagattttcttttgcctgtgccatgctggagacaacaagaccaacccttctacttccacttcctctgtagcctacttattgtaaagatgctgaggatgaagacctctatgatgatccactttcacttaatgaataatcagtatattgtctcttccttatgattttcttaataacatgttttcctctgaattactttattttgataatatagtgtataatacatataacatgcaaaatatgtgttaatcatttatgttatcaataaggcttccagtcaactgtaggctattagtagttatgttttgggatagttgcaagttatatgtggattttctactcttcaggggtcggcatcccagcccccatgatgttcaagggtcaactgtataccttttatatctacataccatagatattgtaaaactacctacattcacaatgattaaaataagttataattatgtattaatttatacactcaaattataattaatgcaattatgatacaaatttaaattatataattttaatttatttctttaatttttatagatttattatgttttttgccattccttttcaaggaatcttttctgatttcagttttattaaagtcactttcaacacagggacactatttctgtttaatgacaggattagctgccagtccctatttctccagatgtggagataacatttttattcagcagggagtctaaaccattcacagaaatcccattttataccataagagcaagcatattaggttgcactcaaataagatggggtatctccaagttatttctctattttatgcctcggttagttcctaaggcaactaaataaataaataactctgacttaataggcaatcaaggagcatcgtttgtaccatatggttggcatagtaaccctggggtattgttactgctaccaccttctagagaggaggaaggctgggcctcagaggttaagtaacttgcttgagattacagtttccacattaagctggaatctaaatacagctgctaatggatgtctccagagtacatgcagcagaaaaactaaaagaaattactgttctatctccatcagtgaaaattttatgtaaattagtaaatgttatgtaacccaagattattgagagtgagagttgaatgaaataactttctacaagtttcttctgacctccaagtaatgtacataatatctgaaactatttgaaaccctgatatttaccgtacaaggaagcaaaaaaacaaattattcataagccagaaatgttcccaccttaggtgcatgcttttggcagcctgcttagaagattgcatgatatgcactaaagaaatgtaaaaaattaacagagcagattacctggaaataagtcccaagttggaacatgagataaatactgtataaaagttaggtggtgattcaacatacccctctccctataatttttagtctttaaggaaccccaggtcttctctgtgctccagtgctccctccttatgcccatgactcaacacctactgtgtgccagcacggacctccctggttcattgaatgcaaggttcattcagcatttaaaattcaattaatgtaattcaccatgataaaacaaagaaggaaatctatgtgatcatctccatagatacagaaaaaaatgcatttaacaaaactcaacattcatatgataaaaacgttcagcaaacagaattaaaggaaacttcctcagcctgaaaatgaccatctacaaaaaaacctagagctaacatagtaatggtgaaagactgaatgcttttccccagagatcaagattaacacaaaggtgttcattcttaccacttctattctacattgtattggtgatcctggtcagtgcaacatggtaagaaaaagaaatagcagttacatatattggaaaaaagtaattaaaaccccctctattaacagatgacatgattgtttatacagaaaatttcaaagaatttgccaaaaagagactagaacaaataactttaacatggtcacaggatacaaagtaaatataaaaaattagttgtttttatacgctagcattgaacaatttgaaactgaaatttttaaagtactattaatttttttaaatgaaataattaggtatacatttaacaatagtagcaagattagaatgccaaaaactacaaaacactgataaaagaaattacataagcccaaataaatgagctatatttcacgttcactgattgaaatactcaacgttgctaaaatgttaatttttgcaaatttaatctctgcattcaatgtaatccaaatgaaaatatcaataggatttttttttgtagaaattgataggctgattctaaaatttgtatggaaagccaaaggaaataaaacaataaaaaccaatttggaaaagatgaacaaagttgaaggactcacactatctgacttcaagatctgttatagaagcacagcaatcaagataatgtagagttggcaaaggatagaaataaacacaataaagaatgcagaaataggctcacacacttatgattaattcattttaaacaaaggtgtaaagcgaatctctggagaaaaggaagtcctctcaacaaacaaagctagcacaatgcatgcagccatattgcagggaaatgaacttcaactcaaattttatacaatcaaatgcaaaaactaactccattaaaactcagatttaatataaaacttcgaagagaacacagaaaatatctgggatcttgggctcagcaaagatttttaaaattatacctaaaaaagtacaaatgatataagggaatctgataaattgcacttcaccaaaattaaaagtttcagctctttgaaagacacttaaaaaaataagaagacaaaccacagaatgtgaaaatattgcaaaacatgttttttcttacatattgatattcagaatatttaaagagctctcaaaactcaagaatgtaaacaaaccagtttaaaaatatacaaaaaatttaaataaatacttcatcacataagatagcaaataagcacatgaaaagatactcaatatcaataacatgtccattgaaaccacatgagatatcactatgcaactattaactattttatatacatgtattagtgtatgtgttgagagagagaaggaaggagagagagtaggttatatgtaataatcgacaataccaaatgctggagaggatgtggaataactctgatgctttggtggcagggatgtaaaatggaaaacagttgggcatttttttcttataaaactaaaaatacacttactgtaacacactgagcaatctcactcccaattcatacatattacccatgagaatgaaaacatacttctacccaaaagcctgtacacaaatgattatttcttctttactcataatttcgaaaacctgataagaacccaaatcttcatcagttactgaatggataaacagtcttaccttcttgcaattgaatgctactcagcaataaaaagacccaaaccattaacacatgcaacaacaaagaataatctcaaaatcatttttctaagtgaaagtagcaaggttcaaaaggctatatattgtatgactccattcatattgcatctggaaagggtaaaattctagggacagtgaagagatggagtgttgctgggagctggaattagggcatggtattgaaaacaaagagcattgagaactgttttggaggggaaggaagtgttctacagctcgattgtggtggtagtcgcacagtgtatacctttgtacacctaacatgatgaattataagtgaattacatatcaataaactcaactttaaaaaagtggaagtgacctggacctctgttgcctctgagatgtccatcctaaccccagtttctcactcttcaccctactgtaatccagtttctatctccaccactgcacaaaaaactcattttgttaaggtcagcaaaaacattctgattgcaaaattcatcctcagttcttcttatgacttctcacaacttttagcataatcaataacttctcctttgaaatattttccctttctcttccacaatgctgctctctcctaatcatgcattcttagcgtgatgaaaagttcctcaaccccctaaatattggtgctgcttagattcccatatttagaatacctttctcattttctatttacttatgactcgtttgttttaaagtaaagttgagcattgtaaacaagggcatcacttttgtattttagggtatttacctttgtatcaattggaagataaatttgaaaaaggcaaaactgaaggaaggcgggtaggttgggagatgatatggagaagtgatggatatccaaatagtagggctttggaagataaggatagattaaagagatgtagaagaaagaatcagtagggcttggcaatacattgaacacagctaggacagggaaatagaattgttagatgaatggtcaaatttatggtcaatttatacaatctgaataatggtggagtcattcggcaagtcagcgaacataagaaaaggaagaggtttgggtataaagtgattatttcagcttggaaaataataagtttgataatcctatcaggaagatatttaaagaaatcaatctgtatcccagggaaggagtagaggcactatatatacatatttccatttatatgacattctggaaggggtaaaatcccaaggacaacagagataatagattgccaggagctggggtcaggaaatgattgtgtgtgtgtgtgtgtgtgtgtgtgtgtgtgtgtgtgtgtgtaatatgcagatatagactatatatgtgactatatatatgtataatagttgtctatttctttcagaagtaaagaaggattcaagtctccatgtatttctctatgttattctctccacttgcaatgctcaccttcttcatctgttatttccaattcatcctccatgaaatgattcagatgccatctacttgaggaaatcttccttgattagccccattccctcaagcccacctttatcccctaactccacgctgttagatgcacatttttggacattttaatgtcacatttataacactctaatgaatgtagcatttagggtactttaatgcaactgttgattagtttagttgtcattttcccacaaaagattgtcagctccttgatgtctttcatctgtggaacatgagtgttttttacagtgcctggcttataggaaatagtcaaatagggttgcagcattacactgttggaaagaacatggtgtaagaaatcaagtagatatgagtttgaattttgactctgctagccatagtctgtgtgcttggttaaatcgttcaatctctttgagtttaggtttctataaaatagagattataatgctactttcctcatcaagtttttgtcatgtattagtaaactactgccgcataacaaattttcccaaaactctgcaacttaaaataatgtccatttattatctcacagtttcagtggataatggcttagctgtattctctgcttcagagtctctcacatggctacaatcaaagtgtcctccagggctggggtctcctctgatggctcaacagggaattagtccacttcaaagttcatgtgtgtggtttttggcaggtacaaattccttcagggtggttagactgaggatctcagtttcttggtggcagtgagccttctctaacaatggcagtttgaccacagtcattatgaaacagagtcttctggcaaggtggaagtcaagatcttttgttacataatcactgaagtgatatctcacgacctttgccatattctgttgattagaagcaagttgctagttccagtccagactcaaggggaggggcttatccaaggatgtgaatgcctggacatggggatcattgggagctatagagtcatatagaactctgcctactacatgtgaggaccaagtcaataaaaccaaaagattcactagatgcctaatattatacatggcaagtgctcaaacagctatttatgtccaatggataaatgaactcatccatcaatcaattgttctgcaattaaccggagtaaccactagatggtggtgcatccttcacagcattgtgccataaaagtagggtcagagattttgaatgtaagagctttttttttttttttttttttaaaacagataaggtcttgctctgtcacccaggctggagagcagtggcgcaatcttggctcactgcagcctgcagcctcgacatcctaggctccagcaatcctcccatcttggcctctagagtagcagaaccagaagtaaaagagcatttttttttttttgatgatgatgatgatgatgtaatacacaaagacacattttaaaaacagaaactatacactcctaactaaatctcttttgtatctctggaactcttacaaaacctatcctgcttcttccttccagagtaaattataaaatgtgcaaacaaaataaacagaaactcctctcctcactttgatgtacaaggtttctcactcggatactatccagccctgatttaaggtttctcactcagatactatccagccctgatttaagtttccttttgactcttaaagacttaaaagcttttgtgtttctgttttgaaatatgtctgttatctttttctaaattaaagtaaaacatattcattgtagaaaatttggaaaatatagaaaagaaataaaggaagttaaaaattctaatcgcacacctaaaaatactttagtatatctattctgctttccttcccttcttttcctctctgtttttctctattcttcccttccccaacacacacatacatatacacagagaaattgaaattatattatatatagttttgtatccgaataaattgctacctcacaatatctttaaacttcctttttgtaatacaatttttgagtccttgccttttactgctgtgtttaagcatatatatagctattattataccatttgtagtgccttgctcctaccttctcattttctgttattgtagagtgtgggtttttttaaattggtgttttaaaaataatttttgtattttttgtatattattttgttgatgtttatctccaccagtgttctggaatttccatattttgttttcattaggctacttttaaacttaaaaacattttttaaatgttttaatctattctcctctaattaccaaggtcaaagtgaaatcatattgttttgattgcccactatgtaagacaaagaatttagcatgttttaaataaaatttcatcttttccatgatagcatggtctttgctaacataatcatgagcttgggaacaaattgttgtcatccaattattattttaacattttggaaatttatttttgaagaataaccttgaacaatttgtcgtattttgtgtcttctgttttgcaaaatgatttagccatactttcaaattgaactggttttaatgtttatgaccagttctttaataatctgcccactaatatttgataatgtactattttatgctatttaactaatattcttcccaatgatattataatttttcccttagtcacatgaagtttatctttaagtatttttaggctatgcacttatcataagtagtatctctttctgttatctacaaatttgaatgacagtttctctgtgcacagaatttcagggtctcagtcttttatattcaaaatgttttaactttaattctattattttgatattcttttggcatttatttgtatcttttaaatttgtttatttttatgtcttttaaaatattttaatataaattaatatttttatgttttccttgtatccacagttaatttttattattgtttttcttctttttgttttgttttctttttaacttttattttgggattaggagtacatgtgcaggtttgttatacagttaaactcgtgtcacaggagtttgtcgcacagattattttgtcatgcaggtgctaagcctagtactcaatagttatttagttatttttttctgctcctctccctcaacttaccctccatccccaaggagtcctcagtgtctgttgttcccttctttgcgttcatgagttctcatcatttagctctcacttatatgtgagaacatgcagtatttggttttctgttcctgcattagtttcctaaggacaatggcctcctgctccatccatgttctcacaaaagacattaccttgttcttttttatggctgcatagtattccatggtgtatatgtaccacattttctttatccaatcacagttaattatttcatcattatttagatgtatgtcgtttaaaattaatgttgactaaaagatagtcatccattttaatatgctgtctcctgtcttattcaacaagaaaaataggtcagctgtcttttattgttaatccacttcaaagtattttgatttctctctcagttacatttgaaattttaaggtctaatttctgttctctagtccctttatctctgggatagtttctcagttttgttctcttatcacagatgcagttttaaaatttttattgaagtacaataaacaaaaaattacataaaccaagtatttagcttaatgagttctcatcaactaaacatatctgtataactaattcctagatcatactgctttgattatctgcagtaccagttttccacttttctgcccccaatgtagattttaatagcactattgcaatgctagttttagtttattcttgttattttacactgcatccttttcttctctgtctgtagtccttaatcccatcctgttgtcttttcagttattgttttcatttttgtgtctttttactttatttccacagaaatcaagttttcacacatattgtcatgaaaataatgtagtattctaaaatgttcttgatgttttgttataagccagattttgggttttcttcctttagctctttagcgttatgttccctttcttttgtggagcactaggaatacataatgtatgtatgtatatgtatagatactcaaacacacaacatgtgtctgtccaatcatcatgtattccctcttgctttacctcttcataaaagaacagtggtttctttaataaccttcttttcctagcagccaggtacattagaggaggctgacttcattctcagttccaaagaataatcctctttcctcccacttcttgccattgatccatttagagatgaatatgagtaaaggtttgctgatggcttctcgggaagttctcatttgttctttaggtagagacatcagggggacgtgaatgaggaagcatgtagatagagtgctacttgcaaccatcctataacttcaaaaatgtctttgaggtaaagctgaaactttgaccagtgaagtgaagaagtggtagatatctgagttcttgatctttttgagtcttcaagataaccctgctgatgttttttttttcttggactttctccttatatgagccaataaattttaatatttagggaagcttcatttaggttctctattgcttgctgccagatcatcctaacttacacataactacaatctgatgttgaaaggaattagttttctctttctctctctctccctctctccccctgccccgctcttccccacatctccttagcaagtgcacaaccagacctagtgtttgctaacaaaataaatctgtgagctgtcattagccaggttcactgaccaccttgaggaacagtcaaagctccacctcagatacatagtagaaattgctgttcaagttccggtagttggtaaccatctgttgtaataatactaaactgtactaggatctaaccagtttcacagatacttcaaaccaagcagatatcttctctgtcacttgtaagataaataaaatatagtcctctgttgcttttgccttgttttgttctgcaagttgtcatttctcaaagcatggagaagacagagtataagaatgacaaggaaaatagtattcagactagctctgtaaagcaactgagtgaccatcagctggctctctcattagtgcagacccagggctctgagcctaattgcatattgcaggatatgaaaaccacgtctctgtactttcctaaaagtagtggaacttcggacgcctgtagtcccagctactcgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaaaaaagtagtggaacttgtcagatgacgttagtcaccatttctgttgctactttcttgtttcacactggttttgtttaattcagcacctttggttttatggttaagcattttctccaattcagacagtaagttatcttttcattttatctgttactattgtgttacctctcatctttttcttgtcttcatacacattttaatgggatattgacagtaactgttaaatagatgatgctatagagtggatatgtgcccctgctaaacagcaattattattgttgtttacatgtttcaaacttgtttacattgcttcaatatagctaaacttgtgatagatataactgtaactaatttgtatttgggcactgccagatctaaatttaagttctggcactaccactgtctaattctgtgacttttggcaagtttcataagctgtcaaagtttcaatttattcagcttaattacctcactgtgaggttgtgagaaatgaataatacagtaaaatacttagcaaagtgagctgcacaccatacctacgcaatagcagtagctattgttaataatgtgctcgccctcgccctctccctctccctctccctctccctctccccacggtctccctctccctctctttccacggtctccctctgatgccgagccgaagctggactgtactgctgccatctcggctcactgcaacctccctgcctgattctcctgccttagcctgccgagtgcctgcgattgcaggcgcgcgccgccacgcctgactggttttcttatttttttggtggagacggggtttcgctgtgttggccgggctggtctccagctcctaaccgcgagtgatccgccagcctcggcctcccgaggtgccgggattgcagatggagtctggttcactcagtgctcaatggtgcccaggctggagtgcagtggtgtgatctcggctcgctacaacctccacctcccagccgcctgccttggcctcccaaagtgccgagagtgcagcctctgcccggccgccaccccgtctgggaagtgaggagcgtctctgcctggccgcccatcgtctgggacgtgaggaacccctctgcctggcttgcccagtctggaaagtgaggagcgtctctgcccggccgccatcccatctaggaagtgaggagtgtctctgcccggccgcccatcgtctgagatgtggggagcgcctctgccctgccgccccgtctgggaggtgaggagcgtctctgcccagccgccctgtctgagaagtgaggagaccctccgcctggcaaccgccccatctgagaagtgaggagcccctccgcccggtagctgccccgtctgagaagtgaggagcccctccacctggcagccaccccgtctgggaagtgaggagcgtctccgccccgcagccaccccgtctgggaaggaggtgggggtcagcccccgccaggccagccgtcccgtccgggagggaggtgggggggtcagccccccgcccggccagccgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatggaaaggggagaaaggtggggaaaagattgagaaatcggatggttgccttgtctgtgtagaaagaagtagacatgggagacttttcattttgttctgtactaagaaaaattcttctgccttgggatcttcttgatctgtgaccttacccccaaccctgtgctctctgaaacatgtgctgtgtccactcagggttaaatggattaagggtggtgcaagatgtgctttgttaaacagatgcttgaaggcagcatgctcgttaagagtcatcaccactccttaatctcaagtacccagtgacacagacactgcggagggccgcagggtcctctgcctaggaaaaccagagacctttgttcacttgtttatctgctgaccttccctccactattgtcctgtgaccctgccaaatccccctctgcgagaaacacccaagaatgatcaataaaaaaataaataaataaaaaataatgtgctcaatattctgcatattttaattaaatagctgttagaatttatatttacaaaatgaatggatctctaacataaatttaacatttcaaatatttcttttattaacttaactttaaaattagagggatttttattttttttaaccaaatgacaaattccagacatttagagaaacatattaccctatagttgtatagtgctttatattttgccgaatagagcactttatattttctaaaatatttacatattaattaccttttccagttctcacaacaactaaaggtaggtggtgcaaaggtgcttactcccatttcaccatgaacaaagttaaaactcagagaaactacatggctcctgtaggatcacatatttaactggagccattgctgggacatttgacctccaaacacctcctctctcttccatatttattaaattggcttgccaattaatatatgtaaacctagtaattaagaagctaagtcagcctatgtttgctacaatatgccacaggtaactttttaatcttaagattgtactaagaaagaatgaagtggaaaaatggttaaagcaaagacaaaatatggaggaaaatttcttgttgcatatttaagatattctttttattctatgaaggacataatgaaatctactcagttaataggcagcatatggtataatccaagtatgttagagatttcgggttttggccaaatagaagttttaaagaaatattttggtgaagtagtttctgccttttatcaagaaacctctatcaactaaagttatttcttctaaaagtcactgccattttttaggaacagtttaaatgccaatccaaagccagcttctttgaactgacacatttacatgggtagataaaatttgtgtctctgaaagtgttttatttcctgcgatcagagcttcttagcttttccagatcaaatattcctgtgaaaatttgttgaaattttagaccagttctgaggaagagtgctaacagaattacctggtatgctcataaaaaatgcagctatctgagcccgatcttgattcacagaatcagaatttctagtgatgtgtcctaagattttgcattttaatcacacccactcccactaagggactcttatgatattatattttatagagtcaatactataaattcttcccccagaaaatgcaaaacaacaaatcaaaaaatattacatatattttcaaatgatttacagacctgtcatgtccattcatggatacattagatatctgcaaatgccaggtttacaacctttgcattgaataaagactaaagttgtcttccaatacattaggctctttatgcaggagaaaagactgaatgcatgttcattttgattacagcatttcacacatttcatcaagatatatactttatagcagtactgtattatataataccgtacactaggaagtaaacatagaaagaggtattcacacttataagagttaccatgcagttgaggaaagtaaatcacaaatattaaaaaaaagaatacaatgtactctgtgctgggttccatatggataagctcagatgttcaaggacaaacatgagtgagagttaccaatagaaggcatttcaatatgggtaagtaacaattgggcagaactgtgaaagaaagttgggatttttaaaaaactgaagagaaagtagcagttgagcagaactctgaaagaaagttgggattttgaaaaaacgaaagagagagagaaaactttgaatgtgttttaaattttattctactaaaatatattttaatacaaccatttatgcagtaagcaatgggaaataatgctgggagatgaataaaagccagattgtggagggccttgaatgtcgggccttaccaggtcaataatatacttggcctttgatattttcatggctgtacaaaattaaagtattaataaatttgcaaaaaatgacaaacagcactgctaaagaatgtaaagccagttcttaccatggcagagagaaagccaacatttcttagaacagcaacatccaactccatacaagacaggtttttataattcactttaacttaagtgtttaatcattcacttttgacaagacaagggaaaaaaggaccaagcaagagcagagccctttctgatgatttactgatcaaagccaattaggatagttctggttgaactgggttgagtttctctgaaattacttttcaaagtaaagtcaacaagagtgagcatgtgcagtgctgtactttctacttgttagtccgtaaaataactaaaaatcacttacctatatccactgagcttcaaagtatgacttttgaagtgcaaaatcaagtgaaatgtgaaactgaaatgcaaggctttttgcagctattttgtctttcgtttgaagatctcagaatactttccacacaatagactgaatcaaatcttcctctgggctcagtattttttttatctgagctaccatatggttttgaacaaatatcaggtctggagagtgtgtatatgtatctcttgcatcagaactttagaatagtataatcataaagtagagcaaagaatggatgctgaagaaacaattccatgctatacgctgtacacacacaatcttaatatacaaaataagttaccaacatagtaacaccacatttttctgatattaaggttgacagtgacccacataaaagagcttttggcataacacatttttataattcttgtgggaaaaatgttttttttaatcatttcacatttaaatatttcagaaatatattacacattttcttgcatttctggtttaaaaatgttgcatacaattttgtatcttattgacgacaatgttattatttattgtcctatgctctatagattttgattttgttcctattttcaatatcttcaaggtactatactttttaatattattttatgccagctcatcatattattttttcggagggagcatgttgtagagaacaaatgacttatctcaggagtcaggcagactgagtaccaaccacaagttggcttggtttcatcatctgtgaaatgcaggtagcaatacatgcttcatcattcattagaatgattaaatggccacataaataaagcacttaccacagtgactggcacagatctgagactcaggaagtgttagttctttctctttttttttgagacggagtcgttctgtcgcgcaggctggagtgcagtggcgcaatctcggctcactgcaagctccgcctccaggggttcatgccacacacctgcctcagcctcctcagtagctgggattacaggcgcccgccaccatgcccggctactttttttgtattttttagtagagacggggtttcaccgtgttagccagaatgatctcgatctcctgacctcgtgatccgccctcctcggcctcccaaagtgctggcattacaggcgtgagccactgcgcccggccagtaagtgttagttctatccactcacattcattttctagttctcagctgtcatttcctgctggctgaaaaggtacacaaagttatcccttatccttttcttttgctgattctattccactgcaagctgaaatatttgataatcaagcttgctttaattgtatctaaaatagtaatgaatgatggattaaggcctgaggaaatagttaacaaacttcgccatctccagttttaaacatagacacttttaggacacatcttcgttcttgattatgttctgcatagttgaggtcacgtacagggactgacctccagaaaagtaaaatttaatggtaatcaatacggagaaaaattgtggacatgatgaaatctaactatgtttttaagcaaataaaaatagagttagtgaattatggcaagacaagcaacatttgataagcacctatgacctggaaccacatgctatgaacaattgcctcatttaatccttattagtggccttctaaagaagttactgctcttccctttttacagattttttaaactgtgacaaaattatgaatttatgaaaatgtcaactcttatattcagcatattttccacttataaattctctacttagaaattattcatgcggcatattctttacttaaaattatgatagaatcttaggactgggagaatcactagaggccattgaaatacataacataccttttcttaaatttcgatgataatatccatgctgaatgatgattctctctaaatctgcacagcttcaatgtcaggaaacatactgtctcccaagacagctggttctatgcttgatgagcatcaactgctagaagattctgcacagtgagcataaataaaccatccaaaggcttcttactgttggtactagttttcacagttagaaacaaataaaacataaaattccatgtgttagacctttagctacatgaagacccttctgatatgccctggtatctgcttttctcctggttaaacattcaattttctccaataatttctctaatgacatgatttcaagtaaaatcactatcatattagctttctttattggagtgtccatatcttatcgctgtctcctaaaacaaaaatatttcgagttcaaattgggagttagaaagggattttcatttcctttgccccagatactatcatcggtcatgacagccccaatgtcacataaaatttggaaagtcacatcaccatggatccatatttcaaagataagttgaggtaatacagaataaagtaaaccataggctgctgtacattatgtaagtgttaataataattattagtaaattattatcaattgaaactcataggtcttcacccaataagttgtatctcttctatccagttttgtggtttcttcacctcaagtgaaaagagttaactctttacttcagattatagaaaactgtcttctttagttgacatgagatccctggcttgcctgctttatatctattccattctgtcccaaccaatcctattctatagtttcccccattcctcattcatttttctcctttccttttgtacatcactctgatatattagctatatagactcatttacatgtattcatgtaaattattaaggtttgtgtataagtatatattgtgttaaagttctcattttctttcttccttttttaacttttagtttaagttcaagggtacaagtacagatttttttacataggcaaacttctgtcatggggggctgttgtacagattatttcatcacccagatgttaagcctagtacccattagttatttttcctgatcctctccctcctccaagccctctaaaggtacatctctttgttgtattggagaagaaaacctttttcagcctccccctagcagagcacccctcaagtcctattgaccaggattgggtcacatgcccatgacccagctgtaaaggagtgtgtgaaagaatatatttgacatgtgtattctatacggtggaacacatttctctctgtaaggaacaggcatgggacatgctggggaatgactactagaggtaaccataatttctgcctaaggatggtcattatttttaacaggttcatgttgcctataaattcaataagtatgccttatatatttttattcaagtaatatttatccaagttcacttatgctgtctacaaaaaagttggtgaaactcctttgaatgactagcatgctccaagcatttatagttatctcatttggttcacacaaaaataattgtttcataggctttattatttctactttataagaaatttcagcttaaataaattagctaatttacccaagttctcatagcctagtatcaaagctccgattaatataaaagtcagtgtcatagtctgactccaagtccatgtttattctacttcattattttgattccctgagggctattagaaatgcctctccaagtaggtccattgatcagaaccctgaatatgttccctctccttcttacaccaccttcaccctgtagcccccaatagatacatttcctcctttggtcctcaaggctgttgtctgcttaggcttccccactactataagcttggataaactgtatgcttcaaaaagcaagattatatctatttttcttcactatcatatctcctgcactcacatagtggcagtcaaactaaggccttgataaataagttttaaatatgaatgaataataaatgaatgaatacatgcactattgcaatgtctcttgcatcacacgttttctgccttattactggtttccatcacaacttatctgacctcagttacctggcgattattttttttaacttggcatacactgcccatgataaggcactaatgactatttcatgatacagttactgcccctctcaggtaacattttcacctttactgaggcttctaagagacaaggtctcaacctaaaggaattgctctgattgtgagaattttagggagtatggtagttctaggggcttcatgacctctcagcttatactgcctatgtgaaacctctctaggtcctcaggttcccctttaagaaaatgttaaaaagaaacaaaaaagaatcactttttttgtttgtactctaagtgtatctcaaacacctcacatattcaaattattctcttgtacaaaattaaatgccattggatgtagaaggagtggagcataactggtctttcatagaggctggaatttctctgagagcaccacacaagtaactcttgccacagtctcaattaataaaagcctttactcttttttcttaatttttctttcctttctatcccttgcatagatacttaatagatttgaagttgccattaatttcttaaccactattcaaaaggaaaacaaacaaaagaaaacaaaaacaaaaacagcatttcctttgttgtaaagcaaaataaaatcaggccctaattttccacaacagaagttgtccaaaatacttatctgtgtttagatttcccaaaattcatttcttcataataatactgtcagcgttcagtgttgtgatcataacattcactagtgtgacttaaaaaggggaggcaccatgtgttaagcagggataggatctaagaataacaaatctgcctggtaagcagcacaaatgagtcttacactaagccacactgatccagcttggagggaaatgagtcaaaaccaagtccccatactctctacctgcgagaaagaggtgacattgaagaacaagcccacacttctggatatggtccaaaatgatcagaaactcactctgtcaacctagtaggtgtttggatggatacctcttttttaacagaaagatgtttggagccaggacacatggttttcacattttaatggcaatgctcataggtaactaactctcttcttatatacgctaatttgcaacatgcttagtgtttttaagatgtttatttagcaactattgtttaatgctataacagatattactatcaaatgaaaattcaaacttttgagaaaggaaaagtggatatatttatgcattgagtttttggctttagataatttctactttgatttctatttattaaaatttttaaaatcctaagtcaatcaaaacagatcaagatgaaacttcctcatttgtatatgtctttgtatatatgtctagtatatatatatctagggtaaattatataacttcatattagatatttcattaaccatggcttcagcaaagtgagaattatgacaaaaatcatcttcatatccaatgatattaattctaaatataaagtctacgttccttttatccattaatatgatttattctcaaggaaatatgagatataccaagtggtagaaatttttgctatcatgattatttttgaaatacagtattattatggaatcagatactgaactaaaaaaattttaggaaagtaaaatgaggtgacagtttttaattaattaaattaattgactttaagcaaataacaataagcttcaagtaatccatcccatactataaataattgcacataaataagcaatttgtattcaactaaaatacccaattaagaagactgaatggccccaatggtcccataaatatgtcctaatccttttatcttgattgacaacagatcttgttctttgcccagctcctccaataaccaataggagacatttttatcttttttcccacttttagttttctgggttcatcaaataaatatgttggactttattttacattggacatgtcaatagaattgattttaagtgaagtaaaagcataaatcgctgtttatcattctacttttcatacctaattctgtttgctgttcttcggactattgatcttaatacaggctttctctcctttttttgttctttttaaagtgatggtaaaatttaaaacttgcttttctgtttatatttaaagaaacacataatcaaattattgacattttatgaaagatcaaatgcataaattttagcaatcataagaaaaaaaacagtaggcaatggtatagaaagcatgaccatctgcacttatttgcccacaaaggataaatgagagtgtactgtaaattgtaaagaaataaacatcttatttcaagctctaataagcttatgtgtcaatagttttaatagctgcctagttggtcttcctgtctctactttcttcccacttcattctgttacatatccctgtgaaggtgatctttatgagaaaccatgttggttttctgtccaacaattacgtatgactccccactgccagaaaataaataaatacagctaaaaacctcgtaagttcccagaccttctccactctggctacatttaacctttgtgtgtttatttttctaggtaaattgtacatgccaaccagattgccaaactcattgtcacctctaaatgttaagctttcccatcgatgagtgttttgtttattcacttatttacacacacaaagacctctttttcttttttcttttttttttctttttcttttttcttttctttttttttttttttttttgagacagagtctcactctgtcgcccaggctggagtgcagtggtttgatctcggctcactgcgagctccgcctcccgggttgacgccattctcctgcctcagcctcctgagtagctgggactacaggcgcccaccaccacacctggctaattttttgtatttttaatagagatggggtttcaccgtgttagccaggatggtctcgatctcctgatctcgtgatccgcccacctcggcttcccaaggttctggcattacaagcatgagccactgcgtccgcccacaaggacctctttatcaacttgacctatatttgaaaacctatattaaattctatttctataagaccttcccagccaggcctgaagagatacccttctccagaggctctgcagcagctactgcccaaactattcacttagaatctattgtgtactgtctagtgaaatctcttcagtattgtcttgacttgcactatcatttagtttttcacaaatttgtcttacttttcctttattaaattcattgaggacagggactagttcgaacttcatgttatctgcaatattttatacatgatatgtaatcaatatttattgatttgacttaaatttaatatgaagatttcatatctaaagatgtttcattatctatcattcaaagtatttttcctaaaactttcctaaatatgctctaatgttgcctgagttttattctcatatattatcgacatctgctgggaacatactatgtacaatgcattttcataaatatatattttgtccttccattatattgtaaatacattcaggctaggtctacgtcttctagtttgtagtctgagagtactctgagagtacatcatagagtagctattctataaattgagaaaatggtcaattgaaatttcatctaaggggtcaagatatggttgctgtcaggtaccaaagtgaattatgaaagaaataaaaacacaagatgttaaagtaaatacagataacagactttaggtttttgaaaggtttatacttttttattttttattttattttatttatttattattttgagacagagtctcgctctgttgccccggctggagtgcagtggcacaatctcagctcactgcaacctccgcctcccagattcaagctattctcccacctcagcctcttgagtagctgggattacaggcacacgccaccacgcctggctaatttttgtatctttagtagagacagggtttcaccatattggtcaagctggtctcaaactcctgacctcatgatccacccgcctgggcctccaaagtgctgggattacaggtgtgagccaccgtgcctggccaaaaggtttatacttatgtcagggatgtgtgaaaattcttcagaggcaatttgaaggagtgggtctataaggagatttcgttggagaggcttgctgctgtgttgtgagttgaaccttactcatcaaattgagggctggatgccacattctaaaccagagtgaccatagcttccaggagtgctccagtgtcatctaaagttggtggaagggaaggaacaggaaacttagactagattctccacctgcctgaggaatccaaagatgaaaaagcgtgatgactcttaacccgaggtgtcaggaaagagagagaaagaattgctgctgtgctgtgttggaaagtaaatgtgctcccctcctactgcaggttaagggtacgtgaatcctgtggtctagatggggaacccatggtaggagcattagtaggcagtttgtgtaaaaatagttcttcccaataggcctctgttggaaggtcaaagaatcccactaaaagagttgataaagaaggaagaaggagtaaacgtcagtaaaccaatagcaaaggggttgaggaaggagcaaatatgagccgccagtaaaaagagaggcaacgtctgcctgccttcacagttctctagagtgagtctcagctgcaggaatagagtgggctccaaggaagtcataagtgtcccttataacaaataccaactttaaacacctcccagtctcagaaaccatggagccatattgtatcagtcaagtgaataatttctgtgcccccttccccctttttttgccaccaagttcagtcttctaggggacaaaacacataaatctgaagatggagacaatggaaggatagaaagagggaagaaggcttccaaatcttccttcaagacagcctgaagttagcctagcagacaaagacgattttattctaaattgcattgaaatttttgatcattatatgtgactgaccattcttattgctttgtttttttttttaagagatcgtgacactactatctaatagtgagccgaaaagtcctggggtctgctgaagacttatctagaggcaatgaaacccttccccagttaaatatgtttcaagatagggtaggagaaaaaatcgtgttttgcttttgttatgccatatcagttgttcaatagttttaccctcaatcaaatacttgttattaatttttttgttcttaaaatcctttgaaaatcaagtttaagtaaaatatcttctaatacaaaagtttcaacttttcatattcagttatattaaacttgtattggaacacccctttagaatatactgtagtttacctgtaattcctgtgtcagttttctgtgcttcccaggataattgtataacaaatagattacttccattcagttctattctttctatccatcaaacatttaatcattcatacccttagcactgtacaggtgctgtgggcgtctctaagaaagattataatatgtccacggttttcacagagcttgaaatatttttgaattgacaaagcttgtatgaaagtaatcccagtacagtaaaatataagtacagtagagtccaatcaagtgcctagacgtgtagatcataaatggcagtacatcgtcagattaacatttcatacgtttgtctaaaagtttacacaaaaagatcactttggttttggatcagattaaatgcattatataaatatttaatcactttaggaaggtcatgatgaattcattcattccaaaattaattactaaatggtgaatacaagccaggtactatgctatgttttagacatatattggtgaataaaacaggcattttccttccttcatggaaagcacaacttgatgagattctagactaatatgctgtccaagtaaatttctcatataaaattacgcaatttacaggacactacacatgcccacactttctaaatagtctctctcaatgactacagtactatttgaattttgtcattagagggtaattctttcctactactttttagtattggccaaaacttattgagaacttgttatataccaaacaatgttatgaatatttacatgtcttaactggtttaatctttaaaagagcctcgtgatgtaaatactattattaatcccattcatagatgaggaaacaaatatagaaagtatatgtgacctgctcacaatcaagcagcatagctggggttctgatccaacattatcaatataggaatctttggtttaaatttttaaaaacacacatttgggcatagagttaaatggaaaaataagacatgcatattaataacaaacaataaatgagaatacactaaattattaattaaaaaactgtgtgtcagattggattcttttttttttttttttgagacaagagtctcgctttgttgcccaggctggagagcagtggcatgatcttggctcactgcaatcttcacctcctgagttcaagagattgtcctgcctcagccttcagagtagctgggattacaggcatgcgccaccatgcttggccagtttttgtatttttagtaaagataggatttcaccatgttggccaggctgatctgaaactcctggccttaagcaatccacccagctaggccccctaaagtgctgggattacagttgtgagctaccgagcatggccaggttggatttttaaaacctagttaatttaggccaggtgtggtggctcacacctgtaatcccagcactttgggaggccgaggcgggtggatcacgaggtcaggagatcgagaccatcctggctaatatggtgaaaccccatctctacaaaaaaaaaaaaaaaattaaccaggcgtggtggcgggcgcctgtagtccaagctactcgggaggctgaggcaggagaatggtgtaaacccgggaggcagagcttgcagtgagccaagattgagattgcaccactgccctccagcctgggcgacagagcgagacacgatctcaaaaacgaaaaaaaaaaaacaaacaaaaaaaactagttaatgtagggtctgatgttagaagtgctttggaacttagacttcactctttctacacctcaatttactctgtgaaagagaactaagaatatctgctttgaaaacctcagaaaattgtagtgagcacaaatataataatttgaatgaagatgttggggaaaccataaagtcctacgcatatgtctgttcttattgttactctttgttcatttgaatctccctggaaaagcaacagccacgcttattaaaaggtgttatacgtattcatattactttttttaaatgaattctaataattccctaattagatatattttttgacttggaatcagaaaaaaaaagtagaaagtgaagttaaaataataaacaggaaaggagcttgttatggtatagacatcatgttttacactggcattgcagggaaggaggaaatggggccttccattcaccttagaagtccttcatggtgagagttgtttggactatttatatttctggcaaacttttaggaattatggggaagtataaacaagatataaggcaaaatcactgtttccaagtagaatagagtgaaatctgcagccagggacagaatatacaatgtctgagaaaaaagtctcgaaataaataaattgtatcttacatcagtgccaagagcgatcttttttcttgtttttgtttgtatgatattcagtgctgcatgtatatctgacagtgatagttggaatcaatcacagtatttggcaaattattcctagaggaagaatacaaagcctgccatgactgcatcttttttcttcatgacacaggtggaatatagaattgattttacttttccttattaagtgtttacattttactccattacagtcctaaacctgagctattcatgcacttctgcaagattatacaagtaaattacgtgaaacttctatttttgatgtgaatatatataattttagcccttttttattatttaacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagaggtgagagaaagctgagtgctatggctaggagtgccatgcctcagagcagagcagaaacagcaaaaacagccagactgcttctgcctgctatgaaacataatgaccccacaagacttctgctgctggttgcccactgatgagaaagaaaagaagagggcagtgatgtgcgttaattaattttgagtggattcataggacatcagtttcactcatacagagaagtaaaaaaaataagcagatagctcttttccaaagaggttttcatctttgtgtttgcaaaatgctactgcaattttaccattggtcacatatcagaaatttattgtaaatcttatttgaaagagaaataatcttttgaaaaaaaaaaaccttagacataaaatttgtcagtgccacatactagcatgatatcttgtgcatagtaaattctcggtaaatattcatttccttgctctcctttccatgcaattcacacttgctccacaatcataattaagcatagcgtttttataaaacgccaattttattcaaaggtatcttttccaaggttgccctggagaagacagataatatactaggtgtcttaagaaaaaaaaaaaagaaaaaaaaatgtggaaagtaacaatagtagaacttggtagatgccataaactaattgatctaatttctctagtaaaccacagtttgcaaagtatttcaaaatccttaacttccaacattgttctagagattgctgttgatagtgatcaatatatacctgtttctttttattattattatcatacattgaaaaagtctgagaggtaattgtaacggactgctttgaagttcagctgtaatttaccccaagattttagagtaacttgaagtaggacaacatctggtaagtagtcttctctgctttatatgaagtaaaattaaaaccagtcttagcctatactctattccatgttcaaatgtctaagaattattagaaactactcaagggtttcccccgaccacaatattcattacaaatcacggacctgtttgacaatgaagtatggtatctactagctctacgtaatattttaagtagaatggcaagttgttttgtgattttttttaaggagaaaaagggaaattatgctgaggcaatgttcactttttgaagaaaaatttaattgacctaaggcaatatttttactacatatacaaaataacaaacagatgctgactcattttgactggcttccagatgcagtgacccatgaggttaatactgaccatggtgatgttaactgtcctagtaaatagattcaagagatgccaatccactgggttctggttttctttattttatccaacttggaaaaccatgaacttttcaaaccaagttcctgaattggttacccttcccccacttctcccagtttccttatactccaacattatttgaaactgcttaaccctcaagaaaatatttgacttcaaaagatcactttacagacagagagagttctgtgaaatcttttctttctgaaaattcttggtataaatttaaggaaaattatatttttcatatcacctcttcattataaaattaaaatattctgtattttctgttatcttgaaggaatgtttcctggagagtttattcccactaaaaactgcttttaagtggtaatgagaacatggagtctttctgctactgtacatatacgtgcaagagggaggagacatactaaaaagcacaaaggcaaacttcagcccattcatgacttgcactcatatttggctcaatgttttccaaccatggtatacattttaatgaacaaggagactggatagaggattttggtggctgactaaacacaaaagacatagtgatttccaatgtatcaaggttgatcttttttaaataatctaatttctcaacagaaagagtgctgaaaaggatttaactaagcttaggtcacagaagtgtccataaggttctctcagcatatcttgtgttgactgtttgtaagaacatgcagcattcaagatactactactcagaataaatggcatcacctacctcttgctctctggtgaacatttgacttacaaaagcaatttacatatctcttcttttcagccatatacctagattttgagaattttattctcttagaattatagtttcctagatatagaaaaagattcattctatgactgaatttttaacacaattgtacctgccaaatgtagtggctcaaatctctgctcaaacaccttcacaaatagagagatcactcactccatcttgccaaaaattgcccaaaagttatttccttatattgaaatagaataggatttgcccgtagctttccttcattgaccttgttgcatttctggaacacatgcaaataaaaatctcaacttgcctgctgcttgagaatacttaatatctgaagaaaagtatctcgagccatctaaaccatcacttctattcaggctaaacatcctgtttcttctaatgtttgccatatgacatagttttccgacacttcatcagctgcttgcaggttttggaatatatttgcttctttgtattccttctaagatgtgatgtctgtatgtgctggatgatacagtgacacacagggccataacctcccttattctagataatgtgcttctgtttttcagcttaatacaacattgactttttggcagccacacttcgtgattgcgtcactttgtatcattgtcactcatgatgccacatagtcctgtttctcccactctaatcttataaacgcacatttagatcgaagtggctcttatttattcttgttaaatttcatcttgttgtattccatcaatcattaaagcttgccaaaattgttttttatctgtatgtgttgttcctcttcatgacatgtcaaccacttgtatgagtatcacccttccaaatccacagccaagtcatatgtcttcaggtgtttctaaagtcatgtagcaaatcacacatgctgattagttgcttgtgatttctgagaaataggattgctgaagaatcaggcttctgagaaaaaaaaatactctgcattttggcttttaatccagatccacaaagtgatgctgaaggcatcctgggatgaccagcaggcaccccgctacccctgaggttgagtgattctgggcatatcttcaaacctcaggggcttcaagggccaaattttcttattaagcattttatctcatatgaaagtgctgcagtgtattcagagatgttaacctcttcaaaggggttattttatctaacagtacacttttgaaagctaccggtagttgcctggagcaggtggtctccaaatgcagattcaaaatgcaatgttcctgtattaaatcaagtcagagttctgaaaatatagccttttatgcagaagatcttcaaacacagttgattgtctaagcaagttttactatagttaagctaaactaaaatgtgtcttacctttgcccaaacttcagctgggccatatgatgacatttagacatgctgaaatatgctctttttttctggttagtactgggatataaaatcttgaagacagcaatatcttgaagacagtgatcttgtcaagttatcaatgctttctagactgcaaaatcaatggtcaattctgtccccatcttacttgatttctcaataccagttaacacaattaaacactccctcctcctgaaaaactattttctcactaggcttatgggacaccacactcccttggttctcctcttatcttactggctactcttgcatcatttcctttacctctacttgtctaatgcccaaggacttacttcttggacctctcattttctctatatatactcattctcttggtgatctcatccagtcttgtggctctaaatatctaatatggtttggatgtatgccccctccaaatctcatgttgaaatgtgattcccaatgttgaaggtggggccgatggaaggtggtatatactaacaaatcccacattatcagaacatcctgcctgaacctctatatcaactgcccactagtcacttctgcttggatatccaaaaaggcatctcaaatttaatatggactcccacctcacccaaaaatcttttcctccagttttcttccgtatctctgcaaatagaaagtccatgcttccagttgcttaggcccaaagccttagagatgaacttgctccagaaaattctgttgtatctaccttcaaaatattttgaaaatctgaccacttttgaccactttcacattaccactgatccaagccattatcatttctctcttgagttgctacaataatgtagtataactttgggcttttgctcagatatcactttctcagagttcctccctgattgttctatttaaaattacaattccacccctccaaatcgccctattccctttctctacctgacattttatactaaaggatttctcaccatctgacatattatatagtttgcttccttgtctgtgtctggtgtctttcctccaactagaatgtaagcttgatgaggatgggaagttttcttcctactatgtcacccatattttacaatgtcagtttttatttttatacatctcaagagttttcttgaggtgatgcacatcaatagcattgccacagatgagcatcactaactcctctgaccacaggaaatgcagggtgggtttaatactcagctttgccccaagttctctgtttcctgtgcctttcctactcccaaccaggaccacagaaggaagggtccttctttttccttgttcaactgccttgcttcttatgtgagatgtcatcccaagagaagatttaatcatctaattcttgatttctgttgtcccaatttatgttatttacagactaaaaacctgaagtttagaaaggttatgtaactagcctaaatcacatgttaatagcagacctgggacaaatacattccaggctctaaaaaatttctttacaaagaataattaggtttaatgacatgtttgcttcagcatgcctctaagtagcaaagattatgactccctgcacagtccacttgcagagggttgcatgaagtgcccttgtccaaaaatttcttccaccaggttggagtatagtagtgtctgatataccaccattaaggcccatattttagggcagcaaaggggagattctttagtttatcagtgcagagatctttttggtctgttttgtgatcaatatgcctgaagtgtaaactacaaaccaaaatatagttattttagggttaaagtaaactcagaagtccagaaagaggccaaatcattattctatttaataaacctgtcctgaactttaaaagctatgtatgagtgtgtatgcttgtgtgcatgtgtgtgtgtgaaatgtataattttcgtcttccatcccttctgtcttttgagccttaagatgtttctttttttttctcctcctcctctattttgacattgaagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaaggtaatgattactcatacaaactaggtatatactgtatgctaaacttttactttattaaaaagataacttattaaaaccattctttgtatataaagatgatgttactgacccaccagtatagaataatatttcatctatattgttccaacaagactgtgaaatttacattgagccatagaaatgaggccttgatcttactggtatcaggatctatttaactaaccaaagtaacttcggctataggcttctctcaccctcacagcaatcaaattacttaggtataataatatttcaattcctaaactcctaatggcacaccagaggtttaactgaattaactctttttggatgatattgttaactttattttaaatgcccaactactattgttttgaacttttattaagtcagaaacaacaagagaaatctgagaggtaatttccttctggtagttgaaatcttccgaaatataatttctcaaagcccaagctttactttaaatattctatgtgctcttctaagagctgcttaaatacaagaacttgtcagctctgcatgacctttcaaaggaaaaaaaggaaacgcatttctgtgtgttgagcgtttgttgagctccaactatggccctacactaagcttggttctaaatatacacaaatgaattattgtaacatagttatggaacattttcaatgtactaggcactattttacatggattaatccacttagttctattgaaggactactgtggaaagcaagcattattgttgtcccaatttacattatttacagatgaagtaactgaagtttagaaaggttatgtaactagcctaaatcatatgttaatagtagacccaggacaaacacagttcatgctctaataaatttctttttaaatactttcattttgaatactttttgtgagcaaccttgtgagaactcaaataataatactatgtctctgattcagaggcagaccaatgtgggaagggcactcactgagttgggatccagaggacctaagtaccaagtttcactgtttcgcttctgtgtaggatcttgggcaactggaaacaccttctttttatcatctataaaaccaggagtaagaatcccttcctcaaatgataattagtgcatgtgaaaaagtgcctggtaatttgtaaattacagaggacactgctatacttgaaaaaccctccttgtgctatggatcaattttatatcttttctctctctctgccaccactctgcccttttagaaaggagttggtaatggcagtagtcatttttattctatttagttaacaatggatcttaaaagtttaaaatgtaaagatgcagggaaattagcattttaaaaaaacagatatgtggtttcaccgtcaacatttttctatttagttgccagtgctttttatacctttgatttcttttctgctcagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtaggtagagttcaaacctaccatctcaccagttaagttgcgacatttgagttgttccaagagcaaacacagaaaaagagtatagacaaagccagtttattaaattaatctatggttgtttcccctatgcgagtaggctaatactgactggcctcttgcctcatcctgcccttggtggctgtctggataggaaatggaggtcacagcaacactaaacctagatgcttaatcatttaaaactgatttcctgaaaaagaattaacaaggcaatatttgaatttccttccctcattactgggaacacagaataaatatgtgcatgttacgcattgccatttattaactatgaggcctcaggcaattcatgtgatctccatcatctaaagcttcctcacctgtaaaatagggagaacactttctacttcttcggtttctttgtgatgattctatgaccttatctgtaaataatcaaacatgttaggcactcaattaatgatatctatgagaatttccctcactgtgaaaagttttcctgtccatcttctgtactacaaaaaacaattttccaaatgttagcaatttgaatactatacagtattcacaattttgacatatccacccactaactatactgttatttatattctgtcttctcacctacttcaaataattcacagtccagttaatagccaaccctctaagtttgcactgaattctaatttcttccccttattcaaagattgtgctcctaaaacttttctctcacacaccagtatcaatttttccatcattacaaaaaatttcttttgacacttcctcactcctattcctaccagttaccatcccatttctctgccttaaagaatagggagtaaaaaaccctttaatgtgttgtccgcaatatgcttctgatattctcactccattctctcttttgctccatacagtcaggcccacacaccaccacctccctcctgaactctcttaacccagagattcacaggtcacctttgtcacttcattcaggtttctacacaaacatcctccaacttggctttatttttatttttatctcttattgttccttgatattttgttacatatgcattgatatatttgtctatcatctctttcatcatgagaatataagcttcacaaggcaagaaacttttctatgtggtttcttgctcataaatatttgtaaaataaataaattgatattattttcttcaaatttacttaatattttcacttaactgctgtggacattaagtacattatcagcttactataaaaaaaatacatgctggatgcagtgactgacacctataatcccagcactttaggaggcagaagtgggaggactgcttgagcccaagaatttgagtctgcagtaagctaggatcacaccactgcactatagcctgtgcaacaaaacaagaccctgtctcaaaaaaaaataaaaataaaaataaaaataaaaatactgcactaaaataatggaatggaactagaggatagtttggcttaaggtcagtagcaatgacatactatctagactgggccccgaagtaactgagaaaaagagaaaaatgaatttacttttatgtttctgtacttcaaaatcatattatttaaaagacctgtatgaaatacattacactgtatatacacttggggaagttctctagaaaaacgtatatacttttatgtttcatacttaagaaataggtaccacacatgtatagaaaacatgatgcgttggcataaataaggtaaattggtttttaatggggcactaaattttaaatgatactttttcattctacttctttaattattctaaaataatttcttaattattaattttactgttgatcttttgatagaaatactaaagttgttagtctcagctatgttctacctggtgtccgaattgttttgaatattttcacaggaaaaatgaataggatttctaaaaacagtggcagccccaaaacagtatgcacactgctctgcaatctacacatcaaacagtttaggagctggacaaacatgtgtcagaaggaagtgaagtgaacttttactgctacaacattgccaatagcaaaagactagtaagtccagctctgacacccccagaaagtcccagtagcattttttaagtatagcttatcttagtgtagagagaaaacgtaaataaataggtgtacaataggaattataaatcaattttctaattgacaggtatgaacccagaattcacttttactactctcataattttaattttatgtaatcttatgactctattatattttctttccaactaaaatatattgaaaagattaagtctaatggaacaagatactcttgagagtacagctgataaattgctctgagtttgcctttaggactttaatcatctctgtatcgtaccaagatttaaacatttacaactcaccttaaatacaggtgtgcttattatggtaaagttccccaaagaaaaggtgaagtacaaaagtgattaggtatatcgtggtttttacccagatcagaagacatgatttcagtgtgctcagcagagttagtaaatatatttatatagcattatagaccatagtcttcatttcagagttggagaattttggagattttttattttaacatttacttaaaaacatgtaatgaaacacttgttgctctttttttccctaaattcccaactccaaacctggttgaaacacacacacacacacacacacacacacacacacacacacacacacatagtaaaaaacaataagatcaaaggaattgatttatttaattaagtcaaataatacacttgaatgatacactgaaattttctcctgctgtggtttctaatcattatctcacttttcaggatacaggatggagttattttcatagagtattcatttaattatgtttactgagcacctactatacatcagggacacacaggcttaggcataaggatttagtgataacctagacacagaggatccttggtttcataaagcttatgtcctagtgcagaaagacagtgaaggaacaagtaaacaaataaacgtaattttaagtggtaatgggagctatgaagaaaattaagcatagacagtgaatgcagggaggcggtttttttaacttggatagtcagggaaaagcttctcagaggaggtgacatttgagcgatattaacactaagaaaagccaagtataagaagatctggggaaataatattcttggtataagtaacagcaagtataaaaggcctgcgctgggaacaagcttggtgtatcttcaatgaatggcaagaaattgtggctgtggcctgtgaatgaattggaattggagagttaatcaggggccagatcatgtagatgcttttttttttaacatggcaaaattttgtcatgaattttttttttttttgaagagagacggggtcttattatgttgcccaggatagtctcaaactgctgacttcaagctatccaccctcctcagcctcccagatagctgagattatacccacaactggctcagatcatgtacactcttgtggttatgtttagaatttaggatttcttttaaagatgataactaatggagcttgactaaggagtggttgttatattgatctgcagagcagtagaagcagggacactaagaagtaattagtcttaatgaaagatgatggtggttgggtgtagtgcctgataatgtattaatagtgttttcaggtcatttgctactgaaaagtgtgatacaataaaagtagataattggccactgcattgagtaacatggaggtcattcattgtaaccatgaaagtggttttagtgaagtgactgggacaaaagcttgagtggcatatataaaagagaaaaatgaggaataatagagtgagaccatggggatataaaattagtaagttttgctggtaaagaaaatagacaaaaaagcagcaggattgggggatgtcaggatactgtttcgtgtgtatttttattttttaagattaaagcaattacacatatttgtatattgatgggaaacaacaaaatggaaggggaaatgatgatgcaagaaagaaaaagaatgcatagaggaataatatgtttaaaaggtgaaaagcagtaggacccagtttataactggtagagttgaccttggtgggaatacagacaatacgtctattatagcaggatagaatgcagtgtggatccaaataatattaggtttacagatttgatggatatctgaggtagctctgttttttcaagaaaatattaggtgagatcataagctgagacagaattagatattttaagagacagaacaagttgtttgttaatcatcttatagaatggggaaaaaagtttttaatagagaaatgcaataggattgcccaaagtgctctgctcacatatagcatgagagcaattgatatggttgtatatgaaagtacttgggtgtagatacagaatttgcagcttgtcacataattggagttttaccaggtaagtaaatcagtcatttggaatgctacttttaactgcctactcatcagcttaatcagaagccagactccactgttaattttctgggtcaccatagctagatttgtgatttctttttgctcaatttatttatgtgtaaaatgaattatcaatgctttatttgtgggagcaaatgcaaaataaaaattggcatgcattaggatttcactggaaaagaaatgtatagttttggttttgctatcagaccatcccagtttgatattctggctttgttatttattaattacatgaccatgaacaaaattacttaaattctgtgagtctcaacttcttcttccataaaatggggataataataatacctgtattcaaaagtttgatattagaaataatataaaagcaactagcacagtatgtaacatgtatcaaatagtcaatatgcaatgttattaacacaatgatcattactattaataacggtaattaagcaaactatagatttaataaagttattgattattatcaccttctctcattaggtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcaggtgagcataaagtccatatgaagcttggtctttgaagctatactctgcatcactgttcttgtcaaattggaaagctctctcctcaaggtatacatatatactgtgctgaacagggtgacactggtagcttctgtcacaatttggtcatgttcagatgggatctcacttaccaggatattctacaggtcagaaaggtagtgtttaaatcagattttcagcaaaatattttctcagtcatctgtgtgaaaatatgtctcatgaactgtagccccagggtctaacagtttcaaggcctcgggaaacaaatgcatttacaataaatgcaaaagctgaaatgtagtattgttagggaaggcatgacttctattgctaaaataatgccttgagctatttcaggcaggtaaatactctaaaatcccgaaaacagtacattaaagtatacagctgactcttgaacaacgcaggggttagaggtgctgatgtgcagttgaaaatccacatttaacttttaactctcccaaaacataacaactatcagcctggttgaccacaaaccttaacaataacatagtcaattaacacatattttgtatgtcatattctgtcttcttactataaagcaagctagagaaaataaaatgttattaagaaaatcataggaaagaaaaaataaatttactattcattagtggaaattgatcatcaaagatctttatcttgattgtcttcatgttgattaggatgaagaggaagagaaggggttggttttgctgtctcagtggtggcagaggtgaaagaacatccacatataagtgaatccacaccattcaaacatgtgttgttcaagggtcaactgtaatttcaaaacagtggaattataattctcagacaaatataaaataaacatgttttaattattctgtcattaatgaggaaactagtaagatataaaaactaattcaaaggacaatctaaagaatatgtatacgtatatatacaaacaagaatgagtgaatgaatttattaataaatacaaaactgtttaatatcccatagggcaagaaaactagtatttgaagtcatcttcaatactgtgataatcatttgtatggctcactacagataaactaatttgcattttgacgaacaagattttcatattaatattgttttctacaacttacagaattgtaataaggcacagaccactgcaaaagtggataatcctggatagtcctttatgtaaacccagcagtgcattgaaagaatatgcagtgattttttttgcccatttcaaagtatttcacatttttctacaactacaaaagcagtattttagttcttgtaactacctccatttcaagctatataaacagagataagaaagactatttttcttctaagtcacattgcttcagtatttccatgtaagaagttattattgtttttacaacttacaccgctttaaatttactaaataattgagtcattatggggaggtgagagggttattattaacaagtaatacattccagaacttcggcaagaacacctggaatgggttggcagcctgtagacattacactaattcagaggtggtaccttaattgcatgaatctcctagcaaacataacatgtaggcatacctataagaagttgtacatctctccttaacagttactgttctgagcctgtgaaagcaaggcactgttgtaggtgctaagtgttcccaacaggtaacctgcctgtttaaaagcaagaagaattcaggatcaaatttagtatatttcactgtgaattttgataagtaaaataaacacataggccctagtaactacttctccagaatttttttctgcctaattcattaaagtcaagttctgaaagatgaaagccctcaaaaataccttctaatgagattcaggaattgtttattaaaaccaagatgtatacaaagcttcatatttgcattgctaattgacctctttcaaagctggttgacatttttggctcttttgaaaagtctttatgatatccttctttttaaagtagaattgattagctcttgcgggaagagacacacttagcatcatataagctagtctatccacattagctgcagcacacacaacagaacaaaattcaattcattttacacttcctgaatatttattagttatctgataccatgcacatacacagtgggtcaaagggcctaagcaacactattaaactctttaaatatcagtcccttcacattactagattttgtcttacagtgaagttccgcttagcttctaatacttgttccgccttttatgaggattctttaacatgtaaagctttgttgccatatcagagagccacactctgaattcacatgcagttaccatcgtgtgctatatacaaagctcctggacagcatttggcttgcattcttcgaagctatgaattattacatagggagcagcaagtcttggcagggcaactggagttcagctctgaaagccaatagagaaatcacatgagtgcttgggtagtagagtgctgtccttgcttcctggcctttatagagatgcaattttcctatggcctttattgatttattagcaaagcagcagcaaatctagttatagcaagttcttttccaacccaaaatttattgccaccccatggcatagatcttatctcacaaacgaaaactgtgtagaaatggaagatgtatagccatgcttgtcacagaaccctccagcaggagctttttactggagaaagtgattcttgcataatgcagcacaattaagcatttgtagctcctccagcctgagtacttaattagcttggcattgactacatacatgaatttatcagaaaacttttcttgaatgagatgaacaagatgaacagctgtggctcttgcttttatctctctagacagagcagattaccctcaacagtctgtgggaatgagaagacaaatctcacttgctacaatggaggcaactgcacagagttccagactgaattaaaatgtatgtgccggccaggttttactggagaatggtgagtcacattagagccttctggaagagaattctgagctaaagaatgatgggattactcaaagttcattttctcctctaattttttatctcagttcccataggaaaatctatgctgaaatagaggttcagacagaatgaaacaataaaaaagaagaaaaactacagtttaggtcaaaggggagaacattttattagacaaaacttcaaatagggaaaaatgatttttaaaaaatgtataatgtgctatttttctttcttataagtacttctgaattcatgtctcttttttgttgctaactctaatacatgatgcaaatatggttgctgtcgaggtaaaataaattacaactaaaagattgcctcatagaattgcctacaacccaaaagtatatataccttatccatatgagtctacttttcccagagaaactcttcaactgttcttcacctcatacaggaattcttaaaatggagttggtcaatggcttcaggcaatctgtgacctgctgaaaatacaggaaaattagaatatgtatttgagtggctaggggtaagttcaggggtagaaataatgcatactgaatagcttttatcagctgcttaaagggatttatgtccccaaaacagttatgaactggggctctatagaatacagatactatataagcagataattgttaaccttttgttttagcactgtgccatgcaccttacaaataccatctctaattcttatagctctgtaaagaaggtttcatgatttttattttgcatatgtgtaaactgaggctgagaggttgagtgacgtataaagggcctatccacacgtttgctgcagtaaggttgagctgccttcaaagcctctgctcttctatttgatgtgccagcataactgtatgaataaatctttgctcaacacaatttctttttttttaatgagaaaggtgttcttccatctcatgtatcatcgagggtaagataagtgatctctgatcaaacttcctacattgaaaaaattaaataaactgagctcagacatatttgacaaagatattttgactgactcaatatttcccataagcatagttaataaaataatggatatgtgagtgctccctggcaagtgccctttggattaattggaattttctgttttctagctggcctcttttgcatcacaaagacacaggtcttttgccatttttacaaaacagcggggagtctagggtatacctgaatttgacccttttaacgttcattttcatttgcagcctgccttctgtggttggttctttgtggtacaggcattccaagtctatatgtgcatgaaaggagatagccttgagtcacattctgctttctgttgcaccaattttggttctgcaacttattaactgagatcgtttagttgtattccaattccatgtatctttcaaaatattgcaaatattttcttgtcattaattttgagtaatccaactattgtcaagggtgggttgcttcctggttgaacgtcacactttctgcctaatggcacaatgcatggaactcatccaaaaccctggattatttttctctgccactcacacattgtttctatttacaacaaatatctccctgtcttctgatatttattagtttacaaaatttatatttgacatttaaattcagatatatttgaaatatagaaagaaaagaaagcttagagttttccttcttttcccaggagacttttcaactggaaaaacttacatgatgctagatatttctaaaacattgaacctgtgttcagtagattctatgctttcaaagtccttaaccatcattacttaattgactagatgttaatggatttatttttacttttcatgcattaattaacctctaataaaaatgccaatgatgctgataatacatgtgtatctattgttgactgtttagttcaacagagaaataggtgagaaagtgatggagtagttagaggaagacagaaaatagtgggctatctcccatggcctagggaaatgtgacttccatcacatccaaggatattgaaaagctatcctcaaataaattggcttctctcctgccttggttaaaccttcagcttaatagtgtcatcctggcaggttttgaatgatggatggtgtgaacactctggcccacccaagaccgagaatgcttggcaggctcctgagggttgtcaagttttgctcagatctaatcagagaagtctccctccagtccagaagcataagccaaaaaaggaaaacaaaatgtctcagctatgcttggtatccaaagggataaggagctgtttttcttggaagaaatctttgttttcctttataccttgggctggccttgccccactacctcaccccctttcattttgagcctagtgattagtctctgacccatacgtgcaagttttacattttggaaggtgagggaaagaataagggaaaattaaaaattgtttacatacaatttcaacattataagctgcactatagagatcttggagctaagattttatataaattttcaaaagtaaaatagccgccttagttgctgttctatcccaaggtcttagcagagtgtttgtcacatagtatgtgttaaataaatatccactgtgtgactgaatacatgattggtgacttaatccatgaatatacagaaaaacaaattcttgctggaaaattagtttaaaaaaatgacaatatcccaggaagaagaaaacttcaatttacctgagacttgatgtcacttgtcttggaaaatttggcttttgaaagtcattctacctcaacatttcagaaattatgcttggctattggaacacagatttattagcaagtacaatcttctaattattgatttttgcttttgttataaaaaaaggatttccacagaaaataattcaaaatctctcagaataaacctctcctcttcctcctcctcctccttccctccttcttttttttttttttttttttttttggtttctctttggtgggctttttccttagcctgagggctctgatgcatgaggatcctgatagcctgaatgtaggtctgccctgcagactccagatggcaaaatacagcctctctccttgtgcccctaataaactgaacatttatataaggtggcaaccacactaatgctcttgagcattgacactggtgtaggcatggcccacttttctcttggtttctaaatatttgcatctattttctcattctaattaattccgtgtgtatatgtatatatatgtgtacagattatttccattaaaccccaaatgtgttaaagaaattttaagaaacatctccgacattatcaagtatgtataaagtatgtgtggatgggtagataagactgtgctgttccagagagataaggcaaactttttcttcccatttcacaaccaatgtattcaacagggacctgggtttctgctgttctgtttattttgaaggtgtgaaaaggacattgatgagtgtgcctctgatccgtgtgtcaatggaggtctgtgccaggacttactcaacaaattccagtgcctctgtgatgttgcctttgctggcgagcgctgcgaggtggacgtaagcagcctctccttttatgtctctctcttattctggcagaatctttttcagcttctttcttacctcattttgcgtatgaatgacgagccagttgttgagtggggtgaacaggaagattattaacatacatttgaacattcccaaatgaaaaaaaaagccattgaatttcaagaaatgccttgattcattttagatctctggggaagaaaaaggaaataaaaaccatctcaataattaaggtaaattcaaggcttattttaaacatatcagaagcactttgtctgtgtataaaatattttcctattctaactttaaatatgaaaaaagtgttcttaatataactagaaatatctccttattgtgtgtatttagtacaaacatattatcattctcaacacttctatatgtgaatgaccactgcaatttcttcccactccatttctgggtattttcacattttaagttgccctccatcactatgattctattttcatttctgttctttcattcttatctattatttatgacacaaaaattgagaattacaggccaggtgtggtggttcactcctataatcccagcactatgggaggctgaagtgggcggaacacctgaggccaggagtttgagaccagcctagccaacgtggtgaaaacctgtctctactaaaaatacaaaagtaactgggagtggtggcacatgcctgtaatcccagctactcaggagggtgaagcaggagacttgcttgaacccaggaggcggccgttgcaatgagccaagattgtgccactgcactccagcctgggcgacaggtgagattctgtctaaaaaaaaaaaaaaaaaaagagagaattaccgattaaaattactgattatattcatctatgtttttacatgaagctattcaaatgaattgttacgttttctctgatatatgattaaatatataaagagaaatcaggaatttacatcgagtccctaaattgtagaaaaacaattatctagtatcagtactcaaattatacctccctggtataatttctgattccataaaactgtctctctaacaaagttacaaataatcctttctctatttcctttcctgcaatactttcccttttcctaacaaatagaacaatttttctgttgtttctaaatttatgagctccttgacttttctatcaaatggactaatttcagttgcttttcaatgaatatttaataaaaataagcactgtagtttatacataaatttaaaagtatatattgtaaaacttgaattttcttagaagcatggttttctaagatttgcaagtaaatttattttcttaagtatctttcagaaaaaaatatgaaagcatagtatacatcataaccaaaatatatttgacattatgattttttaaaataaatgtatacctgaaataatggatctataaagtatactaagatatgcaaaaattaatatattctttattataaatatttcagagattataaaataataatttaaaaaaactttcttaatgtttttattgtttccaccagtacgttatcatttatgctaaatatctttgtgtagatatacccttccaaagaagacgttatttgtgttcatttaaaggaaaaatagtttgatcctatgaattaattcagaaagcaactaaaataacaatggcctgccaaatgtcattttgtaaatatacgtctatgactttaggagctgtcctggtttgaaaacatgaggacagtttatccattggatgccatctatttagtcccaattaagaaagttgtttttttgtgagaatgaccaaggtaaatttaaatataccattcaaacaaacaaggacaaaataatatccttgttatagagtacatgtagcatatagtatgaagtaatatactacaaaagcaaagaaagtgtattctatcttgcaatagtaatagacaatttttatatagcaaattcatatcctttggagtagtgacaatcatttcaaactgggagcaactaattgtgaagattttccttcttactcatccattttcttcacatccaaggctgaacgtgtgatgctgctgcttcagatgatttgttccaaagttaaattttgtgacaaaagacatggggaaaaccttcccatcaatatttacattcacaagtatttgcaataagcataaaatagattatagccagaccatatgtatagttttcacatttactcccttctagacatacctgtacttatgtacttacaggctgttccaaatgtaatatgttctctaccaaatgtggttaagaaatattcactcacaatttctttctgtgtacaattctgatgcctctgttgtcactgtaattgtcagttgcttttctgttttccaaatgtcttcttgtcataaggtatctgactttaaaaaatgttttcccttttctttttattcttctgtattttccagctgcatgtgtgtgactatggcttttacatatttgcacagaaaaataaaacctttgtttctgtatcttctctttctcatcttctaatggtacttgtacttgtttgccttgactatgtcttgtatgataaaatttccaccagccatgcatacacacacacacacacacacacacacaccacagaagtactggtactgatcttcctgaatcgtgatctctttctgtgaaagtgtcactgtgagtaaacactgtggtatccaagtaaagttgcatgtactctggcaagtaatcctctagttggcattctaaagttgattacaaccctaattgttcttattattggtttacattgtccctgccaaagctagccatagttcaacctggttctaaagaggggctgttttacctaaatgacagaaatttacactaactcctctggaccaagcttctaaaacatagcctatatttacttgaataaaaactaattccattttgctgcgtttttcagatttaacattaaactaaacagggctatgtctctatgtttggccatgcctccttttttgtgtgcgtacgtggcaagtgggtttttatcaccctcccttttgcaaaataggaaaatagagagaataggcaaatttggaaaaatcagtgtttgaggaggagagacaactaagttcaattaacaccactgaggacttactctatgccaggaactgtgataagcctttttaaatactttatcttttcaattatcttttttcaatacaaggtcaaccaaaatctttttatcttccaaattcttcactaaattttcttaaaatatcttttggccatttgtaggtttaaaaatagaaactgttaagctttaattttgcaatattaaaattaaacttcttctgcaaatggtgctgcataaaatttgagtttagtgagttaggcaggaaatcagtgaagaaatctgtttctcaactgccagtattattactaatataaactattttacttctctgcttttgtacttattcaacaaatgtttaatgtatgtctactatttgccatactgtatactaggtcctgggaatagaactatgatttagacacaatgcttgctcaaaataagctgaagttatggtaaggaatgtgggttagactgggtgtggtggctcacacctgtaatcccagcactttgggaagccgaggtgggtggatgacctgcagtcaggagttcaagatcagcctgacaaacatggtgaaaccttgtctatactaaaaatacaaaaattagctgggcatggtggcgcatgcctgtaatcccagccactcaggaggccgaggaaggagaatcactttaacccgggaggtggaggttgcagtgagctgagatcacaccattacactccagcctgggtgacagagtgagactttgtctcaaaaaaaaaaaaatgtgattaaacaaatagtcttaggatgtaactaggatgtaactgagtgccagctgtaagggagcatataagagaggcattttgtccagtcttacaggtgggtatagaaggtcaaggaaagtttcctgaagcctaagctaagacttgagggagttaggctgtggaagaagcaatggcacagtactgtgtgtttcaggcagaaggggctggagaggttgtgcactgtgacagggatatcacagggtggcagtgctgaaagatggggctgtcgaaagaagcaggagtaagcccttatacaccttggcagaggccttggtttttcatcataagagaaatggagaatccttgaagggtttcaaacaagaaaaatgtcatgattatacttgcactttagaaagatcacttgggcttctacatagagaatggcttaaaagaaaggcaagactggacccagaaagacacagctaggaggctgctgcagtgataaagaaagaaggagaatttgcactaccatatatagttgtagagaagatagattttaaaagtttgaagcatgattttttgggagaagctgtgggtctaagggggtgataacttaaatttggtggataatatttttaatatctttgttgattggataaatgaatgaatttaagatctgttggatatctaaatacagttattaatcagtgtgcatattccattctggagttcaagaggcatatcagggtgtatatatttgggatatatattatagatctattgagtgttatattccattctttgtatatgtaatccatttgtattatttatttattgttctgcaacaatattacttcaaacttggcaacttaaaacaacacacatttattatctcacagtttctgtgttcaggagcccaggcatggcttaactaggtcctctgctcagggtctcacaagacagcattcaaggtgtcagccagagatgtggtctcatctgagctgaaccagggagggatccacttccagagtgaactcagtgatcaagttcactgaggctgatggcagaggtagccttcgattcctgaaggcagccctcagctccttgccacttggggctccccaacatggttgcttacttcctcaaagccaaaaaaggagggagagatgccagcaagatggatgttaccattttatataacataattatgcaattgtgtacatataatcgcatacttctcctcacctttgtcatagtctgttggttaagaacaagtcacaggttctatctacactgaaagcgagaggggcacacaaggtgtaaacaccaggaggtggggaccaaccatggggggttcacttaaaagggtgtctgccagctggttgcagtggctcacatctgtaatcccagcattttgggaggcctatgcagtaagatcacttgagtctaggatttccaggccagctaggaagcatggtaaaatcccctttctgacaaaaaaaaagaaaagaaaaaatacaaaaattagtttggcatgtgcctgtagtcccagctactaaggaggctgaggctaggtgggaagatcacctgagcctgggaagtcgaggctgccatgagccatgatggcaccactgcactccagcctgggcaacagagcaagaacctgtctcaaaaaaaaaaaaaaaaaaaaaagtctgtctgccaaaccttctctcacagtatctttttttactgtctgtgctgtattctgcatatattccctattgctatcttccaagcactgatagtccacatataatccactgatagatttttcaattttaaattactttaaaaaattctgacttttttaaatcttacaaatcaatcttttctcctgtttgtgtcctgtttttttttctctataattgctaccttcattttactttcacataattaggaacttatttaatagtgtctttcagactgttgtgttatttcaagctcttggagtgctcaccctcctatttttgtttctggggaattttactcacaacagagtttttcttcatgtggtttgttatttttttatgagcaaaaacaactttaagaggatttttctttttcctggggggtctttgtgtgctgagttgcgtaaatgcccctgactacagtcttagctttagatttttgctaggatgccaggagttccactggtctagtgcctgtttttgtgctcttagtttggggattcccacaacatctggatagtgtaaatttggtctccatatacaatttgggttcaagccctttataaatgtgacacaaactgtctccaacttcatttcttacctgtgctctcacaaactccactctccagccacatgaaactttgcacctccctttgaacttttcacagctgccacagctcttcccttacgtgctgttcctcccacctaacctgtcattcccttcttctctgtttgacatacttttgtccttccagaaatttcagatcttgtatagactcttctaggatcctttccctgattgccccaggaaaagcttactattttattcctgcacttttttgctattttgtacttctttttctagtgcttattatttggtaattatctatgcatgtacacacaaaaacagcatccaataataaactgctcaaggccagaggccatctaacatatctaactcagctctacaaatgtctgtaaaagaatgatcactttacagtaacatggagatcttgagaagaaattatattgcttccttattttaatatttttattttaatgaggataaatgcatagtgtagctagaataaaatttatcatgatacacttatagctaagtgagaaactgcaggctatttaagaatacaaattcatagtggtatttacaacaatgtcaaaagaatagcaactatgtcagtgtgcatttttattttcccttagttgtaacatcatagttatgacagctgctttaaaatccttttcagttaattccaacacctaggtcattttgtgattggtcaccatttattgaatttccttttgtatataagtttcatttttctgtttctttatccagtaattttggattgcatcctggtcattgtagcttatacaatgcagagattatgaatgaattcttttatgtttttcagaaaaatattattattattttattttattttatatttttgagatggagtctcgcactgtcgcccaggctggagtgcagtggcgcaatctcggctcactgcaagctccgcctgccgggttcatgccattctcctgcctcagcctctcaagtaggtgggattacaggcgccggccaccacgcccggctaattttttgtatttttagtagagacgggatttcaccgtgttagccaggatggtctcgatctcctgacctcgtgatccgcccgcctcggcctcccaaagtgctggaattacaagcgtgagccaccacgcctggcccagaaaaatattattttattttggcaggcagtctcttagctgaatcaaacttctagtcctgtagcagtgccctctgtggtgtgtcacagctgcaatctctgctcagttattttgtctttagctgggtgacttggagtgtacgctacatgggcatattacaagggtgaaccagagatttgagcagaaatcattttcagaagttgaggctccacctctgtagctgtctcctttctagaatttttccttcactttctagctgctgtggtgaaccctcttttctctggttcttcaagcctgtaagattgcaaacgtctctcctagttttagttaactggcatggtgctgagcagagactgcactccaaaaaaataaaaatcacatagtgccctccgctctgcttagttcaaattctcatacaggtcgatgcatacttttggttattatctgagtgccctcagattgttgttttttgctattccatctggattttattgctgttatatgccgaagggttactctagtagaagctactttgtccacagaagtggaaactgtaattttaagaaggtaatctgagattgtaatcgcataggtatttggtcccagaacaagatacatggttttccttctgatttctgcactgaccacatcaattcagaagcgcaggttttacttctgggcactacattccggggaaaacattgatgaatgccagggcctagaaaagggcattttagcttattttagcaggtttgttacataggtatattgtgtgatgcgtgatgctgaagtttggcatatgaatgatcctgtcaccaggtagtgagcatagtaacccaacagttagttttttttgtaaacattataaggataaacggatattttgtctagaaagggaagacttaaggaaagcatgaaactgccttcacatatttgaaacgttatcatgagaatggaaaaatagatttgttctatattaatacagaaagcataggccgggcgcggtggctcatgcctgtaatcccagcactttgggaggccgaggtgggcggatcacgaggtcaagagatcgagaccatcctggctaacatggtgaaaccccgtctctactaaaaatacaaaaaaaaaaaaaaaaaaaaaaaaaattagctgggcgtggtggccagcgcctgtagtcccagctacttgggaggctgaggcaggagaatggcgtgaacccggggggcggagcttgcggtgagctgagatcgtgccactgcactccagcctggaagacagcgagactccgtcccaaaaaaaaaaaaaaaaaaaaaaaagaaagcataaataagacaaagggatagaatttattgaaagaagatttcaagtcagcataagaggaagcaagttaacattagaagtactcaataatgtaatgcattgatttgcaccaaacaggactcccatccctggaaacattccaatagaatctgaatgaccgtatttcagaaatagtgtagagaatacttaagcactgattgaaagagagacatggacctgacatttcttaagcatctgtgattagctgattagcacaattcatgcattttctatgtataacatttctcaagattatggcatagattactcatgataacaaaattatgggccaggtggaaaaatgacatttgcgaattttagttgagcaaagtgtagtacacagggctaaataattggccgagatcacctgatactttggagaaagggaggactgggaatgattcatctagatttttcaggtcattaatacgttggaccatgttatagtaaagaaatgtttgagaatgagacatttccctaagaatgtgatatttttaaatgcattgatttattatgctgctttctctgaaactgaacctaacactgtcgattctgccccattcagagcaaggatgggctgggcctggatgtttgccatgtgcttcatatacacttacaggattttctgagcaaacttagaggtctacattgcttcatcctcaatcatttccaaacaagatctgaaacagaatcgaggcatatagccagacaatagcaagagagcaattgggaaagtttgtttaaattgcgcttttcttcttaatgtcatatggtaaaatactaacattagaaaaacattccattataaattgtaggatgtcccttataggaagattaagtgaatgctatttccaccactacatatgccactgaaacattagattgaatcatatgaacttgcaaatatttgacattttgactgataaaaatgacaatttaatacggttaaactgactccataatagatgcctgatatttgcaaggatgcttcttctaaagtttaggttgttaatgcagaagggagaattaaagagttaaaaaggatttcgggaatcatctaatccaacttctttatgtatgagatgaagaatctaaagctcagagagagagagtgctttatttagactctacaagtatcccggtctgtcaacccacagttcaatattcttcctgctgttctaagacgacgaaggaaattccctatcccatttgccagagagattgtgaatgagagtctcagagtactctaggccactgcagagtccctgcatacgtgacctattttaaagctacaaatttataaaacccaatcaacatcagcactgcattcatcaaaatgtagtcttagtctaatgatattaaaagtactttaaagaaatatgatgacgaatatcaattgtcattatataggcctaggatcttagaggatgtaggagacaaggctgagtctggcttgatttcgtgatggaaaaatgaaagcatgtatgagatgaagggaccttacatatcaattttagtaataaatattcacagaaaccttatgggataaatattataatgcccatcttatagacgggggaaataagatttagaagggctagttacctgccccagggccacacaacaaatagggatcagagcaaggtttagaacctgggagtacttacttccaagccacaggtcttcctaggatgcagcactatctttagtaacaaaccctgtaagttgattcctaaataagttacacatatgtagaaatggttcagccactataaaaacctgtatgaagtttccccaaaaaattaaaaatagaactatcatataatttgttaactgtcatatgattcatgattctgagtatatatacaaaataattgaaatcaggatttcaaagacatatctgcattcccatattcatttcagcattattcataatagccaatagatggaaacaggctacatgttcagcgaaggataaatgaataaagaaaataaaaatggaatattattcagccttaaaaagaacaaaattctgacacatgctgcaataggaatgaaccagaagtacattatgctaagtgaaattacccaattatagaaggacaaatattgtttgagttcacttatatgagatatctagaagagtcaaactcctagaagcagagggtagaattatgagtgctaggagctagggggaagtggaaatggggagatgtcattaaataagtatgtgtgtatacttgtgtatatatatatatataattaaattagtatataagtatatatatttatatataataagtatatataattaaattagtataattaaattaatatacataattaaattatatataattaaattatataacatacttatatactaatttagcatacttacaagtatagtagtatactaattataaatatattggtatataaatatatacattaaataactgtgtgtgtatatatatgtgtatatatatgtgtgtgtgtgtatatatatatatatagagagagagacagagagagagagagagagggagagggagagagagagagagagagagacaaggtcttgctctgttgcccaggctagagtccaggggtgtgatcacaactcattgcagcctcaaacttctaggttcaggcaatactccttcctcagcctcctgagtagctgggactacagccatgtgccaccacacctggctaattttcttcttctacttcctcttcttcttattattattattatattattaatatattaataataatatattgttaattattaattattaatatattatcaatattattattaatatatattaatattattaataatatatattattaatattattatattattaatatatattattgatattattatattattaataatatatattattgatattattatattattaataatatatattattgatattattatattattatttgtagagatgaggtctcactcatgttgccgaggctggtctcaagctcccaggctcaagcaatcctcctgccctggcctcccaaagtgctgggattacaggcatgagccactctacccagtggtataaaattttaattatacaagatgaataagttttaaagaacagctgtacaacaattgtgcctacagataataatactgtactgtgcacttgaaatcttgttagcagaatcttatgtaaaatgatcttaccacaattttttaaaaagttacttacttaagacagaatttaaaatacttcaaatggaggaaaaataaataaaataagaaattgttcataaatgttattttgatgcattatcaagcaccaaaattaggtctaatttggttcactaatctcttttcctttcatcttttcatacattattaagatttctgcttcaccaagtataattaatgttcttcatttcttaacgtgaggtcattgctgcaggcttcacggaaatcatgcaacataggtttttcccgtcagaacacattttttcatgtgttctgaatagaatggaaacaggcaacatacagagtggagctcctggattatagatgcaaccaactaaattggttggtttgttaagccatagacaactgtgggaaataactaggttgatgtttgctactgagttgactagctaaccaaatcatgcagcatttttgttagctgtcaaatcaatctcatcatctactaaaatctccctaaaatgatcactgccttggtacgatactggacttacggaaaccggtttttaaaataatgcatttattcattcatccaccatttatcaaaggcctttttcaggcaaagctctgagctaggcatggtaagcaactaaaatatacacaaaaaagtgtgtttgtgctttcaaagaacttaggtaagaaaatcaggtacatagcttcgtacataagagttctctaatttcgtgaatcataaagatatttttaatgtgtctataatgacatatgttggttatgacaaggttggccatattatttcttgtccaatttggagcattttcaaagtgaaagagagcaacactattaataattattctaggacagcagcctaaactgatactgttctgggcaaactaggacatatcctagttattacccacccaggagaatgcattatgttttacttgattctctttaaaatgccattgacatctatcacagatcattcagaaatcaagtctacatgttccaaaccaattaactgacaaaaataactcaaacaataaagttgacagcatcgtgttagttaccaattttcttgaattattttccttattttttgctcaaggagaacttttggcatcagttccatctatgaaaaatagagctgtcaaccaaaccgaaaactgccagtatgcacccagataccatgccgttgtcttgtttaacatgacatgaatttagtttctactaatttttaattttaagaatggtgtgtatacatttttttcttttataacttacattgcctttaggaaatgcagttgcacctcattgaattcattgctaaattttttcttgtgagaacaaattgaatagcatgtagaagactgtaggaatttactatctgaacaattttaaataccaagataattgacttgaaattggcaattgctttaatattgtttctacttaaaacttccatgaatcataatacttattcatggattatatgtgtataattttcctaaatttctttaaattaaaaatgatttttcatcctaaaaggttataaagatcatggctgttatatttttctcacaattgtaattactgaaacacaggtttgtttcatgtaaaccgtagaaatattttggagactaattatagacagaaaggaagccacatattaaatataatatccaaaaccaaataggctatttgcaatgaaagttatttgatgttttggaaattatattcatgattatttcattgtctatttgaatgtattttaatttagtttcacaaatagctacaaatatgttacttttatccacttcccttaacatttctttgataatcctatgctgataacaacagttataaaggaaaactgaagtacttctatatttgttatttaaagtgggaaaatatgtattaatgactgataaatggctgaaattactctagttgatacctagaactcaggaaaaaaattatattttgaaaccagttcatttccttgactttttcagtagccagcatcatcctgagtaagtatatactcaataaatattacctaagtgattgagataatgaatgaggtatttttgaggtaattttgaagtgtcaatttccagctttgagaattttgtttttgtgtgtgtgaatgtttttattcatcctgccccatagttactgaaattaagatgaaaatgatagtatatagtaagtacaaaattgtcccatttccctttcaaatttacaggatgaaaaaggcaaggcttgaccattagtcaccactttgttgatgacagtgtcttggagacaagtgagccacactgtccattaggaaaacatttccatctaagaacccaatgcacagaaaccccattattcatcttgaattagaatttgatataaatttaccctttcccgaaccaatcccagatgcagtcaagatccataaagacatatattgcttaccatgcctagctcagagctttgcctgaaaaaggcccttgataaatggtggatgaatgaataaatgtattattttaaaaaccggtttctgtaagtccataatcacatggacacagccaaggacactctcaaggcagtcctgcaggttatactcaatttgcttaaaaatcgtagtggtttgagaggaggagtggattttctcttcaaagtaagataagtatggttgaattgtagaaaatcatgtccttttcttccatttgctctaaagccagtaagagttgaccactgctgcaatattgaaaagacattttaaagaatatgttgctcattgttcttcgaccctaaaaccctcatttcattctcctttgcctagtcaaatacatttgttctcataatgttccagtaaagatttccttgcttccctcccccacacaatcagcatttggagtgtcttgttgccatacaatcctaagtacgcctctatcatagcatcgtataataatactaatagtggctaatatttgtcgtgtgcttactctgagcccgaaactatgctcaggtcattataagcattattttatttattattcacaaaatcccaagagttaagtaatattattttcctcattttattgatgagaactcaaaatcagagagaggataagtatcttttccaaggctctccaattcagaagttggagccacgctttcagatcccggagcatctgcatctattaccaattagctatactgcaaaagccttcatttgtctgcctcatcctccatcctgagagctataggaaggtggagaaaatgtcttgtttatctttataacttcagtacctggcaatcattcctggcagagtagtgcttcactatttaccaaaggactaaatgaacgaatgaaagaattgtatgtggtgtgcacagaagaaattagaacattcccagggctggcggtagggtagaaaaagcttcgtgcagaagatatttgatccagctcttaaagaataagcaagcattatctcagaagaacaaaaagcacatttctccttgacatgtttttttgtattgttgattgtttatttgctaccaaagtgttaatttttaatttaaacagtttttcactggagaaattagttcacaaataagttgtatacctgtcagcaaagagagcttagaatgtcagaatgcccatgtttttattgatagtgtaagtgccacactgtgtttataattatcccttgcttttgttgattattagttcttcttaacataactgcattttaaatttgtgagagtagaaaagggaaattctggaaaacaaccattaaagccataaccttcctcagggatcaccgaacgagggttatagacaaaagggaagaaaggaaacttaaggcactggtcccaaaagataatcaacgtcaacacacatttttgaaggggccctaagcaatgagagcagaaatatgccaaggaaaaatgggtggtaccagaagaaaaggaggatccaggaaagagctagtagagtttacaagtagaaggagccctacagcagccacaggagtttagggacatggatgaagatttctgcatttgccccaaaagtgccattaagaacactaaagcttatctttttttttacaaatctagttgtcagaaaagccttacaacaaattttctaaatgttctcttctttccaaattcagttgagcctgaagggtttatgctgtccactcccacctattcattgccaattcatcttccctataagccaccttcatctgcaataactgctccccacaggataagctgacattctgggcttctaggcaggaaatccaatgttctgtcctttcataagtcccatggcaatgcagagagctgctggagtcagtgccttccacatattctctacagctgaaagaatgcaagcatcttcccaaagtcaccattccatccacacgtttgtttcttcaatacatctggcaatgggtagtacacagggagagaagaaggagagcagggaatctgtaaaagataacatataattcttatgacaatactttcaaggaaactataatctagctgtcaagaaaaaagaaactacaaaacatcctgaaaacaattaatccctaatttatgttactgagtaaaagcacagtataaattcacagaagtctgatcgctatgagctattgcaagagggaaagttttcatggaggatacggaaattaaagtaggccatgacatatgagaaagattatttatagaacagaaaatgggagcacattcaagagagaaaaatgtcgcaagtaaagatgtgatagtgggaaaaaaaagtttggatgggatgaagaacagagactaggtaggcctgattttaatagataaagaatgtcaggaaatagtaggatatagaagtggataaattaagagaaagattagatgatggattccctcgaccaaactttggtaaaaatccagccagagaagaaagaatcattctataattctgtgatttaggtatatgccatgttttcttctcaaatgtttcctacaggttttgattatgtatggctacaattcactttctgactagaaaggacctactttactctgtttggactgctgtaacaaaatgccattgactgggtaacttttaaacaacagaagggtattagtactggaggctgggaacttcaagaccaactaaccagcagatttagtgtctggtgaggaaccacccatttcctggttcgtaaatggtctcttctctctgtgtcctcacatgacaaaggaacaaggcagttctccaggacctcttttataaggtcaccaatcccattcatgaaggctctaccctcatgacctaattggccccatcttctaatacggtgacattggcgattaggtttcagtgaatgaaatctgggaggacataaacattcagaccatggcaggatcttacaccaaaatggtagcatctttccttcatgatggatttatcaataaaaactcctgaattatattctcagacgaattctttcattttggaactcaaagcaatacaaactgtttattcttccagaattttttaaaatatataatgttatgtagacagaaagtttttcctgagcagatttttttgggagtttggtttttgaaactagcttattaaatccacaaaatcttcagtccaatttttgatttctgctaattagaagttttcactaggcatagttttgttagtaagtcttgctttaagcccccctcttttttttttttttttttttttacttcacttgaatctttctaaagttcttaattgaggattttaattgaaggtttttagacctatgatgctctcctatttctctcaaagggccaaagacatgttttgttctggggaggttcagatatgatcagattaagtcttctttcactaaaaattgagcaaattccctggatcagcatcactaaaaaagagtctctggggcaatagactgatgttattactcaccattttaatgtacataaaattaaggaactatatttactcacttcagaaaatttctaagttgtgcagatcaatataaaaggtgccttatactgagcagtggttggtttgaacatttctgtgattagtgcaatctattttcagagctaaggaagccagaagattaaaaaagcagacccttcactacctgaggggagttaacagtctagtgcacaagaaagcttgcatcagatgaccaggattcttacggtgcctctttcagccaagggttgtgccttctctgatattaggccataatgatcacatgcactcaacatgcaatgcctcatttagttctaaccatcatagtactgttatttccactttacagatgctgaaacgaaggcccaaagaagtgaagtgacttacttggggtcacacagttcatttaacctcaaatcctcatttttttctccagtgtataattttggttttctgtttcctagtttgtgaagtgcaacatttggagactgtttttaagcagactgtcctaccagaaaattctagaagtcttaatatttcttaattgtaaaataagtgttttagaagagatgccattacacatagtttacaaaaacacaagtttatcatgggaccaactgtgtccagggaactctggaatttcttaaagaacaggtctaggggcaaatatggaatgtaaatgggaaagaaattgtaaattttgctctacggccctaataggatccagaatctatttgtttttaccattaggtcctgtgaacactaaagataatcacagctggcaatatgtaaattatccatatttgcagcttcttgaagttaaaggttgtgtgtgtttggctggtataactgcattgccacttaattaccaatataaatgctctcaaattatagataccaatgtaagcccctcaacttaaagatttatttgcagaactctaagtaatgacattgagcttcacattcacattgtgaggtgagctgaagaggatcagcttctgtgtgtaattgtgcatgattagtcttctgccttgaaacagaaaaggagtatttcataggattcccaccatggctggggaggacaggccgtggctggggaagacagaggactactctgatggagaaaatgcacacctttgtaaagaggcactctgggatggaaagagcctggggtgggttatgagagccatgaaggtgatgcacatgtgcataaagggaaagcatttgagtggctgcctcttcaaattaaatattctgtgacagaagagtaggctgcatcctgtgtgttagctctcatggcactgcaagctagagagacgtataacaagaaccatcatcactggtcaatttccttttaaagacctgtccactgatttactcattccattgatcagacattgcaattcacaagctcctattacattctcttggttaaaagtgaggtccagattgggctcgacacatgaatctgtagagctttcccctctacctggcaaacaatccaagtcgcacctggatatatcagaccttactcatcatttatgtccaggagtgctgcatttgttttacaatgccatctaatttgtcagctcagttcaaaaaaatttcagcacctgcaaaacatcatgaactctgaagttgacaggaaaagatggcatgttgtttgaatagttttctcaagatagaaatgtatgagtcttgaaattgtacataaagacaaaagcacagcatgccatgaattgcaggaactcatcgcggaggacatgcctattagaatttatgctacacaaatgcaaaagtatgttcttataaattaaatagtttgacttttccacattttatacacatgtaatgttgtcgttcttgattttgtacatgatagtgtagaataagctttttgccttagactttttataggcagaaatgtgccactgcaatgaaaaaacttaggagcattttatggatgactgtattaccatcctcatcaattggcatttattgaattcaggcaccataaataatactgatatatcttacatatagtggaatatgtgtgtatgttttaataaatgatttaaattattttcaggccatttttacattaatctataaggaaatataagctcctttaaaatggttttgaaacttagtgtctcaaaaggagtacaaaaacaactccgaagttcccctatgcttctggaaacattaaatcctcttggcaatgggtgacatgtgaaaggactccctcagtttgccctgaaatactccctttggtcctaaaaacattacgcactcctttagggagttcgaggcaaaggagccagtgtgttttgagggacaaggtataaatgctacggcatccaagaggattagctgccttttctggaaaattaggaaattgatgtataatttttaattacacataaatttcaaactttccatcaaagtcaaattgtgctgatgtagtcaaacgtaatctaagcattgattcaagaacctgctgatggagtgaaaatacatggaaacttgttaacaggaattacaattatctacatctcagcaaataacgccagagtgtcatgtaatatgctgagctcaggcagcctatagccaatgcagatcttttttttttttcttcaccattaatatttacagttggaagcaaaacatggctgcaatctaagtgctgcacctaacaaggaagttgttggcttgataccttgtttcctgacactgtgaagcactgaaacagctaccttcttaatcatcgcctgatgatattgtgttgaaactggaggggagcacatggctgttttataagagccacaaccctgggagattttcttcattgtttagttgttttacttcttgatagacatactgggatgttaaaagcataggactgaaaattgtgcattatggagttttttctttgttctcctgctgaatttttctaggtctatgcagacactgtttgtaaagacagtttacctcctgacacctgctgtgtgctaggcaccttcctagaactgaaaacaaaacccttccacccatcagcctactttattgtagttattctcacatgcaaagtccaaaaaaaacaaaacacacacacactaagcaaacatcagtaatcagagaagcatgattggttacataagcactgtgcatagtaagagacctgaaatataaaataaccatttttactcttctttcagtctgcagatatgccaactaagggtaatacagttgaaattatggggtagatttggggttacatttatatagtgctctatctaaggatgcagctgtgcgtaattaaacaagccctgataatttggattctaagctgcttactagctgtgtgactttggacaaattgcttaaatcatcttttaaatacatgcaataatctctatatcattagattgtggtgaaaattaagagatgacatctaaaatgccagaaaatattaaatcctcagcttgtagttactttttccatatccctatgttccaccttttagttctaacgtattttacaggtaatcccagtgtagcgaatgaaccagatacaggaaagattaactacctggatcgaatgctcaaagaatcaaagacctagttgtcatctttgtcatagaattaatctatttactctgggttcctgaaactagtaaaagaaccctaacaaatagcagcaaacgaattttagtgaaagagaacaatgaaacatttaatagaagaccaacttctaagaactacttaataaaaatgccttttaatattgaggtgatttctgctcaggtccaccccacaaagaggacctggactgagttgagctgtgttgcaactctttctcgcttgtcaaagttgtagctcctcctcgtgttgctaaatcacagcagatggcttccttttacacccaacgccgtcagtggaatgtaaatgcgtctcctcacaacactgaaaatactgaggctgtgtgtttaatctgtgctgtacaagccgaatgaccctgaaaagaacatgagcactgagcacgtttggagaattggcatcaatccttggaaacaggattggggaggatttttcaggcctagtgactaatcatggttttcttcctgaggctcctaactcagccatatccctgaggacaagcaatctaaatggtgattgaatagaaaagttatagacccaagggaagtatttttttttttaaaggggcagtgggagtgttgtttggggtatgggaaaaagtagagagagttgcgctgcactgcaaaattgaagaggcttagtttatagtttgaacattcaattctatgtctccttgggagttaaaaaaataaaatttccctgtttcagattatttaagtcactaagaggaatactttctctaagcaattacttcaaaattcagaaataatgtaaataattcatgtcagtatgataccaagtatgagacaagaattatccagaaaaaaaactatattttgagagtatgaatagcaaattatagaaataaaatataatcaagcacattagccaggttatctcagcttctttcttaaatagatctccaagctgcttagaaaacagagaacctgatcttcattttattaaaacagtctccaaaaattaaccagtggctaaaggagaagagaacttgtcatgcaatttgtcttttgagccttttgtagcaaaggaacagagttcttgtcacttctgcttcccacctttccttgggcaagggtctcaaactattatttcaaaaaaagatgtggtcattgtgaatatcataattaccctatgtactgtatataacacagacttagagatcccaaagcataaaataaccactttagctttattgtatgatctaattttatagcaggttattaaattctgtgctaaatttatacatagagatggagaaattttagttcagcagtatttttaaactaataggaaaatgctgttagactttatttttgtcccctccaagaataaatgctttagattcctcaatacaaatgaaaacctagcctttgcttctgttgtgcttttgcgtatttaggtgaactgttagtaaagtcatacataaggtttagggtttgtttttattttttttttaatcctgctaactttaaaacctatagacttttaccaaatggcttatgaaagcctgacttctgaaacaaacctttagttctaaaactaaatactatttcaataaatcctcataatatgaaggtttctatctttgctggttgtcaggttgcttggtgttttaagttgctttgagttcatagattttagaaatgttcacttgggatctgaccagcctctcagcttcacaggatccatctctgtttagacataccaagtctcaaactattttgaagagaaaaggctgtgcagtgaaaggctacccattaaagcatgatgtgtgtctttcatcttccactaggcagagttcgaaactgaaagtctgataatttgatgtaaactgacagtgacaatagaaatggctacttttgagattatttaagagaaggtgcaaggtatagacattcatcaatgaaacactaaaggaaaggtttttatttctgtgtttgctttttaaaataagaatagagtaaatggcacaatagattatataaacaaggacttcaatgacaagctgtcaaagttaaaataatatattttacatgggtgacttgacgccacactttatcacttacatgaggggaagccaatttgagtctggtcaataaaacacaacctccaaagttgggcctggggcaaagctgacatagtgtggcagagcctggtggtttggcatccacttctgctgggacacagcaggagttggcactgctaccatctggggtatgtcctacatttaagccctatttgattaatcaacacttatgcaggttgaagggacgatgcattggctctgctctgaggcagttcaggctctagtaatttaatgcaggtctgaggcataaatgggactagtgattcaaaaactggatttactgcagtctcacaactgttgaaaattaaagtacatgtgctgcaagttaggggttactagggtatctcattataggaggctattttttttcagaggtttgaatctttgctgaattactgagagacttattcgaatgtaggcttggaccaaataattttctgataaattggccataaatcctcagtaaaataagcttggtgttctcagcatatctattggctttttgatcatttttatggctttccttttgctggtcaaattatccttatatgctcctaaagctcctctgacatggattaagtcaacacaaaccaatagaccttcattactttggcaactggttttgatttgggggcaataaatatgatgacacagactagattacctctgctgaagggatatgtgataagccgtagggatgtcagggatcctgcattattttttctgcgtaatgtgagaatgaattaatagcagcttttaactagctgaagaaagttggaaagaagaaagaaatctgaatgaaaagagagccaaggtacggcttataggttaagagcagtgacaccagtcgatcataagaaagtccatgaacacccaatgtgtgtccaacaccgtgcaaggcacaggcaggcagggtcagggccaaatatgtgaggaaactaacatgtgatgtgatccatatcttagtgtctgggagaggagataagaccatcaatgagagcaagatttattgtgcaataaaagtgtagagcagagagaaataagcaaggcctggtatagccaaggaaggggtaatggaagaagcaagatctgcaaatatgggggttggaggaactattttccttataaaaattgtttgttaaattattacttttccaacattttgcttggaaaaaaatgcaaacctaaagagaattgaaaaaaagttacaactaatgcgtgtaactctttaacccagattaccaactttttaacattttgatacctttgctttatctctgtccatatacatgtattttttttttgctcagtaattagaaagtagattgcagatgtcatgacactttaccactaagtattttagtatctcttaagaaagaaggcttccttctataaccacaatgctagtatcacactcaagaaatttaacatcttatatactatccatattcagactttctaattgtcccaataatgtcccttatagattttttaaatccaggatacaatcaattgcatttaatcatcatttggcatgtctttttagtatctttttttatctcaaactgtcccctgcccttttaattcttttgccactgaatattctcttgcttttggaattctgtataaaatcaattggcatatttatcccttgtcttctaaaattatttagtatggcagaaatgggatatgaagaaactccaatctttttctacactacaaaatgcaagttagtagacgacccagcagatacataaaaagggaactcaaataatgaagctactatgttgaaaataagtggtataagtcatcagcctaggaaaggaccagtagtgagtacacatgaaattgctccctccattctggccctcctgagagacaggaaatcaggtttcttgacatggtatctagatgggttatatgcccagttttggtaaacactttcctggcacatgagctgtctgccacttcctattctagttcttctccatttgtggctctgcataaggagttatccttctgtaaagtttcccaggcatgcaggaaatatcccagaaccacaggcatgctttttgttctccttaaagcaattggatcatggtgattccttcagcctaaaacatacttctttacctcattctcccagcaacttcctttgagaaacttagcgatcccatgaggcaccttcctttctccttgtttttccttcatgttcacctctaaactaacaccacccatatggaactgtaattgctttatatagctgccccacccccaggcactatcactaaacagtgaattattttaaagataatggttatgccttttacttccatatctccaggatctaatatgctgtctgaaagtttgaaggcattcggtaataatttgttgagtaagtgaatgaaagcatgaaaaaatgaatgaatgaatttcaccaccaacaaactttctgggttctatagaactcttcttatgactgagaagaacttagtaatgtgttaaacagggcaatcagtgttacaagtgtgtgagtcgataataattgatcagccacttgggcaaagcactgcattttatattattgggaagttccagagtaacaaatagtcatgccttacagtcctgaaggaagggatagatttggcttaactcacattgaacaacagctacacattcatgcgcatatgttatgccaggcaggcctagctacagctcttctcaaaaatgtgctggccctggacattgctgtgtaagagttacaggtgagtggagtcacatgggcttctctggagaggctttgcaaagtacagagaaagtttgaattatcttttaaaaagaggagaggcatgattgaataaacggcatgtttcaggatagagaagtggtttggaggaacaggtgattcctgtttgaaaagtggcagatagagagagttgctctgctggaaccccccggccccggcactagctaggctgcaactggtgatgaccctcatgaggaaatgggactcattaataaagagcctcaacttaaaaattgttgggtggagtggcgcacgcctgtaatcctagcactttgggaagccaaggtgggcggatagcttgagcccgggaggtcaagtctgcagtgagccaagatcatgccactgcactccagcctgagcgacagagtgagaccctgtctcaaaataaataaataaataaaatcaaaattggcaatttatatttgatatggacaggtttgatatagttcgttcccacgacttcctagtcacgtaagtacggtcatttttttctgtggggctggatggaggatgtagattctggaggaaataaaagtgtgtagagaatagatgaattacctagggagaggataattgggccaggattgtgactgtgggaatgcagagagagaaattagaacagaattgtaggggaattggttacaaatgggtctgggcatagagtaatgaagagatgaaaaggatgtgctttgaaaactacaagagtttgcagctcatagcactgaatgagttacacgctctgaatctttagttagcaaccactgttttctaaaatgaaataaagagaagaaaagaaaaaaaagggagagaagcatgaatgtccacacagcttttctgagaccaaaataggccaagctaatgtccagtagttcacctaacggaaacaaaaagaataattcacatgtagcaaatgatagctggctcctgcttattttttacctttatttttgtttttaatcctcactagcagctcctgattgtatcacgtgataacgtttccattctagatacgaggggcaggaaaaggtaaaaacaaacacattgtttgttgatttcacaaaaaggaataatgctcgtgtctggttggctccttggtcatattatcccttatctgccactccaattcctgccagcagcacctcagagatggcacctccccttgctgcttccgttcctctgcaggacacatggtgaggtttttattacgtaaaaatcccaagaggaagaagctctgtgttgataaagtcaatagctcattgcatgctgctagacaagctctaacttttaattctcttctgccaagtggcagtctgcaatgtctttgtggaacagacactgttccaggtgccagggaaacaattgggaacaaggaaggcaaatatctgcacctgaatggggcttccattacagcaggatacacacaaaaactctatagacttcacatggtactgaatgcttgagagaatgaaagctgattgcaatcaaagaggatggtcagggaaggtctccccaagaagatgacagcaaatagtaacacctacctagttgagttattaggagaattaaagcattttctgtgttaaaaacatctggcaaaccactgacacagggtcagaagaaatggctagccattatctttcaacaataaatttacaaagcataatgaaatataactgagtttgagctgctgggatttggttcttgtatgagatgaggcgataatttttattcacaaggccatgtgctccaaagaaaacaatgctatcacttataccacctgcttatggagagaaaaatatgaaagcaatgtcctcaaacctctagctgcatctatgcttctgcctaaaatctggtatcctaagtaggagagaggttgtgaattatcagggctttttcttgatacttatttttacagatctaatgcctatgatggctcctgccagggactgtttggcccaccactctacttctagctagcattgtggttacacagtttgtagaatgcagaaataaacttgtctatttatgaccaatgtcacagcacatgtcaaatctcagtgtcactgggccctttccctaaaggtctacaagaggaaatatgtcatgcttgagttaatgttgaggttgattgtttaacctggaactagaattccaaacatatatccttatgttacatcagttttttttttctcatttatctccaatgtgtccacaggaaatttccacagtagctgttctagcctcttccttcctatcatagctataccattccttctggtatggaaatcatatcagaaggttcccaggaagcgtcttccaggctgcggttccctggacggtcccatctcagctcagtttttcctcccccagctattgtgatgacccccaatcagcatagttataagaaattgtaatcacatggtgagaattaatgagaaagcctttatattggattccttctttttccagcaagagacttcaaaccctgctaactgcagtcttacagcccttggagggggccgtagctcaccattgttctgttctcggcaaacccagtgggagcttatctgttttctgggagaagcagagcagccagatgaagagatggggcagtgccaaggagaaaatgatactcagcatgcagtgcagatccctccctcccctgttccctgctgtcggcctgctgctcagagggaaaggtgcctggtggctctctgatcgccatcctttcttcacattcctaagccttttatttggtggaaggagcatctggctggatagcctcctccttatcccaggacacttcccgagttctctcttttggctttttaataccttattttccccttatgactgtaaagtggacagtgtatttatggttgaaaattggctgctatagcaatattaattttaaaaacagagttttggcacatattcaatattactatggaaacggccgcttctaacaattcactcataagatatagttcaaggactgaggtctgtgtgggaggtttttaccatccaccaaattgacgatctacttgtcagaatagcaattcacaagaactgctctccaaatttgtattccttttttaaaaaagttagtggatgagcattcgagagatgcctttattttactttatatatgtagatggaagataaatattccaactggcatgttaaagacacaatgtgtttaaaataatttttccatgaatcactaattctcttaattgcacataatggtcttacttggttatttgatgtaacactaaatacacacacagacacaactagtttcagaaacgcacatattgaagctggaatgtaacctgtaatcaattgacacattcaaacattttaactttccatcttaaactgtctccacatatttctatgtaactgatatacatacaactgaattccaggaaagacttgaagtaattcattccagtgtggtgttttccaggagccagtttttaaccccaaatattgccttcatttttaaccgcaaacatacttctgttggttttataaaacgcaggcatgagagaaaggacctctgggggctgatggttgcagcattagttcttgaattccctcactttaagtcaaagctttcatgtttgcacctctgttcacttgggaatgtgaggttacattttccaaaaaatcctgcaatgtttcatattttttcagagctccttctgatatgtttattgttttcacattatttcaaatgctgtcatcggccctaaatatcatgaaagataggtcctgatgctgacaacagaatttgtctcatttctcttatttccagctcattttgtgttttccaaattagattaactctcaagcaattagtaacagttgattctgataggcccaggttgcacacccttccaccagcgccacatcagcacagtgagagtgataacccgaagcgcctccttgttcacaaggatggccctgagtggatggtaggagttctgaaatccaaacaggatcaagaaaatcaatcaggggaaggtcacttggggtaataaacaagagtaatcacatggatcaaagttcttgtcctgtgcgtatgtcctatgagaagctctttatccactgaatgctgtaattcttagaacaattctaagacgtgggaattgttgtccccatttattatacttatcctacatatactgtgggaaaatggtatatgagcagagctcttaaccacttcattacacagccaggagtggcagaggtagggctgcatctcaggccttgaatttgctctttcattcttatgacatttctgagagaagtgggaaaacagtatatgtaggctaagtatactaaacaagtatcgaaattggattcaaatccctttctgtctgcttagcaagtgcatgctgtttccagttccccttcagaagaaacaagatgaaatttcttttctgggattaagaggaaaacacacattaacctatggtgctagcacattccagcatacaataatcaggatggaagtttcaaaataggttttgacagtctcaccatagaataccatggaataaccttgcttgggtcctatataggccagaacccagttaatgtttcagaataaattctctttgaggagaacaaatgaaacatctatttattttattctgcagatatggagttcaaagtaatcacagtttaaattaatcatacatacaatatacattttttaaaagatgttaatatgataactgactgcagatagcagcatgtcatttttcagaaaaaaaaaaaacaattctacattatatttataattaatttggggtatgtcttttcaggaaaaggttattcaaaagctcagtgttagagcacaaccaatccaaatagggctggccttaaatctcgtcctgcacctggaggcctccatcatcagttcatgtgtcccagcagtttcaattatcaaaagatccatcctagtgccgtatattttaagcacagttgaagaatagtggagcaaaaaaaaaaaagcctttcaaccatgggaatttaaaagcaaagggccctgaagaggcgatttcaaaaccctactcattcagttcactctaaagcttaatgacatgccctatttgatacagttaggggaactctttcatcaaaaactttatatgaggctgggaattgcaatattaggtttgtaggttggctcccttggtcatactgcaacgtcctgagggaattctagtttatcttttaaaagcaaatagaattagggaaaatgataaatggtatactaatgactactaatatgtttgtgtatttgagaacttcctataggctgtgctttttgtattttacattctttgtgttttatttggtcccatcctttgaagtagatgttaatattccattttataaatgatgaaaatgagttcctaagaggtgaaataacttgctgtgtttgcacaagtaattggcagagccacgaatcaaacccaggtctctgcctctgaagactgacctcttaaccacttcattacacagccaggactggcagaggtggggctggatcccaggccttgaatttgctcttttatttttatcacatttttaagaacagcaaagcaactgtagatgaaggacttggttcctcaggagtcccaaaatatgtgaaacaggtcagccctctggttcaacctgaattgaggtactaacaaggactcgggacccacccccatgagtccttcttcctctcctgttgcagcatagcagatgagaggatctgggaagcctcagtttacccaatgtaatcaatctcaggctgaatgagaagagaagggcctggaaaagtttagaaaacagagacaaaccaagtgatttttctcttgtgtgcatgggtgtgggcactcccaactctctcatccaggagaaccgccatttactccaacagatgacatgatttaccagacagattaagatgaaatcaacatctaagaacaagagtgtgcattttctaaagatcattggatagtactaaggtgtttttctggtcagatttcatctgctcttctgtgtcccagccttttgacctttcaagcccaactctgcggttctgttcctctttcccaggccagagttatctttattgataaaacatataattatttacaaaagcatggccacacagtatggatggagagtttgccctctagttgacataaactattttttctaaaaaactactgaactctatgaaattctatatgctttacttcaaaagctccagtcattgtcataacccagaatttttcacagtaatatgaaggagagatggagtagtaaacatatttctaatgatctaatagtactatattcttgaatgtctccaaggcacctaagaccagcttttcccagcctgacctcatattcttcctacacaaacctcatgtgaacccagtttttcctcatgtgagcccaatttcaatgactgacatcccaatccacctgctcatctaatgtggtatcaacagccatcttcatccttcctctcttccccactaccccacacaatctgacatggggtgatgctgaatttacctcagaaatccctgtcaaacattctttcccttcaattctcactcctttgctaaatttagacctaggtaatctcttatcatgactaataagataaactaacttctctgcctccaatttcttccccacctacactatctcccatcctccaccctgttaccagagcttatcaagtcatgcttttgcttaaatatcttcagtggctcctcactgactacaggacaaagtctgagtttagtgtggcattcacatttcttaacaagacccttctactttatagtattttctctcaccaactcttttcaccctttcccaattcaaacatacacattcatggtcaatgtattggtcaatatagtattttctctcaccaactcttttcaccctttcccaattcaaacatacacattcggtcacactgggtttcttactctttccctaaattctaaggacttttatgtcttcttgcgttttatgttttgtttttgtttttgttttgagacagagttttgctctatcacccagggtggagtgcagtagcctgatctcagcttacatcaacctccgcatctcgggttcaagcgattcttctgcctcagcctcccaagtcgttgggattacaggcacccaccaccatgccctgctaatttttgtatatttagtagagatagggtttcaccatgttggccaggctggtctcgaactcctgacctcaggtgatctgcccacctcagcttccgaaagtgctgggattacagatatgagccaccgagattgtctcattaaagtggaatttcctccttgaagtacttgagcatccactaatccttcaaaggacaatcatgtctcattccaatcttgctccacctactcctcaacacaattaattcatcacatggtcataacacctatctgtaatgtattatgattatttgtgtgtgtgtgtgtgtgtgtgtgtgtgtgtgtgtgcgcgtcttcctcttctcctatctccagaatttgagctccagattccaaacttttatttgtctttgtattttcatttcctagctcagtaaatgctcatagtaaatggtcaataagtattgctgattgaatgcacaaactaatgaaccacatttgagcaaggattattgtgagtagatcccagacaatactatgaagctgttaaaatattatattaattgtataataatttaaaccaagacacaggggacaataaaaagagactaaggatagaaaagatatttaaactctctaggatgttaaacacagatttcatttgtaatagattggtttggtaacgtggggatgagtcctagagaaagctaaataagaaggtaaaagagtttactactgatttactctgatagaaatatgtctttgaaaaaatcagtttaaaaattcaaacagtaactcctttctgtctttaatatttctgtgcaactcagtcacagtttcatgttagccattgttaaactgataagagctcaggtttgctaaaaagtgtttgcaaacacatcggaattaacattaatcaaaccactgtgtaaaaataacaactttgagagcccaggatccagctccctttgacagggctctacctgccgttgtctgctgctagatacttggattcagcgttaagcacatgtgcctttacaaccattcaattgccatgttgaatccgaatcagagtgattcctttggaaaccccctgcgagaccagcgtatcacagtccctcctctgtgtcaagaatttttcccacaagacccaactaatttaatttctttcctttcccaaagcaacaaaacaaaactgtaaaataaccatttcttcagtcccaaattagaacttttggcaagggaggaaagagatcatgaataatacgtggctatagatctagaatcattttataaatataagtgtgggctcatcttttgcctttgttgctacatgaatcatctcagtcactgagattaagagactgagcaaatatagtaggtatttcatgccatattttctgactgtagactttagattctagatatatgattatttgtaaatgatttgagaataagaaaatctgactttcttttaataccttggtctttttacagtactgagtggtaccagcttgctctggttggtcttcattcctgagtagttccattgtcctgaatatttatttgcctttgctatagaattcgcatcccaatgatttcaatctttccagttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgca

SEQ ID NO: 742 - DNA, 210253 bp, Homo sapiens; identical to SEQ ID NO: 739

SEQ ID NO: 743 - DNA, 210253 bp, Homo sapiens; identical to SEQ ID NO: 739

SEQ ID NO: 744 - DNA, 210253 bp, Homo sapiens; identical to SEQ ID NO: 739
